United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 65

SEQ ID NO: 124782 - DNA, 2397 bp, Artificial Sequence
  Description of Artificial Sequence: Synthetic coding sequence
tgaatgaatctgctcttatcttatagggatgtgcaagattattctgcaatcatcgaactggtggagactctgcaggctctgccaacatgcgacgtggccgaacagcacaatgtgtgttttcactacacattcgccttgaatcgccggaaccgccccggtgatcgagccaaagcgctgagcgtgttgctaccacttgtccagttagaaggttctgttgccccagacctgtactgtatgtgcggaagaatttacaaggacatgttcttttcttcaggattccaggacgccggtcatcgtgaacaagcatatcactggtatagaaaagcctttgacgtcgagcccagtttacactcaggaatcaacgctgcggtgttgttgatagccgccggtcagcacttcgaggactcgaaagaattacgtctgatcggcatgaagcttggatgcctcttggccagaaaaggatgcgtggagaagatgcagtactattgggacgttggcttctacctgggagcgcaaattctggccaacgatccgactcaggttgtcctggctgccgaacagctgtacaagctcaatgcgccaatctggtatctggtcagcgtgatggagacattcctgctgtaccaacactttaggccaaccccggaaccccccggaggccctcccaggcgagcgcacttttggctacactttcttctacagtcatgccagccatttaaaaccgcctgcgctcagggtgaccagtgtttagtgctggtcctcgagatgaataaggttctgttgcccgcaaaactcgaagtacgggggaccgatccagtctccactgtgaccctgagcctcctcgagcccgaaacacaagacattcctagttcttggacatttcccgttgcttccatctgcggagtatcagcgagcaaaagagacgagcgctgctgtttcctgtacgcgctgccaccggctcaagacgtacagttgtgctttccatctgtcggtcactgtcagtggttctgtgggcttattcaggcatgggtgaccaaccctgacagtacagcccctgccgaggaagctgagggcgccggagagatgttagagtttgactacgagtatacagagactggagagagactagtgttgggcaaaggaacctacggcgtggtctatgctggtcgcgatcgacacaccagagtgcggattgccatcaaggaaattcccgaaagggatagtaggttttctcaacctctccatgaagaaattgcactccacagacgactgagacacaagaacattgttaggtaccttggatctgctagccaggggggttatctgaagatattcatggaggaagttccaggtggatctctgtcttctctgcttagatcagtatggggacccctcaaagacaacgaaagcactatttccttctatacaaggcagatactgcagggactgggttatctgcatgataaccatattgttcacagggacataaagggggataacgtgctcattaacacattcagcgggttgctgaaaatctctgattttggaacatctaaacgactggcgggcattaccccttgcaccgagaccttcaccggcaccctccagtacatggctcccgagattatcgatcaaggaccacgaggatatgggaaagctgctgacatttggtctctgggatgtactgtaattgagatggcgacaggccgccctccgtttcatgagcttggtagcccccaggcagcgatgttccaagtaggtatgtacaaagtgcatccgcctatgccaagtagcttgtctgccgaggcacaggcgttccttctccgcacattcgaacccgatcccaggctgagagcaagcgctcagacactcttgggggatccattcctgcagccaggcaagcgctcacggagtcccagctcccccagacatgcacccagacccagcgacgccccctccgcctcgcctacacctagcgccaattccaccactcagtcccaaactttcccatgtcctcaggccccatctcagcatccaccaagtccccctaaaaggtgtttgtcctatggaggcactagccaactacgggttcctgaggagcccgcagcagaagaacctgcctcccccgaagaatcctccggcctgagcctcctccaccaagagtctaaacgacgagccatgctggccgctgtcctcgaacaggagctcccagcgctggccgagaatctgcatcaggaacagaagcaggaacagggcgctcgattgggccgaaatcatgtcgaggagctcctcaggtgtctgggcgcccatatccacactcccaacaggcggcagcttgcgcaggagcttagagccctacaaggctggatgaatggcgaagacaaagggagcttctag

SEQ ID NO: 124783 - DNA, 249 bp, Artificial Sequence
  Description of Artificial Sequence: Synthetic coding sequence
taagaatatcaggccttggtacaacgagccctccagcggctgaatgaagaggcccggacctacgttctagcgcctgagccccccactgcgctgagcaccgatcagggtttagtccaatggctacaagagctcaatgtggactcgggtaccatacagatgggccgcgacggcatgcctcacctcgaagggcacctgggcaccgcctcccggatccacacgtcccacctgtggacactgcgtgcagaatag

SEQ ID NO: 124784 - DNA, 3867 bp, Artificial Sequence
  Description of Artificial Sequence: Synthetic coding sequence
atggccggcccctgcccccggagtggagccgaaagagctgggtcctgttggcaggatcctttagccgttgccttgtcaaggggcaggcagcttgctgccccccctggcagaggttgcgcacgctcacgcccgctttcggtcgtctatgtactgaccagggaaccccagccaggcttagaacccagagaaggaactgaggccgaaccgctaccgttacggtgcctccgcgaggcctgtgcacaggtgcctaggcctcgacctccgccacagttgcgatccctgccgttcggaactttagaactgggagatactgcagctctggatgcgttctacaatgcagatgtggtcgtgctggaagtctcttcgtccctagtgcagccctctctcttttaccacttgggcgtgcgggagagctttagcatgactaacaacgtgctactctgcagccaagcggatttacccgacctccaagctcttcgggaagatgtgttccagaagaattcagactgcgtgggctcctacactttgatcccttatgtggtaacagctactgggcgggtgttgtgcggagacgctggccttctgcgcggcctggcagatggcctcgtccaggcgggcgtgggcacagaggctctgttaacaccgctcgttggaagacttgcgagattgcttgaggcaacccctaccgactcttgcgggtatttccgtgagactattaggagagatattcgtcaggcccgcgagcggttcagtggcccccaactgcggcaggaactcgccagactgcagcgacgcctggattccgtggaactgctgagcccagacattattatgaatttgctgctgtcttatagagacgtccaggattacagcgcaattatagaactggttgaaactctccaggctctccctacttgtgacgtggcagagcagcacaatgtctgcttccactacacattcgccctcaaccgcaggaacagacccggggatagagccaaagccttgagtgttctgctccctctggtccagttggagggaagtgttgctccggacctctactgcatgtgtggcagaatctataaggacatgtttttttccagcggctttcaggacgctggccaccgggagcaggcttatcattggtaccgtaaggcattcgatgtcgagccgtctcttcactcaggcatcaatgcagcggttctgcttatcgcagcaggacagcactttgaggactctaaggagcttcgcctgatcgggatgaaattgggttgtcttctggcacgaaaaggatgtgtagaaaaaatgcaatactactgggacgtggggttttatcttggcgcccagatcctggctaatgacccgacccaagtagttctggctgccgagcagctatataagctaaacgcacccatttggtacctggtgtccgtgatggagactttcctattgtatcagcattttcgtccaactccggaaccgccaggcggcccccctcggcgggctcacttctggttgcattttctgcttcagagctgtcagccttttaagactgcatgcgcccaaggtgaccagtgcctggttctcgtgcttgaaatgaataaggtcctgctccctgcaaagcttgaggtgaggggcaccgatcctgtttccaccgtcactctcagcctgctcgaaccggagacccaagacattccgtcctcgtggacgttcccagtggcaagcatctgtggcgtgtccgcgagcaaaagggatgagagatgttgttttctgtacgccctcccacctgctcaggacgtacagctatgctttccttctgttgggcattgccaatggttctgcggcctgattcaggcatgggtgaccaaccctgatagcacagctccagcagaggaggctgagggggctggcgaaatgctggaattcgactatgagtacacggaaacaggcgagcgcctcgttctggggaagggaacctacggtgtcgtgtatgcgggccgggaccgacacactcgagttagaatcgcaattaaagagattccagaaagagatagtagattcagccagcccttgcacgaagagattgctctgcacaggcggctacgccataagaacatcgtgaggtaccttgggtcagccagccaaggggggtatctgaagatcttcatggaggaggttccaggtgggtcactgtcctcactgctcaggtcagtttggggaccccttaaggacaacgagtcaaccatttctttctatacacgccagatcctgcaaggacttggttatttacacgataatcacatcgtgcatagagatatcaaaggtgacaatgtgctgataaacacattctcaggcctcttaaagatctcggactttggcacatccaagcgcctggctggaattactccttgtactgagacattcacagggacactgcagtatatggccccagagataatcgaccagggtcccagagggtacggaaaggcagcagatatttggtcattaggatgtacagtgatcgagatggctaccggtcggcctcccttccatgagctgggtagcccccaggcagccatgtttcaggtgggcatgtacaaggtgcaccctccaatgcctagcagcttaagcgccgaagcacaggcctttctattacggacttttgaacctgatcctcggcttcgcgcgagcgcccagacattgttgggggacccctttctgcagccgggcaaaaggagcagaagtcctagctccccaagacatgctccccggcccagcgatgcaccatcagcgagcccaacccccagcgcaaactcaaccacacaatcccagacattcccttgtcctcaggctccatcacagcaccctccgtcccctccaaagagatgcctgtcatacggcgggacaagccaattgagggtcccggaagagcccgcggctgaagagcctgctagtccggaggagtcgtccggactgtccttgctccatcaggaaagcaagagacgggctatgttggcagcagtcctggagcaggaacttcctgcactcgctgagaatctgcatcaagagcagaaacaggagcagggagcgcgcctgggcagaaatcatgtcgaggaacttctgcggtgcctcggagctcacatccacacgccaaacagaaggcagttggctcaggaactgcgagccctccaggggcggctgagagctcaaggcttaggacccgcactcctgcaccgacccctatttgccttccccgacgcggtaaagcaaatactgaggaaacgccagatccgtcctcactggatgttcgtgttggactcccttctgagtagggcggtgcgagccgctctcggcgtgctgggacctgaagtcgaaaaagaagccgtctccccacgcagtgaagagttaagcaacgagggcgactcccaacagtcacctgggcagcagagccctctcccggttgagcccgaacaaggccccgctccgcttatggtgcagttgtcgctgcttagagcagagaccgacaggttacgcgagatcctcgctggtaaagagcgggagtaccaggcgctcgttcagagagcactccagcggctaaatgaggaagcacgaacctatgtcctcgccccagaacctcccacagctttgtctacagatcaaggacttgtgcaatggctgcaggaactgaacgtggactctgggaccatccagatgcttttgaatcattccttcacactgcacaccctgcttacttacgccactagggatgatctcatatatactcgcatcagaggcggtatggtatgcaggatctggcgtgccatcctggcgcagagagctggatcaaccccagtcacatctggtccctag

SEQ ID NO: 124785 - DNA, 2394 bp, Artificial Sequence
  Description of Artificial Sequence: Synthetic coding sequence
atgaatctgctccttagctacagagacgtccaggattattcagctattatcgaacttgtggagactctgcaggctctgcccacatgcgacgtcgctgagcagcataatgtctgctttcactataccttcgcactgaaccggcgcaaccgaccgggcgacagagcaaaggcgttatccgtgcttttgcccttagtccagctggaaggcagtgtcgctcccgacttatattgtatgtgcgggcgtatctacaaggacatgttcttttcttctggcttccaggacgccgggcaccgcgagcaggcgtaccactggtacaggaaggcttttgacgtggagcctagccttcatagcggcatcaacgccgccgtcctgcttatcgctgccggccaacacttcgaggatagcaaagagctgagactgattgggatgaaacttggatgcctgctggctcggaagggctgcgtcgagaagatgcagtactactgggacgtggggttctatcttggcgcccaaatactggccaacgaccccacacaagtggtcctggccgcagaacagctctacaagctgaatgcaccaatttggtacctggttagtgttatggagacctttcttctgtatcagcactttaggcctacacccgaaccccctggcggcccgcctcgcagggcccatttttggctccatttcttactgcagtcatgccaaccatttaagactgcgtgcgctcaaggggatcagtgcctcgtcctcgtgctggagatgaacaaggtattgttacctgcaaaactggaagttaggggaacggatccggtctcaacagtcactctgtcccttctggagccagagacccaggacattccctcttcatggaccttcccagtggccagcatctgtggtgtctcagcttcaaaaagagacgagcgctgttgcttcctatacgcattaccccctgcacaagacgtccagctttgctttccttcagtggggcactgccagtggttctgtgggttaattcaagcgtgggtaactaatcccgattccacagctcccgccgaggaggctgagggggcaggggagatgctggaattcgattacgaatatacagagacgggcgaacgactcgttctcggaaagggcacgtatggagttgtttatgccggtcgcgacagacataccagagttcggatcgctatcaaagagatcccggagcgggactccagattcagccagcctcttcacgaagaaatcgcgctgcatcgacggctcagacacaagaacattgtccggtatctaggatcagcctcccagggcggatacttaaaaatctttatggaagaagtccccggcggcagcctgtcatctctgctcagaagcgtttggggccctctaaaagataacgagagcactatctctttctacactcgacagatcctgcagggcctcggttacctgcatgataaccatatagtacacagggatatcaagggagacaacgtcctgatcaacacgttttcaggcttgctgaaaatctccgactttgggacttcaaagcgcctggctggaataaccccctgcacggagacatttaccggcactctgcagtatatggcacctgagattatagatcaaggtcctaggggttacggtaaagccgcggacatctggagtctggggtgtaccgtcatagagatggccaccggaagaccaccctttcatgagctcggatctcctcaggccgccatgtttcaggtgggaatgtataaagttcaccccccaatgccctcaagtctgtctgccgaggctcaggccttcctgcttcgcaccttcgagccagacccacggcttcgcgcgagcgcacagactctgctgggagacccgtttctgcaacccggcaaaagatcacgcagcccatcatctccgcgacatgccccgcggcctagcgacgccccctccgcctccccaactcccagcgccaattcaaccacacaatcccagacttttccttgtccccaggcaccctctcaacatcctccctctcccccgaaacggtgccttagttatgggggcacatctcagctccgggttccagaggagccggcagccgaggagccagcgagtcccgaggagagttcaggactttccttactgcaccaagagtctaaaagacgggccatgctggccgctgtcctggagcaagaattacccgccctcgccgagaatctccatcaggaacagaaacaggagcaaggggcaagactaggacgaaaccacgtggaggaactgctgaggtgcctcggggcccatatccacactccgaaccggcgccagctcgcccaagagctccgggccctgcagggatggatgaacggggaggacaagggatccttctag

SEQ ID NO: 124786 - DNA, 783 bp, Artificial Sequence
  Description of Artificial Sequence: Synthetic coding sequence
atggatatcgcttccacaaatacaagcaataagagcgataccaatatggaacaggtgccagcgaccaatgacacgattaaacgactggaatcgaagctgttgaagaaccaggccaagcaacaaagtgagagtggccgattgtctctaggagcatctagaggatcttccgtcgaatccttgccgcctactagcgaggggaaacgtatgtctgcagacatgtctgaaatcgaggcccgcattgctgcgaccacaggaaacggccagccacggcgccgcagtatccaagatcttaccgttaccggtaccgaaccaggtcaggtgtcttctcgtagtagcagcccttcggtaagaatgatcactacttctggtcccacctctgagaaaccgaccaggtctcacccatggacacccgacgatagcaccgacaccaatggtagtgataactctatccctatggcctatctcacccttgaccaccaactacagccgcttgcaccctgtcctaattccaaggagagtatggcggtgtttgagcagcactgcaagatggctcaggaatacatgaaagtgcagacagaaattgcgctgctgctccagaggaagcaagaattggttgcggagctagaccaggacgagaaggatcagcaaaacactagtcggctcgtgcaggagcacaagaaactgcttgacgagaataaatctttgtctacctactaccagcagtgtaagaagcagctcgaggtgatacgtagtcagcagcagaaacggcagggcacatcttag

SEQ ID NO: 124787 - DNA, 1557 bp, Artificial Sequence
  Description of Artificial Sequence: Synthetic coding sequence
atgagcacagctagtgccgcaagctccagtagttcctcttctgcaggagagatgatcgaagccccgtcacaggtgctgaacttcgaagaaatcgattacaaggaaatcgaggtcgaggaggtcgtggggcgcggggccttcggggtcgtctgcaaagcgaaatggcgagccaaagacgtggccattaagcagatagagtcagaatcagagagaaaggccttcattgtcgaacttcggcagctgtcccgggttaatcatcctaacattgtgaagctctatggggcttgcctgaacccagtctgtttggttatggagtacgccgagggtggatccctctacaatgtgttgcacggggcagagcctctcccttactacacagcggctcatgccatgagctggtgcttgcaatgttctcagggcgttgcatatttgcatagcatgcagcccaaggctctgatccaccgtgatctcaagccacccaacctgctcctggttgcaggaggcaccgtactaaagatctgcgattttggcactgcatgtgatatccagacccatatgacgaataataagggctcagccgcttggatggcccccgaggtttttgagggaagcaattatagcgaaaagtgcgatgtgttctcatgggggatcatcctgtgggaggtaatcacaaggaggaaaccatttgacgaaattggaggacctgctttccgtatcatgtgggctgtgcacaacggcacccgaccaccactgatcaagaacctgcccaaacctatcgaatcactcatgacaaggtgctggtctaaagacccaagccagaggccttcaatggaagagattgtaaagattatgacacacctcatgaggtacttccctggcgcagatgaaccactgcagtatccctgtcagtattctgatgagggccagagtaactctgccacctctactgggtcttttatggatatcgcaagcactaatacaagcaacaagtccgacacaaacatggagcaggtccccgctaccaacgacacaatcaagcggcttgagagcaaattacttaaaaatcaggcgaagcagcaaagcgagtcaggccgcttgtcgctgggggctagtaggggctcgagtgttgagtctcttcctcccacttcagaaggaaagcgcatgagtgctgacatgtcagagattgaagcgcgcatcgctgccaccaccgcctactccaagcccaaaagagggcaccgcaagaccgcctctttcgggaatatcctcgatgtcccagaaatagttatttcagggaacgggcaaccgcggagacgctctattcaggatctaactgtcaccgggacggagcccggccaggtgagctctagatcgagttctccatccgtgaggatgataactacctccgggcctaccagtgagaagccaaccaggtcccacccctggacgcccgatgacagtacagataccaacgggagcgacaactctatacccatggcatacctcactttagatcaccagctgcaggccagaacttcttgcagaacaggacctgggtag

SEQ ID NO: 124788 - DNA, 1476 bp, Artificial Sequence
  Description of Artificial Sequence: Synthetic coding sequence
atgtctactgcaagcgccgcctcctctagctcatcatcctctgctggcgaaatgattgaggcgccaagccaagttctgaactttgaagagattgactacaaggaaattgaggtcgaagaggtggtcgggcggggcgcattcggcgtagtttgcaaggccaagtggcgggccaaagatgtggcaattaagcagattgaaagcgagagtgagcgaaaggccttcatcgtggaactgagacaattatcccgcgtcaaccacccaaatattgtcaagctgtatggggcctgcctaaatcccgtgtgcttggtgatggaatatgctgaaggaggcagcttatacaacgtgctgcatggagctgagccactcccatattacactgctgcccacgccatgtcttggtgcctccagtgctcccaaggcgtggcctatctgcatagcatgcagccaaaggctttaattcatcgggacttgaaacccccaaaccttctgctggtggcaggggggacagtgttgaagatttgcgattttggaacagcctgtgatattcaaactcacatgaccaataacaagggttccgcagcttggatggcccccgaagttttcgaaggttctaactactccgaaaaatgcgacgttttcagttggggaatcattctctgggaagttattacccgaaggaaaccctttgacgagataggggggcccgcctttcgtattatgtgggcagttcataacggaacccgcccccccctcatcaagaatctcccgaaacccatcgagtccctgatgaccaggtgctggtctaaagatccttcccagaggccttctatggaggagattgtcaagattatgacacacctgatgcggtactttccgggcgctgacgaacctctgcaatatccatgccagtacagtgacgaaggccagtctaacagcgccacttcaacaggctctttcatggatattgctagcacaaacacatcaaacaaatctgacaccaatatggaacaagttcctgcaacaaacgacactatcaaacgcctagagtctaagctcctgaaaaaccaggctaaacagcaatccgagtcgggccggctatccctgggagccagcagggggagttccgtggaatcactccctccgacatcagagggaaagaggatgtctgctgacatgtcagaaatcgaagcccgtatcgcagccaccaccggcaatggtcagcccagacgtcgatcaatacaagacctaacagtgacagggaccgagcctgggcaggtgagttcccgcagctcctccccttcagttaggatgatcaccacatcaggtccgacctcagagaaacccacccggtctcacccgtggacgcctgacgacagtaccgacacaaatggctccgacaactccattccaatggcctatctgactctcgatcatcaattgcaggcccgcacctcctgtcgaacggggcctgggtag

SEQ ID NO: 124789 - DNA, 1821 bp, Artificial Sequence
  Description of Artificial Sequence: Synthetic coding sequence
atgtcgactgcatccgctgcttcgtccagctcctcctcttctgcaggcgagatgatcgaggcgccctcacaagtcctaaacttcgaggagatcgattacaaagagattgaggtggaggaggtggttggccgaggagcctttggggtggtatgtaaagccaagtggagggcaaaggatgtagcgataaaacagatcgaaagtgagtcggaacgaaaggcgtttatcgtcgaattacgtcagctaagcagagtgaatcatcctaacatcgtgaagctgtacggcgcatgcttaaatcctgtgtgtctggtaatggagtacgcagaaggcggcagtctgtataacgtcctgcacggagccgagcctctgccctactatacagctgctcacgcaatgagttggtgtttgcagtgcagtcagggtgttgcttacctgcatagcatgcaaccgaaagcactgatacaccgtgatctgaagccacccaatctgctcctggttgccggaggaaccgttctgaagatatgtgatttcgggaccgcatgtgatatccagacgcatatgactaacaataagggatccgccgcttggatggcaccagaagtgttcgaagggagtaattattccgagaagtgtgatgtgtttagctggggcattatcctttgggaagttattactcggagaaaacctttcgatgagatcggcggcccagcatttaggatcatgtgggctgtacacaacggcacacggcctcctcttatcaaaaatctccctaaaccaattgaatctctcatgactcggtgttggagtaaggaccccagtcaaagacccagcatggaggaaatagtgaaaattatgacacacctgatgcgatattttcctggggcagacgagcctcttcagtatccctgccaatactcagacgaaggtcagtctaattcagccacaagtacgggcagcttcatggatatagcctcaaccaacacaagcaacaaaagtgatacgaacatggaacaggttccagctaccaatgacacaattaaaaggctcgaaagtaagctcttgaaaaatcaggctaaacagcagagtgaatctgggcgcctgagtctgggcgcctctcggggatcctccgtcgagagtcttccccctaccagtgagggaaagcggatgtctgccgatatgtccgaaatagaggcaagaatcgctgcaactaccgcttattccaagccaaagagaggccaccgtaaaacagcatccttcggcaacattttggacgttcctgaaatcgtcatctccggcaatggacaaccccgcaggaggtccatccaggatctaaccgttacaggcacagagccagggcaggtgagttcacgatcatcctctccatctgtccgcatgatcactactagcggccctacatccgagaagcccactcggtctcacccttggactcccgacgattccactgacactaacggatccgacaacagtattcccatggcttatctaactctagatcaccagctccagccactggctccctgccctaattcaaaggagtccatggcagtcttcgagcagcactgcaaaatggcccaagagtatatgaaggtgcagacagagatcgccctcctgctccagcggaaacaggaactggtggccgagctagatcaagacgagaaggaccagcagaacacaagtagactggtgcaggagcataaaaagctacttgatgaaaacaagagcctgtcaacatactatcagcagtgtaaaaagcaattggaggttatcaggtcgcagcagcagaagcggcagggaacaagttag

SEQ ID NO: 124790 - DNA, 1740 bp, Artificial Sequence
  Description of Artificial Sequence: Synthetic coding sequence
atgtctacggccagcgctgcgagctcttcctcatcatcctctgccggcgagatgattgaggcaccgtcccaggtcctcaattttgaagaaatcgattacaaggagattgaagtggaagaagttgtgggtagaggcgcattcggtgtggtgtgtaaagcaaagtggagagccaaagatgtggccatcaagcagatcgaatctgagtctgaacgcaaagcttttatcgtcgagctgaggcagctttctcgggtaaaccatccaaatatcgtcaaactctacggcgcctgtctcaaccctgtgtgtttggtgatggagtacgctgaagggggctctctctataacgtcctccacggggcagaacctctgccatactacaccgcagcgcacgcaatgtcctggtgtttgcagtgttctcagggggtggcctacctgcacagcatgcaacccaaagcacttatacatcgggacctgaagcctccaaacctcctcctggtcgcaggcggaaccgtcctgaaaatctgcgattttggaaccgcgtgtgatatacagactcacatgaccaacaacaaggggtccgctgcttggatggcgcctgaggtgttcgaaggtagtaactatagtgaaaaatgcgatgtgttctcttggggcattatcctctgggaggtcatcacccgccgcaaacccttcgacgaaatcgggggccccgccttcaggatcatgtgggcagtgcataatgggactcgtcctcctttgattaagaatctgcctaagccgatcgaatcacttatgacaagatgttggtccaaggatccgtcccagagaccgtcaatggaagaaattgtgaaaatcatgacacatctcatgagatacttccctggggccgacgagccactgcagtacccatgccagtactccgacgaagggcagtcaaatagcgcaacttccaccgggtccttcatggatatcgccagcaccaatacatctaataagagcgatacaaatatggaacaggtgcctgccacaaatgacaccattaaacgtttagagagcaagcttcttaagaaccaggccaagcaacagagtgagtccggacgcttgtcactgggggctagcaggggctcctccgtggaaagtctgccaccaaccagtgaaggaaagcggatgagtgcggatatgtccgagatcgaggcgaggatcgcagcaaccactgggaacggacaacctaggcgccggtcaatccaagacctgactgtgacggggacagaaccgggtcaggtctcgtctcgctcatcgtcaccatccgtgagaatgatcacaacaagcgggcctacttcagagaagcccacccgatctcacccctggacgcccgacgacagcacagacactaatggaagcgacaactcaataccaatggcctaccttacgttggatcatcaattacaaccgctggccccctgccccaacagtaaagagtcaatggctgttttcgagcagcattgtaaaatggcacaggaatatatgaaagtgcagactgagatcgcactgcttctccaaaggaagcaggagctcgtggccgagcttgaccaggacgaaaaggaccagcagaacacgtcgagactggtgcaagagcacaagaagttgctcgacgagaacaaaagtctgtcgacgtattatcagcagtgcaagaaacaattggaggtcattaggtcccagcagcagaagcgccaggggacatcttag

SEQ ID NO: 124791 - DNA, 1257 bp, Artificial Sequence
  Description of Artificial Sequence: Synthetic coding sequence
atgtccaccgcatctgctgcctcatcatccagctccagctctgctggagagatgatcgaggccccatcccaagtactgaactttgaggagattgattataaggagatcgaggttgaggaagtcgtgggccgaggagcttttggggtggtatgcaaggctaagtggagggctaaggatgttgcaatcaagcaaatagaatcggagtcagaacggaaagccttcatcgtcgagctcaggcagctcagtagagtgaatcatcccaacctgcttctggttgcaggcggcactgttttgaaaatctgcgacttcggtacagcgtgtgatatacagacgcacatgacaaataataagggcagtgcagcatggatggccccagaggtgttcgaaggatccaattacagcgaaaaatgtgacgttttttcatggggtattatactctgggaggtgattactagacgaaaaccattcgatgaaataggtggtcctgcatttcggatcatgtgggccgttcataatggcactaggcctcctctgatcaagaacctcccgaaaccgattgagtccctaatgacccggtgttggagcaaagacccgtcacagcgcccttccatggaggaaatagttaagataatgacccacctcatgcgttacttcccgggggctgatgaacctctacagtacccctgtcagtactcggacgaggggcagagcaactcagccactagtaccggatcgtttatggacattgcatccacaaatacttcaaacaaaagcgatacaaacatggagcaggtccctgctaccaatgataccattaaacgattggagagcaaactgcttaagaatcaagctaaacagcaaagtgaatccggcagactgtccctcggcgcctcaagggggagttccgtggaatcacttccccccacttctgagggaaaaaggatgagcgcggatatgtcagagatcgaggcccggatcgctgccaccaccgggaatggacagccccgccgacgctccattcaagaccttaccgttactggcacggaaccaggccaagtctcatcgaggtccagctcaccgtccgtgcgtatgatcaccactagcggtcccacctctgagaagcccacgaggtcccacccttggacgcctgatgacagtactgatacaaatggcagcgacaactcaattccaatggcctacctgaccctggaccaccagctgcaagccaggacttcgtgtcgaactggaccaggatag

SEQ ID NO: 124792 - DNA, 1404 bp, Artificial Sequence
  Description of Artificial Sequence: Synthetic coding sequence
atggagtacatgtccactgggagcgacaacaaggaggagatcgatttgttaatcaagcatctgaatgtttccgacgtcatagatattatggagaacctgtacgcttccgaggagccagccgtttacgaaccgtcattgatgacaatgtgccaggattctaaccagaatgacgagaggtccaagagcctgcttctgagcggacaggaggtcccatggcttagctccgtgagatacggaacagtcgaagatcttctcgcgttcgccaaccacatctcgaacactgcgaaacatttttatgggcagcgcccacaggaatccggaatactcctcaatatggtcattacaccacagaatgggcgctaccagattgactccgacgtgctccttattccttggaagcttacctatcggaacatcggctctgattttattccgcgaggcgctttcgggaaagtgtatctcgctcaggacattaagaccaaaaagcggatggcctgtaagctcatacccgttgaccagtttaagccatctgacgtcgaaatccaggcatgttttcgccacgagaacattgccgaactctacggagcggtcctgtggggcgagaccgtgcacctgttcatggaggcaggagaaggtggaagcgtcctggaaaagctggagtcgtgtgggccaatgagggagtttgaaattatctgggtgaccaaacacgttcttaaagggctcgacttcctccactctaaaaaggtgattcaccacgacataaaaccaagcaacatagtttttatgtctacgaaggctgtgctggtcgatttcggtctcagcgtgcagatgacagaggatgtgtacttccctaaagatctgaggggaaccgaaatttatatgtcaccagaggttatcctgtgtaggggccacagcaccaaggccgacatctatagccttggggcaacattgatccacatgcagactgggacccccccgtgggtgaagagatatcctaggtccgcatacccctcttacctgtacatcatccacaaacaggcgccaccattggaagacatcgctgatgactgctcccctggcatgcgcgagcttatcgaggcctccctcgagcggaaccccaaccacagacctagagcggccgatctactaaaacacgaggcactgaaccccccacgggaagatcagccacgctgccagtcactagactccgcactcctagagcgtaagcgtctgctgtcgcgtaaggagttagaactgcccgaaaacatcgctgactccagttgcactggttccacagaagagagtgagatgctgaaacgccaacgttctctttacatagatttgggagccctggccgggtattttaacctcgtgcgggggccaccaacactggaatatggctag

SEQ ID NO: 124793 - DNA, 1404 bp, Artificial Sequence
  Description of Artificial Sequence: Synthetic coding sequence
atggagtacatgagtactggttcagataacaaagaggagattgatttgctgatcaaacacttgaatgtttcagatgttatcgacatcatggagaacttgtacgcctccgaagagccagcagtgtatgaaccttctctaatgacaatgtgccaggattccaatcagaacgatgaacgatccaaatcgctcttgctgtccggacaagaagtcccctggctgtctagcgtgcgttacggcacggtcgaggacctcctggccttcgccaatcatataagcaatacagccaagcacttttatggccagaggccccaggagagcggcattctccttaatatggtgattacaccccaaaacggtcgataccagattgacagcgacgtgctgctcatcccgtggaagctaacatacagaaatataggaagtgactttatcccccgcggggctttcggcaaagtgtacctggcacaagacatcaaaactaagaaacggatggcgtgcaagctgattccagtcgaccagttcaaaccttcagatgtcgagatccaggcctgctttaggcacgagaacattgcagagttatacggcgccgtcctttggggcgagaccgtgcatctgttcatggaggcaggcgaaggcggaagcgtgttagagaagttggagagctgcggtcctatgcgtgaattcgaaatcatatgggtcaccaagcacgtgcttaaaggcctggactttttgcattccaagaaagtcattcaccacgacattaagccttcaaacattgtctttatgtctacgaaagctgtgctggtagattttggcttatctgtgcagatgacggaggatgtgtactttccgaaggacctgcgcggaaccgagatctatatgtcacctgaagtcatcctgtgccgcggtcattctaccaaagccgatatttactctctgggcgccaccctgatccacatgcaaaccggaacaccaccgtgggtgaagagataccctcgctcggcgtacccatcatacctatacattattcacaaacaggccccccccctcgaagatattgctgacgactgcagtcctggaatgcgagaactgatcgaagcttccctagagcgaaatcccaaccacaggccccgcgcagctgacttattgaaacatgaagccctgaatcccccgagggaggaccagcctagatgccagagcctcgattccgccctgctggagcgtaagaggctcctgtcccgtaaggagctcgagctcccggagaatatcgctgactcctcttgtacgggatccactgaagaaagcgagatgctgaagaggcagcgtagtttatacattgacctgggagctctagctggctacttcaatttagtcagggggccccccaccctcgagtacgggtag

SEQ ID NO: 124794 - DNA, 399 bp, Artificial Sequence
  Description of Artificial Sequence: Synthetic coding sequence
atggagtacatgagcactggctcagataacaaggaagagattgatcttctgattaaacatctgaacgtgtccgatgtgatcgatatcatggaaaacctttatgcctctgaggagccagccgtgtatgagccctctctaatgacaatgtgccaagacagcaatcagaatgacgagcgctccaagtctctgttactgagcggacaagaggttccatggctgtctagcgtgcgctacggaaccgttgaggacctgctggcattcgctaatcacatctccaatactgctaagcatttttacgggcagcgcccacaagagtctggcattttactgaacatggtgcgcttctttccaatcagctgggtgctttgcgcgcaactctcctactgtagtttcatctag

SEQ ID NO: 124795 - DNA, 1404 bp, Artificial Sequence
  Description of Artificial Sequence: Synthetic coding sequence
atggaatacatgagtacaggctcagacaataaggaggagatcgacttactgataaagcatctaaacgtatccgacgtcatcgacattatggagaatttgtatgcatcagaagagcccgccgtgtatgaacccagtctgatgaccatgtgccaagattccaaccagaacgatgaacgttcaaagagtttactgctgagcggtcaggaagtgccatggctgagtagtgtcaggtatggcacagtggaagacctcctagctttcgcaaaccatatcagcaatactgctaagcacttctatggtcagaggccacaggaaagtggcatcctgcttaacatggtaatcactccacagaacggcagatatcagattgattcagacgtcctgctaattccttggaaactgacgtatagaaatatcggcagtgactttattccaaggggagcattcggcaaggtataccttgcccaggacatcaaaaccaagaaacgaatggcctgcaagcttataccggtcgatcagttcaagccttccgacgttgaaattcaggcttgcttccgacacgagaacatcgctgagctgtatggcgcagtgctctggggcgagaccgttcacctgtttatggaagcaggtgaaggtggcagcgttttggaaaagctggaatcatgcggcccaatgcgggagttcgaaataatttgggttacgaagcatgtcctaaaggggctggacttcctccactcaaagaaggtcatccaccacgatattaagccatctaacattgttttcatgagcactaaagccgtcctggtggacttcgggctaagcgtgcagatgaccgaggatgtatattttccgaaagacctgagaggaaccgaaatctatatgtcccccgaggtgatcttatgccgcggccatagtactaaggctgacatttattctctgggcgcaaccctgatccatatgcagaccggcacaccgccttgggtgaaaagatatcccagatccgcatatccatcctacttgtacataattcataagcaggcccccccactagaagatatcgccgacgattgctcaccgggcatgcgcgagcttatcgaggcctctctggaaaggaaccctaatcataggcccagggctgcggaccttcttaagcatgaggctctcaacccaccacgggaagatcagccccggtgtcaatctttggattcggcattgttagaacggaaacggcttctgagccgaaaagagctggaactgcctgagaacattgcggactcatcatgcacgggctccactgaagagtccgagatgcttaagcgccagcggtctttgtacattgatctaggcgccctcgccgggtattttaatctcgtccgcggccctccaactctggagtatggttag

SEQ ID NO: 124796 - DNA, 672 bp, Artificial Sequence
  Description of Artificial Sequence: Synthetic coding sequence
atggagtatatgtccaccggttcagataacaaagaggaaatcgatctactcatcaagcacctgaatgtcagcgacgtgatcgatatcatggaaaacctgtacgcaagcgaagagcccgcggtgtatgaaccctcgctgatgacaatgtgtcaggatagtaaccaaaatgacgagcggtcaaaaagcctcctgctgtcggggcaggaagtcccatggctctcatcggtcaggtatgggaccgtggaagatctcctcgcctttgccaatcatatctctaacacagccaaacacttctatggccagcgtccgcaagaaagcgggattttactgaacatggtaatcaccccccagaatggcagatatcagatcgactcagatgttctgctgatcccctggaaattgacctataggaacatcggtagtgacttcatacctcgcggagccttcgggaaggtatacttggcccaagatataaagaccaaaaagagaatggcctgcaaactgatccctgtcgaccagttcaagccttctgatgtggagatccaagcctgtttccgacatgaaaacattgctgaattgtacggggcagttctgtggggagagacagtccatcttttcatggaagcgggcgagggcgggtctgtccttgaaaagctggaatcgtgcggctag

SEQ ID NO: 124797 - DNA, 768 bp, Artificial Sequence
  Description of Artificial Sequence: Synthetic coding sequence
atggagtacatgagtacaggcagcgacaataaggaggaaatcgatctccttattaaacacctgaacgtgtcagacgtcattgacatcatggagaatctatatgcttccgaagaacctgccgtgtacgagcccagcctgatgaccatgtgccaggactccaatcaaaacgatgaaaggtcaaagagtctcctgctgtcaggccaggaagtgccctggctgagttctgtgcgttatggaacagtcgaagatctgttggccttcgctaaccacattagtaacacagccaaacatttttacggccagagacctcaggaatctggcatccttctgaatatggttatcaccccgcagaatggtaggtaccaaattgactctgatgtcttgttaattccatggaagctgacttatcgaaatataggctccgatttcataccccgtggagcatttggcaaagtttacttggcccaagacattaagacaaagaaacgcatggcctgcaagctgatccccgtcgatcagtttaagccttcggatgttgaaattcaagcctgctttcgccacgagaatattgctgagttgtacggtgcggttctgtggggagagaccgtccatctgtttatggaagcaggcgagggaggcagcgtgctcgaaaaactggagagttgcggtcctatgagggaatttgagatcatatgggtgacaaagcacgtattgaaaggactggatttcctgcactctaagaaggtgatacaccacgacatcaagtag

SEQ ID NO: 124798 - DNA, 573 bp, Artificial Sequence
  Description of Artificial Sequence: Synthetic coding sequence
taagtggaggacctgctagctttcgcaaaccatatatctaacactgccaaacatttctacggccagagacctcaggaatccggaatcctgctgaatatggtcatcacccctcagaatggaaggtatcagatcgactctgacgtgctgttaataccatggaaattgacctatcgcaatattggatctgattttatcccgaggggtgcattcggcaaggtgtacctggctcaggacattaagaccaagaagcgcatggcgtgtaagttaattcctgtggaccagttcaagccctccgatgtggaaattcaggcttgtttccgccatgagaacattgcggaactttatggagctgtattgtggggcgaaaccgtgcatctcttcatggaggctggcgaggggggaagtgtgctcgaaaagctggaaagctgcggcccaatgcgggaatttgagataatctgggtaactaagcacgttctgaaaggccttgactttctacacagcaaaaaggtcatacaccacgatattaagcggaaatacttgtggacctacacattccttgctcagcgcgattag

SEQ ID NO: 124799 - DNA, 1404 bp, Artificial Sequence
  Description of Artificial Sequence: Synthetic coding sequence
atggagtatatgtcaactgggtcagataataaggaagagatcgatctgttaatcaaacacttgaacgtgtcagatgtaatcgacattatggaaaacctatatgccagcgaggaacctgctgtatatgaaccttcgctcatgaccatgtgtcaggatagtaatcaaaacgacgagcggtctaaaagcctcttgttgtccggccaggaggtgccctggctgtcttccgtgcggtacggcactgtagaggacttactggcttttgcgaaccacattagtaataccgcaaagcacttttacggccagagaccacaggagtctggaattcttctgaatatggtgattacgccccagaacggaagataccaaatcgacagtgatgtccttcttatcccatggaagcttacttaccgaaatatcggctccgactttatcccgcgaggagcgtttggaaaggtatacctggcccaagatataaaaacgaaaaaaaggatggcgtgtaaactgatcccagtggatcagttcaagcccagcgatgtggaaatccaggcttgcttcaggcatgagaacatagcagaattgtatggcgccgtgctatggggggaaacagtgcacctttttatggaggccggagagggaggttcggtattggagaagctggagtcctgtgggccaatgagagagtttgaaatcatttgggtgaccaagcatgtactcaaaggactggacttccttcatagcaaaaaagtgattcatcatgatataaagccatctaatatcgtcttcatgtccactaaggccgttttagtggacttcggcctgagtgtgcagatgaccgaagatgtgtacttccctaaggatctacgcggcactgaaatttatatgtcccctgaagtcatcttatgtcggggacacagtactaaagcagacatctactcactgggcgctaccctaatccatatgcaaaccggcaccccgccatgggttaagagatatccacgatccgcatacccatcttatctgtacattattcacaaacaagcacctccactggaagacatcgccgatgattgttcaccaggcatgagggagttaatcgaagccagtctggagagaaaccctaatcaccgaccacgggcagctgacctgctgaaacacgaggccctcaatccccctcgtgaggaccaaccaaggtgtcagtcattggactcggccctgcttgagagaaagcggctcctctccagaaaagagctggagctgcctgaaaacattgctgactcctcttgtactggatcgactgaagagagcgaaatgcttaagaggcagcggtcattgtatatcgatttgggggcgctagccgggtactttaacctggttcgcggcccaccaaccctggaatatggctag

SEQ ID NO: 124800 - DNA, 3357 bp, Artificial Sequence
  Description of Artificial Sequence: Synthetic coding sequence
atggaaccttctcgtgccctgctgggctgtctagcctctgccgctgcggctgctccccccggtgaagacggcgccggtgcaggcgcggaggaggaggaagaagaggaagaggaggccgccgctgccgtgggcccaggagaacttggttgcgacgcaccactgccgtactggactgccgtgtttgaatatgaggcagccggtgaagatgagttgacgctcagattgggagacgtggtggaagtcctgagtaaggacagccaggtctcaggcgatgagggctggtggactggccagctcaatcagcgggtcggcatcttcccctccaactatgtcaccccaaggtcagctttcagcagtagatgtcagcccgggggagaggatccttcctgctatccccccatccagctgctggagatcgatttcgccgagctgactcttgaggagattattggtatcggtgggttcgggaaagtgtatcgagcgttctggatcggcgatgaggttgccgtgaaggccgccagacacgaccccgacgaagatattagccagaccatagagaacgtcaggcaggaagccaagctttttgctatgctcaagcaccctaatataattgccctgcgtggtgtgtgcctgaaagaaccgaacctgtgcctggtcatggagttcgcgagaggggggcccctcaacagggtgctgtccggcaaacgcatccccccagacatcctggtaaactgggcagtgcagatcgcgcgaggaatgaactacctgcacgatgaggccattgtcccaatcatccatagggatctgaaatcatcgaacatccttatcttacagaaggtcgagaatggtgacctgagtaataagatcttgaagatcactgacttcggacttgcgcgagagtggcacagaaccactaagatgtctgccgctggcacatatgcatggatggctcccgaggtcatcagggcctcgatgttttctaagggaagtgacgtctggagctacggagtacttctttgggaactcctgacaggtgaagtgccttttcgcggcatcgatggtctggcagtagcctacggggtggccatgaataaacttgccctgccaatcccaagtacctgcccagagccatttgcgaagctgatggaggactgctggaatccagatccccatagccgcccctcattcactaacatcctggaccagctaaccacaatcgaggaaagtggattttttgagatgccaaaggacagcttccactgccttcaggacaattggaaacacgagatccaggaaatgttcgaccagctaagagcaaaggaaaaggagctgcgtacctgggaggaggaactgaccagagcagcccttcagcagaaaaaccaggaggaattattgaggagacgcgaacaggagctagccgagcgcgagattgacattctcgaaagagagttgaatataataattcatcagctgtgccaggaaaagcctcgcgtgaagaagcggaagggcaagtttcgcaaatctagattaaaattaaaggacggcaacaggatctccctccccagtgatttccagcacaagtttacggtccaggcatctcccaccatggataagcgcaagagcctgataaattcacggtccagtcctccagcatctcccactatcattccgagactgagagctattcagctgacgcccggcgaatcgtccaaaacatggggccgctcctcagttgtacccaaagaagagggggaagaagaagagaagcgagctccaaaaaaaaaagggcgcacatggggccccggtacgttaggtcagaaagagctggcatctggagacgaaggcagcccacagaggcgcgagaaggccaatgggctgtccactcctagcgaatctcctcactttcatctaggtttgaaaagtttagtcgatggctacaaacagtggtcctctagcgcacccaatctggtgaaaggcccgcggtctagtcctgcccttccgggctttactagcctgatggagatggcacttctcgctgcgagttgggtggtccctattgatatcgaagaagacgaggattcagaaggccccggaagcggggagtccagattacagcacagcccgtcacagtcctacctctgtataccttttccacggggggaagatggagatggacccagtagtgatggaatccatgaagaacccactccagtgaactcagcgacttccacgccacagctgactccgaccaactcccttaagagggggggcgcacaccacagaagatgcgaggtcgcactcctgggctgcggagctgtgctcgccgccacgggtctgggttttgatctgctggaggccggcaaatgccagctcctgccccttgaagaacctgaaccaccggcaagggaagaaaaaaagcgcagagaaggcttgttccagagaagttccagaccgagacgatccacatcccccccgagtaggaagctctttaagaaggaggaaccaatgctactcctcggggatccatcagcctccctgacattgctcagcctttcaagtatttcagagtgcaactcaacccgaagcctgctgaggtctgatagcgacgagattgtcgtttatgaaatgcctgtctcaccagtggaagctccacctctctccccttgcacacacaatcccctggtgaatgttcgagttgaacgcttcaagagagaccctaaccagtcgctgacacccacacatgtgactctcacgacaccctctcaaccttcctcacataggagaacgccttcggacggggccttgaagcccgagacactcctggctagtaggagccctagctctaacggcctgagcccatcacccggcgccggtatgctgaaaaccccgtcaccaagtcgtgaccctggagagttcccgcggctgcccgatccaaacgtcgtcttccccccaacgccaagacgctggaacacccagcaagacagcacccttgagcgaccaaagactctcgaattccttccaagaccacggccctcggcaaacaggcagcggctcgatccgtggtggttcgtgagcccttcccacgctcgctccacctctcccgctaactcatcctctaccgagacgccatccaacctggattcctgctttgccagcagcagctctactgtggaggaaaggcctggactgcctgcccttctcccgtttcaggctggcccattgccacccacagagcgaaccttgctcgatctcgacgcagaagggcaatctcaagattcaaccgtacccctctgtagggcggagctgaacacccatcgtcccgcgccttatgagattcaacaagagttttggtcgtag

SEQ ID NO: 124801 - DNA, 2463 bp, Artificial Sequence
  Description of Artificial Sequence: Synthetic coding sequence
cttgtgcttatactgcagaaggtggaaaatggggatctgagcaacaagatcctcaagattaccgattttggccttgcacgagagtggcaccggaccactaaaatgtcagcagctggcacttacgcttggatggccccagaggttatcagagcttccatgttcagcaaaggtagtgacgtatggtcctacggggtgctactatgggagcttctgacgggggaggttccgttccgtgggattgatggcctggctgtcgcctacggagtggccatgaataaattagcactgcccatcccttccacatgtccagaaccgttcgccaagctgatggaggactgttggaaccctgatcctcacagcaggcccagctttactaatatcttggatcaactgaccacaattgaagagtccggctttttcgaaatgccaaaggacagttttcattgtctccaagacaactggaagcacgaaatccaggaaatgttcgaccagctgagagccaaggaaaaagagctgcgtacttgggaagaagagctgaccagggccgctctccagcagaaaaatcaggaagaactcctgaggcggcgtgagcaggagttagccgaaagggaaatcgacattcttgaaagagaactgaacatcatcatacaccagctgtgtcaggagaagccaagggtaaagaagcgaaagggcaaattccgtaagagcaggcttaagttgaaggacggcaatcgcatcagtttgcccagtgactttcaacacaagttcactgtacaggcctctcctacaatggacaaaaggaaaagtctgatcaatagccgctcctctccacctgcgtcaccaactataatacctcggttgcgtgctatacagctcactcccggcgagtctagtaagacatggggtagaagcagcgtcgttcctaaggaggagggcgaagaagaggagaagagggcccccaagaaaaaaggaagaacttgggggccaggcaccttagggcagaaggagctggcgagtggggatgaagggctcaaatccctcgttgatggatataagcagtggagttcaagcgcgcctaatctggtcaaaggaccacgttcatcaccggctctgcccggtttcacaagtcttatggaaatggcctgcttttcctccaccctggttatctttactgaagatgaagattcagaaggccctggttctggagagagtagattacagcactcccccagccagtcttatctgtgcattccttttccccggggtgaagatggcgatggccccagttccgatgggatacatgaggaacctacacccgtcaattcagcgacatccacgcctcagctcaccccaactaattccctgaaacgcggaggcgctcatcatcggagatgcgaggtggcactacttggttgcggcgcagtgctggcggctaccggactgggatttgatctgctggaagccgggaaatgccagctcctgcctctcgaggagcccgaaccccctgctagagaagagaaaaagaggcgcgagggcctgtttcagagatccagccgccccaggaggtccacaagtcctccttcaaggaaactctttaagaaggaagagccaatgctactcttaggggacccgtctgcaagcctgacactgctgagcctgtcctccatttctgagtgtaatagcaccagatccctgcttcggtcagattcagacgagattgtagtctatgagatgccagtgagtcctgtcgaagccccccctctgtcaccttgtacacataaccccctggtcaacgtgcgtgtagagcgcttcaaaagggatcccaaccagagcctgacccccacacacgtgacactgacaacaccatctcagccctcttctcatcgaagaactccaagtgacggcgcactcaagcctgaaactcttttagcatcccgatccccctccagtaatggtctgtcaccatcgcccggggctggcatgctcaaaacaccatcaccttcccgtgaccccggagagttcccccgcctgcccgatcccaatgtcgtgttccccccaactcctaggcgttggaacacgcaacaagattcgacgctggaacggcccaagacactggagtttcttcctcgtccacgtcccagcgcaaaccgacagcggttggacccttggtggttcgtgagcccctcgcacgctagaagcacaagcccagcaaatagctccagcactgaaacccccagtaatttagactcatgcttcgcaagttctagcagcaccgtcgaggaacggccaggacttccagcattgctgccgtttcaggccggcccactgccacccacggaacgaacgctgcttgatctggacgctgagggccagagtcaggacagcactgtccctctatgtcgagctgagctcaacacacatcggcctgccccatatgagatacagcaggaattttggagctag

SEQ ID NO: 124802 - DNA, 3315 bp, Artificial Sequence
  Description of Artificial Sequence: Synthetic coding sequence
atggagccgtccagagcacttctgggatgcctggcctctgcagccgccgctgctccaccaggggaagacggtgcgggggctggcgccgaggaagaagaagaggaagaagaagaagcggcggctgctgtaggacccggggagctgggatgcgatgccccacttccatactggacagctgtattcgagtatgaggctgccggggaagatgaattgaccttgaggttgggggatgtcgttgaagtgctgagcaaggacagccaagtgtcgggcgacgaggggtggtggacaggtcaactgaatcagagagtggggattttccccagtaactatgttaccccccgctcagctttcagcagcagatgccagccaggcggggaagatccaagctgttatccaccgattcaactcttggagatcgactttgctgaactcacactcgaggaaatcatcgggataggcgggtttggcaaagtgtatagggcgttttggatcggagacgaagtcgccgtcaaagctgcacgccacgaccctgatgaagacatctcccagacgattgagaatgtccggcaagaggcgaagttgtttgctatgctaaaacaccccaacattattgccctccggggagtctgtcttaaagaacccaacctgtgtctcgttatggagtttgctcggggtggccctctcaaccgagttctatctggaaagcgaatccccccagacatcctggtaaattgggcagtacaaatagccaggggcatgaattatcttcatgacgaggctatcgtacccatcatccatcgggaccttaagtctagtaatattctgatcctgcagaaagtcgaaaacggagacctgtcaaataagattctgaaaatcacagatttcggactggccagggaatggcatcgtaccacaaaaatgagcgccgccggaacatatgcctggatggcccctgaagtaatcagagcaagcatgttttctaagggctccgacgtctggtcttacggcgtgctcctatgggagcttctgaccggggaggttcccttcaggggcatagatggcttggcggtggcctatggcgtcgccatgaataagcttgcgctgcccatcccgagcacctgccccgagcctttcgccaagttgatggaagactgctggaaccccgatcctcactctagaccatcatttaccaacatcctggaccaacttacaacaatcgaggaatccggcttctttgaaatgcctaaggattctttccattgccttcaggacaactggaaacacgaaattcaagagatgttcgatcagctgcgcgcaaaggagaaggagctaaggacttgggaagaggaactgactcgcgccgccctacagcagaagaatcaggaagaattgctgagaaggcgggagcaggaactggctgaaagagaaatagacattctcgaaagggagctgaatatcattatccatcaattgtgccaggagaaaccgcgggtaaaaaagcgcaagggcaagtttagaaaatctagactgaagttgaaggacggcaacagaatcagtctgccgtctgactttcaacataaattcactgtccaggcctcaccgaccatggacaagcggaagtctctcatcaattcacgcagctccccacccgctagcccaacgatcattcctcgtttgagagcgatccaactgaccccaggcgagagtagcaagacatggggtagaagttcggtagtccccaaagaggaaggagaggaggaggagaagagggcccctaagaaaaaggggcgcacttgggggccaggaacgctgggtcagaaggagctggcctcaggagacgagggcagcccgcagagacgagagaaagccaacggactgtccacgccaagtgaatccccacactttcatttggggctcaaatccctggttgatggatacaaacaatggtctagtagcgcaccaaacctggtgaaagggccaaggtcaagcccagccctccccggttttacatcactgatggaaatggaggatgaggacagtgagggcccaggttcaggcgaatccaggctccagcattcacccagccagtcctatttatgtattcccttcccccggggggaagacggcgatggacccagctcagacgggatccatgaagaaccgacgccagtgaactctgccacttcaactccgcagctgacccccacgaactccctcaaacgcggcggggcgcaccaccgccggtgcgaggtggcactgcttggctgtggcgccgtgcttgcggcaactggtttgggcttcgacctgctagaggcagggaagtgccagcttctccctttggaggaacccgagcctccagctcgcgaggaaaagaaacggagagagggcctatttcagcgtagtagccgaccccgcagaagcacaagccccccaagtcgtaagctttttaagaaggaagagcccatgctcctgctaggcgatcccagtgcatctttaactctgctctctctgtctagcatctcggagtgcaactcaacacggtcccttctccgttccgactctgatgaaatcgtggtctatgagatgcctgtgagtccagttgaagctccacctctttctccatgcacacacaatccactggtgaatgtgcgcgtggaacgcttcaagcgagatccgaaccagagtttaactccgactcacgtgacgctgaccaccccgagccagccaagctctcaccggcgaactccaagtgacggtgctcttaagccagagacactcctggcttctcgttctcccagtagtaacgggctgagtcctagtcctggcgcaggcatgctgaaaacaccgtcccctagccgagatccaggagaattcccccgactacccgaccctaacgttgtgttccctcccaccccccgccgctggaatactcagcaagattccaccctggagaggccaaagacattggaattcctgcccagaccgcggcctagtgcaaacagacagcgattggacccttggtggttcgtgagcccgtctcatgcaaggtccacgagcccagctaattctagtagcacagaaacccccagcaacttggactcctgttttgcgtcctcttcctccacagtcgaggaaaggcctggcttaccggccctccttccctttcaagctggcccccttccccctaccgagcgtacccttttggacctcgatgctgaaggtcagtctcaagactcaacagttccactgtgcagggctgagcttaatacccatcggccagctccctacgaaattcagcaagaattctggtcctag

SEQ ID NO: 124803 - DNA, 1005 bp, Artificial Sequence
  Description of Artificial Sequence: Synthetic coding sequence
atggccctgaggtggggaatcgtatctgtcggactgatttcctctgactttactgccgtcctccaaacgttacctcgatccgaacatcaagtggtggcggttgcggcacgggacttgagtcgtgccaaggagtttgctcagaagcacgacattccaaaagcatatgggtcttacgaagagctggcgaaggatccttccgtcgaagttgcatacatcggaacacagcatccccagcacaaggctgccgtgatgctctgtctcgctgctggaaaggccgtcctgtgcgagaaacccactggtgtaaacgccgcagaggtgcgagagatggtggctgaggcccggagccgcgctctgttcctgatggaggccatttggaccagattcttccccgcgagcgaggccctgagatccgtgctcgctcagggcaccctgggggacctgcgggtggccagagccgagttcggaaagaacctgattcatgtgccccgtgctgttgatcgtgcccaggcaggcggcgcgcttctggacatcggaatctactgtgtgcagttcactagcatggtgtttgggggccagaagcctgaaaagatctcagtggtcggacggaggcacgagacaggcgtggatgatactgtgaccgtgcttcttcagtacccaggcgaagtacacgggtcatttacatgctctattactgtccagctgtccaacacagcctcagtatcgggtacaaagggaatggtccagctgctgaatccatgttggtgtcctactgaactggtggtcaaaggtgagcacaaagagtttccgctgccccccgtgcctaaggactgtaacttcgataacggcgcaggcatgagttacgaagccaaacatgtgtgggaatgcctgcgcaaaggcatgaaggaaagcccggtaattcccttgagcgaatcagagctattggccgacatcttggaggaagtcaggaaagctattggagtaactttcccccaagataagcgctag

SEQ ID NO: 124804 - DNA, 2466 bp, Artificial Sequence
  Description of Artificial Sequence: Synthetic coding sequence
atggacgtcgtcgatcccgacatttttaatcgagacccaagagatcactatgatttgctgcaacggcttggtggtggcacttatggcgaggtgttcaaagcaagggacaaagtatctggcgacttagtcgctttaaagatggtcaagatggaaccggacgacgacgtgtcaaccctgcaaaaggagatcctgatcctgaagacttgcaggcacgccaatattgttgcatatcatgggagctatctgtggctccaaaagctttggatctgtatggagttttgcggagccggctccctgcaggacatctatcaggttacaggtagtttaagcgaactgcagatttcctacgtttgtcgagaggtgttacagggactagcgtatctgcactcccaaaagaaaattcatcgggacattaagggggccaacatcctgatcaatgacgccggcgaggtacgtctggcagactttgggatttcggcccagatcggcgccaccctggcaaggcggctgtccttcatcggcacaccctattggatggctcctgaggtggcagccgtcgccctgaaaggaggctacaacgaactttgtgacatttggtcgctcggtattacggcaatcgagctggccgagcttcaacctcccctattcgatgtacatcctttacgggtactattcctgatgaccaaaagcgggtaccagccaccacggctgaaagagaaggggaagtggtcagcagcctttcacaattttatcaaagttacccttaccaagtcccctaagaaaagaccttcagctaccaagatgctgagccaccagctggtaagtcagcctggcttaaacagagggctgattctcgacctgctggacaaacttaagaaccccggcaaggggccctctatcggagacattgaggacgaagagcctgagctgcccccggcaattccccgtagaattagaagtacccacagatcatcatccttgggcatcccagacgcagactgttgtaggcgtcatatggagttccggaaactgaggggaatggagacgcgcccacccgccaatactgcaaggctccaaccacctagagatctacgttcctcatcccccagaaaacagctgtccgaatcctccgacgacgactacgacgatgtggatatccctacccctgccgaggatactccaccgcctctgccccctaaacccaaattcagaagcccttcggacgaaggccccggttcaatgggggacgacggtcagctctcccccggtgtcctcgtccgctgcgcatcaggtccaccgccaaattcgccccgtcctggacccccaccttccacctcctcaccacatctcacagctcactctgaaccctctctgtggaacccgccaagcagggagttggataaaccgcctctgctgcctcctaagaaagagaaaatgaagcggaaaggctgtgctttgctggtgaaattgtttaacggctgccccctgcgaatacacagtactgctgcttggactcatccgagcacgaaggatcagcacctgttactgggggcagaggaggggatttttattctgaaccgtaacgaccaggaagctacattggagatgctcttccctagccggactacttgggtatacagcataaacaatgtcctaatgtccctatctggcaagacgccccatttatactctcactctatcctgggactactcgagaggaaggaaactagagcgggtaaccccatcgcccatatctctccacacaggctcctggcacgaaaaaatatggtctccaccaagattcaggacacgaaaggctgtcgggcctgttgtgtggccgaaggcgctagcagcggcggcccctttctttgtggggcacttgaaacaagcgttgttttgctgcagtggtaccaaccgatgaataagtttcttttggtgcgacaggtgctgttcccactaccaacacccctatctgtgttcgccctgttgacaggccccggctcggagttgcccgcagtttgtatcggagtgagccccgggaggccaggtaaaagcgttctcttccatacggtccgctttggtgcactttcctgttggcttggggaaatgtctacggaacatcggggccccgttcaagtgacccaagtcgaagaagacatggttatggtgctgatggacgggtcagtcaagctggtgaccccggaggggagcccggtaagggggttgcgcacccccgagatacctatgactgaagccgtggaagccgtggccatggtcggcggccagctgcaggccttttggaaacacggagtccaggtttgggccttggggagcgaccagcttctgcaggaacttcgcgatcctacccttactttcaggctgctgggctcacccagacccgttgtggtagagacacggcctgtggacgatcctacagcaccatccaacctctacatccaggagtag

SEQ ID NO: 124805 - DNA, 720 bp, Artificial Sequence
  Description of Artificial Sequence: Synthetic coding sequence
atggaattcagaaaactccgcgggatggaaacccgccctccagccaacaccgccagattacagccccccagggacttgaggtcatcatccccacgcaagcagttgtctgagtcaagcgacgacgactatgatgatgtggatatacctacacctgcagaggacaccccgcccccactcccaccaaagccaaagttcagatcccccagtgacgaagggcccggctcaatgggagacgatggtcagttgtctcctggtgtgctggtgaggtgcgccagcggcccacccccaaactctcccaggcccggcccgccacctagcacaagttctccgcacctgactgcacatagcgagccctccctgtggaaccccccttcccgggagctcgataaaccccctctgctgccacccaaaaaggagaaaatgaagaggaaaggctgcgcccttctggttaaactcttcaacgggtgtccattgcgtattcacagcactgccgcgtggacccacccaagcaccaaagatcagcatctgcttctcggcgcagaggagggcatctttatcttaaatagaaacgatcaggaagctaccttggagatggagaggcctcccacctgtattcttatcgccagtcttgcctgttggaatgggaaacgccctgagcaggagacgccttcactgacactcgcccccacagcctattggcaaggaacatcatcacagtag

SEQ ID NO: 124806 - DNA, 2502 bp, Artificial Sequence
  Description of Artificial Sequence: Synthetic coding sequence
atggatgtagtcgatccagatattttcaaccgggatccccgggaccattatgacctactgcaaagactggggggagggacgtatggcgaagtgtttaaggcaagggacaaggtctctggcgacctcgtcgccctgaagatggtgaagatggagcctgacgacgacgtgtctacactgcagaaggagatcctgattcttaagacctgccgccatgccaatatagtcgcctatcacggcagttatctgtggcttcagaaactgtggatttgcatggagttttgtggagcaggctcccttcaagacatttatcaggttaccgggagcctgtcggagctgcagatctcttatgtttgccgggaggtccttcagggcttggcatacctgcactcccagaaaaaaatacatagggatattaaaggggcaaacatcttgatcaatgatgcaggagaggtacgcctggcagacttcggaatctccgcccaaatcggtgccactttagcccggagactgtcttttattggcacgccatattggatggcgcctgaggtggccgccgtggcactgaaaggcggctacaatgaactttgcgacatatggtccctgggaattactgctatcgagttggctgagctccagcctccccttttcgacgtccacccccttagagtgctctttctgatgacaaaatccgggtatcagccacctcggctaaaagaaaaaggcaaatggtctgccgcatttcataatttcatcaaggtgaccttaacaaagagccccaaaaaaagaccttcggctactaaaatgctgtcacaccaactggtctcccagcccggcctgaatcggggcctgatcttggacctgctggacaagctgaagaatcctgggaagggaccatccatcggtgacattgaggacgaggagccagaattacctccagctatcccccgtcggataaggagcactcatcgctcgagctctctgggtataccagatgctgactgctgccgtaggcacatggagtttagaaagttaaggggcatggaaactagaccccctgctaatacagcccggcttcaacctccgcgagacctgagatctagctcaccacgcaaacaactcagtgaaagtagtgatgatgactacgatgatgtagacatccccacacctgccgaggatactccaccgccacttccaccaaaacctaagttccggagcccttctgacgagggaccaggatccatgggcgacgacggccaactatcccctggagtcttggtgcgttgcgcttctggacctccgccaaattctccacgccccggaccgccgccctccacgtcttccccacacctcaccgcgcactctgaaccttctctgtggaatcccccatctcgtgagttggataagcctcccctgttgcctcctaaaaaggaaaaaatgaaaagaaagggctgcgccctgctggtaaagctcttcaatggctgccccctcaggatccattccaccgccgcctggacacacccatcaacgaaagaccaacacctgctgctgggagccgaggagggtatctttattctgaaccggaacgatcaggaggccaccctcgaaatgctgttccctagtaggacaacatgggtgtactctatcaataatgttcttatgtctctcagcggaaagacaccccatctctatagtcactccattctcggactcctcgagaggaaggagacccgagctgggaacccaatcgcacatatctctccgcacaggctgctggcccggaagaacatggtttccactaaaatccaggatacaaaaggctgtcgggcctgttgtgtggcagagggagcatcttcaggtggacctttcctctgcggagcactcgaaaccagtgttgttctgctacagtggtaccagccaatgaacaaattcctgttggttcggcaggtgctatttcccctgcctacacccctgagcgttttcgcattgctgaccggccctgggtcagagttgccggcggtatgtatcggcgtgtcaccaggacggccaggtaagagcgttctttttcacacagtgaggtttggtgccttgtcatgctggctaggagagatgtctacagagcatagaggccctgttcaagtcacgcaagtggaggaagacatggttatggtgctgatggacggcagcgtgaagctggtcacccctgagggatctcctgtgcggggcctgcggacaccagaaatcccaatgaccgaggctgttgaagccgttgcgatggtggggggacagctccaggccttttggaagcatggcgttcaagtgtgggcgttagggagtgatcagttgctgcaggaactcagagacccaacgctcacgtttagactgctggggtccccccggcttgagtgctccggtactatctccccacactgtaatctgttgcttcccgggagttctaacagtcctgcctcagcaagccgcgtcgccggaattacgggattgtag

SEQ ID NO: 124807 - DNA, 2463 bp, Artificial Sequence
  Description of Artificial Sequence: Synthetic coding sequence
atggccctgctgcgcgatgtatctctccaagacccgcgcgataggtttgagcttttacaacgtgtcggtgccgggacttatggggacgtttacaaggctcgcgatacagtgacaagtgagttagccgcggttaagattgtgaagctagacccaggtgacgacatctcttccctgcaacaggaaataactatactgcgcgagtgtcggcacccaaacgtggtggcttacatcggctcatatctacgcaatgacaggctgtggatttgtatggagttttgcgggggaggctcattgcaggagatttaccatgcgacaggacccctggaggagcgccagatagcatatgtatgtcgagaggcactgaaaggactgcatcatctgcactctcaaggcaaaattcatcgggatatcaagggtgcaaatctcctcttaaccttgcagggagatgtgaagctggctgattttggtgtgagtggagagttaacggcaagtgtggcgaagcggcggagttttattggtactccttattggatggccccagaagtcgctgcagtggagcggaaaggtggttacaatgaattgtgtgacgtctgggctcttgggatcactgcaatcgagctgggagagctccagcccccccttttccacctccacccgatgagggctcttatgctcatgagcaagtccagtttccagcctcccaagctgagagacaagacgcggtggactcagaattttcaccatttcctgaagcttgccctgacgaaaaatcccaagaagcggccaacagccgagaagttacttcagcacccttttacgacacagcagctgccaagagccttattgactcagctgctagacaaggccagcgatcctcacctcggaactccttctcctgaggattgcgagctggagacatacgacatgttcccagacactattcactctcgggggcagcacggccctgctgagaggacaccaagcgagattcagtttcatcaggtgaagttcggggcacctcgaagaaaggagaccgatcctctaaatgaaccttgggaggaggagtggacccttcttgggaaggaggaactgtctggctcactgttacagtccgttcaagaggccctcgaggagagatcactgaccattaggtccgcgagcgagttccaggaattggacagtccagatgatacaatggggaccataaaaagagccccttttctaggaccgctgcccacggaccctcctgcagaagaacccctcagtagccctcccggcactttgcccccaccgccttcaggaccaaatagcagccccttattgcctacagcctgggcaaccatgaagcaaagagaggacccagaacgctcgtcttgccacggtctccccccgacccccaaggtccacatgggagcttgcttttctaaagtgttcaatggctgtccactaagaattcatgctgcggtgacctggatacatcccgtcacacgcgaccaatttctcgtcgtgggcgctgaagagggaatttacactctcaacctccatgagctccatgaagacacattagagaaactcatcagccaccgatgcagctggctctattgcgtgaataatgtgctcctgagcctttccggaaaatcaacccatatatgggcacatgatctgccaggattgttcgaacaacgcaggctacagcaacaggtgccactatctattcctacgaaccggctgacccagcgtataatccctagaagattcgcgctcagcacgaaaattcccgacaccaaagggtgtctacagtgcagggtcgtgcgaaacccatacaccggggccactttcctgcttgccgccctgccaacctctcttctactcctgcagtggtatgagcctcttcagaagtttcttctcctaaaaaacttcagctcccccctgccttccccagcagggatgttggagccgttggtactcgatggaaaagagctgccacaggtctgtgtaggagcagaaggacccgagggtccgggatgtcgggtgctgttccacgtgctgcccctagaagccggtcttacaccagatattttgattcctccggaaggcatccccggatctgcccagcaggtgattcaggtagatcgggataccattctggtctctttcgagcgatgtgttcgaattgtgaacatgcagggcgaaccaaccgcgaccctagcccccgagctgaccttcgattttcccatcgaaacggtcgtttgcttacaggactccgttctcgccttttggtcccacggaatgcaggggagatccctggacactaacgaggttacacaggaaataacagatgaaaccagaatctttcgggtcctcggggcacacagggatattattctggaatccattccaaccgataacccagaagctcatagcaatctctatatcctgacgggccaccaatctacatactag

SEQ ID NO: 124808 - DNA, 2541 bp, Artificial Sequence
  Description of Artificial Sequence: Synthetic coding sequence
atggaagctcctttacggccagccgccgacattctcagaaggaatccgcagcaggattacgagctggtccagcgcgttggctcagggacctatggtgacgtctacaaggctaggaatgtccacacaggtgagctggccgcagtaaaaatcataaagctggaacccggagatgatttctcccttatacagcaggaaatctttatggttaaagagtgtaagcactgtaatatcgtggcttattttggctcctacctgtctcgcgagaaactctggatctgtatggaatactgcggtggtggcagcctccaggacatctaccacgtgaccgggccgctctcggaactgcaaattgcctatgtctgccgcgaaactcttcagggtttggcatatctccataccaagggcaagatgcacagggacatcaagggcgccaacatcctgttgaccgaccatggagacgtgaaactggccgacttcggagtcgccgcaaagataactgctacaatcgccaagcggaagtctttcattggcaccccctattggatggcgcctgaggtcgcagcagtggagaaaaatggggggtataaccaactgtgtgacatctgggctgtcggaattaccgccattgagcttggcgaacttcagcccccgatgtttgatctgcatcctatgcgggcattgttcctgatgtccaaatctaactttcagccaccaaagctaaaggataagaccaaatggtcatccacctttcataacttcgtaaagattgcccttaccaagaaccctaagaagagaccaactgctgagcgtttactcactcacacgttcgtggctcagccgggcttgagcagggcgttggcggtggagctgctggataaggtaaacaatccagacaatcatgctcattacacagaggcagatgacgatgacttcgaaccacacgcgattatccgacacacaatacgctcgactaaccggaacgcacgtgccgagagaactgcttccgagatcaattttgacaaattgcagttcgaaccccccttgagaaaggagacggaggcaagggacgaaatgggactgagctctgacccaaactttatgcttcagtggaacccttttgtggacggtgcaaatactgggaagagcacaagcaagcgggctatcccacccccactgccaccaaagccacgtattagctcttaccccgaggacaattttccagatgaggagaaagcctccacgatcaagcattgtccggattccgagagcagggcccctcaaattctgagaaggcagtcttctccttcctgtggccccgtggcagaaacatcatccattggaaacggtgacggcatctctaaacttatgtctgaaaatactgagggaagtgcccaggcaccgcagctgcccagaaagaaggataaacgggattttcccaagcctgccattaatggtctacctccaacacctaaggttctcatgggggcctgtttttcaaaagtgttcgatggatgccccttaaaaattaattgcgccacctcatggattcaccctgataccaaagatcaatatatcatcttcgggacagaggatggtatttataccctaaatctgaacgaacttcacgaggccaccatggagcagctctttccaagaaagtgcacatggttgtacgttataaataatactctgatgagtttatcagtgggaaagacattccaactctattcccataatctcattgccctgtttgaacacgccaaaaagcccgggctggcagcacatatacagacccaccgcttccctgatcgcatcctgcccaggaaatttgccctgaccactaagatccctgatactaagggctgccataagtgttgtattgttcgaaatccatataccggtcacaaatacttatgcggggccttgcagagtgggatcgtgcttttgcagtggtacgaacccatgcaaaagtttatgttgataaagcactttgatttcccccttcccagtcccctgaatgtgtttgaaatgctggttatacctgaacaagaatatcccatggtctgcgttgcaatttctaaaggtaccgagtctaaccaggtcgttcagttcgaaactatcaacctgaactctgcgagtagttggttcaccgagatcggagcagggtcccagcagctcgacagcatacacgtgacacagcttgaacgcgacactgtcctcgtgtgtcttgacaagttcgtgaaaatcgtcaacctgcaagggaaattgaaatcaagcaagaagttggccagtgagctcagcttcgatttcagaatcgagagtgtggtttgtcttcaggactctgtactcgccttctggaaacacggaatgcaaggaaaatcattcaagagtgacgaggtcacacaggaaatcagcgacgagaccagggtctttcgactgcttggcagcgaccgcgtggtggttctggagagccgaccgaccgaaaaccccacagcccactcaaatctgtacattctggcaggccacgagaatagttattag

SEQ ID NO: 124809 - DNA, 699 bp, Artificial Sequence
  Description of Artificial Sequence: Synthetic coding sequence
atggctacggcggagtcacgggctttgcagtttgctgaaggggcggccttccctgcttatagagctccccatgctggtggcgccctgctgccacccccttcccccgcagccgccctgctgcctgctccacccgccgggcctggaccagcaacttttgcagggtttctgggtcgcgacccgggaccagcaccacctccccccgcctccctggggagccctgcgccaccaaagggggccgcagcaccctcagcctcacagagacgcaaacggaccagtttttccgctgaacaactgcagttgttagaactggtcttccgcaggactcgttacccagatatccacctccgggagaggttggccgctctgacactgttacccgagtctcgcatccaggtctggtttcaaaatagaagagctaagtcaaggaggcagtcaggcaagagctttcaacctctagcccgccctgaaatcatcctaaatcactgcgcaccgggaactgagacgaagtgcctgaagccccagctccccctggaggtggatgtaaactgcctgcctgagccgaacggggttggaggtggcatcagcgatagctcttcacaggggcagaattttgagacatgttctcccctaagtgaggatatcgggagcaagcttgacagttgggaggagcatatcttctccgcctttggcaacttctag

SEQ ID NO: 124810 - DNA, 723 bp, Artificial Sequence
  Description of Artificial Sequence: Synthetic coding sequence
atggccactgcggagtcaagagcactgcagttcgccgagggggccgcctttcccgcctatagagccccacacgctggcggcgccttgctcccgcccccatcacccgccgccgctctgttacctgcccctccagcgggcccgggacctgccacctttgcgggattcctcggtagggatccgggtccagcacccccacctcccgccagtttgggcagccctgctcctcccaaaggtgctgccgccccctctgccagccagcgccgtaagcgcacctcgttcagtgctgaacagctgcagttgctagagctagtgtttcgtcgaactaggtaccccgatattcacttgcgtgaacgattggccgccctcactttgcttcctgagagtcgcatacaactgctctttagtcccctgttccaggtgtggttccaaaaccggcgggcgaagagccgccgacagagcggtaagtcctttcagcctttagcccggccggaaatcatactaaaccactgtgctccaggtactgagactaagtgcttgaaacctcagttgcccctggaagttgacgtgaactgcctccccgaaccgaatggggttgggggcgggatctccgatagctcatcacagggccaaaactttgaaacgtgttcacctctcagcgaggatattggtagcaagctagattcttgggaagaacatatattttctgcttttggcaacttttag

SEQ ID NO: 124811 - DNA, 882 bp, Artificial Sequence
  Description of Artificial Sequence: Synthetic coding sequence
atggccacattcagcgggcccgcaggtcccattttgtccctcaacccgcaagaagacgtcgagtttcaaaaagaagttgcccaggtccgaaagcgcatcactcagcggaaaaagcaggagcaattgacgcccggcgtcgtgtatgtgaggcaccttcctaacctgttagacgaaacccagatctttagctacttttcacagtttggaactgtcacccgcttcaggctcagcagatcaaaacggacaggtaattcgaaaggctacgcatttgtggagtttgagtccgaggacgttgcaaagatagtcgctgaaaccatgaacaactacctgttcggagaaagattgctggaatgtcactttatgccccctgaaaaggtgcacaaagaattgttcaaggactggaatattcctttcaagcagccatcctacccatcggtgaagcgctataacagaaacaggactctcacacaaaagctgcggatggaagaaaggttcaaaaaaaaagaaaggctcctacggaagaagcttgccaagaaagggattgactatgacttcccgtcactgattcttcagaaaaccgagagcattagtaagacgaacagacagacaagcactaagggccaggtcctccggaagaagaaaaagaaagtaagcgggaccctggatacaccagagaaaacggtcgattcacagggccccacgcccgtgtgtaccccaacgttcctggagcgcaggaaatcacaagttgccgagcttaacgatgacgacaaggacgacgaaattgtatttaaacaacctatttcttgtgtcaaggaagagatccaagagacacagacgcctacccacagtagaaagaagaggcggcgaagctctaatcagtag

SEQ ID NO: 124812 - DNA, 1257 bp, Artificial Sequence
  Description of Artificial Sequence: Synthetic coding sequence
atggcccctagaggacggcgccgccccagaccacacagatctgaaggagcccggaggtctaaaaacactttagaacggactcatagcatgaaagacaaagccggacagaaatgcaagccaattgatgtgtttgacttcccagacaactcagatgtgagctccatcggacggctcggggaaaatgaaaaggatgaagagacttatgaaaccttcgacccaccgctacactctaccgccatctatgctgacgaagaggagtttagtaagcactgcggtctgagcctgtcttcaacacccccagggaaagaagccaagcggagttcagataccagcggtaacgaggcctctgaaatcgagagcgtgaagatctcagcaaaaaaacccgggagaaaactcagaccaatcagcgatgactcagaaagcattgaggaatctgatacgcgaaggaaagtcaagtccgcagagaaaattagtacacaaaggcacgaagtgattagaacaactgcaagttctgagctgtctgagaagcctgcagaatccgtcacatccaagaagaccggccccctgtctgcacagcccagcgttgaaaaagaaaacctagccattgaaagtcagagtaagacccaaaaaaaaggcaaaattagtcatgacaaacgaaaaaagagccgctcaaaggcaatcggatccgacacttcagatatcgtgcatatatggtgtccagagggaatgaagacgtcagatatcaaggaacttaatatcgtgctgcccgagtttgaaaagacccatttggagcatcaacagagaatagaaagcaaagtctgtaaagctgcgatagccaccttctatgttaatgtgaaggaacaatttatcaaaatgctgaaggagagccagatgcttaccaatctgaaaagaaaaaatgctaaaatgattagtgatatcgaaaaaaaacggcaaaggatgatagaagtgcaggacgagctgctacgtcttgagccccagctcaaacagctgcagacaaagtacgacgagctcaaagaacggaagtcatcgctcagaaacgctgcctacttcttgtccaatcttaaacagctctaccaggactattcagatgtccaagcacaggagccaaacgtgaaggagacctatgattctagttcattacccgcactccttttcaaggccaggacacttctcggagccgaatctcatttgcggaatattaatcatcagctggaaaagttactggatcagggatag

SEQ ID NO: 124813 - DNA, 963 bp, Artificial Sequence
  Description of Artificial Sequence: Synthetic coding sequence
atggcacctagaggcagaaggaggccacggccccacaggtccgagggcgccaggagatcaaaaaataccttagaacgcactcactcaatgaaagacaaagccggccagaagtgcaagcctatcgacgtttttgattttcctgataattcggacgttagcagtattgggcggctgggggagaatgaaaaagatgaagaaacatatgaaacttttgatcctccactccatagtaccgctatatacgccgacgaggaggaattttcaaaacactgtggactcagcctttcatcaacacctccgggaaaagaggccaaaaggagctcagataccagtggcaacgaagccagcgaaattgagtctgtgaagatttccgctaagaagccgggcaggaaactccgccccattagcgatgactccgagtcaatagaggaatcagatactcgccgcaaggtgaagagcgcagagaaaatcagcacccagcgtcatgaggtaattcgcaccacggcttcctccgaattgtccgaaaagcccgcagagagcgtgacatcaaagaagactggacccttgagtgcacaaccgtccgtggaaaaggagaacctagcaattgagagtcaatctaaaacccagaagaaaggtaagatttcccacgataagagaaagaaatcacggtccaaggccattgggagtgatacgtccgatatcgtccatatctggtgcccagaagggatgaaaacctcagatatcaaggaactgaatatcgtgttaccagagtttgagaagacacatctcgagcaccagcagcgcatcgaatcgaaggtatgtaaggccgccatcgcaaccttctatgtcaacgtgaaagaacagttcataaagatgctgaaggaaagccaaatgctcaccaatcttaagcgcaagaatgctaaggtaagagctactgctgaaacaacaaccaataaaatctag

SEQ ID NO: 124814 - DNA, 963 bp, Artificial Sequence
  Description of Artificial Sequence: Synthetic coding sequence
atggccccgaggggccgtcgccggcccaggcctcaccgatccgagagtgctcgcaggtccaagaacaccttggagcgcacacactctatgaaggataaagctggccagaaatgtaaacctatagatgtcttcgacttccccgacaactctgacgtctcctctattggcaggttgggagaaaacgaaaaggacgaagagacttacgagacattcgatccaccactgcacagtacagctatttatgcagatgaagaggagttctcgaagcattgtggactttctctttcctcaactccccccggcaaggaggctaaaaggagtagcgataccagcggtaacgaggcctcggagatagagtccgtcaagatctcggctaaaaagccgggccggaaattgagacccatcagcgatgattctgaatcgatcgaagagtcagataccaggagaaaggtcaaatccgctgagaagatatccacgcaaaggcacgaagttattcggaccacagcctccagcgaactgtccgagaaacctgccgagagtgtgacctccaaaaaaaccgggcctttgtcagcacaaccctcagttgagaaagaaaacctggctattgaatcccaatccaaaactcagaagaaggggaaaatcagccacgacaagcgcaaaaaaagcagatccaaagctatcggcagcgacacatccgatatcgtccatatctggtgtcctgagggtatgaaaacttcagatatcaaggagctgaacatcgtcctgcctgaattcgagaagacccatttagagcaccagcagcgcattgagtccaaagtttgcaaggctgcaattgccactttttatgtgaatgtgaaggagcagtttattaagatgcttaaggagtcccaaatgctcaccaacctgaaaagaaaaaatgctaaagtcagagcgacagccgagaccacaacaaataagatttag

SEQ ID NO: 124815 - DNA, 1014 bp, Artificial Sequence
  Description of Artificial Sequence: Synthetic coding sequence
atggctccccgcggacgacgacggccccgcccccacagatcagagggagcccgccgaagtaaaaacacactggaacgcacacactctatgaaggacaaggctggccagaagtgtaaacccattgatgtgttcgacttccccgataacagcgatgtcagcagcatagggcggcttggtgaaaatgaaaaagatgaggagacatacgaaactttcgatcccccactgcatagcacggcgatctatgcggacgaggaagaattctcaaagcattgtgggttgtcactcagtagtacccccccaggaaaggaggccaaacggagttctgacacgtccggcaatgaagccagcgagatagagtcagttaaaattagcgcaaagaaacctggacggaaacttcggcctatttcagacgactccgagtcgatcgaggagtcggacacccggaggaaggtgaaaagcgccgaaaaaatctctacccagagacacgaagtgatccggacaactgcatctagcgaactgtctgagaagcccgccgagtctgttacgtctaagaagaccggcccattgtcagcccaaccatcagtggaaaaagaaaatctagctatcgaatcacagagtaaaactcaaaaaaagggaaagatctctcacgacaagaggaaaaagtcaagatccaaagctatcggctcagacacttccgacatcgttcacatttggtgccccgagggaatgaagactagtgacatcaaggaactgaacattgtcctgcccgagtttgagaaaacccatctggagcatcaacaacgcatcgaatccaaagtctgtaaagcggcaatagctaccttttatgttaacgtgaaggaacagtttattaagatgctgaaggaatcgcagatgctgaccaacttgaaaaggaaaaacgcgaaaatgatttctgacatcgaaaagaagcgacaacgtatgatagaggtgcaagacgagctgctacgcctttggactggggctggcctctggtag

SEQ ID NO: 124816 - DNA, 2760 bp, Artificial Sequence
  Description of Artificial Sequence: Synthetic coding sequence
atggcggccgatgtctttatgtgctctcccaggaggcccagaagcagaggtcgtcaggtgctgctcaaaccccaagtctccgaggatgatgacgattcagataccgacgagcccagtcctccacccgcaagcggggccgccacgcctgctcgggcccatgcatctgccgctccacctcccccccgcgctggccctggacgcgaggagccaccccggcgccaacaaataatccattctggtcattttatggtgtccagcccccatagggaacaccctcctaagaagggttatgattttgacaccgtcaacaaacagacctgtcagacctattccttcggaaagacctcttcttgccacctgtctatcgacgcttccctcacaaagctctttgagtgtatgacactggcgtactcaggaaagctcgtctcccctaaatggaagaatttcaagggtctgaagttgcagtggagggataagatccgacttaacaacgccatctggcgagcttggtatatgcagtacttggagaagcggaagaaccccgtgtgtcatttcgtgacccctctggacgggagcgttgatgtggatgaacaccggagacctgaagcgataactacagagggcaaatactggaagagtcgaattgagatagtgatccgggaataccataagtggcgcacctactttaagaaacgattgcagcagcacaaggatgaggacctgtcaagcttggttcaggatgatgacatgctttactggcataagcacggcgacggatggaagactccagtccctatggaagaagatccactgttagatactgacatgttaatgtccgaattttccgacacactgttctccactctgtccagccaccagcccgttgcctggcccaacccgagagaaatcgcacacctggggaacgccgacatgattcaaccaggtctgatcccactccaaccaaatctggatttcatggacacattcgagccatttcaggaccttttctcaagctccaggagtatttttgggagcatgttacccgctagcgcaagtgcccccgtgccagacccaaataatccacccgcccaggagagtattcttcccactactgctctgcctacagtttcacttcctgatagcctgatcgctccgcctacagcaccctccctggcccatatggacgaacaaggctgtgaacatacatctcgcacggaggatcccttcatacaaccaacagactttggacctagcgagccacctctgtccgtgccacagcccttcctcccggtgttcaccatgccactgctgagcccgagtccggcccctccacctatttcacctgtgctccccctggtgccaccacctgctacagctcttaacccaccagcgcctccaacgttccaccagccccagaagttcgccggagtaaataaagctccctccgtcatcacacacactgcctctgctacactcacccatgatgcgcctgctactacattttcgcagagccagggcttggtcatcacgacccaccaccctgcccccagcgccgccccttgcggacttgccctgtcgcctgtgactcgccctccgcagccacggctgacctttgtgcacccaaagcctgtttcacttaccggcggccgcccaaagcaacctcataagatcgtgcctgctcccaagcctgagcctgtgagcctggtcctaaaaaatgcccggattgccccagcggccttcagcggacagccccaagccgtgattatgacgtccgggcctctgaagcgagaaggaatgctagccagtacggtctcacagagcaacgtcgtcattgcccccgccgcaatcgcccgcgctcctggagtgcctgaattccattcgagtatcctcgtaaccgatctgggacatgggacttcatcacccccagctccagtatcccgtctgtttccttccaccgcccaggacccactggggaagggagagcaagtccctcttcatggtgggtcaccacaggttacagtcacaggccctagccgcgactgccctaactctggccaggctagtccgtgcgcgagcgagcagtcgccttctccccagtccccccagaacaattgtagcggaaagtctgacccgaaaaacgtggccgctctgaagaaccggcagatgaagcacatttcggctgagcaaaagcgccgcttcaatatcaaaatgtgcttcgacatgttgaactccctcataagcaataattctaagttgacgtctcatgcgataactctccagaagactgtggagtacattacaaagctgcagcaggaacggggccagatgcaggaggaggcccggcgcctgagggaagagatcgaagagttaaacgcaacaattatctcctgccaacagctgctgcctgcgacaggtgtccctgtgacccggcgtcaattcgaccacatgaaagacatgtttgacgaatacgtgaaaactcggaccttgcagaattggaaattttggattttttccataatcataaagcccttgttcgagagctttaaaggaatggtctctacttcttctctggaggaactgcaccgcaccgctctgtcctggctggatcagcattgcagcttgccaatcctgcgaccaatggtcctgagcacacttcgccagctgtctacttccacttctatcctcaccgaccccgcccagctgccagaacaggcatcaaaggctgtcacgagaatagggaagcgtctcggcgaaagctag

SEQ ID NO: 124817 - DNA, 657 bp, Artificial Sequence
  Description of Artificial Sequence: Synthetic coding sequence
atggatgagcaaggatgcgagcacactagccgaacagaagacccattcatccagccaacggactttgggccctctgagccaccgctttcagtacctcccccccctatttcccctgtgttaccactcgtgcctccccccgctacagcgctgaacccccccgcgccccctacgtttcaccagcctcagaagttcgcaggcgtgaacaaggctcccagtgtcatcacccataccgcctctgcgacccttactcacgacgcccctgcgaccacctttagtcaatcacagggtctggttattaccacccaccaccccgcaccctcagccgcaccatgtggtcttgctcttagccctgtcactagaccccctcagccaagacttactttcgtgcacccaaaacctgtctcactgacgggaggacggcctaagcagccccacaagattgtccccgcaccaaaaccggagcctgtgtcactggtgctgaagaacgcaagaatcgcccccggtgagcccggcggtgaaacgcagtgcggagccccgcctgatccagagggatgctttcctatcccaaaagccttcaagcttgtgaccactaccactaccctcgtgtgtacgtgcatgaggactcacatccatctgaacgagacgaaagtgtcatag

SEQ ID NO: 124818 - DNA, 1581 bp, Artificial Sequence
  Description of Artificial Sequence: Synthetic coding sequence
atggacgaacaaggctgtgaacacacatccaggactgaggatcccttcatccagccaacagattttggcccctcagagccccccctttcggtaccccaacctttcctacccgtgttcaccatgccccttctttcccccagccctgcacctccacccatatctccagtgttgcccctcgtgccaccacctgcaaccgctttgaaccccccagcccctcccactttccaccagcctcaaaagttcgctggagtgaataaagcaccatccgtgatcactcatacagcctcggccacacttactcacgatgctcctgcgaccactttttcacagtctcaaggacttgtgatcacaacacaccaccctgccccatctgcagctccatgtgggttggcactgtctccagtgaccaggccccctcagccgcgattaacttttgtgcaccctaagcccgtttctttaactggtggccgtcccaagcagccgcacaaaatcgttccagcacctaagcctgaacccgtctcgctggttctgaagaatgctcgaatcgctcctgctgccttctctggtcagccccaggcagtcataatgacttctggcccccttaaaagggaggggatgttagcatcgacagtcagccagtccaacgttgtgatcgctcctgctgcaatcgctcgagcaccaggagtgccagaatttcactcaagtattctggttacagatctgggccatggcactagttcaccgccagccccagtgagtaggctgttcccatcaaccgcacaagaccctctaggtaagggcgaacaggtacccctgcacgggggtagtccccaggtgaccgtcaccggccctagccgtgactgtccaaattccggccaggcctccccttgcgcttcggagcagtccccgagcccccagtctccccagaacaactgcagtggtaaatcggacccgaagaacgtggccgccttgaaaaaccgacagatgaagcatatcagcgcagagcaaaagcggcggtttaacatcaagatgtgcttcgacatgctgaactccctgatatcaaataattccaagctgacttctcacgctattaccctgcaaaaaaccgtcgagtacatcacaaaattgcagcaagagcgcggacagatgcaagaagaggcccgacgactccgcgaggagatcgaagaactgaatgcaactattatctcctgtcaacaactcctccctgcaactggcgtccccgtgactaggaggcagttcgaccacatgaaggacatgttcgatgagtacgtgaagacgaggaccctccagaattggaaattctggatcttctccatcattatcaagcccctgttcgagtctttcaagggaatggtgtctacgtcatcactcgaggagctgcataggactgccttgtcctggctcgaccaacactgctcacttccaatcctgcggccgatggtgctctcgactcttcgccagttgagcaccagcaccagtatcctgactgatccggcccagctccctgaacaagcatccaaagccgtgacccgaatcggaaagcggctgggagaatcttag

SEQ ID NO: 124819 - DNA, 2559 bp, Artificial Sequence
  Description of Artificial Sequence: Synthetic coding sequence
atggcaggtgccctggctggtctggctgccggcctccaggttccacgggtggccccctcccccgattcagattcagatacagattcagaggatccttctctccggcggagcgcgggggggctgcttagatcgcaagtaatccattccggccactttatggtgagcagcccgcatagtgactcattgcctcggagacgggaccaggaggggtctgtgggcccgtcagacttcggacctaggagcattgatccaaccctgacgaggctgtttgagtgtttgagtcttgcttatagcggcaagcttgtgtccccaaaatggaagaattttaaaggcttgaagttattatgcagagataaaatcaggctgaataatgctatctggcgggcctggtacatccaatacgtgaagagaaggaaaagcccagtgtgcggatttgtgaccccactccagggaccagaggcagacgcccaccggaagcccgaggcagtcgtacttgagggtaactattggaagcgtcgaattgaggtggtcatgcgcgaataccataagtggcgaatctactacaagaaaagattaaggaaaccatccagggaagacgatctgttggcccccaagcaggccgagggtagatggcctccccctgaacagtggtgtaagcaacttttttcttccgtggtgccggtgctgctgggagacccagaggaggaacctggaggtaggcaactgttagatctgaattgttttctgtctgatatcagcgacaccctctttaccatgactcagtcaggcccatcccctctgcagctcccacccgaggacgcatatgtgggcaatgccgatatgattcagcctgatttgacacccctgcagcctagtctggacgacttcatggacatctccgacttcttcactaattctcggctgcctcagcctcccatgccttccaattttcctgagcccccctccttttccccggtagtggactcgttgttttcctctgggactcttggtcccgaagttccccctgccagctccgcaatgactcacctctccggccacagcagactccaagccaggaatagctgtcccgggcctttggactcaagcgcattcctcagctcagactttctcctgccggaggaccccaaacctcgcctgccacctccccccgttccccctcctctgctgcattatcctcctcctgcaaaggtccccggtttagagccctgcccacccccccccttcccccctatggctcctccaactgctctgctacaggaagaacccctgttctccccacggttcccatttcctaccgttccacctgcccccggcgtctcccccctgccggcgccggccgccttcccgcccacgcctcagagcgtccccagccctgctcccactccattccccatcgaactgctccccctcgggtattctgaaccggcttttgggccatgttttagtatgccccggggaaagccccccgccccttcacctagaggccagaaggcgtctcctcctaccctggccccagccaccgcttcacctcctaccactgctggaagcaataatccatgtctgactcagctcctgactgcagccaagcctgagcaagcactcgaaccacccctggtcagctcaacccttttacgttctcctggatcaccccaggaaaccgtcccggagtttccatgcacctttctgcctccaacccctgctcctacaccacctcgccccccacctggacctgctaccctggctccctctcggccactgctggtaccgaaggccgagcgactgagtccacccgcacctagcggcagcgagcgcagattgtccggggatctctccagcatgccaggccccggtactctcagcgttcgcgtgtctcctccccaacccattctgtcaagaggccggccggatagtaacaagaccgaaaataggagaattacgcacatttccgccgaacagaagagacggttcaacatcaaacttggctttgataccctgcacggcctagtgagcacactttccgcacaacctagtctaaaagtttcaaaggccacaaccctccagaaaacagctgaatatatcttgatgctgcagcaagaaagggccggcctgcaagaggaggcacagcagctgagggacgaaatcgaggagctaaacgcagctatcaatttgtgccaacaacaactgccagctacaggcgtacctatcacacaccaacgcttcgatcagatgagagacatgttcgatgactacgtgagaacacgcacactgcacaattggaaattctgggtgttttcaatcctgattcggcccctgtttgagtccttcaacgggatggtgtccacagcgagtgtccataccctcagacaaacctccctggcctggcttgatcagtactgtagcctgcccgctctcaggcccaccgtgctcaattctctgcgtcagcttggcacaagtacctccattctgaccgaccctggccgcattcccgaacaagcaacgcgcgccgtcaccgaggggacacttgggaagccactgtag

SEQ ID NO: 124820 - DNA, 2496 bp, Artificial Sequence
  Description of Artificial Sequence: Synthetic coding sequence
atggccggagctctggccggcttggctgccggcctgcaggtgcccagagttgcgccatctcctgacagtgattctgacacagattctgaagacccttcattaagacggagtgctgggggcctactgcgttcccaggtgatacattctggccatttcatggtgtctagtcctcactcagattccctccccaggcgacgagatcaagaggggtccgtaggaccctctgatttcggtccacggagcatagaccctacattaacacggctctttgagtgtttatcattggcttactctggtaagttagtgtccccaaagtggaagaattttaagggactcaaattgctttgccgggataagattaggctcaataacgctatctggcgcgcttggtacatacaatacgtgaaacggagaaaaagcccagtgtgcgggttcgtgacgcctttgcaggggcctgaagccgacgcccacagaaaacctgaggctgtggtgttagagggcaattattggaaacggcgaatagaggtggtgatgagggagtaccacaaatggcgcatctactacaaaaagcgtctccgaaagccctcccgggaagacgacctgctggcgccgaagcaggcagaagggaggtggccccctccagaacagtggtgtaagcagctcttcagctccgtcgtcccggtgctgctgggagatcctgaagaagagccaggaggcaggcagcttctcgatttgaattgtttcctgtcggatatatctgacaccctgttcaccatgacccaatcgggaccttcccctctgcagttacctcctgaggacgcctacgtgggcaacgctgatatgatccagccagacctgactcctctgcagcccagcctggatgacttcatggatatctccgacttttttaccaattctagactacctcagcctcccatgccctccaatttccccgagccccctagtttttcccctgttgttgactccctcttctccagcggcaccttgggtcccgaggtgccgcctgcctcttctgccatgactcatctctcaggacatagtaggctccaagcaaggaactcttgccctggtcctctcgatagtagcgcttttctgtcctccgattttttgttacctgaggacccgaaaccgcggctaccacctccgcccgtcccgccccccttgctacattaccccccgccagcgaaggtgcccggtcttgagccttgccctccccccccctttcctcctatggcccctcccacagcattacttcaagaagaacccctgttttcaccccgcttccctttccccactgtcccaccagcccctggagtttctccattgcctgccccagcagccttccctccaacaccccagagtgtgcccagtcctgcacccacgcctttccctatcgagctccttccgctgggctattctgagcccgccttcgggccttgtttctcaatgcccagagggaaacccccagcgccaagcccacgaggccagaaggcaagccccccgacacttgccccggccaccgccagtcccccaactaccgccggttccaacaacccatgtctgactcagctactcacagctgccaagccagagcaggccctcgaacctccgctggtgtcatcgactctgctacggtctcccgggtcccctcaggagacagtaccggaatttccttgtactttcctcccacccacccccgcacctacccccccccggcctcctcctgggcctgcaacacttgcaccttcacgtcctctgctggtcccaaaggctgaacggttaagtccacctgccccatcgggctccgagaggagactgtccggtgatttgtctagtatgccaggccccgggaccttgtctgtgagggtgtcgcccccgcagccaatcctgtcacgcggtcgccccgactcaaacaaaaatcgacggatcactcatattagcgccgaacagaagaggaggtttaacattaagctgggttttgataccctgcatggactggtgagtacccttagcgcccaacccagcctcaaagagcgcgctggacttcaggaagaggcacagcagctccgtgacgaaatcgaagagttgaacgctgccattaacctgtgccaacaacaactccccgcaacaggcgttcccattacccatcagcgctttgatcaaatgcgtgacatgtttgatgattacgtccgaaccaggaccctgcataattggaaattttgggtgttcagcattctaatccgccctctgttcgagtccttcaacggcatggtaagcacagcttccgttcacaccctgcgccagaccagtctggcctggcttgaccagtactgctctttgcctgcccttcgtccaaccgtattaaacagtctgcgccaattaggtacctctacgtccatactgaccgatcccggcaggataccagagcaggcaacaagggccgttactgaagggacgttgggaaagcctctttag

SEQ ID NO: 124821 - DNA, 2280 bp, Artificial Sequence
  Description of Artificial Sequence: Synthetic coding sequence
atggcaggcgccctggctggcctggctgcagggcttcaggtgccgagggtcgccccttcgcctgacagcgactcagacacggacagcgaggacccgagcctgcgcaggagcgctggaggcctgctgcgctctcaggtgatccacagcggccactttatggtgagctccccacattccgatagcttgcccagaaggagggatcaagagggatcggtcggacctagtgactttggccccaggtccattgatcccactcttacgcggctgtttgagtgcttgtctctggcctatagcggaaagcttgtaagccccaaatggaaaaacttcaagggtctgaagctgttgtgccgcgataagatacgcctcaacaacgcgatttggcgagcttggtacatccaatatgtaaaaagacgcaagtccccagtgtgcggattcgtgaccccccttcagggccccgaggcagacgcccaccgcaaacctgaggccgtagtgctcgaggggaactattggaaaagacggatcgagttaccccccgaagacgcttacgtggggaacgcagacatgattcaacctgacttgacgccattacagccctcccttgatgattttatggatatttccgatttttttacaaattcaaggctacctcagcccccaatgccctctaatttcccagagcccccaagttttagccccgtggtcgacagcttgttcagcagcggaacattggggcccgaggtgccacccgcctccagcgccatgactcatctaagcgggcacagccgactacaggcccggaacagctgccccggccccctggacagttcggcgtttctcagttcagactttcttttgccagaggatccgaaacccagactacctccgcctccagtcccaccaccattgttgcattaccctcccccagcaaaagtccctggtctggaaccctgcccaccgcccccatttcccccaatggctcctcctactgcccttttacaggaagaaccacttttctccccccggttcccgtttccaactgttccaccagcaccgggggtttcccctctgccagctcctgctgcgttccccccaacccctcaatctgtcccctcccctgcaccaaccccttttcccatcgaactactgcccctaggttacagcgagcctgcattcggcccttgcttttctatgcccaggggtaagcctcccgcaccctctccccgagggcaaaaggccagtcccccgacactggcccctgcgactgcgtcacccccaaccactgccggcagcaataatccctgtcttacccagctactgacagctgctaagcctgagcaggcgctggaaccgccactggtgagttccaccctgctgcgaagccccggatccccccaggaaaccgtgccagagtttccctgcacctttctgcccccaactcccgcccccacccctcctagaccccccccaggccccgcgacactggctccctcaaggcccctcttggtgcctaaggcagaacgactgtctccacccgcaccatccggcagcgaacgtcgcttatcaggggacctatcttccatgccagggccaggtaccttatccgtccgggtgtctccccctcagcctatcctcagcagaggtcgccctgactcaaataagactgaaaatcgacggatcacccatatctcggcggaacagaaaaggaggttcaatataaaattgggatttgatacgctgcacggcctggtcagtacgctcagtgcacaaccttccctcaaggtctctaaagctactacccttcagaaaacggccgaatatattctgatgctccagcaggagagggcggggcttcaggaggaagctcagcaacttcgggatgagattgaggaactgaacgccgcaatcaatctctgtcagcagcaacttcctgcaactggggtgcccattacgcaccagagatttgatcagatgcgcgacatgttcgatgactatgtacgcacaaggactcttcataattggaaattttgggtgttttccattttaatcaggcctctgtttgaaagcttcaatgggatggtgagtacagctagtgtgcacacactacgacaaactagtctggcctggttagaccaatattgtagcctgcccgccttgcggccaaccgtgttgaattctctgcgccagctcggcacgtccacgagcattcttaccgaccccggacgtattccagagcaggctactagagcagtcactgaaggcacccttggcaagcccctttag

SEQ ID NO: 124822 - DNA, 2553 bp, Artificial Sequence
  Description of Artificial Sequence: Synthetic coding sequence
atggctggcgccctggccggcctagccgctggcctgcaagtacctcgggtcgcacctagtcccgacagtgattcagacacggattctgaagacccttctttgcgccgttcggccggtggtctgctacgctctcaagtcatccactctggtcatttcatggtttcgtctccccattcagactccctcccgcgacggcgagaccaagagggctccgtcggacctagtgacttcgggccccggtccatcgatcctacgctgacgagactgttcgagtgcctcagcctcgcttattccgggaaacttgtctcaccgaagtggaaaaatttcaaaggcctcaagctgctttgtcgggataaaattcgactgaacaacgcaatttggagagcgtggtacattcaatatgtcaaacgacgcaaaagccccgtctgcgggtttgtgacacctctgcagggccccgaggcggacgcccaccggaagcctgaagccgtggtgctcgagggcaattattggaaacgtcggattgaagtggtgatgcgcgaatatcataaatggcgtatatactataaaaaaagactaaggaagcctagcagggaggacgatttgttggcccccaagcaggctgagggaaggtggccaccaccagaacagtggtgcaagcagctgttctctagtgtggtgcccgttctcctcggcgatcctgaagaagagcccggcgggcgccaactactggatctgaactgcttcctttccgatatcagtgacacactgttcacgatgactcagtctggaccttcccccctccagctgccacccgaagacgcctacgttggaaacgcagatatgatccaaccagacctgaccccgcttcagccaagtctggacgacttcatggacattagcgacttcttcaccaacagtaggctaccccagccaccaatgccatctaattttccagagccgcccagcttcagccccgtcgttgattccttatttagcagtggtactctgggtccggaagtccccccagcatcttccgctatgacacatttgtccggccactctcgattgcaagctcgaaacagctgtccaggtcccctggacagtagcgcgttcctcagtagcgattttctgttaccagaagatcctaagccccgcctgcctcctcccccagtgcccccgccactcctccattacccgccacccgcgaaggtcccgggactcgagccttgtccgcctcccccattcccaccaatggcccctccgactgcccttcttcaggaggagccactgttctcaccgcgattccctttccccacagtgcctcctgccccaggagtgagtcctctgcccgcgcctgcagccttcccccccactccgcaatcagttcccagcccagccccaacgccgttccctatagagcttctgccgctgggatactccgagcccgcttttggcccatgcttctccatgcctagggggaaaccccccgcaccaagtcccagggggcaaaaggctagtccaccaacattggcccctgcaacagcctccccccccactactgcgggatcgaataacccctgcctaacccagctgctgactgctgccaagcccgagcaggctctggagcctcccctcgtctcatctacgctccttcgttccccgggctcacctcaggaaactgtgcctgaatttccttgcacctttctgccgcctacccccgcacctacacccccccgtcccccaccgggcccagcaacgctggcgccatctcggcctctactcgtgccaaaagcagaacgcttatcaccccctgccccaagcggctcagagagacggctgagtggagatttgagctccatgcccgggcctggaacattatcggttcgggtcagccctccacagcctatcttgtctcggggcaggccggatagcaacaaaaaccggcgcataacccatatctctgcagaacagaaacgcaggttcaatatcaagctaggttttgataccctgcatggcctggtgagcacactctccgcacagccgtctctcaaagtgtcgaaagctacaactcttcagaaaactgctgagtatatcctaatgctacagcaggagcgggccggactccaggaggaggcacagcagctgcgggatgaaattgaagagctgaacgccgccatcaacctgtgtcagcagcaattaccagccaccggggtccctatcacccatcagcgctttgaccagatgagggacatgtttgacgattatgtgaggactcggacactgcataactggaaattctgggtattctccatcttaatccggcccttgtttgagtcctttaacggcatggtgtcaactgcctccgtgcataccctccggcaaactagcttggcttggcttgatcaatattgttcactgcccgccttgcggcctactgtactcaacagccttagacagctggggacatcaaccagcatcctcacggaccccggccggattccagaacaggccacaagagcagtgactgagggcacgctggggaagccgttgtag

SEQ ID NO: 124823 - DNA, 2502 bp, Artificial Sequence
  Description of Artificial Sequence: Synthetic coding sequence
atggccggcgctcttgctggcctggccgctggtttacaggtccctagagtggccccaagccctgacagcgacagcgacacagacagcgaagatccaagcttacggaggtcagctggaggcctgctgaggtctcaggttattcattctggacacttcatggtgtcttccccccacagcgacagcctgccccgccgacgcgaccaagaggggtctgtgggaccctcagacttcggacctaggtccatcgatcctacattgaccaggctgttcgaatgtctgagcttggcgtactcaggcaaattggtgagccctaaatggaaaaattttaagggcctgaagctcctctgtcgggataaaatccgacttaacaatgcgatttggagggcgtggtacattcagtacgtgaagcgtcggaagtcacccgtttgtgggtttgttacccctttgcagggccccgaggcagacgcgcaccgcaagccggaggccgtggtcttagaggggaactactggaagcgcagaatcgaagtcgtgatgagagaatatcacaaatggagaatttattacaagaagagactgaggaagccgtcacgggaagacgacttacttgctcctaagcaggccgaggggaggtggccaccgcccgaacaatggtgtaagcagctcttttcctctgtggtccctgttctcttgggcgatcccgaagaggagcccgggggacggcaactgctggacctgaattgcttcctgtccgacattagcgacacactgtttaccatgacccaatccgggccttcacctttacagctaccaccagaagacgcgtacgtcggtaatgctgatatgattcagccggacctcacccctctgcagcctagcctggatgattttatggatatatccgacttcttcactaattcccgactgccacagcccccaatgccctccaactttccagagcctccatcgtttagtcccgtcgtcgactccttgttctcttccggcactttaggacctgaagtaccgcccgcatcctccgccatgacacacttaagtggccacagtaggctgcaggcgagaaattcctgcccgggaccgctggatagttctgcattcttatcgtccgacttcctactgcccgaagatcccaaaccacggctgcctcctcctcctgttcctcctcctctgttgcattacccccccccggctaaagtgccgggcctggaaccttgccccccacccccctttcctcccatggcaccccccacagcactgctgcaggaagagcctctgtttagtccgcgatttcccttccccactgtacctccagcacccggagtcagccctcttcccgcgcccgccgctttccccccgacacctcagagcgttccaagtccagcccctactcccttccccatcgagctattacctcttggatactcagaacccgcctttggtccctgcttctcaatgccgcgaggaaagccgccagccccttcccccagaggacagaaagcgtctcctcccactttagcccccgctacggccagtccccctaccactgccgggtctaataatccctgtctgacccagctgctcactgctgctaaaccagagcaggccctcgaacctcccctggtgtccagtactctgctgcggagccccgggagccctcaggaaaccgtgcccgagtttccatgcacattcctaccaccaactccagcaccaacacccccacggcctcctccaggacccgctacattggcaccgtctcgcccactcttggttcccaaagccgaacgactcagccccccagccccgagcgggtctgagaggcggctgtcaggggatctgtcaagcatgccgggacccgggaccctctcggtgagagtctctccccctcaacccattctgagtcggggccggcctgactccaacaagacagaaaatcgaagaatcacacacataagcgctgaacagaaacggagatttaatattaagctgggattcgataccttacacggcctggtttctactctttctgcccagccaagcctgaaggagcgggccgggcttcaggaggaggcccagcagcttagggacgagattgaggaattaaatgccgccattaatttgtgtcaacaacagctccctgcaaccggggtgcctatcacacatcagcgattcgatcaaatgcgtgatatgtttgatgattacgtcagaaccagaaccctgcacaactggaagttttgggtgtttagcatccttatcagacctctgttcgaaagcttcaatggtatggtgtccacagcctccgttcataccctgcggcagacaagtctggcgtggctggaccagtactgtagtttgcctgctctgcgacctactgttctcaacagtctgcgccagctaggaactagcacgagcattttgaccgatcccggccgcattccggagcaggcaaccagagctgttaccgagggcacattggggaagccgctctag

SEQ ID NO: 124824 - DNA, 1059 bp, Artificial Sequence
  Description of Artificial Sequence: Synthetic coding sequence
atgaacacgattgtgttcaacaaactctcaggcgcagtactgttcgaggacggaggggccagcgaacgggagaggggagggcggccttatagcggcgtactcgacagtcctcatgcgaggccggaggtggggattccggatggcccacccctgaaagacaacttgggacttaggcacagacggactggagcccgacagaacgggggaaaggtcaggcacaaaagacaggcacttcaagacatggcacgcccactcaagcaatggctttacaaacatcgggataacccgtatccaaccaagacagagaaaattctactggccctggggagtcaaatgactcttgtgcaggtttctaactggtttgcaaatgcgcgccgcaggctgaagaacaccgtccggcagcccgacctttcttgggcactccggattaaactttacaacaagtacgtacaggggaatgccgaacggctttcagtatcatcagatgacagctgtagcgaagacggggaaaaccccccacgaactcacatgaacgaaggcggatataacactcctgtccaccatccagtgatcaagagcgaaaactccgtgattaaagccggggtgagaccagagtcccgggcttccgaggattacgtcgcccctccaaaatacaaaagctcactgctgaataggtatcttaatgatagcctgagacatgttatggccacgaataccacaatgatgggcaaaactcggcaaagaaaccactccggatctttcagctcaaacgagttcgaagaggaactggtcagtccctcttccagcgagactgaaggaaacttcgtctaccgaacagacacccttgaaaacggatctaacaaaggagagagtgccgccaaccggaagggaccatcaaaagacgatacctattggaaggagattaacgccgcaatggccctcactaacctcgctcaggggaaggacaagttgcagggcaccacatcttgcataatccagaagtcctctcatattgcagaagttaaaaccgtgaaggtgccactcgtccagcagttctag

SEQ ID NO: 124825 - DNA, 1059 bp, Artificial Sequence
  Description of Artificial Sequence: Synthetic coding sequence
atgaacactattgtttttaacaagctatccggggctgtattgttcgaggacggcggagctagcgaacgtgagcgcggcggcagaccatatagcggcgtgctggactctccccacgcccgccctgaggtcggcatccctgatgggccccctctcaaagacaatctgggattgagacaccgacggaccggggcccggcagaacgggggaaaagtgagacataagcggcaagctctgcaggacatggctcgtcccttgaagcagtggctgtacaaacatcgggacaacccgtatcccactaagaccgagaagattttgttggcactaggctctcaaatgacactagtacaggtatcaaactggtttgccaatgcccgtcgcagactcaagaacacagtcagacagcctgacctgagctgggcactccggataaaattatataataaatacgtccaggggaacgctgagagactatccgtaagttcggacgactcttgttctgaagatggcgaaaatcccccccggacacatatgaatgaagggggatataatacgccagtacaccatcccgttatcaagtcagaaaattcagtgatcaaggccggagtgagaccggaaagtagagcttcagaggattatgtggcccccccaaagtataagtcctccctgctcaatagatacctgaacgactcacttaggcatgtaatggcaaccaatacaaccatgatggggaagacacggcaacggaaccattccggcagcttctcaagtaatgagttcgaagaggagctggtttcccccagcagtagcgagacagagggcaactttgtttaccgcactgacaccctcgagaatggaagcaataagggtgaatccgccgcgaatagaaagggacctagtaaagatgacacctattggaaagagattaacgctgccatggccctgactaacttggcccaggggaaggataaactgcaagggaccacctcctgcatcattcagaaatcctcgcatatcgcagaggtgaagacagtgaaagtcccactggtccagcagttctag

SEQ ID NO: 124826 - DNA, 177 bp, Artificial Sequence
  Description of Artificial Sequence: Synthetic coding sequence
atgaataccatcgtgttcaacaaactttcaggcgccgtgctctttgaagacgggggcgccagtgagcgggaacgaggcgggcgtccatattccggcgttttagattcaccccatgcacgacctgaggtcgggatccctgatggtccacccctgaaggacaaccttggacttaggtag

SEQ ID NO: 124827 - DNA, 288 bp, Artificial Sequence
  Description of Artificial Sequence: Synthetic coding sequence
atgaactttgacttcccttttaagaagggctccggcattccactcctcaccaccaatctttcgccccagtgtctatctttgctgcacgccatggtggcttacgatcctgacgagaggatcgccgcccatcaggctctgcagcatccctattttcaggaacagcgaactcaaaatggatctgaggatgaggcttccgccgtacttctgcctatccagaccagatcaagtttgaatcctttgctaagcacatgcatgctgcccggtaggagcgtgaccctgctggtctag

SEQ ID NO: 124828 - DNA, 1260 bp, Artificial Sequence
  Description of Artificial Sequence: Synthetic coding sequence
atgaagaattacaaagcaatcggtaaaattggagaaggcacgtttagcgaggtgatgaagatgcaaagcctcagagatggaaattactacgcatgcaagcagatgaagcagcgattcgagtctattgaacaagtcaataacctcagggagattcaggccttgaggagactaaatccacacccgaatatcctcatgctccatgaggttgtcttcgatagaaagtctggatccttggcactcatttgcgagcttatggatatgaatatatacgaactgattcggggacgcaggtatcccttgtcggaaaagaagataatgcattatatgtatcagctctgtaagagcctggatcatatccaccggaatggaatcttccatcgcgacgtcaaacccgagaacatcttgataaaacaggacgtcttgaaactaggtgatttcggatcttgcaggtctgtctactctaaacagccctacacagagtatatcagtaccagatggtaccgagcccccgagtgtttacttaccgacgggttctacacctacaagatggatttgtggtctgccggatgcgtgttttatgagattgccagcctccagcccctctttcctggggtcaacgagcttgatcagattagcaaaattcacgacgtgatcggaaccccagcacagaaaatcctgactaagtttaagcagtctcgggccatgaatttcgattttccttttaaaaagggctctggcattcctctccttaccacaaacctatccccccagtgtctctctcttctgcacgcaatggtcgcatacgatccagacgagcgcatagcagctcaccaagctctccaacacccctactttcaggagcagagaaagacagaaaagcgcgccttaggatcacatagaaaagccggcttccctgaacaccccgtggccccagaaccgctgagtaattcctgtcagatttcaaaggaggggagaaagcagaagcagagcctgaagcaggaggaggatagacctaaacggcgcggacccgcctacgtcatggaactgcccaagttgaaactgtctggcgtggtgagacttagctcctactcctccccaacgttgcagagtgtcttgggatctggcactaatggtcgagtgccggttctgagacctctgaagtgtatccctgcttcaaagaagactgacccgcaaaaagatctgaagcctgcgcctcagcagtgtaggctgcctaccatcgtaagaaaagggggccgctag

SEQ ID NO: 124829 - DNA, 2667 bp, Artificial Sequence
  Description of Artificial Sequence: Synthetic coding sequence
atggccggcgccgctgccgagtctgggcgggagctgtggacattcgctggatcccgcgacccatctgcacccagattggcctatgggtatgggcctgggtctctgcgggagttgcgagcccgtgagttctccagattggctgggacagtgtacctggaccacgcaggagctaccctattcagtcagagccagctggaaagctttacctccgatctgatggaaaatacatatgggaacccccattcacaaaatattagcagtaagctgacccacgatactgtggaacaggttcgttataggattctcgcccactttcacacgacggctgaagactacaccgtgatttttactgctggctccacagctgctctgaagctggtcgccgaggcttttccatgggtgagccaagggcctgaatcctcaggcagtcggttttgttatttgacagattctcacacgagcgtggtgggcatgagaaatgtgactatggctattaatgtgatttcgactccagtgaggcctgaagacctgtggtccgcagaagaacgctcagcctccgcatccaatcctgattgccagctgcctcatctgttctgttatcctgcccagagcaactttagcggcgtgaggtatcctctgtcttggatcgaagaagtaaagagcggccgactacaccctgtctcaacccccggaaaatggtttgttttgctcgatgccgctagctacgtctcaacatccccactagatttgtccgcccatcaggccgacttcgttccaatttctttctacaaaatcttcggatttccaacaggcttaggagccctactcgtgcataaccgcgccgctccgctcttaaggaagacctattttggaggcgggactgcctcagcctacctcgccggggaagatttttatataccgcgccagagtgtggctcagaggttcgaggacgggacaatttcttttctggacgtgatcgccctgaagcacggattcgatactcttgaacgcctcacaggggggatggagaatattaagcagcacaccttcactttagcgcaatacacatacgtcgccttgtctagccttcagtatcccaatggggctccagtagtccgcatatactctgactcggagttttcatctcccgaagttcaaggaccaatcatcaattttaatgttctcgacgacaaaggcaacattatcggatatagccaagtagacaagatggcctctctctacaacatccacctcagaaccgggtgcttttgcaatacgggggcatgccaaaggcacctgggtatctcaaatgagatggtgcggaagcactttcaggccggccacgtctgtggggacaacatggatttgatcgatgggcagcccactggaagtgtgcggatttcattcgggtatatgagtaccctggacgatgtgcaagcgttcctccgctttatcatcgacactaggctccatagtagcggagattggcccgtgccccaagcgcacgctgacactggagagactggagcaccttctgccgattctcaggccgacgtgatccccgctgtgatgggtaggagaagtttgtcccctcaagaggatgctctcacggggtcgagagtctggaataacagcagcacggtgaacgctgtgcctgtggcgcctcccgtgtgcgatgtggctaggacacagcctacaccatctgaaaaggccgcgggcgtactggagggggccctgggacctcacgtcgttaccaatctctacctgtaccccatcaagtcatgtgccgctttcgaagttaccagatggcccgtcgggaatcagggtttgttgtacgaccgcagctggatggttgtgaaccacaatggagtgtgcctgtctcagaaacaggagcctcgtctatgtttgattcagccttttattgatctaaggcagagaattatggtcataaaggccaagggaatggagccaatcgaggtccctctggaggagaattccgagagaacacaaattcgtcaatcaagggtgtgcgccgaccgcgtttccacttacgattgcggagaaaagatcagctcttggctgagtacattcttcggtcgcccctgtcatttgatcaaacagtctagtaacagccaaaggaacgccaaaaagaagcacgggaaagaccagctcccaggcacaatggccacattatccttagttaacgaggcccaatacctgttgattaacacatcatccatcctggagttacataggcagctgaacacatctgacgaaaatgggaaagaagaactgtttagtttaaaagatctcagcctgagattcagagctaatatcattatcaacggaaagcgggcgtttgaggaggagaagtgggatgagatctcaataggcagcctgaggtttcaggtcctgggcccgtgccatcggtgccagatgatatgcattgaccagcagacgggtcagagaaaccagcatgtcttccaaaaattgagcgagtcaagggaaacaaaggtcaactttggaatgtaccttatgcacgcaagtctggatctgagctcaccctgctttcttagcgtgggcagccaagtactgcccgtgctgaaggagaatgtggaggggcacgacttgcccgccagtgagaagcaccaggacgtgacctcatag

SEQ ID NO: 124830 - DNA, 1863 bp, Artificial Sequence
  Description of Artificial Sequence: Synthetic coding sequence
atggcagctcgcccgctctcccggatgcttcgacgactgctgcgcagctctgccaggtcctgtagctcaggagccccagttacacagccttgccctggagagtccgcaagagccgcgagcgaagaagtctcacgaaggagacagtttttgagggagcatgcagcgccatttagtgctttcctcacggacagcttcggaaggcagcacagctacctgagaatatccctgacggagaaatgtaacctgaggtgccagtattgcatgcccgaggagggggtccctctcacacccaaagcgaatctcctaacaacggaagagatactcacgcttgctcgcttatttgttaaggagggtatcgacaagatccgcctgacagggggagagcctttaatccgacctgatgtcgtcgacatagtagcccagctgcaacgcttggagggcctcagaacaataggcgtgactaccaacggcataaatctggcacggctcctgcctcagctgcagaaagccgggttatcagctatcaacatctcgctggacactctcgtgcccgccaaatttgagttcatagtaaggcggaagggctttcataaagtcatggagggtatacataaagccatcgagctcggctacaatccggtgaaagtcaattgtgtggttatgcgcggactgaacgaagatgaacttctggacttcgccgcactgaccgaagggttgccactcgatgtgcggtttatcgaatacatgcccttcgacgggaacaaatggaacttcaaaaaaatggtgagttacaaagagatgctggacacggtacgtcaacagtggcctgagctagaaaaagtccctgaagaggaatcgtctaccgccaaggcatttaaaattcctggctttcagggccagatatcattcataacctctatgtcagaacatttttgcggtacatgtaatcgcctgcgcattacagcagacggcaaccttaaggtctgcctctttggcaatagcgaagttagcctgagggaccacctccgggcaggagcatcagaacaggaacttctaagaatcatcggagcagccgtcgggcggaagaagaggcagcatgccgagctttttctgatgttcccaaatagtccaccggccaacccctcaatcttctcctgggatcctcttcacgttcagggcctgcgccctcgcatgtctttcagcagccaggtcgcaaccctgtggaaaggatgcagagtccctcaaacacctcctcttgcgcagcaaagactcgggtcgggaagctttcagaggcactacaccagcagagctgattctgatgccaattcaaagtgcttgtcaccaggctcatgggcatccgccgctcccagcggcccccaattgacatctgaacaactcacacacgtagattctgagggacgagcggctatggtggacgtgggccggaagccggacacagagagagtggcagtcgcatcagccgtcgtgctgctcggtccggtagcatttaaacttgtccagcagaatcagctgaaaaaaggcgacgcactggtcgtcgcccaactggcaggggtgcaagctgctaaggttacctcacagctcattcctttgtgtcatcacgtcgccctgtcgcatattcaggtgcagctcgagctggatagcacccgtcacgcggtgaagatccaggcatcatgcagagctcggggtcctaccggggtggagatggaggcactcacttcagccgccgttgccgccctgacactgtatgatatgtgcaaggccgtttctagagacatcgtgctagaggaaatcaagctgatctcaaaaaccggaggacagagaggagactttcacagggcctag

SEQ ID NO: 124831 - DNA, 1911 bp, Artificial Sequence
  Description of Artificial Sequence: Synthetic coding sequence
atggctgcgagacctcttagcagaatgctgcgtcggctgcttagatcttctgcacgcagctgcagcagcggggcccctgttacacagccatgcccgggagaatcagctagggcagcttccgaggaggtgtcacggcgccgacaattcttgcgcgaacatgcggccccattctctgcctttttgacagattccttcggtaggcagcacagctatttgagaatctctctcacggaaaaatgcaatttgcggtgtcagtattgcatgccagaggagggtgtccccctaacccccaaggccaacctcctgactactgaggaaattctcactctggcgagactctttgtgaaagagggtatcgacaagatacgtctgaccggcggcgagccccttatacgccccgatgtcgtggacatagtcgctcaactacagcggctggaagggctccgtacgataggggtgaccactaacggaatcaacctggctcggcttctgccacagctccagaaagccggattgagcgcaatcaatatctccctcgatacacttgtgcctgctaagtttgagttcattgtgcgccgaaaaggattccacaaagttatggaaggcatacataaggcaattgagctcggctataatccagttaaggttaattgcgtggtcatgaggggattgaatgaggatgaattgcttgatttcgcagctctaactgaagggctgccattagacgtgagatttatcgagtatatgccattcgacggtaacaaatggaacttcaagaaaatggtgagttataaggagatgttagacactgtgaggcaacagtggccagaattggaaaaagtccccgaagaggaatccagcaccgccaaagctttcaagatccccggcttccaggggcagatctccttcatcacctcaatgtccgaacatttttgcggaacttgcaatcgcctaagaatcacagccgacggcaacctcaaagtgtgcctgttcggcaattcagaagtcagcctgagagaccacctgcgcgcaggcgcatccgagcaggaactgctgcggattatcggggccgccgtggggcgcaagaagcggcaacacgctggcatgttttctatctcccagatgaaaaatcggccaatgatcttgattgaacttttcttgatgttcccaaattctccacccgcgaatccatctatcttctcgtgggatccattacacgtgcagggcctgcgaccccgcatgtccttcagcagtcaggtggctaccctgtggaagggctgccgggttccccaaacccccccactcgcacagcagcggttgggaagtggtagttttcaaaggcattacacttctcgggccgatagcgacgccaactccaaatgtctgtctccaggctcctgggccagcgccgctccctctggacctcaattaacctcagagcaattaactcatgtggactctgaaggaagggccgcaatggtagacgttggacgcaagccagatacagaacgggtggccgttgccagtgccgttgtgttgcttggccctgtggcctttaagctcgtgcagcagaatcaactgaaaaagggcgacgctctggtggtcgctcagctggccggggtgcaggctgccaaagttacaagtcagttgatccctttgtgccatcacgtggcactgtcccacatccaggttcaactcgaacttgactccacacggcatgcagtgaagatccaggcatcctgtcgggcccgcggacctacaggggtggagatggaagccttgacctccgccgccgtagccgccttgaccctgtatgatatgtgtaaagctgtgagccgggatatcgttctggaggagattaaactcattagcaagacaggaggccagaggggagatttccaccgggcatag

SEQ ID NO: 124832 - DNA, 456 bp, Artificial Sequence
  Description of Artificial Sequence: Synthetic coding sequence
atgccctttgatgggaacaagtggaactttaagaaaatggtcagctacaaagagatgctcgatacagtgagacagcagtggcccgagctcgaaaaagtcccggaagaagagagcagtactgccaaggctttcaagattcccgggtttcagggacagatttcatttattacctctattttgacagttgcgagatcctgctggccacttttcctctggcctccgtctagcgagacaggctgcgctcacatgggtcactcacccaaggattcctgccaaaccactcagccaactccaggcccagtgcacggctgttccactcatccttctcttttctggagcatcagcgggaaagagaaacttatgattgactgcctgcacccacatagtgcccagattaagctgagatgccagctgtgtaggtgtaaaaacgaggacacagtctgggtgggtcattag

SEQ ID NO: 124833 - DNA, 1071 bp, Artificial Sequence
  Description of Artificial Sequence: Synthetic coding sequence
atgtggaaatcttggaagcttcgaacagatgtgcgcgaggtttcccgacgcagacaattcttacgcgagcacgcggctccattctccgcctttctgaccgactcatttggccgccagcacagctacctacggatttccctaacagaaaaatgtaacctgcggtgccaatactgcatgcctgaagagggtgtgccattaaccccaaaagccaatctgttaacaaccgaagagattttgactttagcccgtctgtttgtgaaagagggcatcgataagatccgcctcacgggcggggaaccattgattagacccgatgttgttgacatcgttgcccagctgcagcggctggaaggtcttcgtacgatcggggtcactactaatggcataaacctggccaggttgctgccacaactgcagaaagctgggctttccgcgataaacatctctctcgataccctcgtgcccgcaaaattcgaattcatcgtcagaagaaaaggtttccacaaggtgatggagggtatccataaggctattgagttaggatacaaccccgtgaaggtgaactgtgtggtcatgcggggtctgaatgaagatgaactgctggatttcgccgctctgaccgaagggctaccattggacgtccgcttcatcgaatacatgccttttgatggcaacaaatggaacttcaaaaagatggtaagctacaaggagatgttagatacagttcgccagcagtggccagaattggaaaaggtcccagaggaagagagtagcacagcaaaagcattcaagattcctggatttcagggccaaatctccttcatcacttcaatgtctgagcatttctgcgggacatgtaaccggctgaggataaccgctgatggaaacctcaaagtttgtcttttcggaaactcagaggtcagcctccgagaccatttgcgcgccggcgccagtgagcaggaactgttacggattattggagccgctgtcggtcgcaagaaaaggcagcacgcgggtatgttcagcatttcccagatgaaaaaccggcctatgatcttaattggggggtag

SEQ ID NO: 124834 - DNA, 1158 bp, Artificial Sequence
  Description of Artificial Sequence: Synthetic coding sequence
atgtggaagtcgtggaaactgcgtacagacgtgcgggtaagggaaggtgctgggggctctccatgtgcatcatcacagcccggatcccgaggaccgtgctttctgccaggactctcatcccaagaagtgtctaggaggagacagttcttgagggaacacgcagctccattctccgccttcctcaccgactcctttggacgccagcacagctaccttagaatctctctcacggagaaatgtaatcttcgatgtcaatactgtatgccagaggagggagtgcctctgacccccaaggccaatctcctgaccacagaagagatcctcaccctggctagacttttcgtaaaggagggaatcgacaagatcagactcacgggcggcgagcccttgatccgaccagatgtggtggacattgtggcccagttgcagcgactcgagggtttgagaaccatcggcgttacaactaacggaattaacctggcacgcctgctacctcaactgcagaaggccggactttcggccatcaatatcagcttagatacgctcgtgccggctaaatttgagttcattgtccgccggaagggatttcataaggtgatggaggggatacataaggctatcgagttgggctataacccagtcaaggtcaactgtgtggtcatgagaggtctgaacgaggatgagctcctggatttcgcagccctgacagaggggttacccctcgatgtgcgatttattgaatatatgcctttcgatggaaacaagtggaattttaaaaagatggtttcctacaaagaaatgctggacaccgttcggcagcagtggccggaactagagaaagtccccgaggaggaatcatctaccgccaaggctttcaagattcccggttttcagggacagatcagctttatcacctcaatgagcgagcacttctgcgggacatgtaaccgcctgaggatcacagccgatggcaacctcaaagtctgcctgttcggcaacagtgaggtgtctcttcgtgaccatctcagagcgggtgctagcgagcaggagctcctgaggatcatcggcgccgccgtggggcgaaagaaaaggcaacacgccgggatgttctcaattagtcagatgaagaaccgccctatgatacttatcggaggctag

SEQ ID NO: 124835 - DNA, 1158 bp, Artificial Sequence
  Description of Artificial Sequence: Synthetic coding sequence
atggcggcccgccccctctcccgaatgctgcggagacttctccgcagttcagcccgctcttgttccagcggcgcgcctgtgacacagccatgtcctggcgagagcgccagagccgcgagtgaagaagtatctcggcggcgacagtttctgcgcgaacatgctgcacccttttcagcattcctaacagactcgttcggaagacagcattcttacttgaggatatccttaacagaaaagtgcaacctgcggtgtcagtattgtatgcccgaagagggcgtaccactgacacctaaggcaaacttgctgactaccgaagagatcctcacactggctagactctttgtgaaggaggggatcgacaagatccgcctgacgggaggggaacctctgattaggcctgatgtggtggatattgttgcccagctgcaaagactcgaaggtctaaggacgatcggcgtaaccacaaatggcattaacctggctcgtttgcttccccagctccaaaaggctggcttgtccgccatcaacatttccctagatacgctggtacccgcaaaattcgagttcatcgtgcgaaggaaaggcttccataaggtcatggaggggatccataaagccatagaactcggctacaatcccgtgaaagttaattgcgtagttatgcgtgggttgaacgaagacgagctgctagattttgccgctctgaccgagggcctgccgctggacgtgcggttcattgagtacatgccctttgatggcaataagtggaacttcaagaaaatggtcagttacaaggagatgctggacacagtaaggcaacagtggccagaactcgagaaggtgcccgaggaagagagcagcactgccaaagctttcaagattccaggctttcagggtcagatttccttcatcacttccatgagcgagcatttctgcggcacctgcaataggctccgcattacagccgatggtaatctgaaagtgtgtctctttggaaacagcgaggtgagcctccgggatcatttacgcgcaggagcatcagaacaagaattgttgagaatcatcggcgcagccgtgggtcgcaaaaagaggcagcacgcagggatgttctcaattagccagatgaagaataggcccatgatattgatcggtggatag

SEQ ID NO: 124836 - DNA, 1602 bp, Artificial Sequence
  Description of Artificial Sequence: Synthetic coding sequence
atgcccgaggagggcgtccctctcacaccaaaggctaatttgctgaccacggaggaaattctgaccttggctcgcctatttgtgaaggaaggcatcgataaaattcgcctgaccggtggagagcccctgataagaccggacgttgtggacatcgttgcccagctgcaaagactcgagggcctgaggacaataggggtgacgactaacggcattaatcttgctcgcttgcttccccagctacaaaaggctggcctatccgccataaatatctctctcgataccctggtgcccgcaaaattcgagttcattgtgcggcggaaggggtttcacaaagtgatggagggtattcacaaagccattgagctgggatataaccccgtgaaggtcaattgcgttgtcatgcggggcctaaatgaggacgagctgctcgactttgctgcactcactgaggggctgcctttggatgtgagattcatcgaatacatgcctttcgacgggaacaagtggaatttcaagaaaatggtgagctacaaagaaatgctagacacagtgcgtcagcagtggcctgaattggaaaaggtgccggaggaggaatcatcaaccgctaaggcgtttaaaataccgggattccagggacagatttccttcataacttccatgagcgaacatttttgtgggacttgtaatcggcttcggattaccgccgacggtaatctcaaagtatgtctcttcggaaattccgaggtctctttgagagaccaccttagggcaggtgcctcagaacaggaacttctgagaatcattggcgccgctgtgggccggaaaaagaggcagcacgctgagttgttcctcatgtttccgaactctccacctgcaaacccctccatattcagctgggacccactccatgtgcaaggcctgcggcctcgcatgagtttcagctcacaggtagctaccctttggaaaggatgccgcgtgccacagacccccccgctggcccagcagaggctcggttccggcagcttccagaggcattacacaagtagagccgattcagacgctaattccaagtgtctgagtccgggaagctgggctagtgcagctccatccggaccccagttgactagcgaacagctgacccacgtagactctgaggggagagccgccatggtggacgtgggccgcaaaccagacactgagagggttgccgtggcctccgccgtagtcctgctggggccagttgcattcaagcttgttcagcaaaaccagctgaagaaaggtgatgcactagtggtggctcaactggccggggtgcaggcggctaaggtcacctcccagctgatacccctctgtcatcacgtggccctgtctcacatccaggtgcaacttgagctggattctactagacatgcagtcaagatccaggcatcctgccgcgctcgggggcccacaggggtggaaatggaggcgcttactagtgcagctgttgctgcattaacactgtacgatatgtgtaaagcagtgtcgcgcgacatcgtgctcgaagagataaaactgatcagcaagactggcgggcaacgcggggatttccaccgcgcatag

SEQ ID NO: 124837 - DNA, 1911 bp, Artificial Sequence
  Description of Artificial Sequence: Synthetic coding sequence
atgtggaagagctggaaactgaggaccgacgttcgagtccgagagggagcgggtgggtctccatgcgcttcaagtcagcccggctcacgcggaccatgctttctgcccggacttagtagccaggaagtgtcacgacggaggcaatttcttcgcgaacacgccgcgccttttagcgcttttctcactgacagcttcggccggcagcatagctacctgcggatcagcctcaccgagaagtgcaacctgcgttgccaatattgcatgccagaggaaggggttcccctgaccccaaaggccaatctgctgaccactgaggaaatcttaaccctggctagattatttgttaaggagggtatcgacaagatacgattaacagggggagaacccttaattcgaccagatgtcgtcgacatcgtggctcagctgcagcgcttagaggggctacggactatcggggtcacaacaaacggtattaacctagccagactcctgccccagcttcagaaagcagggctttctgcaattaacatctcattggatactctggttcctgcaaaattcgagttcattgtgcgacggaaaggcttccataaagttatggaaggcatccataaggctatcgagctcgggtacaatccagtaaaagtgaactgtgttgtaatgcggggcctgaacgaggatgaactgttagatttcgctgcattaacggaggggctgccacttgatgtgcgcttcatcgaatacatgccctttgatggcaacaaatggaacttcaagaagatggtcagctataaagagatgttggatactgtccggcagcagtggcctgaactggagaaagtgcctgaagaagagtccagtactgccaaagcctttaagattccagggttccaaggccagattagcttcataacatcaatgagtgagcacttctgtgggacctgcaatcggctaagaatcaccgcagatgggaacttgaaggtgtgcctttttggcaattcagaagtgtctctcagagaccatcttcgcgccggggcctctgaacaggaactgctgcggatcatcggcgcggccgtaggcaggaagaagcgccagcacgccggcatgttctccattagtcaaatgaaaaaccgccctatgatcttgattgagttattcctcatgtttcctaactcaccaccagcgaatcccagtatatttagctgggatcctcttcatgtccagggcttgcgccctcgcatgtcattttcttcccaggtggcaactttgtggaaggggtgtcgggtcccccaaaccccaccactggctcagcagagactgggaagcggaagtttccagcgtcactacacaagtagagcggactcagacgccaactcgaagtgcctgtcacccggctcgtgggcctctgccgccccctccggcccccaactcacgtccgagcaactgacgcacgtagattcggagggaagagctgcaatggttgatgtggggcggaagccagatactgaaagagttgctgttgcaagcgctgtggtactgttaggtccagtggccttcaagctcgtccagcagaaccagctcaagaaaggggacgcccttgtggttgcacagctcgccggagtacaggctgctaaggtgacatctcagcttatcccattgtgtcatcatgtcgcactgtcacatatccaggtgcaattagagttggacagcactcggcacgctgtgaagattcaggccagttgtagggctaggggccccacaggcgtggaaatggaagccctgacaagcgcagccgtcgctgctctgaccctgtatgacatgtgcaaggcagtcagcagggacattgtgttggaggagatcaagcttatttcaaaaaccggcggacagaggggcgacttccatagggcctag

SEQ ID NO: 124838 - DNA, 1071 bp, Artificial Sequence
  Description of Artificial Sequence: Synthetic coding sequence
atgtggaaaagttggaaacttagaaccgacgtgagggaggtgtcccggaggcggcagttcctgcgggaacacgccgctcccttttccgcttttctgaccgattcttttgggcgtcagcattcctacttacggatttcactgaccgagaaatgcaatctcaggtgccaatattgcatgcctgaggaaggtgtgcccctcactcctaaggctaacctgcttactactgaggagattctcacgctggctaggctgtttgtgaaagaaggcattgataagatccgactgaccggcggagagcctttgatcagacccgatgttgttgatatagtagctcagctgcagaggctcgagggcttgaggactatcggcgtgacgacaaacgggatcaacctcgctcgccttctgccccagctacagaaagccggcctctccgccatcaacatctccctcgacaccctggtcccggcaaagtttgagttcatcgttcgcaggaagggcttccacaaagttatggaaggaattcataaggcaattgaactggggtataaccccgtgaaagttaattgtgtggtgatgagggggctcaatgaggatgagcttttggacttcgccgcccttacagaggggctgccacttgatgtgcggttcatcgaatacatgcctttcgatggcaacaagtggaactttaaaaaaatggtctcttataaggaaatgttagacacggttcggcagcagtggcctgagttggagaaggtacccgaagaagagtcaagcacagcgaaggcctttaaaataccaggattccagggccagatcagcttcatcaccagcatgagcgagcacttctgcggtacatgtaatcgcttgcgcattaccgcggacggaaatttgaaagtgtgtttattcgggaactccgaggtgagcttgcgggatcatctcagggcaggagctagcgaacaggagttactccgcatcatcggcgccgccgtgggtcgaaaaaaaaggcagcatgcaggcatgttctcgatctcccagatgaaaaacaggccaatgattctgattggcggatag

SEQ ID NO: 124839 - DNA, 267 bp, Artificial Sequence
  Description of Artificial Sequence: Synthetic coding sequence
atggttcctctctgtcaggtggaagtgttatactttgcaaaatccgctgagataaccggcgtccgcagtgagaccatcagcgtccctcaggagatcaaggccctccagttgtggaaggaaattgagaccaggcacccagggcttgctgatgtgcgaaaccagataatcttcgctgtgaggcaggagtacgtggagctgggggaccagctcctggttcttcagcctggcgacgaaattgcagtcataccccctattagtggagggtag

SEQ ID NO: 124840 - DNA, 567 bp, Artificial Sequence
  Description of Artificial Sequence: Synthetic coding sequence
atgtcttccctcgaaatatcttcatcatgtttctcattagaaaccaaacttccgcttagcccaccattagtagaggactccgcttttgaaccttcacgtaaagacatggatgaagtggaggagaagtccaaggacgtcattaacttcacagcagagaagctttcagtggacgaagtcagccagttggtcatctcccccttgtgtggcgcaataagtctcttcgtgggtacaacccggaataacttcgagggcaagaaggtgattagtctcgaatacgaagcctatttgcctatggctgaaaatgaggttcgcaagatctgtagcgacatacggcagaagtggcccgtaaagcatattgcagtcttccaccggctcgggttagtgcctgtcagcgaagctagtattatcatcgccgtgagcagcgcgcaccgcgccgccagcttagaggcagtgagctatgcgatcgacacccttaaggccaaagtgcctatctggaagaaggagatttatgaggagagtagcacgtggaaaggcaacaaggagtgcttttgggcctcaaatagctag

SEQ ID NO: 124841 - DNA, 267 bp, Artificial Sequence
  Description of Artificial Sequence: Synthetic coding sequence
atggtgccactgtgtcaggtagaagttttatactttgccaaatcagccgaaattactggagtgcggagtgagacaatatccgttcctcaggagattaaggcgttgcagctgtggaaggagattgagacgagacaccccgggctggccgacgttcgcaatcaaattatcttcgcagtccgacaggagtacgtggagctcggcgaccaactgttggtgctgcagccaggtgatgagattgctgttataccacccataagcggaggttag

SEQ ID NO: 124842 - DNA, 267 bp, Artificial Sequence
  Description of Artificial Sequence: Synthetic coding sequence
atggtgcccttatgtcaggtggaggttttatacttcgccaaaagtgccgagatcaccggcgtgagatcggaaactatttctgtgccacaagaaattaaggctctgcaactgtggaaggaaatcgaaacacgacacccaggtcttgccgatgttcggaaccagattatctttgcagtccgccaggagtatgttgaactaggggatcagcttttggtactgcagcccggtgatgagatcgccgtgattccgcctatatcaggtgggtag

SEQ ID NO: 124843 - DNA, 267 bp, Artificial Sequence
  Description of Artificial Sequence: Synthetic coding sequence
atggtcccgctgtgtcaggtcgaagttctctacttcgctaagagtgccgagatcacaggtgtgcggtctgagaccatctccgttccacaggaaataaaagcactgcagctctggaaggagatcgaaacccgtcatcccggtctcgctgacgtacgaaaccaaattatttttgctgtgcggcaggagtacgtggagttgggcgatcaactgctggttctgcagccaggagatgaaattgccgtcatcccaccaatcagcggagggtag

SEQ ID NO: 124844 - DNA, 462 bp, Artificial Sequence
  Description of Artificial Sequence: Synthetic coding sequence
atgagttccctggagatcagctcaagctgtttctcactagagacgaaattgccactcagtcctcccctagtagaggacagcgcctttgagccctcccgtaaagatatggacgaagtcgaggagaagtcaaaggatgtgataaattttaccgcagagaagctcagcgtggacgaggttagtcagctggtgatttctccactgtgtggcgccatatccctgtttgtaggcactacaagaaacaacttcgagggaaagaaggtcattagtcttgagtacgaagcgtatttacccatggcagagaacgaggtacgtaagatctgctccgacattcgacagaaatggccagtgaaacatattgcagtgtttcataggctgggactggttcccgtctccgaggcctcaataattattgctgtgtccagtgcacacagagccgcctctctggaagcagtcagctactag

SEQ ID NO: 124845 - DNA, 1644 bp, Artificial Sequence
  Description of Artificial Sequence: Synthetic coding sequence
atggaggtaggaggtgatactgccgcccctgctccgggtggcgctgaagaccttgaagacacccaatttccctctgaagaagccagagagggtggtggtgtgcacgctgtcccccccgacccagaggatgagggactggaggagaccgggagcaaggataaagaccagcctccaagtccgtcccctccgcctcagtccgaagcactgagcagtacatcccgattatggagtccagccgctcccgagaattcaccaacttgttccccagagtctagctcgggcggacaaggcggtgacccaagcgacgaagagtggagatctcaaaggaaacacgttttcgttctaagcgaggccggtaagccaatttactctaggtatgggtccgtcgaggccctgtctgcgaccatgggtgtcatgacagcacttgtgagtttcgtgcagagcgcaggggacgctattcgcgcaatatacgccgaggaccacaagttggtgttcctgcaacagggacccttactgctcgtcgccatgagccgtacatcccagtccgctgcacaactccgaggagaattactcgcagttcacgcacagatcgtgtcgaccctgaccagagcgagcgtcgctaggatattcgcgcataagcaaaattatgatctcagaagactgctggctggaagtgagcggactctcgacagattgcttgatagcatggagcaggaccccggtgcactcctcctaggtgctgtgaggtgtgtcccactggcgaggcccttacgcgacgccctcggcgctctcttacgacggtgtacagcaccgggcttggctcttagcgtgctggcggtcggcggccggcttatcaccgcagcccaggaaaggaacgtcttagccgaatgccgcctagatcccgctgatctacaactgttgctggactgggtgggcgcccccgccttcgctgcgggcgaagcatgggctcctgtctgtcttccgcgatttaacccagacggcttcttttatgcctatgtagcacgtctggacgcaatgccagtttgcctcctcctgctgggaacccagcgtgaagcctttcatgcaatggccgcgtgccggaggctggtggaagatggcatgcacgcgcttggtgcgatgagagccctcggtgaagcagcctctttcagcaatgctagctcagccagcgcacctgcctactcagtacaggccgtgggagcccctggactccgccacttcctgtacaaaccactcgacatccccgatcatcatcgccagctgccccagttcacttcccctgagctggaagccccttactctagggaggaagaacgccaacgcctgagcgacctgtatcacaggctccatgcccgtcttcactcgacttcacggcccctccggctgatttatcatgtggccgagaaggaaacgctgttggcgtgggtgacaagtaagttcgaactttatacttgcttatcacccttggtgacaaaggctggagcaatccttgtggttacaaagctcctgcggtgggtcaagaaagaggaggatagactattcataagatatcccccgaaatattcgacaccccctgccacctctactgaccaggccgcccacaacggtctattcactggactgtag

SEQ ID NO: 124846 - DNA, 438 bp, Artificial Sequence
  Description of Artificial Sequence: Synthetic coding sequence
atggaggtcggtggggacaccgctgctccagcccctggaggggccgaggacctcgaggatacccagttccccagcgaagaggcgcgcgagggagggggcgtgcacgcagttcctccggatcccgaagatgagggcctggaagagacagggagtaaggacaaggatcagccgccctccccgtctccaccacctcagtctgaagctctgagctcaactagtcggctatggtcgcccgctgcccccgagaactcacctacatgctccccagagtcctccagcggtggtcagggaggagatccgagtgacgaagagtggcggtctcaaaggaatgggtgcaggacgtgcaccacggcttgcatgctagtatctactgccccacctgacccatgtgcttcctttactacgtggctgagaaggagacactactggcctggctag

SEQ ID NO: 124847 - DNA, 1317 bp, Artificial Sequence
  Description of Artificial Sequence: Synthetic coding sequence
atggaggtgggcggagacacagcagcccctgcacctggtggtgctgaggatttggaggatacccagttcccctctgaagaggcccgggagggcggcggagtgcacgccgtgccacctgatcccgaagatgaagggctcgaggaaaccgaggaccataaacttgtttttctccagcagggccccctcttgctggtcgccatgtccagaaccagtcagtccgcagcacagctccgaggtgaactgctcgccgttcacgcccaaatagtgagcacattaaccagggcctcagtcgccaggatctttgcccacaaacagaactacgacctcagaagactgctggcggggtcagaacgtacattagacaggctgctggatagcatggagcaagaccccggggcactcttgctgggggccgtgcgctgtgtccccttggccaggccattgagggatgccttaggagctctcctccgcagatgtaccgcccctgggctcgcactcagcgtgttggccgttggcggccgcctcatcaccgcggcgcaggagcgcaacgtcttggccgaatgcaggttagatccagctgacttgcagctgctgctggactgggttggcgctccagcctttgccgcgggtgaagcttgggcacctgtttgcctgccccgctttaaccccgacgggtttttctacgcatacgttgcccggctagacgcaatgcccgtctgtctgttgctcctgggtacacaaagagaggcatttcatgcaatggcggcctgtcgcaggctggtggaagacggcatgcatgcactgggagcaatgcgcgcgttaggcgaagctgcaagtttctctaatgcctctagcgcttccgctcccgcttacagcgtacaggcggtcggtgcaccgggactgcgacacttcctgtacaagcccctggacattcccgaccaccacagacaacttcctcagtttacaagtccagagctggaagctccgtactcccgggaggaagagcggcagcggctctctgacttgtatcacagacttcacgcacgtttgcatagcacatcccggccattgagacttatctatcacgtcgctgagaaagagactctccttgcctgggtgacatctaaatttgaactctatacttgcttgagccccctggttactaaagccggggccatcctcgtggttactaagctgctgcgttgggtgaagaaagaggaggacaggctcttcatccggtatccacccaaatacagtacccctccagcaaccagtactgatcaagctgcacataatgggctgtttaccgggctgtag

SEQ ID NO: 124848 - DNA, 1206 bp, Artificial Sequence
  Description of Artificial Sequence: Synthetic coding sequence
atggtcagcggacaactgagatttggtgttaagactgaggaccacaaactggtctttctgcagcaggggcctctccttttggtggcaatgtctaggaccagccagtccgcggcccagctccggggggagttgctcgccgtgcacgctcaaatcgtctccaccctaactagagcttctgtagcgaggatctttgctcacaagcagaattatgacctgaggagactcttggccgggagcgagaggactctcgaccggctgctggactcgatggagcaagatcctggcgccctgctgctgggcgccgtgcggtgcgtgcccctagcaagacccctccgcgatgctctcggcgcactcctccggcggtgtacagcaccaggcctcgcactttcagttctggcagttggtggacggttgatcacagccgcccaggaacgcaatgtgctcgctgaatgcagacttgatcccgccgacttgcagcttctgctggactgggtcggggcacctgcatttgcagccggtgaggcgtgggcacccgtgtgtctcccgcggttcaaccctgatgggtttttttacgcatatgtcgcaaggttggatgctatgcccgtctgcctgctgcttctgggcacacagcgtgaagctttccacgccatggccgcctgtcgcagactagtcgaagacggcatgcacgcgctgggcgcgatgagggcactgggggaggcagctagcttcagcaacgcaagtagcgccagcgcccctgcctatagtgtgcaggcggtgggggccccaggactcagacattttctgtacaagcccctcgacatccctgaccaccacaggcagttaccccagtttacatcacccgaactcgaagccccgtatagccgcgaggaagagaggcaaaggctgagcgatctgtatcacaggcttcacgccaggttgcattctacttctcggcctttacgcctgatctatcacgttgccgaaaaagagaccctgcttgcctgggtcacgtccaagttcgagttatatacctgcctgtctcctttggtgactaaagcaggcgccatcctagtcgtgactaagctattacggtgggtcaagaaagaagaggatagactctttatccgctatccgcccaaatactccaccccacccgcaacaagcaccgatcaggctgcacacaatggacttttcaccggactatag

SEQ ID NO: 124849 - DNA, 1584 bp, Artificial Sequence
  Description of Artificial Sequence: Synthetic coding sequence
atggaaaatcaagaaaaggctagtattgccggccatatgtttgatgtggtggtgataggcgggggcatcagcggcttgagcgccgccaagcttctgaccgagtatggagttagcgtgctggtgctcgaggctagggatcgggtgggaggccgcacttacaccatcaggaatgaacacgtggattacgtcgacgtaggcggcgcctacgtcggaccaacacagaacaggatactgagattatcaaaggagcttgggatagagacatataaggtgaacgtttccgagaggctggtccaatacgtgaagggaaagacatacccctttagaggtgctttccctccggtgtggaaccccattgcatatctggactacaataatctgtggagaacaatagataacatgggtaaagaaatcccgacagacgccccttgggaggcccagcatgccgataaatgggacaagatgactatgaaggagctgatcgataagatctgctggaccaagaccgcccgtcgcttcgcttatttgttcgtgaatattaatgtgacgagtgagccccatgaagtgtcggcactttggttcctgtggtatgtcaagcagtgtggcggcacaaccagaattttctccgtgaccaacggtgggcaagaacgaaagttcgtcggagggtcagggcaagtcagtgagcgaatcatggatttgttaggagaccaggtgaaactgaaccaccccgtgacacatgtggaccagagcagtgacaatatcatcatagagacactgaaccacgagcattacgagtgcaaatacgttataaatgctatcccacccactctgaccgcaaagatccacttcagacctgaattacccgcagaaagaaatcagttaattcagagacttcccatgggcgcagtgatcaaatgtatgatgtattacaaagaggctttctggaagaagaaggactactgtggatgtatgattattgaggatgaggacgctcccatcagtataacactagacgataccaagcccgatggttctctgccagcaattatgggtttcattctggcccgcaaagccgataggttggctaagttgcacaaagaaattcgtaagaagaaaatctgtgagctttacgccaaggtcctcgggtctcaggaagccctgcatcccgtacactatgaagaaaaaaactggtgtgaggaacaatacagcggcgggtgctacacagcctatttccccccaggcattatgacccagtatggccgcgtcatacggcagcctgtaggcaggatcttcttcgcaggcaccgagaccgcaactaaatggtcgggatatatggagggtgcagtcgaggccggtgaacgcgcggctagagaggtgctgaacggacttgggaaggtaacagaaaaagacatttgggtgcaagagcccgaatctaaagacgtgcccgctgtggagattacgcacacattttgggagaggaatctgccaagtgtcagtgggctgctgaaaatcattggctttagcacatcagtgactgccctaggctttgtgctgtataagtacaagcttttaccgcgatcatag

SEQ ID NO: 124850 - DNA, 1185 bp, Artificial Sequence
  Description of Artificial Sequence: Synthetic coding sequence
atgggaaaagaaatccctaccgacgccccgtgggaagctcagcacgcggacaagtgggataaaatgaccatgaaagaactcatagacaagatctgctggactaaaacggcgcgacgattcgcatatctgttcgttaatataaatgtaacaagcgaaccacatgaggtttctgctttatggttcttatggtatgtcaagcaatgcgggggcaccacccggatcttctccgtaaccaatggcgggcaggagcgaaaattcgtgggtggatcaggtcaggtgtctgaaaggattatggaccttttgggagatcaggtcaaacttaaccatcccgtaactcacgtagaccagtcctccgataatatcatcatcgagacactcaaccacgagcattatgaatgcaagtacgtaattaatgccataccacccacactaaccgcgaagatacatttccggcctgagctgccagccgagcggaaccagctgatacagcgtctcccaatgggagccgtaataaaatgtatgatgtattacaaagaggctttttggaaaaagaaggattactgcggttgtatgatcattgaagatgaggatgcccctatctcaatcacacttgacgatacaaaacctgatggatccctccctgccatcatgggcttcattctggcgaggaaagccgaccggttggcgaagctccataaggaaatccgtaagaaaaagatctgtgaattgtatgctaaagtactgggctcccaagaagccctccatcccgtccactatgaggagaagaattggtgcgaagaacagtacagcggagggtgctatacggcctactttccaccagggattatgactcagtatggccgggtcataaggcaacccgttgggcgaatcttctttgcaggtactgagaccgccaccaagtggtcaggatacatggaaggagcagttgaagctggcgaacgcgcagccagggaagtgctcaacgggctcggtaaggtgaccgagaaggacatctgggtacaggagccggagtctaaggatgtaccggctgtggaaataactcacaccttctgggaacggaacctaccatctgtgagcgggctgttgaagataataggtttcagtacatctgttacagccctgggattcgttctctacaaatataaactgctgccacgctcctag

SEQ ID NO: 124851 - DNA, 1563 bp, Artificial Sequence
  Description of Artificial Sequence: Synthetic coding sequence
atgagcaacaaatgtgacgtggttgttgttggcgggggcatctcaggcatggctgctgccaagttattgcacgattccggactgaacgtggtggttctggaggctcgcgatagggtgggcggcaggacatacactctgcgaaaccagaaagtgaagtatgtcgacctgggaggatcatatgttggtccaactcagaacagaattctcagactagccaaggagttaggccttgagacctacaaagttaatgaagtcgagcgcctgatccaccatgtaaagggcaaatcctatccttttcgtgggccttttccacccgtatggaaccctattacataccttgaccataataacttttggcgaacaatggatgacatgggcagggaaattcccagtgacgctccttggaaagcaccattagcagaggagtgggacaacatgaccatgaaagagctgcttgacaagctgtgctggaccgaaagcgcgaaacagttggccaccttgtttgtgaatctgtgtgtcaccgccgagactcacgaggtttccgctctttggttcctctggtatgtgaagcaatgcggggggaccacccgcatcatctccacaacaaatggtggccaggagcgcaagttcgtcggtggctccggtcaggtttccgaaagaataatggatctcctcggcgaccgggtcaaactcgagagacctgtcatctacattgaccaaacaagggaaaacgtactggtggaaaccctgaatcacgaaatgtacgaggcaaagtatgtgatctcagcaatccccccaaccctgggtatgaagatacatttcaatccaccccttccaatgatgaggaatcagatgatcacccgagtgccactaggctccgtcataaagtgcatcgtgtattacaaagagccattttggcgtaaaaaggactactgcggaaccatgataatcgacggggaagaggcccctgtcgcttacactttagacgacacaaaaccagagggcaactacgctgcaattatgggtttcatcttagcacacaaggctcgcaaacttgctcgcctgaccaaagaagaacggttgaagaaactttgtgagctgtatgcgaaggtcctgggctcactggaggccctcgaaccagtgcactacgaggaaaaaaactggtgtgaggaacaatattcaggggggtgttatactacctacttcccgcctggtatactgacccagtacggccgggtcctgcgacagccggtggaccggatctatttcgctggcacagagacagccacccactggtccggatatatggaaggagccgtggaagccggcgagagggcagccagggagattctgcacgcaatggggaaaatacctgaagatgaaatttggcagtctgagcctgagtcggtggacgtccccgcacaacctataaccacaactttcctggagcgacatctgccaagtgtccctggattgcttcgcctaatcggcctcactacgatctttagtgcaacagcactaggctttctggcacacaagagggggctgttggttagagtctag

SEQ ID NO: 124852 - DNA, 1515 bp, Artificial Sequence
  Description of Artificial Sequence: Synthetic coding sequence
atggctgctgccaaactgctgcacgactcaggtctgaacgtggttgtcttagaagccagggaccgcgttggcggtcgcacctacaccctgcgcaatcagaaagtgaaatacgtggacttgggcggatcttacgtgggaccgacacagaatagaatcctgcgattagccaaagaactggggctagagacctataaggtgaacgaagtggaaaggctgatccatcacgtgaaaggcaagtcttacccctttcgcggaccttttccgccggtttggaatcccattacgtaccttgatcacaataatttctggcggacaatggatgacatgggcagagagatcccctccgacgccccctggaaagccccgttggctgaagaatgggacaacatgacgatgaaggaactactggacaagctgtgttggaccgagtccgccaaacagctggctacactgttcgtaaacctgtgcgtaaccgctgaaacccacgaggtgagcgctttgtggttcttgtggtacgtgaagcagtgcggtggaaccacccgcattatcagtactacaaatggggggcaggagagaaaattcgtgggcggatctggtcaggtgagcgagaggattatggatttactcggcgatcgggtgaagttggagcggccagtgatttatattgaccaaactcgtgagaatgtattagtagagaccctgaaccacgaaatgtatgaggctaagtacgtcatttctgcgataccaccaacattgggcatgaaaatacatttcaacccacccctacccatgatgcgcaaccaaatgattacaagagtacctctgggatctgtgataaaatgtatcgtctattataaagaaccattttggcggaagaaagactactgtgggaccatgatcattgacggtgaagaggccccggtagcctacaccctcgacgacacaaagccagagggcaactacgcagcaattatgggctttattcttgctcacaaggcgaggaagctggcacgcctgaccaaggaagagcgactgaaaaagctgtgcgagctgtacgccaaggtgctggggagcctcgaagctctggaaccagtacattacgaagagaaaaattggtgcgaggaacagtatagcggcgggtgctacactacctatttcccccccggtatactgacacaatacggcagagtactccgacagcctgttgaccgcatatactttgctggtacagagaccgctacgcattggagtggctacatggagggagcagttgaagccggagagagggcggcgcgggaaatactccatgcaatggggaagatccccgaggatgaaatttggcaaagcgagccggagagcgtggacgttcctgcacagcccatcacaaccacttttttggagcggcatctgcctagcgtgccaggcctgctgcgactgattggtttgacaactatatttagtgccaccgctctaggctttctggctcataaacgcggtctactggttcgggtgtag

SEQ ID NO: 124853 - DNA, 1236 bp, Artificial Sequence
  Description of Artificial Sequence: Synthetic coding sequence
atggcagcagctaagctgcttcacgacagtggtttgaatgttgtggtgctggaagccagggatcgggtggggggtcgcacctacacactgaggaatcaaaaagttaaatatgtagatctgggcggtagttatgtaggacccacccagaaccgcattttacgcctggccaaggagctcggcttggaaacatacaaggtgaacgaggtggagcggcttatccaccacgttaagggaaagagctatccctttcggggaccttttccgcctgtctggaaccctatcacctatctggaccacaacaacttttggagaacaatggacgacatgggccgcgaaatcccaagcgatgccccatggaaggcacctctggccgaagaatgggacaatatgacaatgaaggagctactagacaaattatgttggaccgagtccgcaaaacagcttgctactctctttgtgaacttgtgcgtcactgccgaaacacacgaggtgagcgctttatggtttctatggtacgtgaagcagtgcggtgggaccactcgaattatctctactactaatgggggacaggaacgcaagttcgtgggcggctctggccaggtgtcggagcgaattatggatctgcttggcgaccgtgtcaagctcgaacggccagtcatctatatcgaccagacacgcgaaaatgtgctcgtggagaccctcaatcatgagatgtatgaggccaaatacgtaatttcggcgattccacctacgctgggaatgaagatccatttcaaccctccattgccgatgatgcgcaaccagatgattacaagggtgccccttggcagcgtgataaaatgtattgtgtactataaagagccattctggagaaagaaggattactgcggcactatgatcatcgatggggaggaagccccggtcgcctacaccctggatgataccaagccagagggaaactacgcagcaatcatgggctttatattggcccacaaggcacggaagctggccaggctgaccaaggaagagcgactaaagaagttgtgcgagctgtatgcaaaggtccttggttcactggaggccctggagggatcgacacccgcgagcggacaggatctgctttgccgacaccgggactgtcacaccctggagaggctacacggggggggttgtcggggacgcggagaatcatcccctagagatcccgcctgtcacggcgaggattctaggggatag

SEQ ID NO: 124854 - DNA, 741 bp, Artificial Sequence
  Description of Artificial Sequence: Synthetic coding sequence
atgtttgccccccgcctcctcgactttcagaaaaccaaatatgcacgttttatgaaccatagagtgccggcccacaaacgatatcaacctactgagtatgaacacgccgccaactgtgcaactcacgctttctggattattccatcaatactcggctcttcaaacttatatttcctgtcagatgacgattgggagactatctctgcatggatctacggtcttggactgtgcggactctttgtggtgtcaacggtgttccacacaatttcctggaaaaaaagtcacctgcggatggtcgagcactgtctgcacatgttcgaccggatggtcatctatttcttcatcgccgctagctacgccccttggttaaacctgcgcgaactcggaccttgggcgtctcacatgaggtggctcgtatggatcatggcttctgtcggaaccatctacgtattctttttccatgagcgctacaagctggtggaactgttgtgctacgttgtgatgggcttttttcccgcactggtgattctgtccatgcctaacaccgagggaatctgggagctggtgactggtggtgtcttttactgcttagggatggtgttctttaaaagtgatggccgaatccccttcgcgcatgccatatggcacctgtttgtggccttcggagcaggaacccactactatgccatctggcgatatctttacctaccaagcacgctgcaaactaaagtgtccaagtag

SEQ ID NO: 124855 - DNA, 813 bp, Artificial Sequence
  Description of Artificial Sequence: Synthetic coding sequence
atgttcgctcccaggctccttgatttccagaaaacaaagtacgctcggtttatgaatcaccgggtgcccgctcataaaaggtaccagcctacagagtacgaacacgccgcgaattgtgcaacccacgcgttttggatcattccttctattctggggtctagtaacctttacttcctatcggatgatgactgggaaaccatcagtgcatggatctatggcctcggcctctgtggcctcttcgtagtaagtactgtgttccacaccatctcttggaaaaaaagccatctgcgcatggttgaacactgtttacacatgtttgatcgcatggttatctacttttttattgctgctagttacgcgccatggttgaacctccgtgaattaggtccttgggcttcacacatgagatggctggtttggattatggcttcagtcggcactatttacgtgttcttttttcacgaaagaaccggcagttgtgtacagttcctgcgcggggaagcctgccccaaagcggggactgcatgcctcccagcccggtataagctcgtggagctgctgtgttatgtcgtcatgggcttctttcccgccctggttatcctgagcatgcctaataccgagggaatctgggagctcgtaacgggcggcgtcttttactgtctcggcatggtgttttttaagtccgatgggaggataccctttgcacacgcaatctggcacttgtttgtcgccttcggagcgggcacccactattacgctatttggagatacctttatctcccttcaacactacaaaccaaggtttctaaatag

SEQ ID NO: 124856 - DNA, 582 bp, Artificial Sequence
  Description of Artificial Sequence: Synthetic coding sequence
atgttcgctccccgcttactggacttccagaagactaagtatgccagattcatgaaccaccgggtgcccgcacacaagagatatcagccaactgaatacgagcacgccgcaaactgcgcaacccatgcattctggatcataccctctatcttgggctccagtaatttatatttcttatctgacgatgactgggaaacaattagcgcttggatctatggcttgggattgtgtggactgttcgtcgtgagcacagtgttccacacgataagctggaagaagtcccatctgcgaatggtggaacactgcctgcacatgttcgaccgcatggtgatctacttcttcatcgcggccagctacgccccttggctgaatctcagagagctcggtccatgggccagtcatatgcgctggctagtctggattatggcatcagtgggcactatatacgtcttcttctttcacgaacggtacaagctcgtggaactcctgtgctatgtggtgatggggttctttccagctctggtgatactgagcatggcaggtaagctacgcccaggaatgacatgcctgaagcgacagtag

SEQ ID NO: 124857 - DNA, 942 bp, Artificial Sequence
  Description of Artificial Sequence: Synthetic coding sequence
atggagactggcccagaagatccaagtagtatgcccgaagagtcaagcccccgcagaaccccccagtccatcccatatcaggaccttccgcacttggtgaacgccgatggccaataccttttctgtaggtactggaagccgacaggcactcccaaggccctgatcttcgtttctcacggtgccggcgaacacagtggaaggtatgaagagctcgccagaatgttgatgggcctggacctgctggtcttcgcacatgaccatgtgggtcatggacagtcagagggggagcgaatggtggtttctgatttccacgtgttcgtgcgcgatgtcttgcagcacgttgactccatgcaaaaagattatcctgggttacctgtttttctattgggccattcaatgggtggagccatagcaatccttactgcggccgagaggccaggccactttgctggcatggtcctgatctctcccctcgttttagcaaaccctgagtccgctaccaccttcaaagttttggcagccaaggtgctcaatcttgtgctgcccaatctcagcttggggcctatcgatagcagcgttctcagcaggaacaagacagaggttgacatatacaacagtgaccctcttatttgtagggctgggctcaaagtctgcttcggaatccagctcctgaatgctgtctcacgggttgaacgcgctctgcctaagctgactgtcccattcctgctgttgcaaggatctgccgaccggttgtgcgactccaagggagcatatctgctcatggagctggccaagtcacaggacaaaactctcaaaatctatgaaggtgcctaccatgtgctgcataaggaactcccagaggtcactaactcggtctttcacgaaataaatatgtgggtgtcccagagaacagcaaccgccggcactgcgtccccaccgtag

SEQ ID NO: 124858 - DNA, 912 bp, Artificial Sequence
  Description of Artificial Sequence: Synthetic coding sequence
atgcctgaagagtccagtcccaggcgtacgcctcagtctattccgtaccaggacctccctcacctggtaaatgcagacggccagtacctgttttgtcggtactggaaaccaacaggcacccccaaggctctaatatttgtgagccatggcgccggtgagcacagcggtagatatgaggagctggccaggatgttgatgggtctcgacttactcgtgttcgcccacgaccacgtgggccatggacagagtgagggcgaacgcatggttgtctccgacttccatgtcttcgtcagggatgtgctgcagcacgttgattctatgcaaaaggattaccccggcttgcccgtattcctgctgggtcacagcatggggggagccatcgccattcttacagctgcggagaggcccggacacttcgccgggatggtactgatcagccccttggtgctggctaaccccgagtctgcgaccacattcaaagtgctggcagctaaggttctgaacttggtgctgcccaacctgtcactgggcccaatagactcctccgtattgtcgaggaataagaccgaggtagatatctataactctgatcctctcatatgtcgggcaggcctgaaggtttgttttggaatccagctcctgaatgcagtctcccgggtggagagggcactccccaagctgacagtgccgttcttactcctgcaggggagtgctgaccgcctctgtgatagcaagggcgcatatctgttaatggaactggcaaagagccaagacaagacattaaagatctacgagggggcctatcatgtcctccataaggagctacctgaggtgactaacagcgtattccacgagataaacatgtgggtgagtcaaagaacagccacagcaggaactgctagccccccatag

SEQ ID NO: 124859 - DNA, 912 bp, Artificial Sequence
  Description of Artificial Sequence: Synthetic coding sequence
atgcccgaggagtcatcacctaggcggaccccacagtcaataccataccaggatctgccccacctcgttaacgccgatggccagtacctgttctgcaggtattggaaacctactggtactcctaaggccttgatcttcgtgtcacatggggcgggcgaacacagcggtagatacgaagagcttgctagaatgctcatgggattggacctgctcgtgttcgcacatgaccacgtgggccacggtcaatcagagggtgaacggatggtcgtgtcagatttccatgtcttcgtgcgcgacgtgctccaacacgttgattccatgcagaaagactatcctggtctgccggtttttctgctcggccatagcatgggaggagctatcgctattctgaccgctgcagaacggccaggacatttcgccgggatggtccttatctcacctttggtgctggctaacccagagagcgccactacttttaaggtactcgccgccaaagtcctgaacctggtgctcccgaacctttcgcttggcccgatcgattcttcggtgctgtcaagaaacaaaacagaggttgacatctacaattctgatcccttgatctgccgggcgggcctgaaagtctgctttggcattcaattactgaatgctgtaagtcgcgtggagcgggccctgcccaaactgactgttccttttctgcttctgcagggatctgctgataggctctgcgacagcaagggagcctacttgctaatggagctggcaaagtctcaagataaaactctcaaaatatacgagggcgcctaccatgttctccacaaggagcttccagaggtcacaaactcggtgttccacgaaatcaacatgtgggtttcccagcgcaccgccaccgccgggactgcctcccccccatag

SEQ ID NO: 124860 - DNA, 852 bp, Artificial Sequence
  Description of Artificial Sequence: Synthetic coding sequence
atggaaactggcccagaggaccccagctccatgcctgaggaatctagcccacggagaactccacagtccatcccatatcaggatctgcctcatttagtgaatgctgacgggcagtatctgttttgccggtactggaagcctactggcacacccaaagcactgatttttgtgtcccatggcgccggggagcacagcggacgctacgaggaacttgcgagaatgttaatggggctggacctccttgtttttgcccatgatcacgtcggacatggccagtccgaaggcgagcgcatggtggtgagcgatttccatgttttcgtaagggacgttcttcagcacgtcgatagcatgcagaaggactatcctggccttccagttttcctattaggtcacagtatgggtggagctatagccatccttacagcagcagaacgtcccggacactttgccggaatggtgttgatcagtccattggtactggcgaatcccgagagtgcaactacctttaaggtcgacatctataacagcgacccccttatctgccgggctggactcaaggtgtgttttggcattcagctgctgaacgctgtgagtcgcgttgagagggcgctcccgaaactgactgttcctttcctactgctccaagggagtgcagatcgcctttgcgacagtaagggcgcgtaccttctaatggaacttgctaaatcccaggataagacactgaaaatttacgaaggcgcctaccacgtacttcacaaggagcttcctgaggtcacaaatagtgttttccacgaaattaatatgtgggtaagccagcgaacagctactgccggtaccgcctctcccccctag

SEQ ID NO: 124861 - DNA, 234 bp, Artificial Sequence
  Description of Artificial Sequence: Synthetic coding sequence
atgcccgaggagtctagtccacgaaggacccctcagagcattccataccaagaccttcctcatctggtcaatgcagatggacaatacctattctgccgatactggaaaccaacgggcacccccaaagccctgatctttgtaagtcacggggccggagagcacagcgggcgctacgaggagctggcccgcatgttgatgggcctggatctgttggtcttcgcccacgaccactag

SEQ ID NO: 124862 - DNA, 942 bp, Artificial Sequence
  Description of Artificial Sequence: Synthetic coding sequence
atgaagaccagacctgaggatcccagtagcatgcctgaggaatccagcccccgtcggactcctcagtcgatcccataccaggaccttccccatttggtgaatgcagacggccagtacctcttttgtcgttactggaagcccaccggaacacctaaagccctgatcttcgtgagtcacggcgccggcgaacactccggacggtatgaagaactagctaggatgctgatgggcttggacttgttagttttcgcccatgatcacgtcggacatggacaatcagaaggtgaaaggatggtggttagtgatttccacgtgtttgtgagggatgtgctgcagcacgtggacagtatgcagaaggattatcctggtttaccggtgtttcttctgggacactctatgggtggggcaatagccatactgaccgctgcagaacgcccaggccacttcgcaggtatggtgctgatctctcccttagtgctcgctaatccggagtctgcgaccacatttaaggtgctggcagcaaaagtgttgaacctggtgctgccaaacctgtctttaggcccaatcgacagttctgtcttgtcgagaaacaaaactgaggtcgacatatataactctgatcccctgatttgccgggcgggcctcaaagtttgctttggaattcagctgttgaacgctgtctcgcgtgtggagagggcacttcccaaactcactgtgcccttcttgcttctgcagggctccgctgatagactgtgcgacagcaagggcgcttaccttctaatggagctggctaagagtcaggacaagactttaaagatctatgagggggcttatcacgtgctgcacaaggagttgcccgaggtgacgaatagcgttttccacgaaataaatatgtgggtgagccaaaggactgctacagccggcaccgcctccccgccctag

SEQ ID NO: 124863 - DNA, 1842 bp, Artificial Sequence
  Description of Artificial Sequence: Synthetic coding sequence
atgtgttgctggcctctccttctgctttggggattgctgcccggtactgcggccggcggttctggccggacctacccccaccggacccttctggattctgaaggcaagtattggctggggtggagccagaggggttcacagatagcttttaggcttcaggtcagaaccgctggctatgtggggttcggatttagtcctaccggcgcaatggcttctgctgatatagtggtgggaggcgtggcacacggtcgcccttatttacaagactacttcaccaatgccaaccgtgaattgaaaaaggatgctcaacaggattaccacttggagtatgcaatggagaactcaacccacacaataattgaattcaccagagagctgcatacatgtgatattaacgataaaagcattacagactctactgttagagtcatttgggcatatcatcacgaggatgctggtgaggccggtcccaaataccacgacagcaatcggggcaccaagtctctgcgcttgctgaatcccgaaaaaaccagtgtcctgagtactgccctcccttacttcgacctcgttaaccaggatgtgcctatacctaataaagataccacctattggtgccagatgttcaagattccagtcttccaggaaaagcaccatgtcatcaaggtagaacccgtaattcagaggggccacgagagtcttgtgcaccacatcttactctaccagtgtagtaataacttcaatgactctgtgttggagtccggacatgaatgttatcaccctaacatgcctgacgcttttttgacctgcgagacagttatatttgcttgggctatcggaggagagggcttcagttacccgccgcacgttggcctgtccctcggaactccattggacccccactacgtgctgctagaagtgcattatgataaccctacatatgaggaaggtcttattgataactcagggctcagacttttctacacaatggacatccggaagtacgacgccggcgtgatcgaggccgggctctgggtttcactattccatacaattccgcccgggatgcccgaatttcagtccgagggacactgtaccctcgaatgcctggaggaagctctagaggccgagaagccttcaggtatccatgtatttgctgtgcttttgcatgcacacctggccgggcgtgggatccggttaaggcacttccgtaaaggtaaggagatgaagttacttgcttacgatgatgattttgatttcaactttcaggagtttcaatacctaaaggaagagcagaccattctgccaggtgataacctcatcaccgagtgccgttataacaccaaagacagggcggagatgacatggggagggctatccacccggtccgagatgtgcttatcgtacctactgtattacccccgcatcaatctcaccagatgcgcaagtatccccgacatcatggaacagctccagttcattggggtgaaggaaatctaccgtcccgtcactacctggccgtttatcattaagtcgcctaaacagtacaagaatctctcattcatggacgcgatgaacaaattcaagtggactaaaaaggaaggcttatcctttaacaaactggttctcagcctaccagtcaatgttcgctgctcgaaaacagacaacgcagagtggtccatccaagggatgactgcactcccccccgacatcgagcgtccatataaagcagaacccctcgtatgtggaacatcgagctcgagttccctgcacagggatttttccattaaccttcttgtctgcttactactcctgtcctgcacactctctactaaatcactttag

SEQ ID NO: 124864 - DNA, 1023 bp, Artificial Sequence
  Description of Artificial Sequence: Synthetic coding sequence
atgtccgagctggaacagctccggcaggaggcagagcaacttcgcaatcagatccaggatgcaaggaaggcctgtaacgacgcaacactggtacagatcacctcgaacatggacagtgtggggagaatacaaatgagaacaaggagaaccctcaggggtcacctggccaagatttatgccatgcactggggctacgacagtcgtctgctcgtgtcggcaagccaggacggcaaactcattatctgggattcctacaccacaaacaagatgcacgccatcccactacgttcttcatgggttatgacgtgtgcctatgccccttctggcaactatgtggcctgtgggggactggacaacatttgttctatatataatctgaaaactcgagagggcaacgtgcgagtgtcccgcgagctaccggggcacacagggtacctctcctgttgccggtttctggacgattcgcagatcgtgaccagttcaggtgacacaacctgcgccctctgggatatcgagacagctcagcaaaccaccaccttcaccgggcacagtggagacgtgatgagcctctcattgagccccgacatgcgaacatttgtgtctggcgcttgcgacgctagttcaaagctctgggacattagagacggtatgtgtcggcagtccttcacgggtcacgtgtcagatatcaacgccgtatcattcttccccaacggatacgcattcgcgactggatctgatgatgcgacatgtcgcctctttgacctgcgcgccgaccaggaactgctgctgtattcacatgataatattatttgcggtattaccagcgtggccttcagtaaatctgggagactcttactggctggttatgatgatttcaattgcaacgtgtgggatactctcaaaggggaccgagccggcgtcctcgctggtcacgacaatcgggtatcatgtctgggggtcaccgacgatggcatggctgttgctaccggaagctgggattcattccttagaatctggaactag

SEQ ID NO: 124865 - DNA, 1089 bp, Artificial Sequence
  Description of Artificial Sequence: Synthetic coding sequence
atggctcccaagcaggatccgaaaccaaaattccaggagggggaaagagtcctctgtttccacggccccctcctttacgaggccaaatgcgtcaaggttgctatcaaagataaacaggtcaaatatttcatccactattcaggttggaataagaaatcggccgtacggcctagacggtctgagaagagccttaaaacccacgaggatatcgttgccctgtttcccgtgcccgaaggagctccatccgttcatcaccctctcctgacctcctcctgggatgagtgggtccctgagagccgggtactcaaatacgttgatactaacctgcagaaacaacgggaactgcagaaggcaaaccaggaacagtatgcagagggcaagatgaggggcgccgcaccaggtaaaaaaacgagcggcctgcagcagaagaacgtcgaggtgaaaaccaagaagaataaacaaaagactcctgggaacggcgacggagggagcacttcagagactccacagcccccaagaaagaagcgcgcaagggtggaccccactgtagaaaacgaggagacgttcatgaatcgggtggaggtcaaagtcaaaattcccgaggagctgaaaccctggctcgtggacgattgggaccttatcaccagacagaaacagctcttttacctacccgccaagaagaacgtagattcaatcctggaagactatgctaattataagaaatccagaggcaataccgacaataaggaatacgccgttaatgaagtggttgcaggaattaaggagtatttcaacgtgatgctggggactcagctgttgtataagttcgaaaggccacagtacgccgagatcctggcagatcatcccgacgcgccaatgtcgcaagtgtacggcgccccgcatctgcttaggctgttcgttagaatcggcgcaatgctggcctatactccgcttgatgagaaaagtctggccctcttactgaattacttgcacgatttccttaagtacctagcgaaaaatagtgctaccttgttcagcgcatcagactatgaggtggcccctcccgagtatcacagaaaggctgtgtag

SEQ ID NO: 124866 - DNA, 1047 bp, Artificial Sequence
  Description of Artificial Sequence: Synthetic coding sequence
atgattccttttccacaccctcaggtgactgacgcgctgggccgatacagcaactacattctctcaagcactgtcgaatctccctcgttgcgatccatgaattttgaaaagcagggagaacgcgtcctgtgcttccatggtcccttgctttacgaggccaagtgcgtgaaggtcgccatcaaggataaacaggtgaaatacttcatccattattctggttggaacaagaattgggacgagtgggtgcccgagtcaagggtcctgaaatacgtcgatacaaatttacagaagcagagggagctccaaaaggcaaaccaagagcagtatgccgaagggaaaatgcggggagcagcccccggtaaaaagactagcggccttcagcaaaagaatgtcgaagtcaaaacaaagaagaataagcagaaaactccgggaaatggcgatggagggagtactagcgaaacaccgcagccaccccgaaaaaagcgcgcgcgagtggatcccaccgttgaaaacgaagagacatttatgaatagagtcgaagtgaaggttaagattcccgaggaactgaaaccttggctggtcgatgactgggaccttataacccgacagaagcagcttttctatttacccgcaaagaagaacgtcgattccatcctggaggactatgccaactacaaaaaatctaggggtaacaccgataataaggaatatgccgtcaacgaggtggtagcagggatcaaagaatatttcaatgtgatgttgggaacccaactgttatacaaatttgaaagaccccagtacgctgaaatactggccgaccatccagatgctcccatgagtcaggtgtacggtgctccacatctgctacgcctgtttgttcgcatcggcgcaatgctcgcctacacaccccttgacgaaaagagcctggctctgttgctgaactacctgcacgacttcctgaagtaccttgccaaaaactctgcaaccctgttctccgcgagtgattacgaggtagcacccccagagtatcatagaaaggcggtgtag

SEQ ID NO: 124867 - DNA, 972 bp, Artificial Sequence
  Description of Artificial Sequence: Synthetic coding sequence
atggctccaaagcaggaccccaagccaaagtttcaggagggagaaagagtcctgtgtttccatgggcctctgctgtatgaagctaaatgcgttaaggtggccatcaaagataagcaggtgaaatactttatacactattcagggtggaacaagaattgggatgagtgggtgcctgagagtagagtgctgaagtacgtcgacaccaacctgcagaaacaaagggaactccaaaaagccaatcaggagcagtacgccgagggcaaaatgagaggagccgctccggggaagaagacatctggattacagcaaaagaatgttgaggtcaagactaagaaaaacaaacaaaagacccctggcaatggcgacgggggcagtactagcgaaacaccgcagcctccccgaaaaaaaagggcccgtgtggacccgacagtggaaaatgaagagacatttatgaaccgggtggaggtgaaggttaagatccccgaggaattgaaaccttggttagtagatgattgggatctcatcacgcggcagaaacagctgttctatctacctgctaagaagaatgtggactctattctggaggactatgcgaattataagaagagtagaggcaacaccgataacaaagaatacgctgtaaatgaagttgtggccggaattaaagaatattttaatgtcatgctaggcacccaactgctctataaattcgaaaggcctcagtatgccgagattctcgcagatcatcccgacgccccaatgagccaggtatatggtgcgcctcatctgctgaggctttttgtacggattggagccatgctggcttacacgccacttgacgaaaagagtctcgccttgctgcttaattacttacacgattttctgaaatatctggctaaaaactctgctacactgttcagcgcctctgattatgaagtggcgccaccagaatatcaccggaaagcagtgtag

SEQ ID NO: 124868 - DNA, 708 bp, Artificial Sequence
  Description of Artificial Sequence: Synthetic coding sequence
atgagaggcgctgctcccggaaaaaagacctccggccttcagcaaaaaaacgtagaggtcaagacaaagaaaaacaagcagaagacaccagggaacggcgatggcggctcaacttctgaaacaccccagccgcctcgaaaaaaacgggcccgggttgaccctactgtcgagaatgaggaaaccttcatgaatagggtggaggtgaaggtgaagattcccgaagaactgaagccatggttggttgatgattgggatcttatcactagacagaaacagctgttttaccttcccgccaagaagaatgtggactccatcctcgaagattacgcaaattacaaaaagagccgaggaaacactgataacaaggagtatgcagttaacgaagtggtagcagggatcaaagagtatttcaacgtgatgctgggcacgcaactactctataaatttgagagaccccaatacgccgagatcctcgcagaccaccccgatgcccctatgtcacaggtttacggcgctccccatttactgagactcttcgtgagaataggagctatgctggcctacacgcctctggacgaaaagtctctagccctgctgctgaattaccttcacgactttttgaagtatcttgcaaaaaactcagccaccctgttctctgcctccgactatgaggtggcccctccagagtaccaccgaaaggccgtctag

SEQ ID NO: 124869 - DNA, 708 bp, Artificial Sequence
  Description of Artificial Sequence: Synthetic coding sequence
atgcgtggagccgctcctgggaagaaaactagcgggctgcagcagaagaatgtggaagtgaagactaagaagaacaagcagaaaacacctggcaatggagacggcggttccacgagtgagactccccagcctcccagaaagaaacgcgctagagttgaccccacagtggagaacgaagaaacctttatgaatagagttgaagtgaaggtgaaaatacctgaagaattaaagccctggctagtcgacgactgggatttgattacacgacaaaaacagctgttctacctccccgccaagaaaaacgtggactctatcttagaggactacgcaaattacaagaagtcacgaggaaacaccgataacaaggagtatgcggtgaatgaggtcgtggcaggcattaaggaatactttaacgtaatgttgggtacccagctgctctacaaattcgaacgccctcagtacgctgaaattttggcagaccaccctgatgcaccaatgtcccaggtgtacggggcccctcatttactaaggctctttgtgaggatcggagctatgctcgcctatacaccactcgacgagaaatcactcgctttgctgttgaactaccttcatgactttctgaagtacttggccaagaattccgccacactgtttagcgcaagtgactatgaggtcgcacccccagagtatcacaggaaagccgtgtag

SEQ ID NO: 124870 - DNA, 345 bp, Artificial Sequence
  Description of Artificial Sequence: Synthetic coding sequence
atggtttcccgcaaagccgtcgcggcacttcttgtcgtgcatgtagcagctatgctggcttcccagacagaagcctttgttcctatattcacctacggagaattgcagcggatgcaggagaaagagagaaataagggccagaagaagtctctgtccgtgtggcaaagatccggcgaggaaggccctgtcgacccggctgagcccatcagggaggaggagaatgaaatgatcaagctgacagccccactggagatagggatgaggatgaattcaaggcagctggaaaaataccccgcaacactagagggtcttctatctgaaatgctgccacagcacgccaagtag

SEQ ID NO: 124871 - DNA, 348 bp, Artificial Sequence
  Description of Artificial Sequence: Synthetic coding sequence
atggtcagccggaaggcggtggccgctctgctggtggttcacgtcgcagcaatgttagccagccaaactgaggcctttgtccccatctttacatacggcgaactgcaacgcatgcaggaaaaagagcggaataaaggccagaagaagtccctaagtgtttggcagcggagcggcgaagagggacccgtggaccccgctgaaccaatccgggaagaggagaatgagatgatcaagctgacagcacccctggaaattggcatgcgtatgaacagtagacagctggaaaagtaccccgcgacactggaaggactgcttagcgaaatgcttcctcaacatgcagcaaaatag

SEQ ID NO: 124872 - DNA, 327 bp, Artificial Sequence
  Description of Artificial Sequence: Synthetic coding sequence
atggtcagtaggaaggctgtggccgcccttttggtcgtccatgtggccgctatgctggcgtcccagactgaggcctttgtgccaattttcacctacggagagttacagcgcatgcaagaaaaagaacgcaataaaggacagaaaaagtccctttccgtttggcagaggagcggtgaggaggggccagttgaccctgctgagcccatccgggaagaggagaatgaaatgattaaactaaccgctcctttagagattggaatgcgcatgaactcccggcagttagaaaagtatcccgcaactctagaagggctgctgacagccaagtag

SEQ ID NO: 124873 - DNA, 1011 bp, Artificial Sequence
  Description of Artificial Sequence: Synthetic coding sequence
atggctagaaggagatcccagagggtgtgcgcctcagggccatcgatgttgaactctgcccggggggcccccgagctcctgcggggcacagccacaaatgccgaggtgagcgctgccgccgccggggctaccggctcagaggagctcccaccaggagaccgcggctgtagaaatggagggggcagggggcctgccgctacaactagttcgaccggagtggcagtgggggcagaacacggcgaagactcactcagccggaaaccagatccagagcccggccgtatggatcaccatcagcctgggacgggccgctaccaggtgctgctgaacgaggaagataactcagagtccagcgcaatcgagcagccccccacctcaaatcctgcaccccagattgtgcaggctgcctcatctgctccagcactcgagaccgatagcagtccaccaccctattcctctattacagttgaagttcccacaacctcagatacagaggtttacggcgaattctatccagttcctccgccctacagcgtagcaaccagtttgccaacatacgatgaagctgaaaaagccaaagccgcagcaatggcagcagcggctgccgagaccagtcagcgaattcaagaagaggagtgtccgccaagagacgacttctctgacgccgatcaattacgagtgggcaatgacgggattttcatgcttgctttctttatggcttttattttcaattggctaggcttctgcttgagtttctgtattactaacacaatcgccggtcggtatggtgcaatttgtggatttgggctgtccttaatcaaatggatcctcatcgtcagattttccgattactttaccggctattttaacggccaatactggctatggtggatcttcttggtgctgggccttttactgttctttaggggatttgtgaactacttgaaggtcaggaatatgtcagaatcaatggccgctgcccaccgtacacgctacttctttcttctgtag

SEQ ID NO: 124874 - DNA, 1161 bp, Artificial Sequence
  Description of Artificial Sequence: Synthetic coding sequence
atgggctcgccttggaatggatcagatggccctgagggggctcgcgagcccccctggcctgcactccctccatgcgatgaacggcggtgctctccttttccccttggtgcccttgtgcccgttactgccgtttgcctctgcctgtttgtggtcggagtgtccggcaacgtagtgactgttatgctcattgggcggtatcgcgacatgcgtaccaccacaaacctgtatctggggtctatggcggtatccgatctgcttatactcctcggtttgcccttcgacctttaccggctctggcggagcaggccgtgggtgttcgggccactgctctgtcggctcagtctctacgtgggcgaaggatgcacatacgccaccctgctccatatgaccgctctgagcgttgagagataccttgccatatgtagacctttgcgggccagagtcctggtcactaggcggagagtgcgcgccctaatcgcggttttgtgggccgtggcactactgagtgcgggcccttttttgtttctggtaggagtggagcaggatccaggaatcagcgtcgtccctggtttgaatggaactgctcgcatagctagcagcccactggcctcctccccccccctctggctctcacgggcgccacctccctcccctccatccggtccggagacagccgaagccgctgctctgttttctcgtgagtgtcgcccctccccagcccagctgggcgccctaagggtaatgctctgggtgaccaccgcctactttttcctgccattcctgtgtctcagcatcctctacggactaatcggaagggagctttggtctagcagaagacccctgcggggccctgccgcctcaggtcgcgagcgcgggcaccgccagacagtccgcgttcttcggaaatggtcccgacgcggatccaaagatgcatgcctccagtccgcccctccagggacagcacaaacacttggcccacttcctttgctggctcagctttgggcgccacttccagcccctttccccatcagcattcctgcctccacgagacggggagggggcagcggaatttacaacctgctggtagctctgcctagatggcagaaccacctccataaacacggccgtttcgccgacgatgtcttattatctgtgctgtag

SEQ ID NO: 124875 - DNA, 1206 bp, Artificial Sequence
  Description of Artificial Sequence: Synthetic coding sequence
atggaaaaaagcaaaaattttaggatcgatgcattgctggcagtggacccacctcgagcagcatcggcccagagtgctcccctcgcattggtaacatccctggctgcggcagccagcggcacaggggggggaggaggtggcggaggtgccagcggagggacctccggcagttgcagtcccgcgtctagcgagcctccagcagcaccagccgatcgtctgagggctgaaagtccatcccccccgaggctgctggccgctcactgcgctttactaccaaagcccggctttctaggggccggggggggtggggggggcaccgggggggggcatggtggaccacatcaccatgcacaccccggcgctgctgctgctgcagctgccgcggccgctgccgctgccgctgggggactcgccctgggtttgcaccccggtggtgcccagggaggcgctggcctcccagcccaggcggcattgtacggacaccctgtgtacggttacagtgcggccgctgcagccgcagcattggccggtcaacaccctgctctgagttattcataccctcaagtgcagggggcacacccagcccaccccgcggaccctattaagctgggggctggcacctttcaattggaccaatggctgagagctagtacagctgggatgatactgcctaagatgcctgatttcaacagtcaggctcagtccaatttattaggcaagtgtcggcgccccagaacagcgtttaccagtcaacagctattggaacttgaacatcagtttaagctaaacaagtacctcagccgccccaaaaggtttgaggttgccacctcgctgatgctgaccgagacacaagtgaaaatttggtttcagaaccgacgcatgaagtggaagcggtccaaaaaagctaaggagcaggcagctcaggaggcagagaagcagaagggcgggggcggaggggccggaaagggtggggcagaagaaccaggtgcagaggaactgctgggtcctccagccccgggggacaaggggtcaggaagacgcctccgagatctcagggacagtgatccggaagaggacgaagacgaagacgacgaagaccattttccctatagcaacggggcgagtgtgcatgcagcaagtagcgactgctcatcagaggacgactctcctcctcctcgcccgagtcatcagccggccccgcaatag

SEQ ID NO: 124876 - DNA, 696 bp, Artificial Sequence
  Description of Artificial Sequence: Synthetic coding sequence
gccgcagctgcgctggctgggcagcacccagcgctgagttactcctatccgcaggttcagggcgcgcatcctgcacaccccgccgatcccatcaaactgggcgctggcacgtttcagttagaccagtggcttagagcaagcaccgcagggatgatcctgcctaagatgccagactttaattctcaagcccagtcgaaccttctgggaaaatgtcggcggccccgcacagcgttcacctcacagcaattgcttgagctggagcatcagtttaagctcaacaaatacctgtcaaggcctaaaagattcgaggtcgctaccagcttgatgctcacagaaacgcaggtgaagatctggttccagaatagacgtatgaaatggaaaaggtccaagaaggcgaaggagcaagcagcccaggaggccgagaaacagaaggggggcggcgggggggccggtaaggggggtgcggaggagcctggcgccgaagaactgctcggaccccccgcccccggggacaaagggtctgggagaaggctgcgtgacctgcgagactcagaccctgaggaggatgaagatgaagatgatgaagatcatttcccatactccaatggggctagcgtacacgccgcctcctcagattgttcaagtgaggatgactctccaccaccaaggccttcacatcagccagccccgcaatag

SEQ ID NO: 124877 - DNA, 570 bp, Artificial Sequence
  Description of Artificial Sequence: Synthetic coding sequence
atgggcggtctgagcactgtaggagcatgtcccggtatcctaggagcgcagcaggcccaggcccagagtaacctgttaggtaaatgccggaggcccaggaccgctttcacctctcagcagttattagaactggagcaccaatttaaattaaacaagtacctgtcccgccctaagcgtttcgaggttgccacaagtttgatgttgactgagacccaggtaaaaatttggttccagaataggcggatgaagtggaaaaggagcaaaaaagctaaggaacaggccgcacaagaagctgagaaacagaaaggcggcggcggaggcgctggcaaaggcggagcggaggaacctggtgccgaagaacttttgggccccccagcacctggtgataagggcagcgggcgacgtcttagggatctgcgcgattccgacccagaggaggacgaggatgaagacgatgaggaccatttcccttatagcaatggggcctcagtgcacgcggcgagttcggattgttccagcgaggatgactcccccccaccacgcccatctcatcagcccgcaccacagtag

SEQ ID NO: 124878 - DNA, 1692 bp, Artificial Sequence
  Description of Artificial Sequence: Synthetic coding sequence
atgccctctaaatttagttgtcggcagctgcgtgaagcaggccagtgttttgagtctttcctggtggttaggggcctcgacatggaaaccgatagggaaagactcagaactatttacaacagagacttcaagatcagtttcggtacccctgctccagggttcagctctatgctgtacggcatgaagatagccaatctggcgtatgtgacaaaaacacgtgtgaggttctttcgtctcgaccggtgggcggacgttagatttcccgaaaagcggcgtatgaagctcgggagcgatatttctaagcaccataaaagtctgctggccaagatcttttatgacagggccgagtacctgcacggaaagcatggtgtcgacgttgaggtccaggggcctcatgaggctcgggacggtcaactgctcatccggctggaccttaatagaaaggaggtgctcaccctccgccttaggaacggaggaacacagtctgtaacccttacccacttattccctctgtgtaggaccccgcagtttgctttttacaacgaggatcaagagctgccctgtcccctgggacccggggagtgctacgaactacacgttcactgtaagacatcgtttgtggggtactttcctgcaactgtgctctgggaactcctgggcccaggagagagtggttctgagggagccggcaccttttacatagctcgcttcctggcagccgtcgcacacagccccctagcagcccagctgaaaccaatgacaccatttaagcgcacgaggatcactggaaatcctgttgtgacaaatagaatcgaggaaggtgagaggcctgaccgtgctaaagggtacgacctggaactctcaatggcactgggaacctactatcctccgcctagactgcgccaactcttgccaatgttgctgcaggggacatccattttcactgcacccaaggaaattgccgagatcaaggcccagcttgaaacagctctgaagtggcgcaattatgaggtaaagctgaggctccttctgcaccttgaagagcttcaaatggagcacgatattcgacactacgatctggagagcgtgcccatgacctgggatccggtggatcagaatccacgactgctgaccctggaggtgcctggggtgaccgagtcacgcccatccgtactcagaggtgaccacttatttgccctgctttcttcagagacccaccaagaagatccgattacgtacaagggatttgttcataaagtggaactcgatcgggtcaaattatcctttagcatgtcactcctcagccggttcgtggacggactgacattcaaagtgaactttactttcaataggcagccgctccgggtgcaacacagagccctggaactaaccggaagatggctgctttggcccatgctgttccccgtggctcctagggatgtgccattgctgccatcagacgtgaagctcaaactgtacgatcgctctctggagagcaatcccgaacagttacaggctatgaggcacattgtgacaggaacaactcgaccggctctgactgcgtgcttgaccctgaaccagaatcccgccgaacttcccctgcaaggcacggggcgcctcggcgaaggcgtgtacaacccctcgcatagcaccccgtcccccgcaggtgagaacgacacctcttcctgttag

SEQ ID NO: 124879 - DNA, 3012 bp, Artificial Sequence
  Description of Artificial Sequence: Synthetic coding sequence
atgccttccaaattctcatgccgccagttgcgggaggccgggcagtgttttgagtcctttctggtggtgaggggcctggacatggaaaccgatagggagaggctcaggacaatttacaacagggactttaagataagctttggcacccccgcccccggattctcctcgatgttgtatgggatgaaaatcgcgaatctggcatacgtgactaaaactcgggtacggttctttcggctcgacaggtgggcggacgtgcgttttcctgagaaacgtagaatgaaactcggtagcgacatatcgaagcatcataagtctctcctcgccaaaatcttctacgatagagccgagtatttgcatggtaaacatggggtggacgtcgaagtccagggcccccacgaagctcgggatggacagctcttgatacgcctggatttaaatcgcaaggaagtccttactttacgactccgcaatggtggcacacagtccgtgactcttacccatttgttccccttgtgccggactccccagtttgcattttacaatgaggatcaggagctgccctgtccgctcgggcccggggaatgctatgagttgcacgtacactgtaagacaagcttcgtaggttatttccccgcaaccgtgctgtgggaactcttagggccaggcgaaagcgggagcgaaggtgccggtactttttatatcgcccgattcctggccgctgtcgcccatagccctctggcagcccagctgaaaccgatgaccccctttaagcgcacgcggataactggtaaccccgtggtgaccaacagaattgaagagggggaaagaccagaccgagccaaaggatacgacctggagctaagcatggcgctcggtacctattatccacccccacgcctccggcagcttctccctatgctgctccagggcaccagtatcttcacagcacctaaggaaatcgcagaaattaaagcccagcttgaaacagctttaaaatggcgcaactacgaggttaagcttcgacttctgctccacctcgaagagttacagatggagcatgacataaggcattacgacctggagagtgtgccaatgacgtgggaccccgtagaccagaatcctagacttctgacgctcgaggtccctggggttacggagagtcggccctcagtcctgcggggcgaccatctgtttgctctgctgagtagtgagacccatcaggaagatcctattacttacaaggggttcgtccacaaagtcgaattagacagggtaaagctgtctttcagcatgtcgctgctcagtaggttcgtagatgggcttaccttcaaagtgaatttcacattcaaccgccaacccttgcgtgtacagcaccgagccttggaacttacaggtcgatggctcctttggcccatgctattcccagtggcccccagagacgtccccctgctgccatcagacgtgaagcttaagttgtatgacagatctctcgagagtaaccccgagcagttacaggctatgagacacattgtgactggaacaacccggcccgccccgtacataatctttggcccccctggtacgggaaagacagtaactctcgtagaggcgattaaacaggtggtaaaacatctaccgaaggcgcatattttagcctgtgctccgtccaatagcggcgctgacttactgtgccagcgacttagagtccacctgcccagcagcatctaccggttattggcgccatccagagacatccggatggtgcccgaggatataaaaccctgttgtaactgggacgctaagaaaggcgagtatgtgttccctgcgaaaaagaagctacaagagtacagagtgctgatcactacactcattacagccggacgtttggtgagtgcccagttcccaattgaccacttcacacacatcttcattgatgaggcaggacactgtatggaacccgagtcactggtggcaatcgcaggtttgatggaggtaaaagagacgggtgacccaggtggacagctagtattggccggcgacccaagacagctgggccctgtgctgagatccccactcacccagaagcatggtctaggatattcactcctggagaggctacttacatataatagcttgtacaaaaagggtcctgacggctatgatccacagttcatcaccaaactgctgaggaattatcggtcgcacccaacaatcctcgacatccccaaccagctctactatgagggcgagctgcaagcttgcgcagacgtggtggatcgagaacgcttttgccggtgggctggcctccccaggcagggtttcccaataatattccatggtgtgatgggcaaggatgagagggaaggtaattccccctcgttcttcaacccagaggaggcagctacagtaaccagctatctcaaactgttgctcgctccaagcagcaagaaggggaaggcaagactgagccctagatctgtgggtgtgatcagcccttaccgcaagcaggtggagaagattcgctactgtattactaaattagaccgcgagcttagaggcctggatgacataaaggacctgaaagttggctccgtggaggagtttcaaggccaggagaggtcagtgatacttatttctactgtgcgctccagtcagtcttttgttcaactggatcttgacttcaatcttggttttcttaagaatcctaagagattcaatgttgccgtcaccagagcaaaggcactgctgatcatagttggaaaccctctgcttttgggccacgacccggattggaaggtctttctcgagttctgtaaggagaacggcgggtatacaggctgtccattcccagcaaagctcgacctgcaacagggtcaaaacctccttcagggcctgagtaagttgagcccttctacctccgggccccactcccatgactatttgccacaggaacgagagggggagggaggattaagcctccaggtggagcctgaatggcggaacgagctctag

SEQ ID NO: 124880 - DNA, 2844 bp, Artificial Sequence
  Description of Artificial Sequence: Synthetic coding sequence
atgctgtatggaatgaagatcgcaaacctggcgtacgtgacaaaaacaagagttaggtttttccgactggaccgttgggcagacgtgaggttccccgaaaaacgaaggatgaagcttggtagcgacatctcaaaacatcacaagtcgctgctcgccaaaatcttctacgatcgcgccgagtatctgcatgggaagcatggagtcgatgtcgaggtgcaagggcctcatgaagccagggacgggcagttgttgattaggcttgatcttaatagaaaggaggtgctgaccctgaggctgaggaatggcgggactcagtccgtgaccctgactcaccttttcccgttgtgcagaaccccccagttcgctttctacaacgaggaccaggagttaccttgccccctgggtcccggtgagtgctacgagctgcatgtgcattgtaaaactagcttcgttggatacttccccgcaacggtgctctgggagctcctcgggcctggggaatctgggtccgaaggcgccggaaccttctatatcgcgcgcttcctggccgctgttgcgcattcacccctggcagcacagctgaaacctatgacacccttcaagcggacacggatcaccggcaaccctgttgtcaccaaccgcatcgaggagggcgaacgccccgatcgtgcaaaagggtatgacctcgagctatcaatggctcttgggacttattacccaccgcccagactccggcaactgctgcctatgttactacaggggacttcaatttttaccgctcccaaggaaattgcggaaattaaggcccagctggagacagcactgaagtggaggaactatgaggtcaagctgcggcttctccttcatctcgaggagctgcaaatggaacacgatatacgccactacgatctggagtccgtacctatgacctgggatcctgtggaccaaaaccccagacttttgacactggaagttccaggggtcacagaatctcggccatccgtgctgcgcggagaccacctatttgccttgttgagttccgagactcaccaggaagaccctattacttacaaggggtttgtccacaaagtggagttagacagagttaaactctcattttcaatgtcccttctcagtaggtttgtggatggacttacatttaaggtcaacttcactttcaaccgacagcctcttcgagtccaacacagagctctcgaattaaccgggagatggctcctatggcccatgttgtttcctgttgctccacgggatgttcctctgctcccaagcgatgttaaattaaagctctatgacagatcactggagtcaaacccagaacagcttcaggcgatgcgtcacatcgtgaccggcacaaccaggcccgcaccatacataattttcggcccgcctgggacgggaaagactgttaccttggtagaagctatcaaacaggtggtaaagcacctgccaaaagcccatatcttggcttgtgctcccagcaatagtggcgccgatctgctgtgtcaacggctccgggtccatctgccaagttcaatctacagactgctagcccccagccgtgacattcgaatggtcccagaagacatcaagccctgttgcaattgggacgctaagaagggggaatatgtgtttcctgcaaagaaaaaactccaggagtatcgtgtcctgatcactacactaatcacagctgggcgattggtgtctgcccagtttcccatcgaccactttacccatatttttatcgatgaagccgggcactgtatggaaccggagagtttggttgcaatcgccggactaatggaagtaaaagaaaccggcgaccctgggggccagctcgtgctggccggagatcccaggcagttaggtccagtcttacgaagccccctgactcagaagcatggtctcgggtactctctgctggagagactgctgacatataactctctgtacaaaaagggcccagacggatacgatccacaatttattaccaagcttctgcggaactaccggagtcaccccaccatcctggatattcctaaccagctgtactatgaaggtgagcttcaggcatgcgccgacgttgtcgatcgggaacggttctgtcggtgggccggattgccccgacagggctttcccatcattttccacggtgtgatgggcaaagacgagcgcgaggggaactccccatcattctttaacccagaggaggccgcgaccgttacgtcctatctgaagttgttgctagctccaagttcaaagaagggaaaggccagactaagcccacggagcgtcggggtcatcagcccctatagaaagcaggtggagaagattcggtattgcatcaccaaactggatcgggaactgaggggtcttgatgatattaaggacttaaaggttgggtccgtcgaggagttccagggacaggagcgtagcgttatcctaatctcgactgtgagaagcagtcagtcattcgtccagctcgatctcgacttcaacttgggttttctaaagaatcctaaacgattcaatgtggcagtaactcgtgcgaaggctcttctgataatcgtcgggaatcctctgcttttaggacacgatccggattggaaagtttttcttgaattctgtaaggaaaatgggggctataccggctgtcccttccccgctaagctcgatctccaacaaggtcagaacctgctgcagggtctgtctaaactgtccccctcgacgtcagggcctcatagtcatgattacctgccccaagaacgggaaggcgaaggcgggttgagcctacaggtcgagccagaatggcgcaacgagctgtag

SEQ ID NO: 124881 - DNA, 3012 bp, Artificial Sequence
  Description of Artificial Sequence: Synthetic coding sequence
atgccgtccaagttcagctgccggcagcttagggaagccggccagtgcttcgagagtttcctagtcgtccgtggtctggacatggaaaccgaccgcgaaagattacggacgatctataatcgggactttaagattagtttcggcactcctgctcctggattttctagtatgctgtatgggatgaaaattgcaaatctcgcctacgtcactaagactcgggttaggtttttccgcctagaccgctgggcagatgtgcgctttccagagaagagaaggatgaagctaggctcagacatttccaagcatcacaagagtctcctggctaagattttttatgaccgggccgaatatctgcacggtaaacatggagtggacgtagaagtgcaggggccccatgaagctcgggacggtcagctgctgatacgtcttgacttgaacaggaaggaagtgttaacattgcgtctccgaaatggtggcacacagtccgttacccttacccatctctttcctctctgccgcacccctcagttcgctttttataatgaggaccaagagttgccttgccccctgggaccaggagagtgctacgagctgcatgtacactgcaagacaagcttcgttgggtacttccccgccaccgtcttgtgggaactcctgggccccggtgaaagcggcagcgaaggcgctggaaccttctatatcgctcgattcctcgcggctgtggctcattcgcccctggctgcacagctaaaacctatgacccctttcaagcgtactaggataactgggaacccggtggtgacgaacaggatcgaagagggggagcgccccgacagggcaaagggctacgatctggaactttcaatggctctggggacgtattatccccctcctaggcttagacagctgctgccgatgctgctgcaaggcacatccatttttaccgcgcctaaagaaatcgccgagattaaggcacagttagaaacagccctgaagtggaggaactacgaagttaagcttcggctcctgctccacctggaggagctgcagatggaacacgatatacggcactacgatctcgagagtgtgcctatgacttgggaccccgtggaccagaatccccggctactaacattagaggtgcccggagtcacagagagcaggccttccgtgctccgcggtgaccatctgtttgctcttctgtcaagcgagacacaccaggaggacccaattacctataaaggcttcgtgcataaagttgagctggatcgagttaagctaagcttttccatgtcactcctttcgcgttttgtggacggactgacttttaaggtgaacttcactttcaaccggcagccactgagggtacagcatcgcgcactcgaactaacaggccgatggcttctgtggcccatgctgtttcccgtggcccctcgagacgtgccactgctacccagcgacgttaaattgaaattatacgatcgatcgctggagagcaatccagagcagttacaggccatgcggcatatagtcactgggacaactaggccagccccgtacattatattcggaccacctggaacaggaaagactgtgactctggtggaggccatcaaacaggtcgtgaaacatctccctaaggcccacatcttggcatgcgctccctcaaacagtggggccgacctgttgtgccagagactgagagtacatctcccaagctccatctacaggctgttggctccctctagggacatcagaatggtgccagaggatataaaaccctgttgcaattgggacgccaaaaagggggagtacgtgttccccgccaagaagaaactgcaagaatatcgcgtcttgattactacgctgatcacagcaggacgtttggtcagcgcacagtttcccattgatcactttacccacattttcattgacgaagccgggcattgcatggagcccgagtctctcgtagccatagctgggcttatggaagttaaggagaccggtgacccagggggtcagctggttctcgcaggggaccctcggcagctgggacccgtgctgagatctccgctgacacagaagcacggtctgggatatagcctcctggagcgattgcttacctataactctctgtataagaagggccctgacggatacgacccgcagttcatcaccaaacttctccggaattatcgctcacaccccacaattctggacatcccgaaccagttatactatgaaggagaactgcaggcctgcgcagatgttgtggacagagaacggttttgtcgctgggccggtcttccacgccagggttttccaattatctttcacggcgttatggggaaagatgagagagaaggtaacagcccctcattcttcaacccagaagaggccgccactgtcacctcctatctgaaattgcttctggctccgagcagcaaaaagggcaaggcacgtttatcaccacggtcagtcggtgtcattagcccataccggaagcaggtggaaaagatacggtattgtattaccaagcttgatagagaacttcgcggacttgacgacatcaaggatctgaaggtcggctccgtcgaggagttccagggccaggaaaggagtgtgattctgataagcacggtgaggtcctctcaatcgtttgtccagctggacttggatttcaacttgggtttcttaaaaaatccgaagcgttttaacgtcgcagtcacgcgggccaaggcccttctcatcattgtggggaacccactcctgcttggccatgaccctgactggaaagtgtttctggagttctgtaaagaaaacggcgggtatactggatgcccctttcctgcaaagctggacctgcagcaggggcagaatctcctgcagggacttagtaagctgtcaccgagcacaagtgggccccactcccacgactatttgcctcaggaacgtgagggagaaggcggtctaagccttcaggtggagcccgaatggcgaaatgagttgtag

SEQ ID NO: 124882 - DNA, 2826 bp, Artificial Sequence
  Description of Artificial Sequence: Synthetic coding sequence
atggagactgaccgggaacggctgagaaccatctacaatagggatttcaagatttcctttggtacccctgctcccggcttttctagcatgttatacggaatgaagatcgctaaccttgcgtacgtgaccaagacccgcgtgcggtttttcaggcttgacaggtgggccgacgtgagattcccagaaaaaagaaggatgaaactgggatctgatatatccaaacaccacaaaagtctgctcgctaagattttttatgatagagccgagtacctgcatgggaagcacggtggtacccagtcggtcacactgacacacctgttccccctttgtagaactccccagtttgccttctacaacgaggatcaagaattgccgtgtccactgggccccggcgaatgttatgagctgcacgttcattgtaagacgtcctttgtagggtatttccccgctaccgtgctgtgggaactcctggggcccggcgaaagcggctcagaaggggcaggcaccttctatattgcccggtttctcgcagccgtggcacactcaccactcgccgcgcagctgaagcccatgactccctttaagaggacccgcatcactggaaaccctgtggtcacaaaccggatcgaggagggcgagagaccagaccgcgccaagggttacgacctcgaattgagtatggctctgggcacctactacccacccccccggctccggcagctgctacccatgctgcttcagggaaccagcattttcacggctcctaaggaaatcgcggaaatcaaggctcagctggagaccgccctcaagtggagaaactacgaggtgaagcttcgattgctcctacacctagaggagctacaaatggagcatgacatacgacattatgatctggagtcagtaccgatgacttgggatccagttgatcaaaacccccgcctgttaacactggaagtgcctggcgtgacagagagtagaccctctgtcctgaggggggatcatttgtttgcactgctgagtagcgagacccatcaagaagatcctatcacatacaagggattcgttcataaggtggaactggacagagtgaaattgagtttttccatgtctctgctttcaaggttcgtggacggtctaacattcaaagtcaatttcacttttaatcgacagcccctcagggtccagcatagagcccttgagctgacggggagatggctgttgtggccaatgctgtttcctgtggcaccaagagacgtccccctgctgccttctgacgtcaagttgaaactatacgatcgatccctagagagcaaccccgaacaactgcaggctatgaggcacatagttaccggcactacgcggcccgccccctacatcatcttcggccccccaggaaccgggaagacagtcaccctggtcgaggccataaagcaggtggtgaagcacctgccaaaggcgcatatcctggcatgcgcccctagcaactcaggtgccgacttactgtgccagcgcctccgggtgcacttgccctcgtctatttacagacttcttgccccttctcgcgacatacgcatggttcctgaagatatcaaaccctgttgtaactgggacgctaagaaaggagagtatgtgttccctgccaaaaagaaattgcaggagtatcgggttctgataaccactctcatcaccgctggacgtctggtgtccgcccagtttccaatcgatcatttcacccacatttttattgacgaggccggacactgcatggagcctgaaagtctagtggccatcgctggcctgatggaggtgaaagagacaggcgatccaggtgggcaactcgtcctcgctggggatccacggcagctggggcccgttctgaggagtcccttgacccagaaacatggtttaggatatagtctactagagaggctgctgacatacaattccctctacaaaaagggccctgatgggtacgacccacagttcatcacaaagctcttgagaaactacaggagtcatcctaccattctggacatccccaaccagctgtattacgaaggggagttgcaggcctgtgctgatgtggtcgacagggaaagattttgcagatgggccggactgccccgacaggggtttcctataatctttcacggggtgatgggaaaagacgagcgagaaggcaattcgcctagtttcttcaatcctgaggaggctgcaaccgtgactagctatctcaagctgctgcttgctcccagtagcaaaaagggtaaagctagactctcacctcggtcagtaggggtgatttccccctatcgcaaacaggttgagaaaatccgatattgtataactaagctagaccgcgagctcagaggactagatgatatcaaagatcttaaggtcggctcagtcgaagagtttcagggtcaagagaggtcagtgattttgatcagcacagtccgaagctcacagtctttcgtccagctcgatctggacttcaatctgggctttctgaaaaaccccaaaaggtttaatgtggctgtcacccgagctaaagcactgctgatcatagtcggcaatcccctcttgcttgggcacgacccggactggaaagtcttcctcgaattttgtaaggaaaatggcgggtacactgggtgcccgtttcccgccaagttggacctacagcagggccagaatctgctccaaggcttgtctaaactgagccccagcacaagcggcccccactcccacgattacctcccacaggagcgagaaggagagggaggcttgtcactacaggtggaacctgaatggagaaacgaactgtag

SEQ ID NO: 124883 - DNA, 3012 bp, Artificial Sequence
  Description of Artificial Sequence: Synthetic coding sequence
atgccatctaaattctcatgtcggcagttgagggaggccggtcagtgttttgaaagttttctggtcgttcgggggctagatatggaaaccgacagagaaagacttcggaccatctacaatcgggacttcaaaatttcttttggtaccccagctccaggatttagttcgatgctttatgggatgaaaatcgccaacctcgcatatgttacaaagactagggtcaggttcttcaggctcgatcgctgggccgatgtgcggtttcctgaaaagaggcgtatgaagctcggttcagacatcagtaaacatcacaaatccttgctcgccaaaatcttttatgatagggccgaatacctccacggaaagcacggggtagacgtcgaggtccagggaccacatgaggctcgcgatgggcagctcctgataagacttgatttgaacaggaaagaggtgttgacactgagactgagaaatggcggaacacagagcgtgacactcacccacctgttcccactgtgccgaacaccccagtttgctttctataacgaagaccaggagcttccgtgccccttgggccccggtgaatgctacgagcttcacgtgcactgcaagaccagcttcgtgggctactttcccgctacagtgctttgggagctgctgggtccgggcgagtctggatccgaaggagctgggactttctacatagctcggttccttgctgccgtggcacattccccgctagccgcgcaactgaaacctatgactccttttaaaagaaccagaattaccggcaacccagttgttacgaatcggattgaggaaggcgaacgccccgatagggccaaaggctacgacctggagctgtccatggctttagggacctattatcccccccctcggctacggcagctgttgccaatgctcctgcaggggacaagcatctttacagcccccaaagaaatcgctgagatcaaggcccagctcgaaacagccctaaaatggcggaattatgaggtgaagctacgcttgctcctgcacctcgaagagctgcagatggagcacgatatcagacattacgacctggagagtgtgcctatgacatgggatcctgtagaccagaacccacgcctgctgaccctggaagtccccggcgtaactgaaagtcgtccctctgtgctccggggcgatcatctatttgcactcctctccagcgaaacacaccaggaggaccctatcacctataaggggttcgttcataaggtggagttagacagagtgaagctgagcttttcgatgagccttttgagtagattcgtggacgggctgacatttaaggtcaacttcacctttaacaggcagcccctccgagtgcagcacagagctttggaactgaccggcaggtggctgttatggccaatgctctttcccgttgctcctcgtgacgtgccattactgccctccgacgtgaaattaaagctgtacgatcgaagtctggaaagcaacccagagcaactgcaggcaatgcgacacatcgtgaccggaacaacaagaccagctccttatattatatttggtcctcctggaaccggaaaaaccgtgactcttgtcgaggccattaagcaggtggtgaagcacctgcccaaagcacacatccttgcttgtgcaccaagcaattctggggctgacctcctatgtcaaaggctccgcgtacaccttccaagctctatatacaggctgttggccccaagtagagacattcgtatggtaccggaggatattaagccatgttgtaactgggacgctaagaaaggtgagtatgtattccccgccaaaaaaaaacttcaggagtaccgggtattgatcactaccctcataaccgcaggacggctggtgagcgcacagttccccatagatcattttacccacatttttatcgacgaggcaggccactgcatggaacctgagagtttggtagcaatagcgggactgatggaggttaaagaaaccggagaccccggcggccaactggtgctcgccggggatccacgacaactgggccctgtgctcaggagccctctgacccaaaagcacgggctgggttacagcctgctagaacgactgctgacatacaacagcctgtataagaaggggcccgacggttacgacccgcagtttattaccaagctgttgagaaactatcgcagtcatccgaccatcctggacattccgaaccaactgtactacgaaggcgagctgcaggcctgcgcggatgtggtcgaccgggagaggttctgcagatgggccgggttgccaaggcagggtttccctatcatctttcacggcgtcatgggcaaggatgagagggaggggaactctcccagttttttcaacccagaggaggcagctacagtcacttcctacctaaagctgctcttggcacctagctcaaaaaaaggaaaggctcggttgtctcccaggtctgttggggtcatttcgccctaccggaagcaggtggaaaaaatcaggtactgcatcaccaagcttgatagagaactgcgggggcttgacgacatcaaggacctgaaagtcggctccgtggaggaattccaggggcaggagagatccgtgatcctgatcagcactgtgcggagctcacagtctttcgtccagctggacctggatttcaatctcggattcttaaaaaatccaaaaaggtttaacgtggccgtaaccagggctaaagcactacttattattgtcggcaatcccctgctgcttgggcacgaccctgattggaaagtgttcttggaattttgtaaggagaatggcggctatactggatgccctttccccgccaagttggacctccagcagggacagaacctgctgcagggcctgagcaagctctccccatcaacttccggcccacattcacatgactatctgccgcaggagcgggagggtgaaggagggctctccctgcaagtcgagccagagtggagaaatgagctctag

SEQ ID NO: 124884 - DNA, 171 bp, Artificial Sequence
  Description of Artificial Sequence: Synthetic coding sequence
atgcctagtaagttttcatgccgccaattgagggaggcgggtcaatgcttcgagtcttttcttgtcgtgagagggctagacatggaaactgaccgggaaagacttcggaccatttataacagagattttaagattagcctagcttcatcaaaatccatcttacagagttag

SEQ ID NO: 124885 - DNA, 3636 bp, Artificial Sequence
  Description of Artificial Sequence: Synthetic coding sequence
atgctcagcctcgccgctaaactggtggctttcttttggcggacggcggacacaccccgcgaggaggccggccagcttgagccagaattggccgaaggcgatactaagcttaagacagtgaggggcgtggtgactcgatactgttccgattacggaatgatcgatgatatgatctacttctcgagcgacgccgtgacatcccgtgtgttgctgaacgtggggcaggaagtcatcgcggtggtcgaagaaaataaggtttctaatgggctaaaggccatcagggtggaagctgtaagcgataaatgggaggatgacagccgcaaccatggttccccaagtgattgcggtccccgggttctgatcgggtgtgtcaccagcctcgtcgagggtgccggatgcattagccagacgacttacttttccctggaatcagtctgtgaaggatttgagccatgcaagggagattgggtcgaagccgagtaccgaatccggccaggcacatggtcaagtgaggccacttcagtgaagcctctgcgatacaagagggtggacaaagtgtgtatcagctcactgtgtggaaggaacggagtgcttgaggaaagtatcttctttacattagacagcctgaaactccccgacggatatacacccagaaggggggatgttgttaacgccgtcgtggttgaatcctcgcagagttgttatgtttggcgtgccctctgtatgacacttgtcaagagacgggatgcagctcctgtccacgaggcaacgcacttctatgggaccatcttgctgaagaataaaggggatatcgaggtgacacaggtaactcacttcggcaccctcaaggagggccgttcgaagaccatggtgatttggattgagaataagggagatattccgcaaaatctggtgagttgtaaactggccgggtgggacaaatcgaagcagtttcgtttccagatgttagataaagaccaaatgtgccccgtggtgtcttttgtatcagtcccagagaaggagaatagttcagacgagaatatcaacagccttaattctcacaccaagaataaaacatcacaaatgagcgagtctagtctcgtcaataatcgagggatctcccccggcgactgcacatgcaaaggcgagaacggcgagaaggacaacattctctcaaggaaacaaatgacagaacccgagccaggcggccttgtccctcccggcggaaaaactttcattgtcgtgatttgcgacggcaaaaatcctggccgctgtaaggagctcctgttgttgtgttttagcgattttttgatcggcagatatcttgaggttaacgttataagcggggaagagtccttgatcgccgcacgcgaacccttcagttggaagaaactgaaatcctcccaggccctcacctcagccaaaacaacggtggtcgtgacggcccaaaagaggaactctcgcaggcagttgccttctttccttccacagtaccctatcccggatcgtttacgcaaatgcgtggagcaaaaaatagatatcctaacgtttcaaccattattggcagagctgctgaatatgtccaattacaaagagaaattctccaccctgttgtggctggaggaaatttatgctgagatggaactcaaagaatataacatgtccggcataatcctcagacgtaatggcgatctattagttctcgaggtgccaggtctggccgaggggcggcccagtctctatgcgggagacaagcttatcttgaagacccaggagtataatggccacgcaattgaatacatctcctatgtaaccgagatccacgaagaagacgtgacacttaagattaacccagagtttgaacaggcctacaatttcgagcctatggacgtggaatttacgtacaatagaaccacgtcccgccgatgccactttgcactggaacacgtgatccatctgggggtgaaggtgctattcccagaggagattattttgcagtccccacaggtaactggcaactggaaccacgcacaggacacgaaatcatctggccaatctactagcaaaaagaatcgaaaaacgatgaccgaccaggcggagcatggaacggaggagagacgagtgggcgacaaggaccttccggtcttggccccattcaccgctgagatgagcgattgggtagacgaaatacagacaccaaaggctaggaaaatggaattctttaaccctgtgctgaatgagaaccagaagttggccgtgaaaaggatcttaagcggtgactgcagaccgctcccatacatcctgtttggccctcctggtactggtaagacagtgacaattatcgaggctgtgctgcaggtgcatttcgcactacccgactctcgcattttggtgtgtgccccgtcaaacagcgcagctgacttagtgtgcctcaggctgcatgaaagcaaagtgctgcaacctgcgaccatggttcgcgtaaatgcaacttgccggttcgaggagattgtcattgacgcagttaagccttattgtagagatggggaagacatttggaaggcaagtagatttcgaatcatcatcaccacctgttcctcctcaggcctcttctaccagataggggtgcgggtgggtcatttcacccacgtgtttgtggatgaggcgggacaggcgtccgagcccgagtgtctgatcccactggggctgatgtccgatattagtggccagatcgtgctggctggagatccaatgcagctcggacctgtgattaaatcccggctggcaatggcctatggattgaatgtgagcttcttggagcggctgatgtcccgcccagcctaccagcgagatgagaacgcgttcggcgcctgcggtgctcacaaccctctgctcgtcaccaaactggtcaagaactatcgatcacatgaagccctcctcatgctgccgagccggttgttctatcatcgtgaactggaagtgtgcgccgatcccacggtggtgactagcctgttaggatgggaaaagttgcccaagaagggcttccccttaatctttcacggagtacgtggtagtgaagccagagagggcaagtctccttcctggtttaaccccgcggaggcagttcaggtgctccgttactgctgtttgctagcccacagtataagctcccaagtctcggcttccgacatcggggtcatcacgccgtataggaagcaggttgagaagatccggatactgcttcgcaatgtggacctgatggacatcaaggtgggttccgttgaggaatttcaagggcaggaatacttggtcattattatttccaccgtgagatccaacgaggacagatttgaggacgatcggtacttcctgggatttctctcaaatagtaagcgtttcaatgttgcgattacccgccccaaggcattattgatcgtactgggcaaccctcatgtactcgtgcgggacccatgttttggggcgctccttgaatacagcatcacaaatggggtgtacatgggctgcgatctacccccagcgctccagtccttgcagaactgcggcgaaggggtcgccgacccctcgtacccggtggtcccagagtccaccggccccgaaaagcaccaagagccctcatag

SEQ ID NO: 124886 - DNA, 378 bp, Artificial Sequence
  Description of Artificial Sequence: Synthetic coding sequence
atgagtgatatctccgggcaggttacaaaactagttaagaattatcgaagccatgaggccctgcttatgttaccgtcccgactcttctatcacagggaactcgaggtttgtgccgatcctaccgttgtgacgtctctccttgggtgggagaagctcccgaaaaagggcttccctttgatattccacggtgttaggggatctgaggcacgggagggtaagtctccctcctggttcaaccccgccgaagcagtccaggtcttacgatactgctgcctgttagcccacagtattagctctcaggtttctgccagcgacattggcgttattacaccttaccggaaacaagttcggcctgcacaggcacggctagtcctgtag

SEQ ID NO: 124887 - DNA, 378 bp, Artificial Sequence
  Description of Artificial Sequence: Synthetic coding sequence
atgtctgatattagcgggcaggttaccaaactggtgaaaaattacagaagtcacgaggcccttctgatgctccccagtcggcttttctaccacagggaactagaggtttgcgcagaccctacagttgtcacgtcactgctggggtgggagaagctccccaaaaaaggctttccccttatcttccacggcgtgcgtggcagcgaagcccgggaaggaaagtcaccaagctggttcaatccagccgaagcggtccaggtgctccgttattgctgcttgctggctcacagtatctcttcccaggtttctgccagcgacatcggggtcatcacgccttaccgcaaacaggtccggcctgctcaagccaggctcgtgctgtag

SEQ ID NO: 124888 - DNA, 1017 bp, Artificial Sequence
  Description of Artificial Sequence: Synthetic coding sequence
atgtttcgcgtgggccattttacgcacgtattcgtggacgaggcgggacaggcctctgagccagagtgtctgatccctctgggcctcatgagcgatatttccggacagattgtgctggccggggacccaatgcaactggggcctgtcattaagagtcgcctggccatggcatacgggctcaatgtcagcttcctcgagcgcctgatgtcccgccccgcttaccagcgggatgaaaatgcttttggcgcctgcggagctcataacccactccttgtgaccaaattagtaaaaaattaccgatctcacgaggccctgttgatgctgccatcacgattgttctaccatcgcgagcttgaggtgtgcgcagaccccacagtcgttacctccctccttggatgggagaaactcccgaagaaaggctttccgttgattttccacggcgtgcggggttcagaggctagagaaggcaagagccccagttggtttaacccggccgaggcagttcaggtgctgaggtactgctgcctgttggctcactctatctccagccaggttagtgcctcagacataggggttattacgccatatagaaaacaggtcgagaagatccgcatcctcctcagaaacgttgatctgatggacataaaggtaggcagtgtcgaagagtttcaagggcaggagtacttagtcataatcatctccactgtacggtccaacgaagataggttcgaggacgatcggtactttctcggtttcctaagcaactctaagcgattcaatgtggccattacccgtccaaaagcactgctgatcgtgctagggaatccacacgttctagtaagagacccctgttttggcgcccttctagagtatagtataactaacggggtgtacatgggatgtgatcttccacccgccctgcaatccctgcagaactgcggtgaaggagtcgccgatcctagctatcctgtggtgcccgagagtacgggcccagagaagcatcaggagcccagttag

SEQ ID NO: 124889 - DNA, 3498 bp, Artificial Sequence
  Description of Artificial Sequence: Synthetic coding sequence
atgctgtctctcgcggctaagttagtcgcctttttctggagaaccgctgacacgccacgcgaagaagcgggccaattggagcctgagctggccgaaggagatactaagctaaagaccgtgcggggggttgtgacacggtattgtagtgattacggcatgattgacgacatgatttatttttctagcgatgccgtgacttcgagggtattgttgaacgtaggccaggaggtgatcgcggtggttgaggagaataaagtgagtaacggcttgaaagcgataagagtggaagcagtgagcgataagtgggaagacgatagtcgaaaccacggatcacccagcgactgcggcccccgcgtgcttattggctgcgttacaagtctggtggagggagcgggatgtatttctcagactacatatttcagcctggaatctgtgtgcgagggattcgagccatgcaaaggggactgggttgaagccgaatatcgtattagacccggcacatggagttctgaggccacctcagtgaaaccacttagatataaacgcgtagataaggtatgcataagtagcctctgcggacgaaatggtgtgcttgaagagtccatcttttttacactagactccttgaagctaccggacgggtatacacctagaagaggtgacgtagtcaatgccgtggtagttgaatcttcgcagagctgttatgtatggagagcactgtgcatgacgttggtgaagcgccgtgatgctgcaccagttcatgaggctacccacttttacggcaccattctgctgaaaaacaaaggtgacattgaggtcacacaggtaacgcactttgggacccttaaggagggtagatctaaaactatggtcatttggattgaaaacaaaggcgatattccccaaaacctcgtgagttgcaaactggctgggtgggataaatctaagcagttccggttccagatgcttgataaagatcagatgtgcccagtggtgagcttcgtttcagtgcccgagaaagagaattctagcgacgaaaacatcaactccctgaattcccacacgaagaacaaaaccagccagatgtccgagtcctcactggttaacaatcgtggtatctcacctggagactgcacatgcaaaggcgagaacggagagaaggataacatcctttctcggaagcaaatgacagagcctgaaccaggagggctggtcccaccaggaggcaaaaccttcattgtcgttatttgtgatggaaagaatcccgggcggtgcaaggagttattattactgtgcttttctgactttctaatagggagatatttggaggtaaacgtgataagtggagaagaaagccttatagcagcgcgggaaccgttctcctggaagaagttaaagtcctcccaagctcttacatctgccaagacaaccgtggtggtcaccgcccaaaagaggaattctagacgtcaactgccctccttcttgcctcagtaccccataccagaccggttgaggaagtgcgtcgagcagaagatcgacatcctcactttccagcctcttttggcggaactcctgaacatgtcaaattacaaggagaagttctctacactgctgtggttagaagagatctatgccgaaatggagctcaaggaatataatatgtccgggataattctgcgcaggaatggcgatctactcgtcctggaagtgcccgggcttgcggaaggtagaccctccttgtatgcgggcgataagctcattctcaaaactcaagaatataacgggcatgccatcgagtatatctcttatgtgaccgagattcacgaggaggacgttacactcaagattaatccagaatttgaacaggcatataacttcgagcccatggacgtggagttcacctacaataggaccacctccagaaggtgccatttcgccctcgaacacgtgatccatctgggagttaaggttctttttcccgaggaaattatcctgcagtcccctcaggtcacaggaaactggaatcacgcgcaggacaccaagtccagtggtcagtcaacgagtaaaaagaacagaaaaactatgaccgatcaggctgagcacggaacagaggaacgcagggtcggcgacaaagaccttccagtactggcccctttcaccgcagaaatgagcgattgggttgatgagatccagacccccaaagccagaaagatggagtttttcaaccccgtgctgaacgaaaaccagaagctggctgtgaaaaggatcttgagcggtgactgcaggccattgccttacatactctttggcccacctggaactggcaaaaccgtcaccattattgaggctgtgcttcaggtgcactttgcactccctgatagcagaattctcgtttgcgctcctagtaatagcgctgccgatttagtgtgtcttagacttcacgaatccaaagtgctgcagcccgccaccatggtgcgcgttaacgccacttgccgcttcgaggaaattgttattgacgccgtgaagccctactgtcgggacggcgaggacatttggaaagcttctcgcttccgcattataatcacgacgtgtagctcaagcggactcttctaccaaattggtgtgagggtgggacacttcactcacgtgttcgtcgatgaagcaggtcaggccagcgagccagaatgtcttatcccattggggttgatgtcagacatttctggccaaatagtgctggccggcgatcctatgcaattaggtccagttattaaatctagactggctatggcatacggtcttaatgtcagctttctggagaggttaatgtcccgcccagcgtatcaacgggacgagaatgcgtttggtgcttgcggggcgcataatccccttctggtgaccaaactcgtgaaaaactacaggtcccatgaggcattgttgatgctcccctcccgcctgttttaccacagagaactagaggtctgtgctgatcctacagtcgtcacctccctgctcgggtgggagaagctccccaagaagggttttccgctcattttccatggagtgcgaggatccgaagcccgggaaggtaagagtccatcatggttcaatcctgccgaggccgtccaggtgttgcggtattgttgtcttctcgctcactcaatttccagccaggtgtctgcctctgacataggagtaatcacgccatataggaaacaggtcgagaagatccgtattctgctgcggaatgtggacctaatggatatcaaagtgggcagcgtagaggaatttcaggggcaggaatacctggtaatcataatttccaccgatccatgttttggcgcgctgcttgaatacagcatcaccaacggagtttatatggggtgcgacctgccccccgctctccaatccttacagaactgtggagagggcgtcgcggacccatcctaccctgtagtccccgagtctacgggccctgagaaacaccaagagccaagctag

SEQ ID NO: 124890 - DNA, 636 bp, Artificial Sequence
  Description of Artificial Sequence: Synthetic coding sequence
atgtcattcctgccggtgagaagcgtgataggagggggggacacaaaactgaagactgtgaggggggtggtgacacggtattgttctgattacggcatgatagatgatatgatctacttctccagcgatgcagtcacctcgagggtcctcttgaacgttggccaggaggtgatcgctgtcgtggaggagaacaaagtcagcaacgggctgaaggcgattcgtgtagaggctgtgtcggataagtgggaagacgacagtagaaatcacggatcacccagcgattgcggtccgagggtgctgatcggttgcgtgacctctctcgtggaaggcgcggggtgtatttcccaaactacctacttctcacttgagtccgtctgcgaagggttcgagccttgtaaaggagactgggtcgaagctgagtacagaatcagaccaggcacatggagcagtgaggccacgtccgtgaaacctttacgatataagcgggtcgataaggtggcatgtcgtctcgtggccccactctgcgccagcgggagacccgcgattagggggaacttgcacgggcccgggttcagttgtatgtgctggaaacccgggaagattaaattgtgtcatgggcaacgggaaaagaaatag

SEQ ID NO: 124891 - DNA, 3498 bp, Artificial Sequence
  Description of Artificial Sequence: Synthetic coding sequence
atgtccttcctccccgtgcgctctgtgatcggaggcggtgataccaagctgaagaccgtccgcggcgtggtcacaagatactgctccgattatgggatgattgacgatatgatctatttctcatcagatgccgtgacttctcgggtactgcttaatgtgggacaagaggtcatcgcggtggtggaggaaaacaaggtgtccaatggcctcaaagccataagagtggaagcagtgagcgacaaatgggaggatgactcgagaaaccatggatcccccagcgactgcggccctcgggtactgatcgggtgtgttacatctctggtggagggggctggatgcataagccagactacttacttttcactggaaagcgtttgcgaggggttcgaaccgtgcaagggcgattgggttgaggccgagtaccgaattagacccggcacgtggtcgtcagaggccaccagtgtcaaacctctaagatataagcgcgtcgataaggtgtgcatttcctctctgtgcggacgcaacggagtgttggaggaatcaatatttttcactcttgactccctcaagctccccgacggatacacaccaagaaggggcgatgtcgttaacgctgtagtggtggagtcctcccagagctgttatgtctggcgagctctctgtatgacacttgttaaaagacgggatgccgcacccgtgcatgaagccactcatttctatggtacgatcctcttaaagaacaaaggagatatagaggttacccaggtcacacattttgggacactcaaggaaggacggtccaagactatggtcatttggatagagaacaagggcgacataccacagaatttagtgtcctgcaagttagctggatgggataagtccaaacagtttcggtttcaaatgctcgataaagaccagatgtgccccgtagtctcatttgtaagcgttcccgaaaaggagaattcctcagacgagaacataaatagtctaaattcccacaccaaaaacaagacctcacagatgagcgagagctccttggtgaacaatcgcggcataagtccgggagactgtacttgtaagggcgagaatggcgaaaaggataatattctgagccgcaagcaaatgaccgaaccggagcctggcgggcttgtgcctcccggagggaagaccttcattgtagtgatctgcgacggcaaaaatccaggcaggtgtaaagagttgctgttgttgtgcttcagcgatttccttataggacgatacctggaggttaatgttatatctggtgaagagagcctcatcgcagcacgagagcccttcagctggaaaaaactcaagtcctcccaggcactgactagcgctaagacaactgttgtagttactgcccagaaaagaaacagtcgtcgacaactcccctccttcctaccccagtatcccattcccgatagacttagaaaatgtgtggagcagaagatcgatattttaacttttcaaccgttgctggcagaactactgaacatgtccaattacaaggagaaattctctacactgttgtggctggaggaaatttatgccgaaatggagttgaaggaatacaatatgtcggggatcatactaaggaggaacggggatctcctggtgctggaggtgcccggcttagctgaagggaggccctcattatatgctggggacaagctgattctaaagacgcaggagtacaatggccacgcaatagagtacattagttacgttaccgaaatccacgaagaagacgtgactctaaagataaaccccgaattcgagcaagcatataacttcgaaccgatggacgtcgaatttacatacaatcgaactacttcaagaagatgccacttcgccctggaacacgtgattcatctgggtgtcaaagtgctttttccagaggagattatcctgcagtcccctcaagttacaggcaactggaaccacgcacaggacaccaaaagtagcggccagagcacatcaaagaaaaatagaaagacaatgacagaccaggccgaacatggaactgaagagaggcgcgtaggggacaaggatctgcccgttttagccccctttactgctgaaatgtcagactgggttgacgaaatccaaacacccaaagcacgaaaaatggagttttttaatccagtcctgaatgagaaccagaagctggctgtgaagagaatcctgagtggagattgtaggcctctaccttatatcctttttggcccacctggcacagggaagaccgtcactattatcgaagccgtgcttcaggtgcacttcgcgctgccggattctcgcattctggtgtgcgctccgagcaactccgctgcagacttagtgtgtctgagactgcatgagtccaaagttcttcagccagcaacaatggttcgggtgaacgctacctgccgtttcgaagaaattgtgattgacgccgtgaaaccttactgtcgggacggagaggacatttggaaagcatctaggtttcggataatcatcaccacctgctcctcgagtggcctgttctaccagatcggagtgcgtgtgggccattttacccacgtcttcgtggatgaggcaggccaagcatctgaacctgagtgcctgatccctttagggctaatgtctgacatatcaggacagatcgtcctggcaggcgaccctatgcagctcggccccgttatcaagagtagattagcaatggcttatggcctgaatgtgtctttcctggagcgcctgatgagtaggcctgcttaccagagggatgagaatgcctttggtgcttgcggcgcccacaatccgctgctggtaacaaagctggtgaagaactaccggtcccatgaggccctcctgatgcttccatcccggttattttaccacagagagctcgaggtgtgtgccgaccctaccgttgttaccagtctcttgggatgggaaaagcttcccaagaaggggttcccactgatctttcatggcgttcgagggagtgaggcgcgcgagggcaagagcccttcctggttcaacccagctgaagctgttcaagtactgaggtactgttgtctgctggcacattcgatctcttcacaggtgtccgcgtccgacattggcgtgatcacaccctacagaaagcaagtggagaaaatcagaatccttctgcgcaacgtcgacctgatggacattaaggtgggctccgtggaggaattccaggggcaagaatatttggtgatcatcatttcgaccgtgagatcaaacgaggatcgttttgaggacgatagatattttctaggttttctgagcaactcaaaaaggtttaatgttgccatcacaagaccaaaagcattgctgattgtactgggaaatccacacgtgttagtccgcttgtggcgaggtggaggaaggcctctgcttcccagcggcgcccgaatacaccgcaccagggaggcctcaggagcgcagctgatctgttcggggtag

SEQ ID NO: 124892 - DNA, 3636 bp, Artificial Sequence
  Description of Artificial Sequence: Synthetic coding sequence
atgctctcgctcgccgcaaaactcgtggcattcttctggcggactgcagacactccccgggaggaggctggtcaactggagccagaactggctgaaggggacacaaaacttaagacagtgaggggagtggtcacccgttattgttccgattacggcatgatagatgacatgatttatttctcctccgacgctgtgacctcgagagtgctgctgaatgttggccaggaggtaatcgccgtcgtggaagaaaacaaggtctcaaacggcttaaaagcgattcgcgtggaggcggtaagcgacaagtgggaagatgactcacgaaaccatggctctccaagcgattgcggtcctcgggttctcataggatgcgtgacttctcttgtggagggagccgggtgcatctctcagacaacgtattttagcctcgaatctgtgtgtgaaggcttcgagccatgcaagggagattgggttgaagcggagtaccgtattcggcccggcacttggagtagcgaggctacgtcggtgaaaccactgcgctacaagagagttgacaaggtgtgcattagctccctttgtggcagaaatggagtgctcgaagagtctatcttttttactcttgattccctgaaactgcctgatggttacaccccacgtaggggcgatgtagtgaacgcagtggttgtggagtccagccaatcttgctatgtgtggagggccctgtgcatgacactggtcaagcgacgtgacgccgcaccagtgcatgaggccactcatttctacggtaccattttattgaagaacaaaggggatattgaggtgacgcaggtgactcatttcggaaccttaaaagaaggtagaagtaaaaccatggttatctggatcgagaataagggagatatccctcagaatttagttagttgtaagctggcaggctgggacaagtctaaacagtttagatttcagatgctggacaaggatcagatgtgccctgtcgtgtcgtttgtttctgtgcccgagaaggagaacagttcagatgaaaatataaattctctgaactcccacacaaagaataagacatcgcagatgagtgaatcctctctcgtaaacaatcggggaatttcgcccggtgactgtacgtgtaaaggtgagaatggggagaaagataacatactttccaggaagcagatgactgagcctgagccagggggcctagtcccccccggaggtaaaacttttatagttgtcatctgtgacggcaagaatccaggtcggtgtaaggaactattgttactgtgcttctcagactttctgatcggccggtacctggaggtaaatgtgatcagtggcgaggaatcactgattgctgcgagagaaccttttagctggaagaaacttaaaagctcccaggccctcacgagcgccaagactactgtggttgttactgcccagaaacggaactcccggaggcagctcccatccttcctgccacagtaccctatcccggaccggctacgaaagtgcgtggaacagaaaatcgacattctgactttccagccactgctcgccgagctgcttaatatgagtaattataaggaaaaattctctacactcttatggcttgaagagatctacgccgagatggaactgaaagagtataacatgagcgggatcattctccgccgaaacggtgatctgttagtgctcgaggtgcctggactggcagaaggaagaccttcattatatgctggggacaagctgatccttaaaactcaagaatataacgggcatgccattgaatatatttcttatgtcactgaaatccacgaagaggacgtgacactcaaaataaatccggaatttgaacaggcctacaactttgagcccatggatgtggaattcacttacaaccgcaccacgtctagaagatgtcacttcgcgctcgaacatgtgattcacctcggcgtcaaagtgctcttccctgaagaaatcattctgcaaagcccacaggtgacaggcaattggaatcacgctcaagacaccaaatcttccggccaaagtacttccaaaaagaaccgaaagacaatgactgaccaggcagaacatggaacagaggagcgacgggtcggcgataaggacctacctgtattagcccccttcactgccgaaatgtctgactgggtagacgaaatccagacccctaaagcacgaaagatggaattctttaatcctgtcctgaatgaaaaccaaaaactggcggtgaagcggattctgtcaggagactgtcggcctctgccatatatccttttcggaccacctgggacaggtaaaacagttaccattattgaggctgtgctacaggtgcattttgctttgccagattcacggatcctggtttgtgctccttccaactctgcagccgacttggtgtgcctgaggctccatgagagcaaagtcttacagccagccacgatggtccgagtcaacgccacttgtcggttcgaagaaattgtgatagatgcggtaaagccctactgtcgcgatggtgaagacatatggaaagcctcccgatttagaatcattatcaccacgtgctccagctccggactgttttatcaaattggagttcgcgtgggacactttactcatgtgtttgtcgacgaggctggacaggcgtctgaacccgagtgtctgatacccttagggctgatgtccgatatcagcgggcagattgtccttgccggcgaccctatgcagctgggccccgtgattaagagcaggcttgcgatggcatacggtctcaacgtttccttcctcgaaaggctcatgtcccggccagcttaccagcgggatgagaatgcctttggtgcatgtggagcccataacccactgttagtgacaaagctggttaaaaactaccgtagtcacgaggccctattgatgctgccaagtcggctgttttatcatagagaactggaggtttgtgccgatccaaccgttgtcacctctctgttgggctgggagaagctgccaaagaaagggtttcctctaatatttcacggggtgaggggcagcgaagctagggagggaaagtcaccgtcgtggttcaatccagcagaagccgtgcaggtcctccgttattgctgcttattagcccattcgattagttcacaggtctcagcctcagatatcggtgtaatcacaccctacaggaagcaagtggagaaaatccggatccttctgaggaacgtcgatttgatggatattaaagtgggctctgtcgaggaattccaaggccaagagtatctggtgataatcatctctacggtcaggagtaatgaagaccggttcgaggatgacagatatttcctggggtttttgagtaattccaagaggttcaatgtcgctatcacaagacccaaagcgctcttgattgtgttggggaaccctcatgtcctcgtgagagatccatgctttggtgcactactggaatattctattacaaatggcgtctacatgggctgcgaccttcccccagcactacaaagcttacagaattgcggagaaggggtggccgacccatcttaccctgtggtgcccgaatctactggccccgaaaaacaccaggagccaagctag

SEQ ID NO: 124893 - DNA, 483 bp, Artificial Sequence
  Description of Artificial Sequence: Synthetic coding sequence
atggccgccgagaggaagacccggctgagtaagaacctgcttcgaatgaaattcatgcagaggggcttagatagcgagactaagaagcagctggaagaggaggaaaagaaaattatcagcgaggagcactggtacttagacttacccgagcttaaggaaaaggaatcatttatcatcgaggagcagtctttccttctgtgcgaggaccttctctacgggcgcatgagtttcagaggctttaatcctgaagtggagaagctaatgttacagatgaacgccaagcacaaagctgaggaagttgaggatgaaaccgttgagttggacgtgtccgacgaagaaatggcccggagatacgaaacactggttggcactatagggaagaagttcgctcggaagagggaccacgctaattacgaagaggacgaaaacggggatattacgccaatcaaagcgaagaagatgtttttaaaacctcaggactag

SEQ ID NO: 124894 - DNA, 627 bp, Artificial Sequence
  Description of Artificial Sequence: Synthetic coding sequence
atgaaggcctgcaaacgcggcaactcagatattgtgagactggttatagaatgcggagcagattgtaacattctgagcaagcatcagaactctgcactgcactttgctaagcagtcaaataatgtgctggtgtacgacctgctgaagaaccatctcgagactctttcacgcgtggccgaagagaccattaaggactactttgaggcaagacttgcgctcctagagccagtttttcctatagcgtgccatcgactgtgtgaaggcccagatttcagcaccgactttaactataagcctccccagaacatcccggaagggtccggtattttgctgttcatcttccatgcaaatttcctagggaaggaagttatcgcccggctgtgtggcccttgtagcgtgcaagctgtcgtccttaatgataaatttcagttaccggtgttcttgaccggcagtcgttccgtagttcaggccggagtgcagtggcggggcctacagctgactggggtgctcactagtcaggcgcaggccatcctgcccccacaaccacctaattatttaggtttgaaaatgaccgttatacttttcacacacagcgccctgttgcaggtgccaatcaattcaagctag

SEQ ID NO: 124895 - DNA, 2583 bp, Artificial Sequence
  Description of Artificial Sequence: Synthetic coding sequence
atggagcaggtggcagagggggctagggtcaccgcagtcccagttagtgctgccgactccaccgaagagctcgccgaagtcgaagagggggtgggcgtggttggcgaagataacgatgccgcagctcggggcgcagaggcctttggcgatagcgaagaagacggagaagacgtgttcgaggtggaaaaaatcctcgacatgaaaactgagggcggtaaggtgctgtataaagtgcggtggaagggctacacctctgatgatgacacctgggaacccgagattcacctggaagactgtaaggaggtgctgttggagtttcgcaaaaagatagcggaaaataaggccaaggcagtgcggaaggatatccagcggcttagcctgaacaatgatatctttgaggccaacagcgacagtgaccagcagtctgagaccaaggaagatacgtctccaaaaaaaaagaagaagaagttgcgtcaacgggaggagaagtcccccgacgacctcaaaaagaagaaagctaaagctgggaagctgaaggacaaatccaagccggacctggaatctagtcttgaatccctcgtgttcgacctgcgcacgaaaaaaaggatctcggaggctaaggaggaactgaaggaaagcaagaagcccaaaaaggatgaggtgaaggagactaaagagctgaagaaggtgaaaaaaggagagatccgggacctcaaaacaaaaacccgggaggaccccaaggaaaaccgaaaaactaagaaagaaaagtttgtcgaaagtcaggtggaaagtgaaagtagtgtgctaaacgattcaccctttcccgaggacgacagcgagggactgcattcagattccagggaggagaagcagaatactaagtcggccagagagagagcaggacaagacatggggctcgagcacgggtttgaaaagcctctcgattccgcaatgtctgctgaagaggacactgacgtgagggggcgccggaagaagaagacccctcgaaaagcagaggacacccgcgagaatagaaagttagaaaacaagaacgcctttctcgaaaaaaagacggtcccgaagaagcaacgcaaccaggatcgaagcaaatctgccgcagagctggaaaagctgatgccagtgagcgcacagacacccaaaggcagacgtctctcaggggaagaacgcgggctctggagtactgactctgcagaagaggacaaagagaccaagcgcaatgagtctaaggagaaatatcagaagaggcacgattccgataaggaagaaaagggtcggaaagaaccgaaaggcctgaagacactcaaggagatccgaaatgcgtttgatttgtttaaactgacaccagaggagaagaacgatgtgtcagagaacaatagaaaacgagaggaaattcccttggattttaaaactatcgatgatcacaagaccaaggaaaacaagcagtcgctaaaggaacgacgaaatacccgtgacgagaccgatacatgggcctacatcgccgccgaaggggaccaggaggttctggactccgtgtgccaggcagacgagaacagtgatggccgacaacagatcctctcactgggtatggatctacaactggaatggatgaaattggaggacttccagaaacatttggatggaaaggatgagaatttcgctgcaaccgatgccatccccagcaacgtactccgcgacgctgtaaaaaatggagattacattacggtaaaggtggctttgaacagcaatgaggagtacaatttagaccaggaagactccagtggtatgaccctggtaatgctggccgctgcaggaggacaggacgacttgttgaggctgctgattaccaaaggcgcaaaggtcaatggcagacagaaaaatggaacaacagcacttatccacgcagccgagaaaaattttctgactaccgttgcgatacttcttgaggcaggcgcattcgtgaatgttcagcagagtaatggcgaaaccgcccttatgaaggcctgcaagcgtggaaactcagacattgtaaggctagttatagagtgtggagccgattgcaacattcttagcaagcaccaaaatagcgcccttcatttcgccaagcagagtaataatgtgctcgtatatgacctgctgaagaaccatttggagactctgtcacgagtagctgaggagactataaaggattactttgaagcgagactggctctgctggaacccgtcttccctatagcctgccaccgtctctgcgagggcccagacttttcgaccgattttaattataagcccccccagaacattccggaggggtccggcattctgctcttcatctttcatgctaatttcctcggcaaggaagtcattgctcgtctatgtggcccctgtagcgtgcaggccgtggtgctgaacgataagtttcaactgcctgtgttcctagattctcactttgtgtacagcttctcaccagttgccggtcctaataaattgtttatccgcctgaccgaagccccatcagctaaggtgaaattactgataggtgcttacagggttcaactgcagtag

SEQ ID NO: 124896 - DNA, 2604 bp, Artificial Sequence
  Description of Artificial Sequence: Synthetic coding sequence
atggagcaggtcgctgaaggcgctagagttactgccgtgccagtctccgctgcagacagtaccgaggaactggcagaagtagaggagggtgtcggagtagttggagaggacaacgacgcagccgcccggggggctgaagcatttggcgatagtgaggaagacggggaagacgtgttcgaagtcgagaagatactcgatatgaagaccgaagggggaaaagtgttgtacaaagtgcgctggaaaggctacacctccgacgacgacacttgggaaccagagatccatctggaggactgcaaagaggttctcttggaatttagaaaaaagattgccgaaaacaaggctaaagctgtgcggaaggatattcagagactgagtttgaacaatgacatatttgaagcaaactccgactccgatcagcagtcagagacaaaggaggacactagccccaagaaaaagaagaaaaaactgcgacaaagggaggaaaagtcaccagatgatcttaagaaaaaaaaagctaaagcaggaaaactgaaggacaagtccaagcctgacctggaatcctcactcgagtctttggttttcgaccttcgtaccaaaaagcggatctccgaagccaaggaggagctgaaagagtctaagaagccaaaaaaggatgaggtgaaggagaccaaggaattaaagaaggtaaaaaagggcgaaattagggatcttaagaccaagacccgcgaggaccctaaggagaaccgcaagaccaagaaggagaagtttgtggaatcccaggtggaaagcgaaagctccgtccttaatgactcgccatttcccgaagacgattccgagggacttcacagtgatagcagggaggagaaacaaaacacaaagagcgccagggaaagagcaggacaagatatgggactggagcatgggttcgagaagcctctggacagtgcgatgtctgccgaagaagatacagatgtgcgtggccgacgcaagaaaaagacccctcgcaaggccgaagatacccgagagaatcgcaaattggagaacaaaaacgccttcctcgagaaaaagacagtgccaaagaagcaacgaaaccaagataggagtaagtccgctgctgaactggagaagctgatgcccgtgtctgcgcagactcccaaggggaggcggctctccggggaagagcgcggtctgtggagtaccgacagtgccgaagaagacaaggagacaaagcgaaatgagagtaaagagaagtaccagaagcgacacgattcagacaaggaggagaagggtcgcaaggagcccaaaggcctgaaaacactaaaggagattcggaacgcattcgaccttttcaaactgacgcccgaagaaaagaatgacgtttcagagaacaatcggaaaagagaggagatccccctcgacttcaaaactattgacgatcacaagactaaagaaaataaacagtcacttaaagagcgccgcaatacacgcgacgagacagacacctgggcttacatagctgcagaaggagaccaagaagtgcttgactccgtgtgtcaggccgacgagaatagcgacggtcgtcagcagatcctgtccttggggatggacctccaacttgagtggatgaaactggaagatttccagaagcacctggatggcaaggacgaaaatttcgcagccactgatgccattccaagtaatgtcctgcgtgacgcagttaagaatggagattacatcacagtaaaggtagctcttaactccaatgaagagtataatttagaccaggaagacagctccggcatgacactggttatgctggccgctgcaggcgggcaggacgatttactgcgcctgctgataacaaagggtgcgaaggtgaacggtaggcagaaaaatggtactacagcgttaattcatgcagcggagaaaaatttcctcacaacagtggctatcctgctcgaggccggtgccttcgtgaatgtgcagcaatcaaatggcgaaacggcactgatgaaggcctgcaagcgaggaaacagcgacatcgtacgactggtcattgagtgcggggccgattgtaatatcctgtctaaacaccagaattctgctttacacttcgccaaacagagtaataatgtgctagtgtatgacctcctcaagaaccatcttgaaacattgtcacgggtcgcggaagagactatcaaagattacttcgaggctcggctggcactgttggagccagtgttcccaatagcctgccacaggctatgcgaaggcccggacttttctacagactttaactataaacctccccagaacatcccagagggctcaggcattcttctgtttatcttccatgcaaatttcttgggtaaggaggtgatcgcccggctctgcgggccatgctccgttcaagcggtggtcctgaatgataaattccagttaccagtgttcctcaccggtagcagatcagtggtgcaagccggtgtacagtggagaggcctccagctgacgggcgtcctgactagccaggctcaggctattttgcctccacagccacccaactacctcgggctaaagatgcatgctactacgtccgggtag

SEQ ID NO: 124897 - DNA, 1812 bp, Artificial Sequence
  Description of Artificial Sequence: Synthetic coding sequence
atggaacaggtggctgaaggggccagggtgacagctgtaccagtgtctgctgctgacagcaccgaagagctcgcagaagtggaggagggagttggtgtggttggcgaagataacgatgcagcggctcggggggcagaggcattcggggactctgaggaagatggggaggacgttttcgaggtcgagaaaattctggatatgaaaacggagggtgggaaggttctttacaaggtgaggtggaagggctatacctctgatgatgacacatgggagcccgagatccatttagaagactgtaaggaggttttgttggaatttcggaaaaaaatagccgagaataaggctaaagccgtgagaaaagatattcagaggttgtccctcaacaatgacatcttcgaagctaacagcgattctgaccagcaatcagagacaaaggaggacacttcacctaaaaagaaaaagaagaaattacgacaaagagaagaaaaaagccccgacgacctgaagaagaagaaagccaaagcaggtaagctgaaggacaaaagtaaaccggatctggagagtagcttagagagtctcgtgtttgacctccgaaccaaaaagagaatctctgaggccaaggaggagctgaaggagtcaaagaagcctaagaaggatgaggttaaagaaacaaaagaattaaagaaggtcaaaaagggagagattagagacctgaagaccaaaacacgggaagaccccaaggagaatcgaaaaaccaagaaggagaagtttgttgaatctcaagtggagagtgagagctccgtactgaacgacagccctttccctgaggacgactctgagggactgcactcagatagcagggaagagaaacaaaatacaaaaagcgccagggagcgtgcagggcaagacatggggctggaacacggctttgagaaaccactggacagtgccatgtctgctgaggaagataccgatgtcaggggacgccggaaaaagaagactcctcgcaaggccgaggacacccgggagaaccgaaagctcgagaataaaaacgccttcctcgagaagaagaccgttcctaagaaacagcgtaatcaggataggagcaaatcagccgctgagctcgaaaaactgatgcctgtgagcgcccagactcccaagggcaggcgcctatctggggaggaacgtggcctgtggtcaaccgattcagctgaggaggacaaggagactaaacgaaacgagtcaaaagaaaagtatcaaaagaggcacgactctgacaaagaggagaaggggcggaaagagcccaaaggattgaaaacattgaaggagattcggaatgctttcgacttgttcaagctgactccagaggaaaagaatgacgtgtcggagaacaaccggaaaagggaggaaatccctctggactttaagacaattgacgaccataagaccaaggagaacaaacagagcttgaaagaaagacggaatacaagagatgagactgacacgtgggcttatattgctgcggagggtgaccaagaagtgctcgactctgtgtgccaagctgacgaaaattcagacgggagacagcagatcctgtcccttggcatggatctacagttagagtggatgaaactcgaggatttccagaagcacctggacggcaaggacgagaacttcgccgcaacggatgcaattccctctaatgtgctccgcgatgccgttaagaagaaaaaaaagaagaaattccttgggacctacaccttcttcttatttttcttcttcgaaaaacctgacctcgttcctttattctag

SEQ ID NO: 124898 - DNA, 3087 bp, Artificial Sequence
  Description of Artificial Sequence: Synthetic coding sequence
atgggctttttcagcctgagttctgaaagaaatgagagcgttattcactaccccgaaagcaccgagccagaaatacagcaggagatgagcacatctcagcccgattgtaacgtggactcctgttcagtgtcgagcggatacggcacattctgcatttctgaactgaatttatacaagtcgaaggacccgaaggagtttatggaacatattgacgtgcctaagggtcaatatgttgcccccgctgttccagccgagagcctggtcgatggcgttaaaaatgagaatttttatattcagacccctgaagaatgtcatgtctccctgaaagaggacgtcagtatatcacccggcgagtttgaacacaacttcctgggagagaacaaggtttcagaggtttactctggtaaaaccaacagcaacgccataacaagttgggctcagaagctgaagcagaatcagccgaaaagggcgcacgtggaggacggcggcagccgctctaaacagggaaacgaacagagcaagaagacacccatagagaagtctgactttgccgccgcgactcaccccagagcattttacctatccaaacccgatgaaacacccaatgcctggatgtctgacagcggcacggggctgacatattggaaacttgaggagaaagatatgcaccactcactgcctgagactctcgagaaaacattcatatccctgagctcaaccgacgtctcaccaaaccagagcaacacgtctaatgagatgaagctcccctcgctgaaggatatttattacaaaaaacagcgggagaataagcagctccctgagcggaatttgacgtcagccagtaaccccaatcatccgcccgaggtgctgactcttgaccccacactgcacatgaagcccaaacagcagatttcaggcattcagccacatggactgccaaacgctctggacgacagaatctctttctcacctgactcagttttggaaccgagtatgtcttctccatcagatattgattcctttagccaggcctccaatgtgacctctcagttacccggctttcccaagtacccttctcataccaaggcctcgcccgtcgacagctggaaaaaccagacgtttcaaaatgagtcacgcacaagcagcaccttcccctccgtgtacacaataacatccaatgatatctcagttaacaccgtcgacgaggaaaatacagtcatggtcgcatcagccagcgtttcccagtctcagttgccaggcacggccaacagcgtacccgaatgtatttctctcacctcactcgaggatccggtgatcctgtcaaagattcgacagaacctgaaagaaaagcacgccagacacatcgctgatcttcgagcctattatgaatccgagatcaatagcctgaaacagaagctggaggccaaggaaatttctggagtggaagactggaagatcactaaccagatactagttgaccggtgtggccagctcgatagcgccctgcacgaggctacatcgcgagtgaggacactggagaataagaacaatctcttggaaatagaggttaatgaccttagggaacggttctccgccgcatcttctgcttccaaaatactgcaggaaaggattgaggaaatgcggacaagctcaaaagagaaggataacactatcataaggctgaaatcacggctccaggacctggaagaagcctttgagaacgcttataaactctccgacgacaaggaggcacagcttaaacaggagaataaaatgttccaagatctgctgggggaatacgaatctctgggcaaggaacatcggagagtgaaggacgccctgaataccacggagaataagctcttggacgcctacactcagatttctgatctcaaaagaatgataagcaagctggaggcccaggtgaaacaggttgagcatgagaatatgttatctctgcgacacaatagtaggattcacgttcgaccgtctcgagccaacacactggccacctctgatgtgtcccgcagaaagtggctcatacctggagcggagtactccattttcacaggccagcctcttgacacccaggattccaacgtagataatcagctggaggagacctgctcactggggcatagatctccgctcgagaaggacagttccccagggtcctcttctacatccctgctgatcaagaagcaacgggagacatctgacacccccatcatgagggctctcaaagagcttgacgaaggcaagatcttcaagaattgggggacacagacggagaaagaggacaccagcaatatcaaccctcgacagactgaaaccagtgtgaatgctagcagaagcccggagaaatgcgcacagcagagacagaagcggttgaatagcgcatcgcaacggagttccagccttcccccttccaacaggaagtccagcactcccaccaaaagggagattatgttaacccctgtcacagtggcctattcaccgaagaggtctccaaaagagaatctttcccccggctttagtcacctgttgagtaagaatgagtccagcccaatcagatttgacatcttgttagacgacctggacactgttcccgtgagcactctccagcggaccaacccccggaagcagctgcaattcctgcccctggatgactccgaagaaaaaacctattccgaaaaagccacagataatcacgttaatcattcttcttgccctgaacccgtccctaacggcgttaaaaaggtgtctgtgaggaccgcctgggagaaaaacaaaagcgtgtcgtatgagcagtgtaaaccagtcagtgttacgccacagggtaacgattttgagtacaccgcaaaaatccgcacactggcggagacagaacgctttttcgatgagttgactaaagagaaggatcaaatagaagccgccctatcccgcatgccatcacccggtggaaggatcacacttcagacccgactgaaccagacacctcagatttgtgaagagagttcccacaagtgcgcctttgccgggcattatgtgccgtgccatctgtacgattacaggttccagggctag

SEQ ID NO: 124899 - DNA, 3096 bp, Artificial Sequence
  Description of Artificial Sequence: Synthetic coding sequence
atgggcttctttagcctgtcctccgaacgaaatgagagtgtgatccactatccagagagtacggaacccgaaatccagcaagagatgagcacctctcaacccgactgcaacgtggattcttgctctgtcagttccggctacggcacattttgtattagtgagctgaacctatataaaagcaaagaccccaaagaattcatggagcatatcgacgtgccaaagggccagtatgtcgccccagcggtgcctgcagaatcccttgtggatggagtaaaaaacgagaacttctacattcagaccccagaagagtgtcacgtaagcctcaaagaggacgtgtctatcagccccggtgagttcgagcataatttcctgggcgaaaacaaagtctcggaggtctactcaggtaaaaccaattcgaatgctatcacttcgtgggcccaaaagcttaagcaaaaccaacccaaaagggcccacgtggaggatggtggctccaggtctaaacagggaaacgaacagtcgaagaagactcccatcgagaaatcagatttcgctgcggccacccacccaagagcattctacttatctaagcctgacgaaacccccaacgcatggatgtccgacagtggaacggggctgacatactggaaactcgaggaaaaggatatgcatcattccctgcccgaaaccctggagaaaacgttcatctctctatcctccaccgacgtgtcgccaaaccagagcaacaccagcaatgaaatgaagctgcccagtctgaaagatatctattacaagaaacagagagagaacaaacagctgcctgagaggaatttgacaagtgcctcgaatcccaaccaccctcctgaagtccttaccctggatccaacgctacacatgaaaccaaagcagcaaataagcggaatccagccccacgggctccccaacgctctcgatgaccggatttctttttcccctgactccgtgttagagccaagcatgtcatcccccagcgatatcgacagttttagccaagcatcgaatgtgaccagccaacttcccggcttcccaaaataccctagccacaccaaagcatcccctgtggatagttggaagaaccagacatttcagaacgagagccggacgagtagtacatttccctccgtttacaccatcacatccaacgacattagcgtcaacacagtggatgaagagaacaccgtgatggtagcaagcgctagtgtgtctcagtcccagctgcctggaaccgctaacagtgttccagagtgtatatctttgacatctcttgaggaccctgtgatcctatccaagatccggcagaacctgaaagaaaagcacgctcggcatattgcggacctaagagcatactatgagagcgaaatcaactcactcaagcagaaattagaggccaaagaaatttcaggggtggaggactggaaaataaccaaccagattttggtcgatcgatgcggccagctggattcagcgctgcacgaagccacaagcagagtccgaaccttagaaaataaaaacaacctactggaaatcgaggtcaatgatctaagggaacgattcagcgcggcttcatctgccagtaagatcttacaggagaggatagaggagatgaggaccagttcaaaagaaaaggacaacaccataattcgtcttaagtcaaggctacaggacttagaagaggcgtttgagaacgcctataagttgagcgacgacaaagaggcacagctgaaacaggaaaacaagatgttccaggacctcttaggcgaatatgaaagtctggggaaggaacacaggcgcgtgaaggacgccttaaacactactgaaaacaaactgctggatgcatatactcagattagtgacctgaaaagaatgatcagcaagctagaagcacaggttaagcaggttgagcatgagaacatgctgtctctgcgtcataattcacggatccatgtccggccctctagggccaacactttggctacaagcgacgttagcaggcggaaatggctcatccccggagctgaatactctattttcacagggcagccgctggacactcaggactctaacgtggacaaccagcttgaggagacctgctcactgggtcatcggtcgcctctcgaaaaagatagctcccctggttcaagtagcaccagccttctgatcaaaaaacaacgcgagactagcgacactccaatcatgcgagccttgaaggagctcgatgagggtaagattttcaagaattgggggactcaaacagagaaagaggataccagtaacatcaatccacgccaaacggagacctccgtgaacgcctccaggagtccagagaagtgcgctcaacaaagacagaaaagactaaattccgcatcccaacgctcgtccagcttaccacccagcaataggaagagcagcactcccaccaagcgcgagatcatgcttaccccagtgaccgtcgcctatagccccaaacgcagccccaaagaaaacctctcccctgggttctctcacctcctcagcaaaaatgagtccagtcccattaggttcgacatccttttagatgaccttgataccgtgcctgtctcaaccctgcagcgcacaaatcctcggaagcagctccagttcctacctctggatgattcggaggagaaaacttacagtgaaaaagctaccgacaaccacgtgaaccactcttcttgccctgagcccgttcccaacggggtgaagaaggtgtctgtcagaaccgcctgggaaaaaaataaatccgtctcctatgaacagtgcaagccagtaagcgtcaccccccaaggcaatgattttgaatacacagcaaaaatccgcacattggcagaaacagaacggttcttcgacgagttgaccaaagaaaaggatcaaattgaggctgccctgtcaaggatgccaagccccggaggacgaattaccctccagacccgtctaaaccaagaagcccttgaggaccggttagagcggattaatagagaactgggatcagtgcggatgacgctcaagaaattccacgttttgagaactagcgctaatctgtag

SEQ ID NO: 124900 - DNA, 1167 bp, Artificial Sequence
  Description of Artificial Sequence: Synthetic coding sequence
atggagccctcacctgccgctggaggcctggaaacaacccgactggtcagtccaagagaccgcggcggagccggcggcagtctcagactgaaatcactatttacggagccgagcgagcccctgcccgaggagtcaaaaccagtggaaatgcccttccaccattgtcatcgggatcccctgccacctccaggactcaccccagagcgcctgcatgcgcgccggcaactgtacgccgcatgcgcagtgtgctttgttttcatggccggcgaagtcgtggggggctatctggcacattcactggcaatcatgacagatgccgcccatctacttgccgatgtcggaagtatgatgggctccttgttttcgctatggctatctacgcgcccggcaaccaggactatgacctttggatggcatcgctcggaaacccttggggctctggctagcgtggtctctctttggatggttacagggattctgctctacctggcctttgtgcgcctgttgcactctgactatcatatagaaggaggcgcaatgctgctaactgcaagtatcgcagtgtgtgctaacctgcttatggcatttgtgctgcatcaagcaggacccccacacagtcacggcagtcggggggcagaatacgcccctctggaagaggggccagaagagcccctacctctcggaaatactagtgtgcgggctgcatttgtgcacgtgctgggagacctactgcagtcgtttggggtcctcgctgccagtattctgatctattttaaaccacagtacaaggctgcagaccctatttctacgttcctgttctccatttgtgccttgggatccacagcgcctactctcagagatgtcctgcgcatcctcatggaaggcacacctcgcaatgttggttttgagcctgttagggatacgctgttgtccgtccctggagtgcgcgctacgcatgagcttcatctgtgggccctgactctgacataccacgtcgcaagcgcccatctcgccatcgattcaaccgcagatcctgaagccgtgcttgcagaagcctcatccagactttattctcgattcgggttctccagctgtacactgcaggtcgaacaatatcagcccgagatggcccagtgcctgcgttgtcaggaacctccccaggcctag

SEQ ID NO: 124901 - DNA, 363 bp, Artificial Sequence
  Description of Artificial Sequence: Synthetic coding sequence
atgtgccatttgtatgaggggccggtcgtgggggggtggtataaggtcttggaccggttcatccctggcactacaaaagtcgacgctctgaagaagatgttgctcgaccagggcggattcgccccatgctttctgggatgcttcctgcccctggtgggagcattgaatgggctgagcgcccaggacaattgggccaaactccagagggattatccagatgccctgatcaccaattattatctctggcctgcggtacagctggctaatttctacctggtgcccctgcactatcgcctagcagttgtccagtgtgtggcagtgatatggaacagttatctaagctggaaagcccatagattatag

SEQ ID NO: 124902 - DNA, 531 bp, Artificial Sequence
  Description of Artificial Sequence: Synthetic coding sequence
atggcgctctggagagcttatcagcgtgccctggccgcccatccctggaaggtgcaggtgctcacggctggaagtctaatgggtcttggcgacataatcagtcagcagctggtcgagcgacgcgggctccaggagcatcaacgcggacgcaccttgaccatggtgagccttggttgcggattcgtgggccctgtcgtgggcggttggtataaagtgctggatagattcattccaggaaccaccaaagtcgacgctcttaagaaaatgctactggatcaaggagggtttgctccctgctttctggggtgtttcctacccctggttggcgctctcaacggtctgagtgcccaagacaattgggccaagttacagcgcgactatcctgatgcactgattacaaactactatctgtggcctgccgtccagctggctaacttctatctggtgccactccattacaggctggccgtagtccaatgcgtggcagttatctggaattcatacctaagctggaaggcgcatagactgtag

SEQ ID NO: 124903 - DNA, 513 bp, Artificial Sequence
  Description of Artificial Sequence: Synthetic coding sequence
atggccctgtggcgggcctaccagcgcgcactggccgcccacccctggaaggtccaggtccttaccgccggcagcctcatggggctgggcgatattatatctcagcaactggtggagaggaggggactgcaagagcaccagcgcgggcggaccctcactatggtttccctcggttgtggtttcgtcggtcccgtcgtgggggggtggtacaaggtcctcgaccggttcattcccggcacaactaaggtcgacgctttaaagaagatgcttctggaccagggcggcttcgcgccctgcttcctgggttgcttcttaccacttgttggagccctaaacggccttagtgcccaggataattgggccaagctccagcgtgattatccggatgcacttattacaaattattatgtgggcagatgtcctatgtgttgctgctaccttgaattactaccagtgctggagggcacctcagctttgtctctgcctcatagcatcgtttcgacgctgcagtag

SEQ ID NO: 124904 - DNA, 342 bp, Artificial Sequence
  Description of Artificial Sequence: Synthetic coding sequence
atggcgttgtggcgggcttatcaacgggccttggcagcacacccttggaaggtccaagtccttacagccgggtcactgatggggcttggagatatcatttcccagcagctggtagagcgacggggcctgcaggaacaccagagaggcaggaccctgacaatggtgagcttgggatgcgggttcgtcgactaccccgatgctctcattaccaactactacttgtggcctgccgtccagctcgcaaatttctatctggtgccacttcattacagactggctgttgtgcaatgcgtggccgtgatatggaattcttacctgtcctggaaagctcatcgcctgtag

SEQ ID NO: 124905 - DNA, 576 bp, Artificial Sequence
  Description of Artificial Sequence: Synthetic coding sequence
atggccctctggcgggcctaccagcgagccctggctgcccacccgtggaaagtccaggttctgacagcagcccaccctcggagatgcccggataacacttgcgtgccatgtatcggatcacttatgggcctgggtgatatcatttctcaacaactggtggagagacggggactgcaggaacatcagcgtggaagaactttaactatggtttcactgggatgcggattcgtggggcccgtggtcggtggctggtataaagtgctggatcgtttcataccagggactactaaggttgatgcgctcaagaaaatgctgctggaccaggggggctttgcgccatgttttctaggctgtttccttccattggtgggtgcccttaatgggctgagtgcgcaggacaattgggcaaaactccagagggattatcccgatgcccttattactaattattatctgtggccagcagtgcagctcgcaaatttctacctggtcccactgcactaccgccttgcggtggtccagtgcgtggcagtgatatggaattcatacctgtcctggaaagcccatcgtctgtag

SEQ ID NO: 124906 - DNA, 348 bp, Artificial Sequence
  Description of Artificial Sequence: Synthetic coding sequence
atggggctaggggacattatttcccagcagctggtcgagcgaaggggcctccaggagcaccagcgtggacggacactgactatggtgtctctgggctgcgggttcgttggtcctgtcgtggggggctggtataaggtgctggacaggtttatccctggaacaacaaaggttgatgccctgaaaaaaatgctgctggaccagggtggcttcgcaccatgcttcctgggatgctttctgcccttggtaggcgccttgaatggtctctccgctcaagataactgggctaaactgcagcgtgactacccggacgcgctgatcactaactactatttgtggcctgccgtttag

SEQ ID NO: 124907 - DNA, 366 bp, Artificial Sequence
  Description of Artificial Sequence: Synthetic coding sequence
tagagtctcatgggtctgggtgacatcatctctcagcagttggttgagcggagggggcttcaagaacaccagcgggggcgcacactgacaatggttagcctggggtgcggctttgttgggcccgtggtcggtggatggtacaaggttctcgatagatttataccaggaacaacaaaagtcgatgctctaaaaaagatgctactcgaccaggactaccctgacgccctgattacaaattattacttgtggccagcagtacaactcgctaatttctacctggtgccattacactataggctcgccgtcgttcaatgtgtcgcggtaatttggaacagttacctgtcatggaaagctcatagactctag

SEQ ID NO: 124908 - DNA, 204 bp, Artificial Sequence
  Description of Artificial Sequence: Synthetic coding sequence
tgagattcccaggggaaaaagaccggatttacaggtattaaaaaaggagactaccccgacgccctgataaccaactactatctgtggcctgcggtgcagctcgcaaatttctatctagtgccactccattaccgtctggccgtggtccaatgtgtcgccgtgatctggaactcctacttgtcttggaaagcacatcgactgtag

SEQ ID NO: 124909 - DNA, 912 bp, Artificial Sequence
  Description of Artificial Sequence: Synthetic coding sequence
atggcgcccgccgcagatatgaccagtctgcccctcggcgtgaaagtggaagatagtgcctttgggaagcctgcgggaggtggtgcaggccaggccccctctgcagccgcggccaccgccgccgccatgggagccgacgaggagggagctaaacccaaagtgtccccatcccttctgcccttttcagttgaggccctgatggcggaccatcgcaagcccggggcaaaagaatccgcccttgccccctcagagggcgttcaggcagctggtggctctgctcagccactgggcgtgcctcctggcagcctcggagctccagacgcgccatcaagtccccgcccactgggtcacttttcagttggaggcctccttaagttgcccgaagacgccttagtaaaggctgagagtcccgagaaaccggaacggacgccttggatgcaatcaccgcgcttcagcccaccaccagcaagacgtctctcaccacctgcctgtaccctgcggaagcacaagaccaaccggaagccaagaaccccctttacaaccgctcagctccttgcattggaacggaagttcagacagaaacaatatcttagcattgcagagagggccgaatttagttctagcctgtcattgaccgaaacccaggttaagatctggttccagaacagacgcgccaaggctaaacggttgcaagaagctgaattggagaagctgaaaatggccgctaagcctatgcttccaccggcggccttcggcctgtcttttccactaggggggcccgctgctgtcgctgctgcagcaggggccagcctctatggagcctcaggcccattccagcgagccgccctgcccgtggcccccgtagggttatataccgcacacgtaggctactccatgtatcacctaacgtag

SEQ ID NO: 124910 - DNA, 804 bp, Artificial Sequence
  Description of Artificial Sequence: Synthetic coding sequence
atggcgagcccctccaaaggtaatgacttgttctctccagacgaggagggacccgctgtggtcgccgggccaggccctggccccggcggcgccgaaggcgctgccgaagaaaggcgcgtcaaagtgagtagcctgccgttcagcgtggaggccctgatgtctgataagaagccccccaaagaggcttcccccctcccggcagaaagcgccagtgcgggtgccaccctaaggcctctactgttgtcaggtcacggtgcaagagaagctcattcaccaggtccactcgtgaaaccattcgagaccgcgagcgtgaaaagtgaaaatagtgaggacggagccgcttggatgcaggaacctggcaggtactctcccccaccccggcacatgtctccaaccacttgtacgcttcgaaagcataagaccaataggaaaccaagaacaccttttacaacatcacaactgctggccctcgagagaaagttccgacaaaagcagtacctaagcattgccgaacgagctgagttcagttcttcgcttaacctgacggagacccaagtcaagatctggttccagaacaggagagcaaaagccaaacgtctgcaggaggctgagttggagaaattgaagatggctgctaagccaatgctgccctcctcattcagcctgcccttccctatctcttctcccctgcaagctgctagcatatatggcgcctcctaccctttccaccgacctgttttgccaatcccccctgtggggttgtatgccacgcccgtgggttacggcatgtaccacctctcttag

SEQ ID NO: 124911 - DNA, 981 bp, Artificial Sequence
  Description of Artificial Sequence: Synthetic coding sequence
atgaacacatcaccggggacagtaggctcggacccggtgattttagccacggccggctacgatcacaccgtgaggttttggcaggcccattccgggatctgcactaggaccgtccagcatcaagattcccaggtgaacgcactcgaagttacaccagatcgaagcatgattgcggcagccgggtatcagcatattcgcatgtacgacttgaatagtaataatcctaaccccatcatctcatacgatggcgtgaataaaaatattgcctccgtgggcttccacgaagacggaagatggatgtacactggtggagaagattgcactgcaagaatctgggacctgcggtctaggaatctacaatgtcagagaattttccaggttaacgctcccattaactgcgtctgcctgcaccccaaccaggcagagctgatcgtcggggaccagagcggagcaatccatatctgggacctgaagactgatcataacgaacagttgattccagagcctgaagtgtcaataacgagtgcccacatcgatcccgacgcgagctatatggccgccgtgaattcgacaggaaattgttacgtgtggaatctcacgggaggcatcggagacgaagtgactcagctgatccctaagaccaagatccccgcacacacccgctacgctctgcagtgtagattttcgccagattcaaccctcctggccacatgctccgcggaccagacttgtaagatctggagaacctcaaatttcagcctcatgactgagctttccatcaagagcgggaatcccggggaatctagccgtggctggatgtggggatgcgcttttagcggtgacagccagtacatagttactgcctcttccgataacctggctcgtctctggtgtgtggagaccggggagattaagcgcgaatacggcggtcatcagaaggccgtggtctgtctggcctttaatgactccgttctggggtag

SEQ ID NO: 124912 - DNA, 981 bp, Artificial Sequence
  Description of Artificial Sequence: Synthetic coding sequence
atgaacacttcccccggaaccgtgggtagcgaccccgtgattctggccaccgcgggctacgatcatactgtgcggttctggcaggcccacagcggcatctgtactaggactgtgcagcaccaggactcccaagtgaacgccttggaagtgacccccgaccgctcaatgattgccgccgccggatatcaacatatcagaatgtacgacctgaattccaataaccccaaccccatcatcagttatgatggtgtgaataagaacattgcatctgtcggcttccatgaggatggccgctggatgtacacaggcggtgaggattgcaccgctagaatctgggacctgcgttctagaaacctgcaatgccaacggattttccaggttaatgcccccatcaactgcgtttgcctgcacccgaatcaggcagaactcatagtcggcgaccagtcgggtgctattcacatttgggatttgaagacggatcataatgaacaactaatccccgagcctgaggtgagcattaccagtgcccacatcgatcccgacgcctcttacatggctgccgtgaactccactggcaactgttacgtctggaacctgaccggtggcatcggcgatgaggttacccagctgatccccaaaaccaaaattcccgcccacactaggtatgctctacaatgtcgtttttcacctgacagtaccctccttgccacttgtagtgccgatcagacttgcaaaatctggagaactagtaatttcagtctgatgactgaactgagcataaagtccggcaatccaggagagagttcccgaggctggatgtggggatgcgcctttagtggagactctcaatatatcgtgaccgcttcttctgacaacctcgccaggttgtggtgcgtggagactggcgaaatcaagagggaatacggaggccatcagaaggcagtggtgtgtcttgccttcaatgattcagtgctcggatag

SEQ ID NO: 124913 - DNA, 984 bp, Artificial Sequence
  Description of Artificial Sequence: Synthetic coding sequence
atgaacacaagccccggaactgtaggctcggacccagtaatcctcgccaccgccggctatgaccatacagtgcgcttttggcaggcccattcaggcatatgcacacgcacggttcagcaccaggatagtcaggtgaacgcccttgaggtgacccccgatagatcaatgattgcagctgcaggataccagcatattcgcatgtacgatctgaactcaaataatccaaaccccattatatcctatgatggggtcaacaaaaacatcgccagtgtaggttttcatgaggacggtcggtggatgtacacaggcggggaggactgtacagcgagaatttgggatctgcggtctaggaatctgcaatgccagaggatcttccaagtgaacgcaccgatcaattgtgtgtgcctgcatccaaatcaggccgagctgattgtgggggatcagagcggagccatacatatttgggacctgaaaactgaccataatgagcaattgatcccagagccggaggtatcgattacatcggcccacatcgatcctgatgctagctatatggctgctgtgaattccaccggcaattgctatgtctggaacttaactgggggtatcggagatgaggttacgcagctgattccaaagacaaagatccctgcgcacaccaggtatgcacttcaatgccgattctctccagattccactttgctggccacgtgcagcgctgaccagacttgtaaaatttggcggaccagtaacttcagtctcatgactgaactgtctattaagagcggcaatccaggcgagtcgtcgagagggtggatgtggggttgtgcatttagcggggacagccaatatattgtgaccggggaacccaggccagggctgccgcacccgtggccacccgcactcgcttcaagggctagtcctccacgactgcaacttcccctgtgctggggccgactgttggggctccatctgaggtcctag

SEQ ID NO: 124914 - DNA, 654 bp, Artificial Sequence
  Description of Artificial Sequence: Synthetic coding sequence
atggagcatgcaccctggagtcctggtgctagtagtagggctcgcgcagggcacacaatgaatacaagccccgggaccgtgggatccgaccctgtgattctcgcaacggcagggtacgaccatacggtacgattctggcaggcccattccgggatctgtacaagaaccgtgcaacaccaggatagtcaggtgaatgctcttgaggtgactcctgacaggtctatgatcgcggctgccggataccaacacattagaatgtacgatctgaattctaataacccaaatcccatcatctcttatgacggggtgaacaagaacatagctagtgtcgggttccatgaagatggccgttggatgtatactgggggtgaagactgtactgctcgcatttgggatctgcgcagtcggaatctgcagtgtcagcgaatattccaggtcaacgcccctattaactgcgtttgtcttcaccccaatcaggccgaactgattgtaggggatcagtccggagccatacatatctgggatctaaagacagatcataacgagcagctcattccggagccagaagtaagcattacctccgctcacatcgaccccgatgccagctatatggccgctgtaaatagcacggccccccgccacctcctggggtag

SEQ ID NO: 124915 - DNA, 981 bp, Artificial Sequence
  Description of Artificial Sequence: Synthetic coding sequence
atgaacacctcaccagggacggtgggctctgatcctgtgatcctggccactgccgggtacgaccacactgtgagattctggcaggctcacagcggaatatgtacacgtaccgttcagcaccaggactcgcaggtcaacgcactggaggtgacccctgatagatcaatgattgccgccgcggggtatcagcacatacgtatgtacgatctgaactccaataatcccaaccccatcattagctacgatggagttaacaagaacattgctagtgttgggttccatgaggatggccgctggatgtacacagggggggaggattgtactgcaagaatctgggacctcaggtccaggaatcttcagtgccagcggatttttcaggtaaatgctcccatcaactgcgtttgcctgcatcctaatcaagcagaattaattgtgggcgaccagtccggggctatacacatctgggatctcaaaacagaccacaacgagcaactgattcccgagccagaggtgagtatcaccagcgcccacatcgaccccgatgcctcttacatggctgctgtcaatagcactggaaactgctacgtctggaaccttactggtgggattggagacgaagttacccagctgatacctaagactaagattccagcccatacccggtacgccctgcagtgtaggttttctcctgatagtaccctcctggccacttgctcagccgaccagacatgcaagatctggagaaccagcaacttcagcctgatgacagagctttccattaaaagcggtaacccgggagaatcctctagagggtggatgtggggatgcgctttttccggggactcccagtatatcgttaccgcttcctcagataatctcgcccgattatggtgcgtggagacaggggagatcaagagggagtatgggggtcaccaaaaagccgtagtgtgcctggcctttaacgacagtgtcctagggtag

SEQ ID NO: 124916 - DNA, 981 bp, Artificial Sequence
  Description of Artificial Sequence: Synthetic coding sequence
atgaatacgagccccggtaccgttgggagtgaccccgtgattcttgctacagctggatacgaccacactgtgagattctggcaggcacatagtgggatttgcacccgaacggtccagcatcaggactcacaagtaaacgccctcgaagtgaccccggacaggtcaatgatcgccgccgccggctaccagcacattcgaatgtatgacctcaactccaacaatccgaatccgatcatttcctatgacggggtcaataagaatatcgctagcgtgggctttcacgaggacggccgttggatgtacacaggcggcgaggactgtaccgcccggatttgggatctacggtcacgcaacctgcagtgccagagaatttttcaggttaacgctcccatcaattgcgtttgcctccaccccaaccaagctgagcttatagtgggggaccaaagcggagccatccacatctgggatctgaagaccgatcacaatgagcaattgatacccgaaccagaggtcagtatcacatccgcacacattgatccggatgcttcttacatggccgctgtgaactcaaccggcaactgctatgtctggaatctaactgggggaattggggacgaagtaacccagctcatcccaaaaacgaagatcccagcccacacaagatatgctctccagtgtcgcttttcgccagattccacgctccttgccacttgctccgcggaccaaacatgcaaaatctggagaacgtctaacttttcgttgatgactgagcttagcatcaagtcgggtaatcctggagaatcatcgcgtggctggatgtggggatgcgccttttcaggggacagtcaatacatagttactgcatctagtgataatctggctagactctggtgcgtggagacaggagagatcaaacgggagtacggcggacatcagaaggcggtggtgtgtctagcgttcaatgattccgtgctggggtag

SEQ ID NO: 124917 - DNA, 1473 bp, Artificial Sequence
  Description of Artificial Sequence: Synthetic coding sequence
atggcacagagggctgtgtggctcatcagccacgaaccaggaacccccctgtgcggaacagttaggtttagtagaaggtaccctaccgtggagaagagagccagggtttttaacggcgcttcatacgtccccgtgccagaggacggcccctttcttaaggcactactcttcgaattaaggctgctggacgacgataaagatttcgtcgagagccgagactcttgctctcgcataaataagacatctatctacgggctactaatcgggggagaagaactgtggcccgtggtagccttcctgaagaatgatatgatttacgcttgtgtgcctctcgtagagcagaccttgtcaccaagaccgcccctaattagcgtgtctggggtttctcagggctttgaattcctattcggcatccaggactttttatattccggacagaaaaacgacagtgagttaaataccaagctctcacagctacccgatctgcttttgcaggcctgcccattcgggacccttttggacgctaatctccagaacagcctcgacaatactaattttgcctctgtcacccagccacaaaagcaacctgcctggaagactggcacatacaaaggaaaaccacaagtttcgatatcgatcactgagaaagtcaagtctatgcagtatgataagcaaggcatcgcggatacatggcaagtggtgggcaccgtgacttgtaaatgtgacctagaagggattatgcctaatgtcacgatcagccttagcctgccgacgaacggtagtcctctccaggacattctggtgcacccctgtgtgactagtctcgattccgctatcttgacttcctcctctatcgatgctatggatgacagcgccttctccggaccatacaagtttccattcacaccccccctggagtcctttaacctgtgtttttacacatcacaggtgccagttccgcccattctgggattttaccagatgaaggaagaggaagtgcagctcagaatcactatcaacttgaagctgcacgagagcgtaaagaataacttcgagttctgtgaagctcatatccctttttataacagggggcctatcactcacctcgagtataaaacttccttcggccagctggaagtctttagagagaaatcactgctcatttggataatcggacagaagttccccaaatcaatggagatctccttgtcaggtactgttacttttggagccaaatcgcacgagaagcagccgttcgaccccatctgcaccggggaaaccgcctatctgaagctgcacttccgtatcctcgactataccctcacaggctgttacgcagatcaacattcagtgcaggtgttcgcttctggcaaacccaagatttccgcccaccgcaagctgattagtagtgactattatatttggaactccaaagcccctgccccagtgacgtatggatcccttctcctctag

SEQ ID NO: 124918 - DNA, 16437 bp, Artificial Sequence
  Description of Artificial Sequence: Synthetic coding sequence
atgcttgtgatctggattcttactttagccctaagactgtgcgccagcgtaactaccgtgacccctgagggatctgctgttcacaaagctatctcacagcagggcaccctgtggactggagaagtcctagagaagcagacggtggagcaaggcaaatcgacactgcgacgtcagaaaaaccactttcaccggtcggccggtgaacttagatgtagaaacgcccttaaggacgagggggcttctgccgggtggtccgtgatgtttgcaggtgaatccgtggtggtgcttgtgcacctttggatgactggtgcccgggtgaaaaatctcgggttggtggagttcgcttctcctggggacgacggtgatggtcgtgccgaagggtttagcctgggcctccccctgagtgagcaagcccgggccgctggggctagagagaaagagaggcaggagactgtgataaatcacagtacgttctctgggttcagccagatcactggctctactgtgaacaccagtattggtgggaacacaacgtctgcaagcacaccttctagctccgacccgttcaccacctttagcgattatggggtgagtgtcaccttcataacaggatctaccgccaccaagcattttctggatagttctactaacagcgggcatagtgaggaatcgaccgtgtctcatagtggccctggggccaccggaacaacactgttcccatctcactctgcaacatcagtgttcgtgggcgagccaaagacttccccaatcacatctgcgagcatggagacaaccgcacttcctggaagcaccacgaccgcaggcttatctgagaaatccacaaccttctactcatctccgagaagtccagatcgcacgttgagtcctgcaaggacaacatcgagcggcgtctctgaaaaatccacaacctcccacagtcgtccaggtcccacccataccattgccttccctgactccacaaccatgcccggtgtgagtcaagaatctacggcatctcactctattccaggatccactgataccacactttcccccggaacgaccacacccagctcgctgggccctgagtctactaccttccattctagcccaggctatactaagaccacacggttacccgacaataccaccacctctgggcttttagaggcctcaacacctgtacattcctccaccggaagcccccatacaaccctgtctccgtccagtagtacaactcatgagggcgaacctacaactttccaatcatggccatcgagtaaagacacaagcccggcacctagcggcaccacttctgcctttgtcaagctcagcacaacatatcatagctcccccagttccactcctaccactcacttcagtgcctcaagcaccaccctgggccattcagaagaatcaaccccggtacactcttcaccagttgctacagccacaactccaccccccgcccggagcgccacaagtggtcacgttgaagagtccaccgcctatcacagaagtcctggctccacccagaccatgcactttcccgaaagtagcaccaccagcggacatagcgaagagagtgcaacattccacgggtcgacaactcacactaaatctagcacccctagtaccactgccgcgctggcacacacctcttaccactcaagcctgggcagtaccgaaacaacgcattttagggactccagcactatttccggtcgcagcgaggaatccaaagcaagtcattcaagtccagacgctatggcgacgaccgttctgccagccgggagcaccccaagcgtactagttggagactcaacaccctctcccataagcagtggttcgatggagacaacggcattgcccggttcgaccacgaagccaggactcagtgagaaatccacgaccttctattcctctccccggagtcccgataccactcacctgcctgcctctatgactagctcaggggttagcgaggagagcacaacgagccacagccgcccgggatccactcatacgacggcattcccaggctctactaccatgcccggcctgtcgcaagagagcactgccagccactctagccctgggccaacggataccactctttctcctggttctacaaccgctagttctctggggccggaatacaccacttttcattccagaccaggcagcaccgaaactacattgttgcccgataataccaccgcttcaggtctcctggaggcgagcatgcctgtgcatagcagcacgcgcagcccccacaccaccctatcacctgcgggtagcacaacaaggcagggggagtcaaccacattccactcctggcccagctcaaaagacacaagacccgcgccgcccactacaacaagtgcattcgtggaaccaagcaccacctctcacgggtcccccagtagcattcccacaactcacattagcgcacgcagcaccacatcgggcctggttgaagagtcgacaacctaccactcttctcccggcagcacccaaaccatgcactttcccgagagtgatactactagtggtcgcggcgaggagtctacaaccagtcacagtagtaccactcatactatttcttctgcaccatccaccacaagcgcgctggtggaggagcccacttcctatcactcatcccccggctccacagcaacaacacacttccctgactcctctactaccagcggacgcagtgaggaatccaccgcaagccatagctctcaggacgctaccggaaccatcgtgctgccggctagatcaactactagcgtgttacttggcgaaagcacgacctctcccataagtagtggctctatggaaacaaccgccctgcctggcagcacgaccacacccgggctcagcgaacgatccaccacattccacagctctcctcgtagtcccgccaccaccctcagtcccgctagcactacttcaagtggcgtttcggaagaaagcaccaccagcaggagtaggcccggttctacccataccactgcctttccagactctacaaccactcccgggttgagccgccattccacgacctcccacagcagcccagggtccacagacaccaccctcctgccggcttctaccactacctcaggcccgtctcaggagtctacaaccagccactcctcttccggatctacagacacagctttaagcccaggatcgaccaccgctctgtccttcggccaagagagcaccactttccactccaaccccgggtcaactcacaccacactttttcctgactctacaacctcatcgggcatcgtggaagctagtacaagggtgcactcctcaaccggctctccaaggaccaccctttctcccgcgtcatcaacctcccctggtctgcagggagagtctaccgccttccagacacatccagctagtacacataccacacctagtcctccgtccaccgccacagcccctgtggaggaatcaactacatatcacagaagcccaggatcgaccccaactacgcacttccctgcctcgagcacgacctctggacactcggagaagtcaaccatattccacagctctcccgacgcctctggaactacccctagcagtgcccatagcaccacctctggccgcggcgaatcaactactagtcgcatttctccaggcagcacagaaattaccaccctgcctggctccacaactacccccggcctgagcgaggcgtcaacaaccttctacagttcccccagaagtccaacaactacactatcacccgccagtatgacaagtctcggtgtaggcgaggagtcgacaacaagccgctcccagcccggctcaacccattccacggtgtcccccgcatctaccactacacccgggctgagcgaagagtcaacgaccgtatattctagctcacgcggttccacggaaaccacagtgttccctcactcgactacaacttctgtgcatggagaggagcccaccacctttcactcccgcccagcctcaactcatactaccctcttcactgaggattccacaacatccgggctaactgaggaatcaactgcatttcctgggagccccgcaagtacccagactggtctgcccgctaccctcacaactgccgacctcggggaagagtccacaacgttcccctcctcctctggctctaccggaacaaagttatcccctgcaagatccactactagcggcttggtgggcgaaagtactccaagccgcttatccccctctagtacggaaaccactaccctcccgggctctcccacgacgccctccctgtcagaaaagagtaccaccttttacacatcacctagatctccagatgccactctttcccccgctactacgacctcatcaggcgttagtgaagagagctctacttcccattctcagcctggaagtacccacacgactgccttccctgacagcaccacaacttcagaccttagtcaggaaccgaccacctcgcatagctcccagggttctacagaagccaccctgagccccggctctacaacagcctcatccctgggtcagcagagcaccacctttcattcttctcccggtgatactgagactaccctcctccccgacgataccattacgtcaggcttggtggaagcctcaactcctactcactcctctaccggctcccttcatactacgttgacacccgcttcctcaactagcgccggcctccaggaagaaagtactaccttccagagctggcctagtagctctgacaccactcctagcccccctgggaccaccgctgcaccagtggaagtttccacaacctaccactctcgtccatccagtacgcccacgactcacttttccgcctcgagtactaccctggggaggtcagaagaaagcacaaccgtgcatagctcacctggcgccaccggtacagcactcttcccaacacgttcggctacctcagtgctggtgggcgagccaactacctccccgatttctagcggcagtaccgagacaaccgccttacctggaagcacaaccacagctggcttgagcgaaaaatccaccactttctatagctctcctcgatctccagacaccaccctgagccctgcgtcaaccacaagtagcggtgtaagtgaggagtcaactacaagccattcaaggccgggatctacccacacaacagctttcccaggatcaaccactatgccaggggtgtcccaagagtcaactgccagccactcgagtccaggaagcaccgacaccactctttcgccggggtcgacaacagcttctagcttaggccccgagtccacgacattccatagttcccccggttcaacagaaacaacactgctgccagataatacgacagcctcaggattgctggaagcatccaccccagtgcacagctcaactggatctccccatacgacacttagccccgccgggtcaactaccaggcagggggaatctactacatttcagagttggcctagctcgaaggatacaatgccggcccccccaacaactacttcagccttcgtggagttgtcgacaacatctcatggcagcccgagctctacaccaactactcacttcagtgcttcctccacgactttaggacgcagcgaggaatcgaccaccgttcacagttctcctgtcgctactgcaacaacaccgtcacccgcccgaagcaccacctccggacttgtggaggagtcaacagcctatcacagtagccccggcagcacccaaacaatgcatttccccgaatcatcgacggctagtggcaggagtgaagagtctcggacgagccattcttccacgacgcacactataagctctccacccagcactacttcagctttggtggaagagccgacatcctaccactcatctccaggatctaccgcaactactcacttccctgactctagcacaacaagcggtcgctcagaagagagtactgcctctcactcctcacaggacgctacgggtacaatcgttctccccgcaagaagcacgacatctgttttattaggtgaatctacaacctctccaatcagtagcggaagcatggagacaacagcgcttcccggaagtacaacaacccctgggttgtctgaaaagagcacgacctttcactcatcccctcgaagcccagcaactacactttcacccgccagcaccacatccagtggcgttagcgaagagtctactacatcacatagcaggcctggttccacccacacaacagcatttcccgatagcacaactacacctggactttctcgccacagcacaacgagtcattcctctcccggaagtactgatactacactgctgccggccagcactacaacatctgggccatcacaggagagcaccacgtcccattctagtcctggaagtaccgataccgccctttccccgggctccacaacggctctgtcgtttggacaggagtctacaacgtttcacagttctcccggcagtacccatactacactgtttcccgactccactaccagtagcggcatagtcgaggcttctactcgggtgcattcttccacaggtagcccgagaacaacgctcagccccgctagcagtacctcgcccgggcttcagggtgagtctaccgccttccaaacacaccctgcgagtactcacacaacaccatcacccccaagtaccgcaacagccccagtggaggagagcaccacttaccataggtcccccggaagcacaccaaccacacacttccccgcctctagcaccacctccggccacagcgagaagtctactatctttcacagcagccccgacgcctccggcactacaccttcatccgctcatagcacaacatcaggcaggggcgagtccacaaccagccgcattagccctgggtcgactgagataaccacattgcctgggtcaactacaactccaggtctgagcgaagcatctacaacattctattcctccccccgttcaccaacaactaccctatcccctgcttccatgacatccctcggcgtgggtgaggaaagcacgacaagtcgctcccaacctggttctacacattcaactgtgtcccctgccagcactacgacccccggcctgtccgaagaatcaacaaccgtttactcctcatcccccggaagtaccgagacaactgtctttcctcgcaccccaacaacatcagtgcgcggagaggaacctacaaccttccactctagacccgcttctacacacactaccctcttcaccgaagattcaactacatcaggtctgacagaagagtctacagcctttccaggctccccagcatctacacaaactggtctcccagcgacactaactactgcagacctgggcgaggaatccaccacatttccttcctcctcaggcagcaccggtactacactttcaccagcccgctcaactacgagcggtctcgtgggggagtcaacgcccagtaggctgtctccatctagtacagaaaccaccacacttcccggtagcccaaccacaccgtcccttagtgagaaatccacaactttttacactagccctcgatcccctgatgccacacttagccccgccacaactactagcagcggcgtctccgaggaatcaagtaccagtcactctcagcctggctccacccacaccaccgcttttcctgattcaaccacaacccccgggttgtcacgtcatagcaccacctcccactcaagccccggttctacagatacaacccttctgcctgccagtaccacaacctctggaccctcgcaagaatcaacaacctcccattccagcccaggctcaacggacaccgcattgtcaccgggaagtacaaccgccctgagcttcggtcaggagagcaccaccttccatagttctcctggctccacccatacaaccttattccccgatagtacaacatcatcaggtatagtggaagcaagtactcgggtccactcatcgaccgggtccccaaggaccacactgagccctgcctcttccaccagtcctggcctgcagggtgagagtaccacgtttcagacccaccctgctagcacacacactaccccctctccaccatcaactgccactgcccctgtggaggaatcaacaacatatcataggtcccccggatccacaccaacaacacactttcccgcgtcctccactactagcggccattccgagaaatccacgatttttcattcttctccggacgcttctggcactactccttcgtcggcccattccaccaccagtggcagaggagagtccacgacgtcaagaatctcccccggtagcacagaaatcactaccctgccaggcagcactaccactccaggcctctcagaggctagcaccactttctactcctcacccaggagccccactacaaccctttcaccagcaagtatgaccagtctcggtgtgggagaggagtcaacaacaagccgctcccaaccagggtctactcacagcaccgtaagccctgcctctaccactacccctggcttatctgaggaatccacgacagtgtattcaagttctcccggctcgaccgagactacagtgtttcctcggtccacaacaacatcagtgagaggcgaggaacccaccactttccactcccgacccgcttctacgcacacgacactgttcaccgaggacagtacgacttcgggcctcacagaagaatcaactgcctttccggggtcacctgctagcacccaaaccggcctgccagccacgctcacaactgcagacctgggagaggagagcaccacatttccctccagctcagggagcaccggcaccaccctgagccccgctagaagcactacgagcgggctggttggcgaatcaacaccatcacgactgtcaccaagcagtaccgagactacaacccttccgggtagccctactactccctccctgtctgaaaagagtaccactttctatacctccccccgctctcccgacgccactctctccccagccaccactacgagctctggagtgtcggaggaatctagtactagccattcacagcccggcagtacacacaccactgcattcccggactctaccactacttctggcctctcccaggagcctacggcgtcccactcttctcagggctctaccgaggccaccctttctccgggctctacgactgcttcctcacttggtcagcagtccactaccttccatagctcgcccggcgacacagagactaccttattgcccgacgacaccattacaagtggccttgttgaagcttctacacctacccattcttccaccggaagtctccatactacactcactccagccagctcaacctccgcaggactgcaggaggagagcacaacgtttcagtcctggccttcctcctcggacactacacctagtcccccgggcacaactgccgcacccgtggaggtaagcacaacctatcatagtcgtccctccagcaccccaaccacacattttagcgccagctcaactactttggggagatccgaagaaagtaccaccgtgcactcatcacccggggccaccggcactgccctgttccctacacgtagtgccactagcgtgcttgtgggagaaccgaccaccagccccatcagcagcgggtccaccgagaccactgccctgcctggcagcacaacaactgcaggcctgagtgagaaatccaccactttttatagttctcccaggtccccagatactaccttgtcaccagcatcaaccacatcttccggcgtaagcgaagagtcaacaacttcccacagtcgacctgggtccacgcacaccacggcttttcccggttccaccacaatgcccggagtgtctcaggagtctactgcaagtcactcatccccgggctctaccgacaccactctgagcccaggctcaactactgcctccagccttgggccagaatcaacaactttccactcaggtccaggcagtacggaaacgaccctgctgccggataatactactgcttcaggactgctggaagcttctacccccgtgcactctagcacgggctccccccacacaactcttagtccagcggggtcaactacgcgtcagggggagtctactacattccagtcgtggccgaacagtaaggacacaacacccgctcctccgaccaccacatccgcctttgtggagctctccaccacttctcatggcagtccctccagtaccccaacgacccactttagcgcttcatctacaacgctcgggagaagtgaggagtcgactaccgtacattcatccccggtggctaccgccactactccgtctcctgctcgcagtactacatcaggcctagtagaggaatcgacgacctaccattcctccccaggatccactcaaactatgcactttccagagtccgatactaccagtggacggggtgaagaatccaccacgagccattcatcaacgacccataccataagttctgcacctagcaccacatcggcactcgttgaggagcccacttcctatcattcaagtcctggctcaaccgcaactacacacttccctgatagttcgacgacgagtggacggtcagaagagtccacggcctcccactccagccaggacgctacagggacaatagttctcccagcccgctccaccacatccgttctgcttggtgaaagcaccacttctcccatctccagtggatctatggagactactgcattaccaggatctaccactacacctggactctcagagaagagtacaacttttcactctagcccacgctcgcccgccactaccctgagcccggcctccactaccagttcaggcgtgagcgaggagtccacaacaagccactctagaccaggctctacccatactaccgcattcccagactcgaccaccaccccgggtctgagtaggcattccaccaccagccatagctccccaggctccaccgacacaactctgttaccagcaagtactacgacctcggggagctcccaagagagcacaacatcacactcctcttcaggttctactgacaccgccttgtctccggggagcacgacggcattgtcttttgggcaagaatctaccacgttccatagtagccctgggagtacccacaccacactctttcctgactctactacctcttccggaattgtggaggccagcacacgggtgcactcctctacaggatctccacggacaacactgagccccgccagctcaactagtccaggcctgcagggcgaaagcacagccttccagactcaccccgcttccacccatacaactccttcccccccctcaacagcaacagccccagttgaggagtcgacgacctaccaccggagccccggctcgaccccaacaacccattttcccgccagcagcaccactagtggacactctgagaagagcaccatcttccactccagccctgatgcaagcggaaccacaccatcttccgctcatagcacaacgagcggaagaggcgagagtacaaccagcaggatctccccagggagtaccgagattacaacgctgcccgggtcaacaaccacacctggcctgagtgaggcctctaccaccttttactcctcgccacggagccccaccactaccctgagtcctgcctctatgaccagcctcggggttggagaggagagtactacatctagaagccaacccggcagcacccacagcactgtgtcccccgcctctactaccactcctgggctatctgaagagtcgaccacggtctattcaagttctcctggctctaccgagaccactgtgtttccacggtctacaaccacaagtgttcggagggaggaacccacaacgtttcattcccgcccagccagcacacacactactttattcacagaggactccaccaccagtggactcaccgaagagagcacagcgtttcccggctctccggcatctacacagaccggcctgcccgccacactgactacggcagatcttggcgaagaatcaacaacattcccatccagttccggatccacagggactaaattgtctcccgctcgcagcactacctccggattggttggcgaatctaccccttcccgtttatcacccagtagcaccgaaaccacaaccctgcccggcagccccacgacaccttctctgtcagaaaagtctacaaccttctacacatcccctagaagcccggatgcaactttgtctccagccacaacaacatcttccggtgtttctgaagagagtagtacgtctcactcccagccgggaagtacccatacgaccgctttccctgactcaaccaccacctcaggcctgtcccaagagcctactacctctcacagctcgcagggaagcaccgaagccaccctcagccccgggtctacgaccgcatcttcactgggacaacagtctaccaccttccactccagcccaggcgacacagagaccactctgcttcctgacgataccatcacatccggcctggtggaggctagcacacctactcactcgtccactggctccctgcacaccaccctcacgccagcatcgagcacctctacaggtctgcaagaggagtccaccacattccaatcctggccctcctccagtgacaccactccgtcccccccctccaccacggccgttcctgttgaggtctccactacttaccatagccgtccgtccagcacccccacaacgcacttttcagcaagctcgacaacgttgggaagaagcgaagaatccacaacagtgcattcgtcaccaggagctactggcactgccttatttccaaccagatctgccaccagcgtacttgtgggggagcctaccacttccccaatcagctcaggaagcacagaaaccactgctcttccaggcagcacaaccactgcggggctctctgaaaaatcaacgaccttctatagcagtccccgttctccggataccactctcagtcccgcctctacgacttcttctggcgtatctgaggagagcacaacatctcactctcggccgggcagcatgcacacaaccgccttcccatcttcaaccacaatgcccggggtctcgcaagaatcaactgctagccacagctctcccggctcaaccgatacaaccctgtcccccggaagtactacggcttcctccctggggcctgagtctaccacttttcatagcagccctgggtccacagagaccaccctgcttccagacaatacgaccgccagcggcctattggaagcatcgacaccagttcactccagtactggcagcccccacacaaccttgtcccccgcaggctccacgacaaggcaaggcgaatcaacgacttttcagtcctggcctaacagtaaggatacgacccctgcaccacctactaccacatctgccttcgttgaacttagcactacttcacacggatcccccagttctaccccaacgacccattttagtgctagctcgacgacgttaggtcgcagcgaagagtccacaaccgtccactcttcccccgtggcaactgccaccactccctcccccgccaggagcaccacaagtgggctagtggaagaatctacaacctaccattctagccccgggtccacacagacgatgcactttcccgagtcaaacacaacgtccgggcggggtgaggaatctactaccagccatagtagtaccacccacacaataagcagtgcaccgtctacgactagtgccttggttgaggagccaacatcataccactcctcccccgggagcactgccaccacacattttcccgactcgtcaaccacatcaggccgcagcgaggaatcaaccgcgagtcattcttcccaggacgcgactggaacgatcgtactgccagctaggtctacaaccagcgttcttctgggcgagtccacaaccagcccgatctcctccggatccatggaaaccaccgcgttacccggaagcactacaacgcctgggttgtccgaaaagtccaccacgtttcatagcagcccttcaagcacacctaccacgcacttcagcgccagctccaccacattgggacgcagcgaggagtccacaactgtgcactctagtcctgtggccacagccacaacaccatccccagcccgctcgactaccagtggcctcgtagaggaatccaccgcctatcacagctccccgggctcaacgcaaacaatgcactttcccgaaagtagcaccgcttccgggaggtcagaggagtcgaggacatcacatagcagcacaactcacaccatctctagcccccccagcaccacctccgccctggtggaggagcccacctcgtaccattcttcccctggcagtatagcaactacccacttcccagagagctccaccacgtccggcaggtccgaggagtccacagccagccacagttcgccagataccaacgggattaccccccttccagcccattttactacatctgggaggatcgctgagtctaccacattctatataagcccaggctctatggaaaccaccttggcaagcaccgcaactactccaggtctaagtgccaaatcaacgatattgtattcctcctctagaagcccagaccagacgctgtcccctgcctcaatgacaagctcatctatttcaggcgagcccactagtctgtactcccaggcagagtctactcacactacggctttccccgcctctaccaccacaagtggattatcacaggaatccacaacattccacagtaagccagggtccactgagaccactcttagtcccggcagcatcactacgtctagctttgcacaggagtttacaacccctcattctcagccaggaagtgctctgtccacagtgagtcccgccagcacaactgtacccggactgtccgaagaaagtactaccttctactcatctcctggatctactgaaaccaccgccttttctcatagcaacacaatgtcaatccattcacaacaaagcactcccttcccggattcacccgggttcacacacactgtgctgccagcgacactcactactaccgatatcggccaggagagcaccgccttccattcctctagtgatgctaccggcacgaccccattgcccgcacgctcaaccgcgtcagacctagttggagaacctaccacgttttacattagcccttcccctacatatacaacacttttcccagcttctagttctacctcagggctgactgaggagtccactaccttccacacaagccccagtttcacatccactattgttagcactgaatctctcgagactctggcccctggcctctgccaggagggccaaatctggaatggcaagcaatgcgtctgccctcagggctacgtggggtaccaatgcctctctcccctggagtcctttccagtggagacaccagagaaacttaacgctaccctgggaatgactgtcaaggttacatataggaattttacagaaaagatgaacgacgcaagctcccaagagtaccaaaacttcagtaccctgttcaaaaaccgcatggacgtggtgctgaaaggcgacaatctacctcaataccgcggcgtcaatatccggcggctgcttaacggctctatcgtagttaaaaatgacgtgatcctagaggcagactacacgcttgaatatgaggagctttttgagaacctggcagagatcgtgaaagctaaaattatgaacgagacgcgcaccactcttttggaccccgattcctgccgtaaggccattttatgttactccgaagaagatactttcgtcgattcttccgtaactcccggctttgactttcaggaacaatgtactcagaaggccgccgaaggctacactcaattctactatgtcgatgtgctggacgggaagctcgcatgcgtgaacaagtgtaccaagggaacaaaatcccagatgaattgtaacttagggacttgccaactccagcggtcaggccctaggtgcttgtgcccaaataccaacacccactggtattggggggaaacttgcgaattcaacattgcaaagtctctcgtctacggcattgtgggggcagtgatggctgtgctactcctggctttgatcattctcattattctgttctcactgagccagaggaaacgccaccgcgagcagtatgatgtcccccaggagtggagaaaagagggcacacctggcatattccagaagaccgcgatctgggaagaccagaacctgagagaaagcagatttggcctagaaaacgcctacaataattttcgcccaactcttgaaacagttgacagcgggacagaactccatatccagaggcctgagatggtggcatccaccgtgtag

SEQ ID NO: 124919 - DNA, 16008 bp, Artificial Sequence
  Description of Artificial Sequence: Synthetic coding sequence
atgctcgtgatttggatcctgactctagccctccgactgtgtgcctctgtcacgacagttactccgggatcgaccgttaacaccagtataggtggtaacacgactagcgcgtctacaccaagtagcagtgacccgttcactacctttagtgattacggagttagtgtcacatttattaccggttcaaccgccacgaagcacttcctggacagctccaccaatagtggacactccgaggagagcacagtctcccactctggccccggggcaaccggaaccactctctttccatctcacagcgccacctcggtctttgtcggggagcctaagaccagccctataacctcagcgtccatggaaaccactgccctccccggctctacgacgactgcgggacttagcgagaaatccactaccttctactcttcgccacggagtccagaccgaactctctctcctgcccgcactacaagttccggcgtctctgagaaaagcactactagccactcgagacctggccctacacacacaattgcctttcctgactctacaacgatgcccggggtttcgcaggagtctaccgcttcacactctatcccaggttcaacagataccacactgagtccaggcacaaccactccatcttcattgggacccgagagtactaccttccactcctctccgggttacacaaagacaactcgccttccggacaacacaaccacgagtgggctgctcgaggccagcacccctgtgcacagctccaccggcagtccacacactactctgagtcctagctcctctacaacccatgagggcgaaccaaccacatttcaaagctggccttcttccaaggatacctctccagcaccctctggtactacctccgcctttgtaaagctcagtaccacctaccactcttccccttcctctacccccaccacacacttcagcgccagcagtactactctgggccactccgaggagtccactccagtccactcctcgcctgtggctactgctaccacgccaccccctgcacgatccgctacatctggccatgttgaggagtcaacagcataccataggagtcccggctccactcagacaatgcactttcctgaaagtagtacgacatccggccattctgaggaaagcgccactttccatggcagcacgactcatacaaagagctctaccccttctaccaccgcggctttagctcacacatcctaccacagcagtctgggaagtaccgaaactacccacttccgagattcttcgactatcagtgggcgctctgaagagagcaaggcctcccactccagcccagatgccatggcaactacagtgttgcccgctgggagcacaccctccgttctagtgggggacagcacaccatccccaatcagcagtggcagcatggagacaacagcgctgcccggttccacgactaaacctggcctgtctgaaaagtcgaccactttctattcatctcccagatccccggacaccacacatttacctgcgtccatgaccagcagtggcgtatcagaggagtctaccacctctcattcaagaccaggctctacccacactacagctttccccggctctacaacgatgcctgggctgagtcaagagtcaactgcttcccactccagcccgggaccgacagacaccacgcttagccccggatcaaccacagcgagcagtctgggaccagaatacaccacgtttcacagccggcctgggagcacagagaccacactcctgcctgataatacgaccgcctccggtctgctcgaggcttccatgcccgtgcacagctccactcgttccccgcatacgaccctatctccagccgggtccaccacacgacagggggaaagcaccactttccacagttggccctcttcaaaggatacccggcccgctccgccgacaaccacatctgcattcgtcgagccgtcgactactagccacggcagcccaagcagcatccctactacacatatctccgctagatccaccacgagtgggctcgtcgaggagtctactacgtatcacagcagtccaggatccacacagactatgcattttcctgagagcgatacaacatccgggaggggcgaggaaagcacaacaagccacagtagcacaactcacactatatctagcgcgccgagcaccactagtgcgcttgtagaggagcctactagctatcattcaagtccaggcagcacggcaaccacacatttccctgattcctcaaccacttccggacggagcgaggagtccaccgcgtcgcactcaagccaggacgccacagggactatcgtcctccctgccagatcaactactagcgtgctcttgggggagagcaccacctccccaatttcctctggttcgatggagacaaccgctctgccagggtcaaccacgacaccagggctcagtgaaaggagcaccacctttcactcgtcacctcgctctcccgcaactaccttgagccccgcttcaaccacttcctctggtgtatctgaggaaagcacaacttcaagatccagaccaggtagcactcatacgactgcttttccggattctacaaccactcctggactctcacgtcactctaccacatctcattcttcgccggggtccacagacactaccctcctccctgccagcaccacgacctccggcccatcccaggaatcaaccacctctcactcatctagtggcagcacagataccgccctgtccccaggaagcaccacggcgctgagctttggccaagagagtaccaccttccactccaatcccggaagtacccatacgacactgttcccggattcaaccacttctagtggtatcgttgaggcctccacgcgagtccatagttccactgggtcacctcgtaccacgctatccccagcatcttcaacatctccgggcttgcagggcgagagcactgcctttcagacccaccctgcatccacacacaccactccgagcccaccttccactgctaccgcccctgtcgaagaatctaccacgtaccaccgatctcccggatcgactccaaccacgcattttcccgcctctagcaccacaagcggccattccgagaagagtactatctttcatagctcccccgacgcttccggaaccacaccaagcagcgctcacagcacaacatcgggccgcggtgaaagcaccacctcaaggatttcgccaggaagcacggaaattactacactgcccggcagtaccacaacacccgggctgtcggaagcctccaccactttctattcctctcctcggagtcctaccaccaccctctcccccgctagcatgacctcacttggtgtgggtgaagaatccaccacctcacggagccagccaggaagcacccatagcacagtatccccagccagcactactacacccggtctgagcgaggagtcaactaccgtttattcttctagtcgtggatcgacggagaccactgtcttcccacactccacgaccacttccgttcacggagaggaacccaccacttttcattctagaccggcaagtacacatacaacgctctttacggaggactcaaccaccagtggactgaccgaggaaagcactgccttccctgggtcgcccgcctcaacgcaaaccggccttcccgcaactctcacaaccgctgacctcggcgaagaaagcactacatttcccagcagcagcgggagcacaggcactaaactcagtcctgccaggagtaccacctcaggccttgtgggcgaatcaaccccatcacggctcagtcctagcagcaccgagaccacaactctgccaggcagtccgaccaccccttcactaagcgagaagagcactaccttttatacgtccccaaggagcccagacgccaccctgagcccagccacaactaccagttcaggggtgagcgaggagagctccaccagccactcccagcctggctcgacccatacaacagcctttcccgacagcactactacctccgacctttcccaggaaccaactaccagccatagctcccaagggagcactgaggcgacgctctcacctggtagcacgactgcaagttctctgggacagcaatccaccacttttcatagctcacctggagatacagaaacaacgctgttaccagatgacaccataacgtctggtctggtcgaagccagtactccgacccactccagtacaggatccctacataccactcttactccagcgtcatctacaagtgccggactgcaggaggaaagcacaacgtttcaatcctggcccagcagcagcgatacaacaccctccccaccgggcacaacagccgcaccagtcgaggtgtctaccacgtaccattccaggccatccagcacccctaccactcacttctcagctagttccacaacactcggaagaagcgaggagtccacaacggtgcattcatctcctggggctactggcacggccctgttccccaccagatccgcgacaagtgtgctggtgggggagcccaccaccagtcccatcagctctggcagtaccgaaaccaccgctctgccagggagcactaccactgctggcctctccgagaagtccactactttttactcatccccgaggtccccagatacaacgctgagtcctgccagcactacatcatcgggggtgagcgaggaatctaccacatcgcacagtagaccaggctccactcacacgaccgcgttccccggatccacaactatgccgggcgtgagccaggagtccaccgcttcacacagctctccgggaagcacagacaccacgctgagtccaggctccacaacagcttcctccctgggacctgagagtaccacttttcacagtagcccaggcagtactgaaaccactctcttgcctgataacacaaccgcatcagggctgctcgaggcatccacacctgtccattcgtctacggggagtcctcacacaactctctcaccagccggtagtacaacccgccaaggggagtccaccaccttccagtcctggccctcctcgaaagacacaatgccagccccccccacaactacgagcgcgttcgtggaactgagcaccacatcccatggctcaccttcaagtaccccaacaacccatttctccgcatccagtacaaccctggggagaagtgaagagtctacaaccgtgcacagttcccccgtggccaccgcaaccacaccaagcccggcccgctctactacctccggattggtcgaagaatcaacagcataccatagctcccccgggagtacacagacaatgcatttccctgagtcctctacagcgagcggcagaagcgaggaaagcagaacatcccacagttccactacccacaccatttcatctcctcccagcacgacctcagccctggtggaagaaccaacaagctatcacagtagcccgggttcgactgccactacacatttcccggattcctccacgacctccgggagaagcgaggaatcgaccgcaagtcactcctcgcaggatgccactggcaccattgtgctgccggcaaggtctacaacctctgttctcctgggagaatccactacctctcctatcagtagcggtagtatggaaactactgcccttcctggctctactaccacaccgggcctgtctgagaaatcaactactttccactcctccccaagaagccctgccaccaccctatctccggccagcaccacttcttcaggcgtttccgaagaatccactacatctcattctcgaccaggatctacacacacaaccgcttttccagacagcaccactaccccaggccttagcagacacagcactacgtcgcatagctcaccaggatccaccgataccactctgctccctgcttctacaacaacttctgggcctagtcaggagtcgaccacctcccattctagtccagggtctaccgacaccgctctgagtcccgggagtacaaccgccctgtccttcggtcaggagtcaaccactttccactcgtcacctgggtcgacacacaccacgctttttcctgacagcacaacctcttccggtatcgtcgaggcatctacccgtgtccactcaagcaccggttcgccccgtacgacgctgagtccagcctcatctacctctcccgggctgcagggagaatccacagccttccagactcatccagcctccacgcacacaaccccgagccccccaagtaccgccactgcccccgttgaggaaagtacgacttatcaccgaagtcccggatccacaccgaccacccactttcctgctagcagcacaacgagcgggcacagcgaaaaatccactatatttcactccagccctgacgccagcgggacaaccccttcttccgcacactctacaacaagcggaaggggtgaatctacgacttcacggattagtcccggctccacagaaatcactacattgcccgggagcacaacaacaccaggcttgagtgaagcgtccactacattctacagcagccccaggtctccaacgacaactctcagccctgcttccatgacaagtctgggtgttggcgaggaaagcaccacatcccggtcgcagcctgggagcacccactctactgtgtctccagccagcactaccactcccggattgtctgaggaatcaaccactgtgtacagctcttccccaggatctaccgagactactgttttcccccgcacacctaccactagtgtccgcggagaagaacctacgactttccacagcaggccagcctcgacacacaccacccttttcacagaggactctaccacctccggactgacagaagaatctaccgcttttcctggcagtccagctagcacacaaaccggactccctgcaacactcaccacagcagacttaggagaagagtcaacaacatttcccagctctagtggatcaactgggaccactctctctcctgcccgctctacaacgtctggcctggtgggagagtctacccctagcaggttgagcccgagcagcacagagacaactaccctcccaggttctcctacaacaccaagcctcagcgagaaaagtacaaccttctacactagtccacggtccccagacgcgactcttagcccagcgaccacaactagttcaggggtctcggaggagtcctccacctctcatagccagccaggcagcacccatacgaccgcatttcctgactcaacgactactccaggcctgagccgtcacagcactacgagccactcctctccgggcagtactgacaccaccctcctgcccgcatcaacgaccacctccggccccagtcaagagtctacaacatctcactcgagccctggaagtacagatactgctctgtccccgggttcaactaccgcgttgagctttggtcaggaatctacaacttttcattcttctcccggctccactcacactactttgttcccggactctacaacttctagcgggatcgtggaggccagtacccgagtgcactctagtactgggtcaccccgcactactttgagccctgcttcttcgaccagccctggacttcaaggtgaatcaactacattccagacacacccagcgtctacccatacaacgccttctccacccagtacagcaacagctccagtggaggaatctacaacataccatcgatcccccgggagcactccaaccactcactttcccgctagttctacaacgagtggacatagtgaaaagagcacaatctttcatagctctcctgatgcttccggaaccacccccagctctgctcatagtaccaccagtgggcggggggagtcaaccactagtcgcatctcccctggtagcactgagataaccacactgccaggaagtaccactactcccggtctgtctgaagcgtcaacaacattttattcaagcccccgaagtccaacaactacgttgtccccagcttctatgacctctctgggcgtgggggaggagagtaccacatcacggtcacagccggggtcaacccactccaccgtgtctcccgctagtactaccaccccaggcctctcagaagaaagtacaactgtgtattcatcaagcccggggtccaccgagacaaccgtcttcccaagatcaacaactacatcggtgagaggcgaagagcccaccacgtttcactcaagaccagccagcacccatacaacactctttacagaggattcaactacctctggactgacagaagagtctaccgcatttcccggaagccctgcttccacgcagaccggcctgcccgctacattaacaaccgctgatttgggggaagaatccacaacattccccagcagttccggatcaactggcaccaccttgagcccagctaggtctaccacatccggcctggtgggagaatccacaccctctagattaagtccgtctagtaccgaaaccacgacactccctggaagcccgactacaccatccctgagtgagaagagtactacgttctacacatcaccccgctcccctgatgcaactctaagcccagcaactacgacaagctccggggtgtcagaggaaagcagcacatctcatagccaaccggggtcgacccacactactgcgttcccggattccactacaacgtcaggactctcacaggagcctacagcgtcccatagctctcagggttcaacggaggccacactgagccccggcagcaccacggcctcttccctcgggcagcagtctactacctttcatagcagccctggagacaccgagacaacgctgctccctgatgatactataaccagcgggctggtcgaagctagtactcctacgcattcatcaacaggctcgttgcatactaccttgacgcctgcttcatcgactagcgccggactgcaggaggagtcaacaaccttccaatcctggccttctagctctgacacgaccccctcgccaccgggaaccactgctgcccctgtagaagtatcgacaacctaccactctcgcccaagcagcacccccactacccacttctctgcatcctctaccactttaggcaggagcgaagagtccaccactgtgcacagtagtccaggagccaccggcacggcactgtttcccacaaggagcgccacctccgtcctggtgggagaacccacgacaagtcctataagctctggatctacagagaccaccgccctacccggcagtaccaccacagccggactcagcgagaaatccacaacattttactcatccccaaggtctcccgacaccactctaagcccagcatctactacatcatctggagtgtcggaagaatcaactacttcacactctagacccgggagcacccataccacggctttccctggatcaactaccatgcccggcgttagccaggagagcaccgcttcacattcctcccctggcagtactgatacaacactctcccctggatccaccacagcctctagcctcggtccagagtccacaaccttccacagtggaccaggatctactgaaacaaccttgttgccggacaatacaaccgcttccgggttgctagaggcttcaacacccgtgcactcatcgaccggctccccacatacgacactctcacccgccggctctacgactcggcagggggagagcaccacatttcagagctggcctaacagtaaggacactacaccagccccgcctactactacttctgcattcgtggagctgtctaccacatctcatggcagcccaagctctaccccaacaacccacttttctgccagttctaccacccttggacggagtgaggagtccaccacagtgcattcaagccccgttgcaaccgccactaccccttctccggcgcggtcaacgacttcgggcctcgttgaggaatccacaacgtatcactcaagcccgggttctacccagacaatgcacttcccagaaagcgatacgacgtcagggaggggtgaagaaagcaccacatctcacagtagcactacccataccatctcgagtgcgcccagcactacctctgccctggtagaggagccaaccagctaccatagctcccccgggtcaacagccacaacgcacttcccagatagcagcactactagtggcagatcagaagagtccaccgcctctcatagtagccaggacgccaccgggaccattgtactccccgcaaggtccaccacctcagttttgcttggcgaatcaaccaccagccctatctcttcgggaagtatggagactacggcgttgcctggttccacaacaacccccgggctgagcgagaagtctaccacattccacagctcaccaaggtccccggccacaacactgagcccggcgagcacaacatcttcaggagtttccgaggagagcaccacgtctcacagcagaccagggagcacacacactacagctttccccgactcaacgacaacacctggtctgtctagacatagcaccacctcccactcatcacctggtagcaccgacaccacgttgctccccgcttctacaaccacctctggatcctcacaggagtcaacgactagccactcaagttcggggtctaccgacaccgctttatcacccggatccacgacagccctgagttttggacaggaatctactaccttccatagttccccaggctccacccacaccaccctgttcccagattccaccaccagcagtggaattgtcgaggccagcacgcgcgtacacagctctacaggttcaccgaggacaaccctcagccccgcctcatccacatcaccggggcttcaaggagaatcgacggcattccaaactcacccagccagcacccacacaacacctagcccaccgagcacagcaacagctcctgtagaagagtccaccacctaccacaggtccccaggctcgacccccactacacactttccagcatcttctacaacaagtgggcattccgaaaaaagcacgattttccactcttccccagatgccagtggcaccactccgagttctgcgcattccaccactagtggaaggggggagagcaccacatccaggatctctccgggttccactgaaattactacccttccagggtccaccaccaccccaggattgtcagaggctagtaccaccttctattcatccccccgctcaccgactactactctttcaccagctagtatgacctcacttggcgtgggcgaggagagtaccacctcccggtcccagccaggcagcacacatagcacggtaagccctgcctccaccacgacccctgggctctccgaggaatcaaccacagtttatagctctagccctggctctaccgagacaacggtttttccacgttcaaccacaacaagcgtcagacgtgaggagcctacaacctttcacagtcgccccgcctcaactcatactaccctgtttacagaggattctaccacctctggactgacagaagagtctactgcatttccggggtcgcctgcctccactcagacaggactgcccgccacactgacaacagctgacctgggggaggagtctaccacgtttcctagcagctcaggatcaaccggtacaaagctgtcacctgcacgatctacaactagcggacttgttggtgagtcaactccctcaagactgagcccttccagcacagaaacaactaccttgcctggttcccctactaccccttctctctctgagaaaagcactaccttctacacttcaccacggtcacctgatgccacactgtcacccgccactaccacctcctccggggtgtccgaggaaagctcaacaagccatagccaaccagggtccacacataccacagcctttcctgacagcactacaacttctggactgagccaggagccaactacctcccactcctctcagggatctaccgaagctaccctgtcacccgggagcactacagccagctccctggggcaacagtcaacgactttccattcttccccaggggatactgagaccacgctgttaccagatgatacaatcacatccggcttagtggaggcttctacccctacccactcctccacaggaagcctgcacacaaccttgacccctgcctcttccacatccactggcttacaggaggaaagtacaacgttccagtcttggccgagtagttcggacaccacaccctccccaccatccacgacagctgtccctgtggaagtgtccaccacataccattctcggccgagttcaacccccactacccattttagcgcctcaagcacgacacttgggcgaagcgaggagtcaacaactgtgcatagcagcccgggtgccacagggacagcccttttccccacacggtccgctacgagcgtattggttggcgagccaactacatcccccattagctccgggagcacagaaactacagcgctgcccggctccacaacaacagccggtttatcggaaaagtcgaccactttctacagcagccctaggagccccgacaccacactcagtcctgcttccactacctcttcgggggtgagtgaagagtctacgacttcgcactctagacccggttcaatgcatacaactgcctttccttccagcaccaccatgcccggcgtatcacaggaatccacggcatcccacagttcccccgggtccaccgacacaactttgtcacctggtagcactacagcatcttcactgggacctgagtctaccacgtttcattcctcacctggatctactgaaacaaccctgcttcccgacaatactacggcctctgggctgttggaggccagtacccctgttcacagcagcaccgggtctcctcacaccacattatcgcctgccggctctactactaggcagggggaaagcactacgtttcagtcctggccaaattccaaggacactacacctgcaccccccaccaccacttcagctttcgtggagctgtctaccactagccatggctctccgtcttctacccctaccacacacttcagtgcatctagcactacattgggtcgcagcgaggagtccacgacagttcacagttccccggtcgccaccgccacaacaccctccccagccagatcaactacaagtgggctcgtggaggaatccacaacttaccatagcagtccagggtccactcagaccatgcatttcccagagtctaacactacaagcgggcgaggtgaggagtccacaacctctcacagcagcacaactcacaccatctctagtgccccttccacaaccagcgcactagtcgaagagccaacgtcctaccattcctcacccgggtccaccgcaaccacacactttccagactcaagcaccactagcggtcggtccgaggaatccacagcatcccactctagtcaggacgccactggtaccattgtgctgcccgcccggagcacgaccagtgtgttgctgggagagagcacgacgtctccaatctcctccggttctatggagacaacggccctcccggggtccaccaccactcctggattgagcgaaaagtccaccacgttccattcaagccctagtagcacacctactacgcatttctcggcttcttctacgacactgggacggagcgaagagagcactaccgtgcatagctctcccgtagcgactgcgacaacgccatcaccagcccgcagcaccacaagtggcctagtcgaggagagtaccgcctaccacagcagcccaggctcaactcagaccatgcactttcctgagtcttccactgcatctgggagatcagaggaaagccgcacctcacacagctctaccacgcatacaattagttcccctccctctaccacttccgctctcgtagaggagccaacgtcctatcattcttctcctgggtctattgccaccactcattttcctgaatcatctaccaccagcggcagatctgaggaaagcacagccagtcacagtagcccagatactaacggaattaccccactgcccgcgcatttcactacatcggggagaatagcagaatcgaccacattctacatctcccctggtagtatggagaccactcttgcttcaactgccactactcctggactttctgcgaagagtaccatactatatagctcttctcggtccccggatcaaactctgagtccggcatcaatgactagtagctctatctccggagagcctacctccctgtactcccaggctgagagtacgcatacgacagcgttcccagcctccaccactacttccgggctgtcacaggagtctacaactttccattccaagcctgggtccaccgaaacaaccctcagccctgggagcattaccacctcatcattcgcccaggagtttactaccccacatagtcagccaggctccgccttgtctaccgtgagccccgcttcaacaacagtacccgggctttctgaggaatcaacaaccttctactcgtctccgggatcaaccgagacgacagcgttttcccacagtaatacaatgagcatccactcccagcagagcacacccttccccgactccccaggattcactcatactgtgctgcctgctacgctgactaccacagatattggccaggagtctactgcttttcactcatccagcgacgcaactggcactaccccactgcccgcccggtctactgcctcagatctggtcggagagcccactactttttacattagcccaagtccgacgtacacgacacttttccccgcctcttcaagtacatccggactgactgaagaatccaccaccttccataccagtccaagcttcacttcgaccatagtctctaccgaatctctggagaccctggctcccggcctgtgtcaagaggggcagatttggaacgggaagcagtgcgtgtgcccacagggttatgtggggtatcagtgtctgtcaccgctcgaatcttttcctgtcgagacgcctgaaaagcttaacgccacattaggaatgaccgttaaggtcacttacagaaacttcacagaaaaaatgaacgacgccagctcacaggagtatcagaatttttctacactgttcaagaacaggatggacgtcgttctgaaaggagataacctacctcagtaccgcggcgtgaatatcaggagactactcaacgggtcgatcgtggtgaagaacgacgtcatacttgaagcggattacacactcgaatacgaagagctcttcgagaacctggcagagatcgtgaaagcgaaaatcatgaacgagactagaactacgttgttagacccagacagctgtagaaaagccatattgtgttactccgaggaggacacattcgtggactcctccgtaacacctggcttcgattttcaggaacaatgcacccaaaaagctgccgaagggtatactcagttttattacgtggacgtgcttgacggcaaattggcgtgtgttaacaaatgtacaaagggtaccaaaagccagatgaactgcaacttgggaacttgccagctgcagcggtctggcccaaggtgtctatgtcctaataccaatacccactggtactggggagagacatgcgagttcaacattgcaaagtctttggtgtatggcattgtgggcgcggtgatggccgttctgctcctcgccctcatcatcctcattatcctgttctccctgtcccaacggaaaagacatagggaacaatacgacgtccctcaggaatggcgtaaagagggcacacccgggattttccagaagactgcgatctgggaagaccagaatctgcgcgagtcacgctttgggcttgaaaacgcctacaacaattttcgcccaactctggaaactgtggattctggcactgagctccacatccaacgcccagaaatggtggctagtacggtgtag

SEQ ID NO: 124920 - DNA, 1536 bp, Artificial Sequence
  Description of Artificial Sequence: Synthetic coding sequence
atgaaagcgatcatccatctgaccctgctggctctgttatcagtcaatacagcaacgaatcaagggaacagcgccgatgctgtgacgacaactgagacagccacctccggccccactgttgctgcagccgataccaccgagactaattttcccgagacggcaagtactacggccaacacacccttccctacagccacatctcccgcccccccaatcatcagcactcatagtagttctaccatcccgacgccagctccaccaattataagtacacatagtagtagcactatcccgatcccgaccgcagcggattctgagtccaccacaaatgtgaactcccttgccactagtgacatcatcacagcaagctcgcccaatgatgggctgatcacgatggtcccgtctgagacacagtctaacaatgagatgtctcccaccaccgaagacaaccagagcagtggtcccccaacaggcaccgcgttattagaaacaagcaccttgaactcaactggaccctctaacccgtgtcaggatgacccatgtgccgataacagcctctgcgtgaagctgcataatacgagtttttgcttgtgcctggaggggtattactacaatagctctacctgtaagaagggcaaagtatttccgggaaagatctcagtcacagtatctgaaacctttgatcccgaagagaaacattccatggcttaccaagatctacattctgaaatcaccagcctgttcaaagacgtcttcggcacctcagtgtacggccaaactgtcatcctcacagtttctacgagtctgtccccccggagcgaaatgcgggcagatgacaagtttgtcaatgtgaccattgttaccattctggccgagaccaccagtgataatgaaaagactgtgacagaaaaaattaataaggccatccggtccagttcctcaaatttcctcaactatgacctcactttgagatgtgattattatggatgcaatcagactgctgatgactgccttaacggcctggcctgtgattgtaaatccgacttacagcgacctaatcctcagagccccttttgcgtggcttcttcactcaaatgcccggacgcctgcaacgcacagcacaaacaatgcctcattaagaaaagcggtggcgctcccgagtgtgcctgcgtccctggctaccaagaggacgccaacgggaactgccaaaaatgcgcctttggttactctggtctcgactgcaaagataagttccaattgattctcacaatcgtcggtaccattgctgggatcgtcatactgtctatgatcatcgcgctgatagtgacagccaggagcaacaataagaccaagcatattgaggaggagaaccttatcgacgaggattttcagaatctgaagctccgctccactggcttcacgaatcttggggccgaaggcagcgtgttccccaaagtgaggatcaccgcatcgagggatagtcagatgcaaaacccttactcgcgtcactcttccatgccaaggccagactattag

SEQ ID NO: 124921 - DNA, 13482 bp, Artificial Sequence
  Description of Artificial Sequence: Synthetic coding sequence
atgccccggcctggtactatggccctctgccttctgaccctcgtcctgagcctgctgcccccacaggccgcagcagagcaagacctgagcgtgaatcgcgccgtctgggatggcggcggatgtatttcccaaggtgatgttcttaaccgacagtgccagcagctgtcccagcacgttcggaccggttccgctgcgaacacggcaaccggcactacaagcacaaatgtcgttgaacctcggatgtacctgtcgtgctcaaccaacccagaaatgacttcgattgaaagctccgtcacgtccgacaccccaggggtcagttctacaaggatgacccctactgaaagcaggacaaccagtgagagcacctccgattctaccaccttgtttcctagctcaactgaggacacgtctagccctaccacccctgaaggcacagacgtgcctatgagtacgcctagcgaagaatctatctccagcaccatggccttcgtctccacagcgcccttaccttcctttgaggcgtatacaagtcttacttacaaggtggacatgtccacgcctcttactacctcaactcaggcctccagttcccccaccactccagagtctacaacgatacccaaaagcactaacagcgaaggatcaactccactgaccagcatgccagcgagcaccatgaaagtagcgagctctgaagctattacgcttctaaccacccccgtggagatctccactcccgtgacaatttccgcacaggcatcaagctctccaaccacagccgagggcccttcactgtccaactcagctcccagcggggggtccacgccattgacccgaatgcccctgtctgttatgttggttgtctcgagtgaggcaagcaccctgagcactacccctgcagccaccaacatccctgtcattacctccacagaagcctcctcttcaccaacaacagctgagggtacctcaatccccacaagtacatacaccgaggggagtaccccattgacctccacaccagccagcacgatgcccgtcgcaaccagcgagatgagcacattgagcatcacaccggtggacacctctaccttggtgaccactagtacagaaccatctagcctccccactacggcagaagccactagcatgttgaccagtaccttgtcggagggcagcaccccattgacaaacatgccggtgtcaacaatcttagtggcatcttcagaagctagcacaacctcaaccatccccgttgacagcaaaacatttgttacaactgcctcagaagcctcaagcagcccaacaaccgcggaagacacctctatcgccacttcaaccccctcggaaggctctaccccacttaccagtatgccagtgtctacaacccccgttgcatcctctgaggcctcaaacctcagcactacgccggtggatagtaaaacacaggtcactacgtccactgaggcttcttccagtcctccaacggctgaggtgaattccatgcctacctccacaccttctgagggttcaacacccctgactagcatgagtgtctccaccatgcccgtggccagctccgaagcctctacgttatcgacgacacctgtggatacctccacccccgtgaccacctcttctgaggcatcttcctcgtctacaacccccgagggcaccagcattcccacgagcacccctagcgaggggagtacaccactgactaacatgcccgtatccacacgacttgtcgtgtcttctgaggcttcaacaacaagcaccactccagccgactcaaacacttttgtgacaacttctagtgaagccagtagctcaagcaccaccgcagaaggaaccagcatgcccaccagtacatactcagaacgaggcactaccatcacatcaatgtcagtatctaccaccctggtggcaagtagcgaggcctctactctgagcacaacaccagtcgattccaacacacccgttaccacgagcacagaggcgacatcatcctccaccacggccgaggggactagcatgccaacatctacctatacggaaggctccaccccacttaccagcatgcccgttaatactacattggtggcatctagcgaggccagtacattgagcaccacaccagtcgatacatcaaccccggtcaccacttccaccgaggctagctcatcccccactacggctgacggtgccagcatgccgacatctactcccagcgagggttccaccccccttacctctatgcctgttagcaaaacgctcctaacctctagcgaggcaagcaccctgagcacaacaccactggacacttccacccacatcacaacatcgaccgaggccagttgtagtcccaccaccaccgaaggcactagcatgcctatatctacccctagtgaggggagcccgctcctgacgtccatccctgtgagcatcactcctgtgacatctcctgaggcgagtactcttagtactaccccagttgacagcaatagcccagttacgacatctactgaagtctcctctagtcccacaccagctgagggcacaagtatgccaacaagtacttattcagaaggtagaacccccctgacctctatgcccgtgagtaccacattggtggctacttctgctatttccacattgagtactacccccgtggacacatccactccagtaactaatagtactgaggcgcgtagttcaccaactacttctgagggcacttcaatgccaacaagtacccccggcgagggaagtacccccctcactagcatgccagatagcaccactccagtcgtgagctccgaggcccgaacgctcagcgctacccccgtagatacgtcgactccagtgaccacctcaaccgaagccactagttctcccaccaccgctgagggcacaagcatccccacaagtaccccaagcgaaggaacaaccccactgacaagcacgcctgtaagtcacacactcgttgcaaacagtgaggccagcacactatctacaacacccgtagattctaatacgccgctaactaccagcacagaggcatcctccccgcctcctactgctgagggtacttcaatgcccaccagcactccctcggagggcagcactcctctcacacggatgcccgtgagcaccactatggtggcgagcagcgagacatctacattgtcgacaacgccggccgacacctccacgcccgttaccacatacagccaggcttcatcgagctccacaaccgccgacggtacttctatgcccacttctacatattcagaaggctccacccctcttacgagcgttccagtgtccactcgactggtggtaagtagcgaggcctccacactaagcacgactccagtcgatacaagcatacccgttaccacctctaccgaagcttccagcagtcccaccacagccgaaggtaccagtatcccaacttctccaccatctgaaggcacgactccactggctagcatgcctgtgagcacaactctggtagtttcctccgaggccaacactctcagcaccacaccggtcgacagtaagacccaggtggccacttccacggaggcctcatcacctccgcctactgctgaggttacaagtatgccaacctccactcccggtgagcggagcacaccattgacaagcatgccagtccgccacacacccgtggcatcgagtgaggcttcgacgctgagtactagccctgtagacaccagcacgcccgtcaccacaagtgctgaaacttctagttctcctaccactgcagagggaacatctctccccacgagcactacaagtgaggggtccaccctcctgacatcaattcccgtgtctaccacactggtcaccagccccgaggcaagcacgctcctcacgacacccgtggacacaaaaggtcctgtcgttacctccaatgaagttagctccagccctacaccagccgagggaactagcatgcctacctccacttatagcgagggccgaacccccctgacgtctatccctgtcaacacaactctcgtagcatccagcgccatctctatcctttctactacaccagtagacaactctactccggtgacgacatccaccgaggcatgctcctcccctaccacgagtgagggcacaagcatgcctaatagtaatcccagtgaggggactacaccgctgacaagtatcccagtgagcactacgccagtcgtgagtagcgaagcatcaacattatctgctacgccagtagataccagcacgcctggcaccacctctgcggaggctaccagctctccaaccacggccgaaggtatctctatccccaccagcaccccctctgagggtaaaacccctctgaagagcataccagtgtccaatactccagtcgccaattcggaggctagcacgttaagtacaacgcccgttgactctaatagtcctgtggttacaagcaccgcagtgtcatctagcccaacccctgctgaggggacatctatcgcaattagtactccatccgagggcagcaccgcgctgacaagcatcccagtaagtaccactaccgttgccagttctgaaatcaactccctttcaacaacccccgcagttacatcaacaccggtcactacgtattcacaggctagttcgtcacccaccactgctgatgggaccagcatgcaaaccagtacatactccgagggatccaccccactgacctccttgcccgtgagcaccatgttagttgtgtcatccgaggctaacacgctgtcgacgaccccgatcgatagtaaaactcaggtgaccgcctcgacagaggcctctagcagcactactgcagaggggtcttcaatgacaattagtactccaagtgagggaagccccctgctgactagcataccggttagcacgactcctgttgcatctcctgaagcctcaaccctgtctactacaccagttgactcgaattcccccgtgattaccagcacggaagtgtcgtcaagcccgacccctgccgaaggcacttctatgcccacctctacctacaccgaaggcaggactcccctaacctctatcactgtgaggaccactccggttgctagctccgcaatttctactctctcaactacgccggtcgataactctacccccgtgaccacttctacggaagcaagatcctcaccgacaacatctgaggggacctctatgccaaactccaccccttcagaggggacgactccactgacatctatcccagtcagtactactcccgtcttaagctccgaagcgagcactcttagtgcaaccccgatcgacacatccaccccagttacaacttccactgaggcgaccagctcaccaaccaccgccgaaggcacctcgatccccacctcaaccctcagtgagggcatgacccctctgaccagcacccccgtgtcccatactctggtggcaaactccgaggccagtaccctcagcacaacaccagtggatagcaattctcccgtcgtgactagcacagcagtgtcgagcagtccaacaccagctgagggaacatcgatcgcgacatcgactccatcggagggaagtacagctctcacaagcatcccagtgagcacaacaacagtggcctcctcggagacaaatacattgagcacaacgcctgccgtaacatcaacccccgtcaccacctatgcgcaagtttcttcatctcctacaacagcggatggatcttcaatgcccacaagcacccctagggaagggcgacctcctctcacatctatcccggtttctacaactacggttgccagctcggaaataaatactctgtctacaacactcgctgatacacggacacccgttactacctacagccaggcaagttctagcccaacaacagccgacggaacctccatgcccacacctgcctactctgagggttcaacgccgctgacctccatgccactctcaacgacgcttgtcgtgtcgtccgaggccagcactctgtctaccactccggtggatacaagcacaccagccaccacatctaccgaaggatcttccagccccaccacagcgggcgggacatcaatacagacttccactccttctgagcgaacaaccccactggctgggatgcccgtgagcacaacattggtagtatcaagtgaaggaaataccctaagcacaactcccgtggatagcaaaacccaagtgactaactcaacagaggcttcttccagtgccacggctgaaggctcctcaatgacaatttccgcaccatctgagggaagcccactgctaacttctatcccccttagcaccacacccgtggcaagcccggaggcatctacgctgtctaccaccccagtcgactcaaactctccagtgattacgtcaaccgaagtgtcttcctctcccatccccactgaaggaacaagtatgcagacatctacatactccgacagaagaactccgctgaccagcatgcccgtcagcacgacagttgtcgcctctagcgccatcagtacactgtcaaccacgcctgtcgatacatcaacccctgtcactaacagtaccgaagctaggagtagcccaaccacctcagagggcacaagcatgcccacgtcaaccccatccgaagggtctaccccctttaccagtatgcctgtgtccacaatgcctgtcgtcacatccgaggccagcactctgtccgcaacccccgtagatacttctacacccgtcaccacttctaccgaggcaacatccagtccaacaacagccgagggaaccagtattcctacatctactcttagtgagggcactacaccgcttacatccatcccagtctcccacaccctcgtggccaattcggaagtgtctacattgtctactactccggtcgacagcaataccccgttcactaccagcaccgaggccagcagtcccccccctacagccgagggcacttccatgcccactagcacgagtagcgagggaaacacaccattaactaggatgcccgtcagcactacaatggtcgcttcattcgagacatccacactctccacaactcctgccgacacctccacacctgtcacaacatattcccaggcaggctcaagcccaacaaccgcagacgacacatctatgcctaccagtacctatagcgaaggatcaacaccgctcactagcgtgcccgtgtcaacaatgcccgtcgtgtctagcgaggcctcgacacatagcactacgcctgtcgataccagcacccccgtgaccaccagtacagaagccagttcatctcctaccaccgctgagggcacctctatacctacatctcccccatccgaaggtacaacaccactggcatcaatgccggtttctaccacgcctgtggtgtcaagcgaagccggtacattgagtacgacccctgtcgatacatctacccccatgactacaagcaccgaagcctcatccagtcccacaaccgcagaagatattgtggttcctattagcaccgcttcagaagggtctaccctgctgacatcaatccccgtctccacaacccccgtcgcatccccagaggcttcaacactctccacaaccccggtggattccaatagtcccgttgtgacctctacagagataagtagttccgctacttccgcggagggtacatctatgcctacttctacatatagcgaaggatccactcctctgcgttccatgcctgtaagcaccaagccactggctagttccgaggcttctaccctgtccactacaccagtggatacatcgataccagttaccactagcaccgagacctcgtctagcccaacaaccgcaaaggacacaagcatgcccattagtactccttccgaggtgtccacgtctcttacaagcatattggtcagcacgatgccggtcgcctccagcgaggcctcaaccctttctaccactcccgttgacacacggactctggtgaccaccagcaccggcaccagcagttctcctacaactgcagaaggatcctctatgccaacttctacgcccggtgaacggtcaacccctctgaccaacatcctggtctcgacaacccttttagccaattcggaagcatcaacgttgtccacgactccagtggacacaagcacccccgttacgacatccgcggaggcctcttcttctcctactacggcagagggaacgtccatgaggatttctacccctagcgacggatctactcccctgacatctattctggtgtctactttacccgttgcttcaagtgaagcgtcaacggtttccactacagcagtggatacctcgatccctgtaacaacctcaactgaggcctctagcagccccaccaccgccgaggtaacttctatgccgacaagcacccctagcgaaactagcactcccctcacaagcatgccggtgaaccatacaccggtagcctcatctgaagctggcaccctgagcacaacgccagtagacaccagtacccccgtgactaccagcacaaaagcctcgagcagcccaactaccgcagagggtatagtggtgccaataagcactgcatctgaaggatctaccttgctgacatccatcccggtctctacaacccccgtggcctcaagtgaagcttccacgctgtcgacaacgcccgtcgacaccagcatacccgtgactacatcaacggagggatcatcatctccgaccaccgccgaaggtaccagcatgccaatttctacgcctagcgaggtgagcactccactgacaagtattctggtgagcaccgtacccgtcgcagggtctgaggcaagtactctgtcgaccactcctgtcgacacaaggacgcctgtgacaaccagcgcagaggcttcctcatcccctaccactgccgagggcacttccatgcccatttcaacacctggagagcgccgaaccccactcaccagtatgagcgtctccaccatgcccgtcgcatcttctgaggcatctacactttcacgcacacccgcggacacttctacccccgtgactacatccaccgaggcttcttctagcccaaccactgccgagggaacagggatcccaatctcaacaccttccgaaggctcaacacccctaacctccattcctgttagtaccacgcccgtggccattccagaggcgagcaccctgtcaacaacaccggtggacagtaacagtcccgtggttacaagcactgaagtgtcctctagtccaacacccgccgagggcacttccatgcctatttctacctattccgaagggtctacccccctgaccggagtgcccgtctcaactacgccggtgacttcatctgctatatccacactctcaacaactcccgtggatacatctacccccgtcactacatcaactgaagcacatagctcccctactacctcagagggcacatctatgcctaccagtacacccagtgaaggaagcactcctctgacatatatgcctgtgagtacgatgttggtagtgtcctctgaagattcaaccttgagcgctacccccgtcgacacgtctacaccagtgaccacctcaaccgaagctacatcaagcaccactgctgaggggacatctatccccaccagcactccgtccgagggaatgaccccgcttacatctgtacctgtcagtaatacccctgtcgcgagcagtgaggcttccatcctgtctacaacccctgttgactccaataccccactgacaacaagtacagaagcgtcatcttccccccctactgctgagggtactagcatgccaactagtactccctccgagggatctactcctctcaccagtatgcctgtatcgacgacaaccgtcgcttcatcggagacctcaaccctgagtacaacccctgccgacacctccacgccagtcaccacctactcccaagcgagcagtagccccccaatagctgacgggacctctatgcccacctctacttatagcgaggggagcaccccactaacgaacatgagcttcagcacaacccctgtagtgagctcagaggcttcaacactcagtactacccctgtggatacatccacccccgtgaccacatctaccgaggcctctctgtctcctacgacggctgaagggacatcaattcctaccagtagtccctcagaggggaccacccctctagccagcatgccggtcagcacaacccccgtggtcagtagtgaagttaataccttgtccacgacaccagtggatagtaatacacttgttacaacctccacagaggcctctagctccccaaccatcgccgagggcaccagcctgcctacgtctaccacatctgaagggagcacgccgctcagtattatgccattaagtaccaccccagtggcctcatctgaagccagcacactgtccaccacacctgttgatacatctaccccagtgaccacgagttctcctacaaactcatcacctacgactgctgaagtaaccagtatgccaacaagcacagctggggaagggtcgacccctctcacaaacatgcccgtcagtacaactcccgtggccagttccgaggcgtcgacattgagtactacacctgttgactccaacaccttcgtaacaagtagtagccaggcctccagctcccccgcgacacttcaggtgactacgatgagaatgtcgactccaagtgaaggaagcagctctttgaccactatgttactcagcagtacatacgtgacctccagtgaggcctctacaccatccacaccaagcgttgaccggtcaacccctgttaccacatccactcagtccaactctacccccaccccacccgaggtaattacgttgcccatgagtactccctccgaggtgtctacaccccttaccatcatgccagtctccacaacaagcgttacaatcagtgaagcagggacagcgtctactctgccagttgacacttctacaccagtcatcacaagcacccaggttagcagcagccctgtcactcctgagggtaccacgatgcctatatggacgcctagtgagggttctacacccttgactaccatgcccgttagtaccacaagggtcacttcatcagaggggtctacccttagtactccctccgtagtgacatcaacccccgtgactacctcaaccgaggcaatctcttctagcgccacacttgactcgaccacaatgagcgtttccatgccaatggagatatccacgctgggaaccaccatcctcgtctcgaccacacccgtaacccgtttcccagagtccagtaccccctcaatcccgtctgtttacacatctatgagcatgactacagcgtccgaagggtcaagttctccaaccacattggaagggaccaccaccatgcccatgagcaccacctctgagagatctaccctcctgactactgtgttaattagtcctatatctgtgatgagcccctccgaagctagtaccctgtctactcctccgggggacacgtctacgcccctgctgacaagtaccaaagcagggtcatttagtatcccagcagaggtcaccacgattagaattagtatcacgtctgagcgatctaccccactcaccactcttctggtatcaacaacgttgccaacctcattccccggcgcaagcatcgccagtaccccgcccttggacactagcactacgtttactccctcaactgatacggcctcaaccccgacgattcccgtggccactactatttccgtctccgtcatcacggaagggtcaacaccaggaacgaccatatttattccatctaccccggtgaccagctcaaccgccgacgtgtttcccgccaccacaggagcagtcagcacacccgtaatcacgagcaccgagctcaatacccctagcacctcttctagtagtactaccaccagtttttctacaacaaaagagtttacaacccccgctatgacaaccgccgctcctctcacttatgtaaccatgtctacagccccgagcactcctaggaccactagtaggggttgcactacctctgcctccaccttgtcagcaacttccacaccacacacgagcacaagcgtgacaacgcggcccgtgaccccaagctccgagagcagccgcccatccaccattactagccacacgatacctccgacattcccccccgctcatagctctactccccctacaacatccgccagttcgacgaccgttaacccggaggcagtgactactatgacgactaggacaaagccaagtacccgcactactagtttccccaccgtgacgacgactgccgttcccacaaacacaactattaaatccaaccctacctctacacccaccgtgccgcgcactacgacctgctttggggacggttgtcagaataccgcaagcaggtgcaagaatggaggcacctgggacggtcttaaatgtcaatgcccaaatctgtattacggtgagctgtgtgaggaggtggtgagttccatcgatatcggacctccggagaccataagtgctcaaatggaactaacggtgactgttaccagtgtcaagtttaccgaagagctcaaaaaccactctagtcaggaatttcaggagtttaagcagacctttacggaacaaatgaacatcgtttatagcggcattcccgagtacgtgggcgtcaacataaccaagctccgactgggaagtgtggttgtggaacacgatgtcttactacgtactaaatacacacccgaatacaaaaccgtccttgacaacgccacagaggtcgtgaaggaaaagattacgaaagtcacgacgcagcagattatgataaacgatatttgcagtgatatgatgtgctttaacaccaccggcactcaagtacagaatatcactgtcacccaatatgacccagaagaggattgtcgcaagatggccaaggaatacggcgactattttgtggtagagtatcgtgaccagaaaccttattgcatcagcccatgtgaaccgggcttttcagttagtaagaactgcaatctgggtaagtgccaaatgtcattgtccgggcctcagtgcctgtgcgtgactaccgaaacccactggtactccggcgaaacttgcaaccagggaacacaaaagtcgctcgtgtatggcctagtgggcgctggcgtggtcctgatgttgataatcctggtcgccttgctgatgctggtgtttagaagcaaaagggaagtgaaacggcagaaatatagactgtcacaactctacaaatggcaggaggaagattctgggcccgcaccgggaacatttcagaacatcggtttcgacatttgtcaggacgacgacagcatacatctggaaagcatttactccaattttcagccgagcctgcgccatatcgaccctgaaacaaaaattcggatccaacgtccccaagtaatgaccacttcattttag

SEQ ID NO: 124922 - DNA, 843 bp, Artificial Sequence
  Description of Artificial Sequence: Synthetic coding sequence
atgaccaccgccttgggtagtcagctcagctcgagccaaacagtgattccaggaagcagcggcacgatttcacatacaaccgtggcccctggcagtagcgtgacaggcactaccaccggagcttcagatgatcaggttactggcagtaaaaccggaaccactggagtggccttatctactactgtggcaccgggaagttcttcaacagaggcgaccacaagcacaggcgtccaccggaccactgttgtggggcagaaaactggggccacaacccgcgggtcggccaaacaaggcactcggagtactatagaagctactacgagttttagaggaacaggaactaccgggagcgggatgaacacgggtaccacgggggtagtttctgggaatactattagcccctctagcttcaataccgaagctacaagcgggacgtcggagcgccctaaccctggcagtgaaattggaacaaccgggattgtctcagggaccaccgttgcccctggcagctctaacacagaagctaccacgtccctggggaatggcggaactactgaggccgggtcaaagattgtgaccacaggcattacaaccggaaccactatcgtgccagggagctttaacacaaaagccaccactagcacagacgtgggggtggctaccggcgtggggatggccacagggattacaaacatcatttcagggagaagccagccaaccgggtccaagacaggctatactgtcactggatcaggcacaactgcgctgcctgggggcttccgcaccgattccccctcgttccccctgttcctgatctgtagctatcggggccacaacttttag

SEQ ID NO: 124923 - DNA, 837 bp, Artificial Sequence
  Description of Artificial Sequence: Synthetic coding sequence
ccgacaggtacccagacccctaccccaaccccaatcagcaccaccacaaccgtaacccctacccccacaccaacgggaacacagacccctacaaccacacctataaccaccaccacaactgtgacacccactcctactccgaccgggacgcaaacccccacaaccgttctcatcacaaccacgactactatgacccctacccctactcccacctccaccaagtccacaaccgtgacgccaattacaacaacgacgactgtgacagccacacccactcccaccggtacccagacaccaacgatgattcccatcagcacgactacaaccgtcacaccaacacccacacctaccaccggatctactgggccccccactcatacaagtactgcccccattgccgagctgaccacatccaaccctcctcctgagtcctctactcctcagaccagcaggtcaaccagttctcctctgacggaatcaaccaccctattatctaccctgccacccgccatcgaaatgacgagcaccgcccctcctagcactccgactgcccccaccacaacatccggcggacacactttgagccctccaccctctacaacgacgagcccccctggcacacctacaagaggtactaccaccggcagttcttctgccccaactccctccaccgttcagaccacaaccaccagcgcatggacccctactccaacccctctctctacgccttccatcatcagaaccacaggcctccgtccgtatcctagctcagttctgatctgctgcgtgctgaatgatacttattatgctcctggggaagaagtgtacaacggctag

SEQ ID NO: 124924 - DNA, 5343 bp, Artificial Sequence
  Description of Artificial Sequence: Synthetic coding sequence
atgggattacccctggcgcggctggccgccgtttgcctggctctgtccctggctggagggtcggagctccaaacagaagggcggacacgaaaccacgggcacaacgtctgctccacttggggcaacttccactataaaactttcgacggcgatgtctttcggtttccgggattgtgcgactataatttcgctagcgactgcaggggcagttacaaggagtttgcagtccaccttaagcgaggtcctgggcaagccgaggcccccgcaggagtggagagtatcttattaaccatcaaagatgatacgatttacctcacaagacacctcgctgtgcttaacggcgcagtcgtgtccactccccactactccccaggactcttaattgagaaatcagatgcctacaccaaggtatacagccgcgctgggctgacacttatgtggaatagagaagatgccctgatgctggaactggacactaaattcaggaaccatacctgcggactatgtggggattacaacggactgcagagctacagtgagtttctctccgatggggttctgttttcgcctctcgagtttgggaacatgcagaagattaatcaacccgacgttgtttgcgaggaccctgaagaggaagtcgctccagcgtcttgtagcgaacatagagctgagtgtgaaaggctccttacagcagaagcgttcgccgattgtcaggatctggtgccccttgagccttatctgagagcctgccagcaggatcgttgcaggtgtcctggtggcgatacatgcgtttgtagtacggtggctgagtttagcagacaatgctctcacgctggcggccgccccggaaactggaggacagccacattgtgtcccaaaacctgtcccggaaatttggtctacctcgagtccggtagcccctgcatggacacatgctcccatcttgaagtgtcctctctatgtgaggagcacagaatggacggatgcttttgccctgaagggactgtttacgatgatataggcgattccgggtgtgttcccgtgagccagtgccattgccgcctccatggccacctgtatacccccggccaggaaatcactaatgattgcgagcaatgtgtgtgtaatgccggccggtgggtgtgtaaagaccttccgtgtcccggcacttgcgcattggagggtggttcccacattacaacatttgacggaaagacatatacatttcatggtgattgttactatgtgctggccaagggggatcacaacgacagctatgccctcctgggcgagctggcgccatgtgggagtactgataagcaaacctgtcttaagacggtggtactgcttgcagataaaaaaaagaacgttgttgttttcaaaagtgacggaagcgtgcttctcaacgagttgcaagtgaatctgcctcatgtaacggccagtttcagtgtgtttcgccccagtagctaccacatcatggtcagtatggctatcggcgtgagactccaggtgcaactggcgcccgtgatgcagctgttcgtaacccttgaccaggcctcacagggtcaagtccaaggcctgtgtggcaatttcaacggactggagggggatgacttcaagacagccagtggtcttgtcgaggcgactggcgccggttttgcgaatacttggaaggcgcagtcaagttgtcacgataaacttgactggctggacgatccatgtagcctaaatatcgagtctgctaattacgcagagcactggtgtagcctgttaaagaagactgagaccccgttcggcaggtgtcacagcgcggtcgacccggctgagtactacaaacggtgcaagtacgatacatgcaactgtcagaacaacgaagattgcctgtgcgcagcattgagctcctacgctcgcgcctgcacagccaagggtgtgatgctgtggggctggcgcgagcatgtatgtaacaaagacgttggatcctgtcccaatagtcaggtattcctgtacaatctcactacctgccagcaaacctgccggtcgcttagcgaagccgattcccattgtctggaggggttcgctcctgttgacgggtgtgggtgtcccgatcacacctttttggacgagaaaggtcgctgcgtgccactggccaaatgtagttgctatcaccgaggcctttatctggaggctggagacgtcgtggtgagacaagaagagaggtgcgtctgcagggacggtcgtctgcactgccggcaaatcagactgatcggacagagctgcaccgctcctaaaattcatatggactgttctaatctgaccgccttggccaccagcaaacctcgagccctgtcctgccagactttagccgcgggatattaccatacagagtgcgtctccggttgtgtgtgcccagacggactcatggatgatgggcgaggaggttgtgttgtggagaaagagtgcccttgcgtacataacaatgatttgtactccagcggcgccaaaattaaggtcgattgtaacacatgcacatgcaagagaggccgctgggtctgtacacaagctgtctgtcatggcacttgttctatatacgggtcaggacattacattacgtttgatgggaagtactatgatttcgacgggcactgtagctatgtggctgttcaagattactgcggacagaatagctccctcggatctttcagtatcatcactgagaacgtcccttgcggtactactggagtcacgtgctccaaggcaattaaaattttcatgggcagaacagaactgaagttggaagataagcacagagtagtgattcagcgcgacgagggacatcacgtggcctatacaaccagggaggttgggcagtaccttgtggttgagtctagtactggtataatcgtgatttgggataaaaggacaaccgtttttataaaacttgccccatcctataaaggaacagtgtgtggactgtgcggtaatttcgaccataggagtaataatgatttcactactagagaccatatggtcgtgtcctccgaactcgattttggtaactcctggaaggaggccccgacctgtccagacgtaagtactaacccagaaccgtgcagtctgaatccgcatcgtagaagttgggcagaaaagcaatgctcaatcctgaagtctagcgttttcagcatttgccactccaaagttgatcctaagcccttctatgaggcatgcgttcacgactcatgctcgtgtgacactggaggtgactgtgagtgtttctgctctgctgtggcctcttatgcccaggagtgcaccaaggagggcgcttgcgtattctggcggacacccgacctatgccctatcttttgcgactactataacccccctcatgagtgcgagtggcactacgagccttgcggaaatcgatccttcgaaacctgcagaacgattaatggaatccactccaacattagcgtttcgtacctagaaggatgttatcctaggtgtccaaaggatcggcccatctatgaagaagatttaaaaaaatgcgtaaccgctgacaaatgcggctgttatgtggaggatacccattatcctcctggtgcctcggtgcctactgaggagacctgcaaatcttggtgtacctgcacacagactcacactgcataccatgtacatacccacggcaaaattcttaatcagactcaagacggagcattttgctattgggaaatctgcggacccaacggaacggttgagaagcattttaatatctgtagcatcactacacggccaagcacactgacaaccttcaccactatcaccctccccactacgcccacgacttttaccaccaccactaccaccaccacgcctactagcagcaccgtgttatctactacacccaagctgtgctgtctgtggtctgattggataaacgaagatcaccccagtagcggtagtgatgatggcgaccgtgagacgttcgatggtgtgtgcggagctccagaagatatcgagtgtcgatctgtgaaggacccacatctaagcctcgaacaactggggcagaaagtgcagtgcgacgtgagcgtgggatttatatgcaaaaatgaggaccagttcgggaacggcccatttggattgtgttatgactataagattagagtgaattgctgctggccgatggataaatgcattaccacacccagcccacccacaacaacgccttcgccacctccaacatccacaaccacccttcctcccactaccacgccgtctccacctacaaccacaactactacgcctcctcccactaccacgccaagtcctccgattactaccacaactacgccccctccaaccaccacgcccagcccaccgatatcgactacaacgaccccacctcctactacaactccatcacctcctactactactccatcacccccgaccaccaccccttccccaccaaccacaaccacaactacacctccccccaccactacaccctcacctcccacaacaacacctatcactccgcccgcatccacaaccactctgccaccaaccacaactccgtcgccgcctaccacaactacaaccactccgcctccgactacgacccccattacaactactactaccgtcactcccactcccacccctacggggacacagacccccactaccaccccaattacaaccactactactgttacccccacccctacgcccacaggcacccagactccaacttccactcctataactaccaccacaacaactcccactcccacggctatcaccactactactacggtgacccccactccaacacccaccggcacacagacacccaccaccacaccaatcaccactaccacgacagtgactccaacgcccacacctaccggaacacaatctccaacccccacagctattacaacaaccaccaccgtaactccgactcctactcccactgggacgcagactcctacctccacccccattaccacaaccactaccgtcacccctacccccacacccacggggacacagactccaacaccaacgcccatctcaacgaccacaaccgttacccccacacccaccccaacgggcacacagaccccaacgacgactcccatcaccacaacaactactgtcactcccaccccgacccctacaggtacacagacacccaccactacaccgaccccgacttccaccaaatctaccacggtcacaccaattaccaccactaccaccgttactgccacacccaccccaacaggaactcaaacgcctacaatgatccctatctctacaaccaccactgtgactccgtag

SEQ ID NO: 124925 - DNA, 1230 bp, Artificial Sequence
  Description of Artificial Sequence: Synthetic coding sequence
gacatcgagtgcaggagtgtgaaggacccccatctgtcactggagcaattgggacaaaaagtgcaatgtgatgtctctgttggtttcatttgtaaaaatgaggaccagtttgggaacggaccttttggactgtgctacgactataagattcgagtgaattgttgctgcacccctactcgcggtaccactacagggtccagctccgcacctaccccctccacggtacagactacaacgacctccgcgtggacccccactccgactcctctgtctactccatcaataattcgtacaactgggttgcggccttacccgtctagtgtgttgatttgctgtgttctcaacgacacctactacgcacccggagaggaagtctataacgggacttatggggatacttgttatttcgtgaattgtagcctctcttgcaccctggagttctacaactggtcttgcccctctaccccttctcccactccaaccccttcaaagtcaacacctacgcctagtaaaccttcctcaacaccctctaaacctacccctgggacaaaacctcccgagtgccctgacttcgacccccccagacaggagaatgaaacctggtggctgtgtgactgttttatggcaacgtgcaagtacaacaatacggtagaaatcgtaaaagtggagtgcgagcctcctcccatgcccacgtgctctaatggcttacagcctgtgagagtggaggacccggatgggtgttgctggcattgggagtgcgattgttattgcaccggctggggagatcctcactacgtaacattcgacggcctgtattattcatatcagggaaattgcacctacgtgttggttgaggagatctccccttcagtggataactttggcgtgtacattgacaattatcattgtgacccaaacgacaaggtttcctgtcccaggacccttatcgtgagacacgaaacacaggaggtgcttattaaaaccgttcacatgatgcctatgcaggttcaggtgcaagtgaacaggcaggctgtcgctctcccatataagaagtatggcctggaggtttatcagagtggcataaactatgtggtggacattcctgagcttggcgtgttggtcagttataacggattaagttttagcgtaaggctaccctaccaccgattcggcaacaacacgaaagggcagtgtggaacctgcaccaacaccacaagcgacgattgttag

SEQ ID NO: 124926 - DNA, 8454 bp, Artificial Sequence
  Description of Artificial Sequence: Synthetic coding sequence
atgggccttcctctggccaggttggctgccgtgtgtcttgcactctcactggcagggggctccgagttacagacagagggcagaacccgcaatcacggccacaatgtctgctcgacatgggggaacttccactataaaacatttgatggggatgttttccgctttcctggtctgtgtgactacaattttgcctctgactgccgaggatcgtacaaagagttcgctgtgcacctgaaaagaggacctgggcaggccgaggcccctgccggagtggaatccattctgctcactattaaagatgatacgatatacctcacaaggcacctggccgtgttgaatggcgccgtggtttctactccacattacagcccagggctcttaatcgagaagtctgacgcctacacgaaagtgtatagccgcgctggcctgaccctcatgtggaaccgggaggacgccctcatgctggaactcgataccaagtttcggaatcatacctgtgggttgtgtggcgactataatggtttgcagagctacagtgagtttctgtcggacggtgtgctgtttagccccctagaatttgggaatatgcagaagatcaaccagcccgacgtggtgtgcgaagaccctgaagaggaagtggcgccagcctcctgcagcgagcatagggctgagtgtgaaaggttgctcactgccgaagcattcgccgattgtcaggacttggttcccctggagccttatctgagagcttgccagcaagatagatgcagatgtcccgggggggacacctgtgtgtgcagcacggttgctgaattcagccgccagtgtagtcacgcaggaggcagacctggcaactggcgcactgcaactctgtgtcccaagacatgtccaggcaatttagtgtacctggaatccggttcaccttgcatggacacttgcagtcatctggaagtatctagcttatgcgaagagcatcgcatggatggctgcttttgtcctgaaggcacagtctacgacgatatcggtgattctggttgcgttcccgtttcgcagtgtcattgcaggctgcacggccatctgtatactcctggacaggaaataaccaatgactgcgagcagtgcgtttgtaatgcaggtcgttgggtgtgtaaggatctcccttgtccgggtacatgtgctttggaaggtgggagccacattactacattcgacggtaagacgtacacgtttcacggcgactgttattacgttctggccaaaggagatcataatgattcttacgcgcttctgggcgaattggctccctgcggatctaccgacaagcaaacgtgccttaagaccgtagtgctgctggctgataagaagaagaacgtcgtggtatttaagtctgatggctctgttctgctaaacgagctccaggtaaacctgcctcatgtaacagcttctttctccgtcttccggccatcctcctatcatatcatggtgtccatggcaataggggttagactgcaagttcagctggccccagtgatgcagctgttcgttaccctcgaccaagcctcccaggggcaggtgcaaggcctttgtggcaattttaatggcttggagggggacgacttcaagacagcttccggcctcgtggaggctaccggcgcagggtttgccaatacgtggaaagcacagtcttcctgccacgacaaactggactggctggatgatccctgttccctcaatattgaaagcgcgaactatgccgagcactggtgcagcttgctcaaaaagacagagactcctttcggcagatgccattccgccgtcgaccctgccgagtattacaagcgctgtaaatatgacacttgcaattgccaaaataacgaagactgcctctgcgccgctctgagctcctatgctagggcctgcaccgccaagggggtaatgctctggggctggagggaacacgtctgcaacaaagatgtcggctcgtgcccaaattctcaggtgttcctgtataatctgactacgtgtcaacagacttgccgaagtctaagtgaggcagactcccattgcctggagggtttcgcccccgtggacgggtgtggctgtcccgaccatacgttcctggacgagaagggacggtgcgtcccgctcgccaaatgttcatgttatcacagaggtctgtatctcgaggctggggatgtcgtcgtgagacaggaggaaaggtgcgtttgtagagatggccggcttcactgccgtcagattcggctcatcggccaaagctgtaccgcccctaagatccacatggactgtagcaatctgacagcactggcgacatcgaaaccccgcgctctatcttgtcagactttggctgcaggatactatcacaccgagtgcgtgagtggttgtgtgtgccccgatggtctgatggatgatgggcgcggcgggtgtgtcgtggaaaaggaatgtccatgcgtacacaataacgacctatacagctcaggggccaagatcaaagtcgattgcaatacctgtacttgcaaacgggggaggtgggtatgcacacaggccgtttgccacggcacatgctccatttacggtagtggacactacattacatttgatggcaaatattacgacttcgacggccattgctcatatgtcgcagtgcaggactactgtggccaaaattcttcactgggcagcttttcgattataacagagaacgtgccttgcggaactacaggagtgacatgcagtaaggcaattaaaatatttatgggaagaacagagctgaagctggaggataagcaccgagtggtgatccaacgggatgagggacaccatgttgcttatacgacacgagaggtgggccagtacctcgtggtcgaatcaagtacaggaatcatagtcatttgggataagaggaccaccgtgtttattaaactcgcaccctcttataaaggaactgtttgcggactgtgtggcaattttgatcataggtccaacaatgattttactactagagatcacatggtggtatcgtcagaactagacttcgggaattcatggaaggaggcccccacatgcccagacgtgagcacaaacccagaaccttgctctctgaacccacatcgtcggtcttgggccgaaaagcaatgctcgatactgaaatctagtgtattttccatttgtcacagcaaggtagaccccaaaccgttctacgaggcctgcgtgcacgattcatgctcgtgcgacacaggcggagactgtgaatgtttttgtagcgcggtggcctcatacgcacaggaatgcacaaaagaaggcgcatgtgtcttttggaggacgcctgatctctgtcctattttttgtgattactacaatccaccacacgagtgcgagtggcattatgaaccttgcgggaaccgcagctttgagacatgtaggacaattaatggtatccatagcaatatttccgtcagttatctggaaggttgctacccaaggtgtcccaaagataggcccatctacgaagaagacctgaaaaaatgcgtgactgccgacaagtgtggatgttatgtagaggatacacactacccacccggggcaagtgtgcctactgaggagacatgtaagtcctgtgtctgcaccaatagctcacaggtggtctgtcgacccgaagaaggaaagattctgaaccagacacaggacggcgctttttgttactgggaaatttgtggcccaaatgggactgttgagaagcactttaacatttgcagcatcacaacccgcccatctacactcactacattcacaaccattacacttcctaccacacctacaacattcaccaccacaacaactacaactacccccactagcagtaccgtcctgtccacaaccccaaagctctgttgcctatggagtgactggatcaacgaagatcatccatcaagcggaagcgacgacggtgaccgtgaaacgttcgacggggtctgcggagcccctgaggacattgagtgccgcagcgtaaaggatcctcacctaagcctggaacagctggggcagaaggtccagtgcgacgtttctgtgggattcatctgcaagaatgaggatcagtttggcaacggccccttcggcctgtgctacgattacaagatccgcgtgaattgttgctggcccatggacaagtgcattactactccctcgccacctaccaccacgccaagccctcccccgacctctaccacaactctccctccgactacaacccctagtccccctaccacaacaaccacaactccccccccaacaacaaccccttcacctccaatcacaactaccacaacaccgccaccaacaacaactcctagcccccccataagtactacaaccacacctcctcctacaaccacaccctctccacctacaacaacaccatctccgccaaccactaccccctcaccaccaacgacaactactaccacaccgcccccaacaactacaccgtccccaccaactacaaccccaattacaccacctgccagtaccaccacactgccgccaactactacaccctccccaccaaccaccaccacaacgacacctccaccgacaacaacccccatcactacaaccactacagtgacgcccactcccactcccaccggtactcagactccaacaacgacgcctatcaccactaccacaacagtgactcctacaccaaccccgaccggcacccagacgccaactagtacgcctattacaaccacgaccaccgtcactccgacccccacccccaccgggactcagacccccactaccacacccataacaactaccactacggttacgcccacaccgactcctacaggcacccagactcctacccccactgcgatcacgacaaccactaccgttactccaacccctacccctaccggtacacagactcccactaccactcctatcacaacgactactacagtgaccccgacgcccacccctacaggtacacaatcaccgactcctaccgccatcacaacaaccacaaccgttactccaactcccactcctactgggacacagacaccgaccagtactccgatcacaacgaccacaacagttactccaacgcccacgccaaccggcacccagaccccaactcccacaccgatcagtacaaccacgaccgtgacgcctacaccaactcccacaggaacacaaactcccacgaccacccctatcacaaccaccacaaccgtaaccccaacaccaacccccaccggtactcagaccccgaccacggtactgatcaccacgacaactaccatgactccgaccccaacacccacctcaacaaagtccacgactgttactcccatcaccactacaaccactgttacggcaacaccaacgcccacgggcactcagactccgactatgatccctataagcacaaccactactgtgacccctacgcccacaccgactaccgggagcacgggaccccccacccacacctccacagctcctatcgccgagttaacgacctctaaccctccccctgagagctctaccccccagacctcccgcagcacatcaagtcctctaaccgaatctactactttactctcgactttgcctcctgctattgagatgaccagtacagcgccgccttccacacccaccgctccaactacaacctcgggtgggcatacgctctccccgcccccctccacaactacatctcctccagggacaccaacaaggggcaccaccacaggttcaagctccgcccctaccccaagcacagtccaaactacgacgactagcgcctggacccctacccctactcccctgtccaccccctccatcatccgtacaactgggttacggccctatccatcaagcgtattgatatgttgcgtactaaatgacacctactatgcgcccggcgaggaagtgtacaatggcacttacggtgacacctgttattttgttaactgtagcctgagctgcacgctcgagttctacaactggagttgtccctccacacccagccctacacctacacccagtaagagtacccctacgccttcaaagccaagctctaccccttccaagcctaccccaggtaccaaacctcccgaatgcccggacttcgatcctcctcggcaagagaacgaaacatggtggctgtgtgattgtttcatggccacatgcaagtacaataatactgttgaaatcgtcaaggtggaatgcgagcccccccccatgccaacgtgctctaatggtcttcaacctgttcgagtggaggaccccgacggatgctgctggcattgggagtgcgattgctactgtaccgggtggggtgacccacattacgtgacatttgatggcttgtattattcctatcagggcaattgtacttacgtgctggtagaggagatcagtccctcggtggacaacttcggagtgtatattgacaactaccactgtgatccaaacgacaaagtcagttgtccacggacccttattgtccgtcacgagacccaggaggtgctaatcaagactgtccacatgatgccgatgcaggtgcaggtccaggtgaaccgtcaagccgtggccttgccctacaagaagtacggcctcgaagtctaccagtcagggattaactacgtggtagatattccagagttgggagtcctcgtttcatacaacgggctgagcttctccgtgcggctgccatatcatcgcttcggaaataacacaaaggggcagtgcggcacatgtactaacaccacaagcgacgattgtatcctaccatcaggcgagatcgtgagcaactgtgaggccgcagccgatcaatggctagtaaatgaccctagcaagcctcattgccctcatagctcctctactaccaagcgtcctgccgtcactgtgcccgggggtggcaagacaactccccacaaagattgtactccctctccactgtgccaattgattaaggattctctcttcgcccagtgccatgccctggtgcccccacagcattactatgatgcgtgtgtgtttgactcttgcttcatgccagggtcctccctagagtgcgcaagtttgcaagcatatgccgccctctgtgcacagcaaaacatttgtctcgactggcgcaaccatacgcacggggcctgcctggttgagtgtccctcgcatcgtgagtaccaggcttgtggtcccgctgaagaacctacctgcaaatcatctagtagccagcagaataacactgttcttgtggaagggtgcttctgccctgaaggcaccatgaattatgcaccaggtttcgacgtgtgcgttaagacctgtgggtgcgtgggccctgacaatgtgcctcgggagttcggggagcacttcgagtttgattgcaagaattgtgtgtgtttggagggcgggtctgggataatctgccaacctaaacgctgctcccagaaacctgtgactcattgcgtggaggacggaacctacctggcaaccgaagttaaccccgccgacacctgttgcaacatcacagtgtgtaagtgtaacacaagtttgtgcaaggagaagccaagtgtttgtcccctgggatttgaggtaaagtcaaaaatggttccagggcgatgttgcccgttttattggtgcgaaagtaagggcgtgtgcgtccatggaaacgccgaataccaaccaggttctcctgtgtattcgagcaaatgccaggattgcgtttgtaccgacaaggtggacaacaataccctcctcaacgtgatcgcctgcacacacgttccatgcaacactagctgtagcccagggttcgaactgatggaggcccccggagagtgttgtaagaagtgtgagcagacacactgtatcattaaaagaccagataaccaacacgtgatactgaagccaggcgactttaaatcagatcccaaaaataattgtaccttcttttcatgtgtgaagatccacaaccaactgatatcttccgtttctaatatcacctgcccaaatttcgacgctagtatctgtattcctggctcaatcacatttatgcccaatggttgctgtaagacctgcactccccgaaatgagacccgcgtcccctgtagtacggttccagtcaccaccgaggtcagctatgccgggtgtacaaagaccgtgctgatgaaccattgctcgggtagctgcggcacctttgtgatgtatagcgctaaggcacaggcgctcgaccactcttgttcatgttgcaaagaagaaaaaactagccagcgagaagttgtcctttcctgccctaacggtggatctctaacgcatacctacacccatatcgagtcatgccaatgccaggatacagtttgcggcctcccaaccgggacttcacggagggcgcgtcgttccccccgacatcttggtagtggctag

SEQ ID NO: 124927 - DNA, 2631 bp, Artificial Sequence
  Description of Artificial Sequence: Synthetic coding sequence
atctattccactgtttctacatctactaccgctattaccagccatttcaccactagcgagacagctgttacccctactccagtgaccccaagctcactgagcactgatatcccaactaccagcctgagaacactgacacccagttctgtggggacgtccacgtccctgacaacaactaccgattttcctagcattcctaccgacatttccacccttcctacacgaacacacatcatttctagctcacctagcatccagtccaccgagactagctcgttggtggggacgaccagccccaccatgtctactgtgaggatgactttacggataacagagaacactccaatctcctcattttctaccagcatcgtggtgatcccagagacacccacgcagaccccccctgtcctgacgagtgcaacaggaacacagaccagccccgctccgacgactgtgacctttgggagcaccgacagctcaacgagcacgttacacactctgacccctagcacggcccttagcactattgtatcgacctctcaggtgcccatcccatctactcactctagcactcttcagactacccccagcacccccagcctccagacttcactcacttcgacaagcgagtttacaaccgaatccttcaccagggggtcgacttccaccaacgctatccttacgagcttttcaactatcatttggtcgagcacccccacaatcatcatgagcagctcgccctcttccgcatctatcaccccagttttcagcaccactattcacagtgtgcctagcagtccctatatctttagcacagagaatgtgggatctgcatctatcactgggttcccatccctgagcagctcagcgaccacgagtacctcgtccacttcatcctcactgacgactgcccttaccgaaattacccccttttcttacatatctctgccaagtaccacaccttgtcccggaaccattactatcaccattgtcccagcatctcctacggacccttgcgtggaaatggatccctcgaccgaggccacatccccacccaccactccacttactgtgtttccctttacgaccgagatggtgacatgccctacatccatttcaattcagacgacgctgacgacctacatggatacgtcttcaatgatgccagagagtgaaagttctatttcccctaatgctagtagcagtacaggaactgggaccgtgccaacgaatacagtattcacttcgacacggctgcccaccagcgaaacttggctgtcaaactcttcagttataccattgcccctgccgggtgtttccacaatacctctcaccatgaagccgagtagcagcttgcccactatactccgaacaagcagcaagagcacccatccctctcctccgaccacaaggacttccgagacccctgtggctactacccaaactcccactacattaacttcgaggcggacaactcggattacttctcaaatgacaacacaatcaacactcactactacagcaggcacctgtgacaacggagggacctgggagcagggacagtgcgcatgtctgccgggtttctctggcgatcggtgccagctccagaccaggtgccagaatggggggcagtgggatggcctaaaatgccaatgccccagcacattctatggctcatcatgtgaatttgcggtggaacaggtagatctggacgtggttgagacagaagtggggatggaagtctccgtggatcagcagttttctcctgacctaaacgacaatacgagccaggcttatcgggacttcaataaaactttttggaaccagatgcagaagatctttgctgacatgcaaggctttacctttaagggagtcgaaattctctctcttaggaatggctccatcgttgtggattacctggtgctcttggaaatgccattctcccctcagttagaatccgaatatgaacaggtgaagactactctgaaggagggcctgcaaaacgcaagccaggatgcgaactcttgtcaggactcacagactctctgctttaagcccgatagcatcaaagtgaataacaatagcaagacagaattaacaccggaagcgatctgtcgacgggctgccccaacaggatacgaggagttctactttcctctggtcgaggccacacgactaaggtgtgtcacaaaatgcacttcaggagtcgacaacgccatcgattgtcaccagggccagtgcgtgttagagacctcagggccagcttgtcgatgttactctacggatactcattggttctctgggccccggtgtgaggtggccgtgcactggagggcccttgtgggcggtctaaccgccggcgccgccctgttagtactgctgcttttagctctaggcgtcagagcggtcagaagtgggtggtggggaggccagcgtagaggacggtcgtgggatcaggatcgcaagtggtttgagacttgggacgaagaggtggtcggtacattcagcaattggggcttcgaggatgatggaactgacaaggacaccaatttccacgtggctttagaaaacgtcgataccacaatgaaggtgcacatcaagcgcccagaaatgaccagttccagtgtttag

SEQ ID NO: 124928 - DNA, 927 bp, Artificial Sequence
  Description of Artificial Sequence: Synthetic coding sequence
tgtgataacggcggcacttgggagcagggtcagtgtgcatgcctgcccgggtttagtggcgatcgttgccagctgcagacacgctgccagaatggagggcaatgggacggattgaaatgccagtgcccgtcaactttctatggatcctcctgcgaattcgccgtggagcaggtggacctcgacgtagtagaaacagaggtgggcatggaggtttccgtggatcaacagttctcccctgatttgaacgacaatacatcccaagcatatcgggactttaataaaacattttggaaccagatgcagaaaattttcgccgacatgcagggtttcacattcaaaggggtggagattttgagcctacgcaatggtagtattgttgtcgattaccttgtactcctggaaatgcctttttcaccgcagctggaatcggaatatgagcaggtgaagacaaccctgaaagagggtcttcaaaatgcctcacaggatgccaattcctgtcaggattctcagaccctgtgcttcaagccagattccatcaaagtgaataacaactctaaaaccgaacttacccctgaagctatttgtagacgagccgctcctaccggatacgaagaattctactttcctttagtcgaggccacaaggttgcgctgtgtgacgaagtgtaccagcggtgtggataatgctattgactgtcaccagggccaatgcgtcttagagacaagcgggcctgcatgccgcagctgggaccaagacaggaaatggttcgagacctgggatgaggaggtggtaggaacgttctcgaactgggggtttgaagacgatggcaccgacaaggatacaaacttccatgtggcactcgagaatgtggatacaactatgaaggtccacatcaagcgcccagaaatgaccagctcttcagtgtag

SEQ ID NO: 124929 - DNA, 3531 bp, Artificial Sequence
  Description of Artificial Sequence: Synthetic coding sequence
atgaaaggtgctcgttggcgaagagtgccctgggttagtctcagttgtctttgcctatgtctcctcccccatgtcgtaccgggcatgaccactccctccctgaagacggacgggggccggcggactgctacgagccctcctccgacaacctctcagactattatctccacaattccaagcactgctatgcataccaggtcaactgccgcgccgattcccatattaccggagcggggagtgagtctgtttccttatggggcaggcgcgggtgatctggaattcgtcaggcgtacagtagatttcactagccccttgttcaagcctgctacgggattccctctcggaagtagtttgcgcgactcactctattttacggacaatgggcagatcatctttcccgagagtgactatcaaatctttagttaccctaatccactccccaccggatttacaggaagagacccggtggctttagtggcacccttctgggatgacgctgatttcagtaccgggcggggaacaacgttttatcaggagtacgagactttctatggcgagcacagcctgctggtgcagcaggccgagtcctggattaggaagatgaccaacaatgggggttataaagccagatgggccctcaaagtgacctgggtgaacgcccacgcataccccgctcagtggacacttggctcgaatacctaccaggcgattttgagcaccgatggctcgagatcttatgcgctgtttctttaccagtccgggggcatgcagtgggatgtggctcaaaggtcaggcaacccggtgcttatgggattctctagtggcgatggatatttcgaaaatagcccattgatgtctcagccagtctgggaaaggtatagaccggatcgatttctaaacagcaatagtggcttacagggactgcagttttatcgtcttcatcgggaagagcggcctaactatcgtcttgaatgcctgcaatggttgaaatcccagcccaggtggccgagctggggctggaatcaggtgtcttgcccttgctcttggcaacagggtcggagagacttaagattccagccagtgagtataggcagatggggtctgggctctcgccagttatgcagctttacttcctggagagggggcgtttgttgcagctatggaccctggggagagtttagggagggctggcatgtgcagcgcccctggcaattggcccaagagctcgagccgcaatcctggtgttgccgatggaatgacaagccctacctgtgtgccctgtaccagcagagaaggcctcacgtggggtgcgctacatatcggcccccccaacctgcttggatgtttggagatcctcatatcacgactctggacggtgtgagttatacctttaacggtttgggcgattttctcctggtgggggcccaggatggaaattctagcttccttctccagggccgaaccgcacaaactgggtctgcccaggctactaattttatagcatttgccgcccagtaccggtcttcatccctgggtccagttaccgtccagtggctcctggagcctcacgatgctatccgtgtgcttctagacaatcagacggtaacattccagcccgaccacgaggatggcggcggccaggagacatttaacgctaccggcgtgctgctttcccgaaacgggtcggaggtctcggcttcatttgacggctgggcaaccgtgagtgtgatcgcactcagcaacattctccatgcgtcggcctcattaccacccgaataccagaacagaaccgagggacttcttggcgtgtggaacaacaacccggaggacgatttccgcatgccaaacggaagcactattcctcctgggagcccggaggagatgctcttccactttgggatgacatggcaaatcaacggtacaggtctcctcgggaaacggaatgaccaactcccttctaactttactcccgtgttctactcccagttgcaaaagaactcgagttgggctgaacacttgattagtaactgtgatggagactcaagctgtatttacgataccctggcacttaggaatgctagtatcggactccataccagggaggtgtctaagaattacgagcaggcaaatgctacactcaatcaataccccccatccattaatgggggcagggtcatcgaagcctacaaaggacagactactttgatccagtatacctccaatgcagaggacgccaacttcactttgagagatagttgtaccgatcttgagttgttcgagaacgggacactgctctggacacccaaaagtctagagccctttactcttgagatcctggcaagaagcgctaagatcggcctcgcttccgccttgcagccaagaactgtcgtttgccattgtaatgccgagtctcagtgcctgtataaccaaacctctagagtaggcaatagttctctcgaagtcgcaggctgtaagtgtgatggaggaacatttggtcggtactgcgagggttccgaggatgcctgcgaggaaccatgctttccttcggtacattgtgtgcctgggaaagggtgcgaagcgtgtcccccaaatctgaccggcgacggccgacattgtgctgcactgggttctagcttcctgtgtcagaatcaatcttgcccggtgaattattgttataaccaaggacactgttatatcagccagactctcggctgtcaacccatgtgtacatgtccgcccgccttcacggatagtagatgcttcctcgccgggaataacttcagccctaccgtgaacctggagttgccactgagggtgatccagttacttctgtctgaggaggagaatgcttccatggcggaggtcaatgctagcgtggcatacaggctggggaccctggatatgcgggctttcttgcgcaatagccaagtagaacgaattgattctgctgcccccgcaagcggtagccccattcagcactggatggtgatcagcgaatttcagtaccgcccacgaggccctgttatagacttccttaacaatcaacttctggcagccgtggtggaggcatttctgtaccacgtgcctagacgcagcgaagagccaaggaatgatgtggtgttccagcccatcagcggagaggatgttcgggatgtgacagcccttaatgtgtcaactctgaaagcttatttccgctgcgacggttataagggttatgatctggtgtattccccccaatccggcttcacctgcgtgtccccctgcagccgaggttactgtgaccatggtggccagtgccagcacctcccttccgggccccggtgtagctgcgttagttttagtatctacacagcttggggggagcactgcgagcacttgtctatgaagctggacgcctttttcggcatcttcttcggggccctgggtgggcttctgctgcttggcgtcggaacatttgtggttttgcgcttctggggctgcagcggggcgcgcttttcctacttcctgaattccgcagaggcacttccctag

SEQ ID NO: 124930 - DNA, 3378 bp, Artificial Sequence
  Description of Artificial Sequence: Synthetic coding sequence
atgaaaggcgcacggtggcggcgcgttccatgggtgagtctgagttgtttgtgtctgtgtctgttaccgcacgtggtgcccggagtcagtctgttcccatacggcgccggcgccggagacctggaattcgtgaggaggacagtcgacttcacatccccattattcaagccggcgaccggtttccccctgggctccagtctccgggattctctgtatttcacagacaacggacagatcatttttcctgaatcagactatcagatcttctcatatcccaatcccctgcctacaggctttacgggccgagatccggttgccctggttgcaccgttctgggatgacgctgatttcagtactggcagggggacaacattttaccaggagtacgaaacattttatggcgagcacagcctcctcgttcagcaggccgagagttggattcggaagatgaccaacaacggcggttacaaggcccggtgggcgctaaaagtaacatgggtgaatgcacacgcctaccccgcccagtggacgctcggatctaacacgtatcaggccattctgtctaccgacggttctcgaagttacgcgttattcttatatcagagtggtggcatgcaatgggacgtggctcaacgctctgggaaccctgtgctcatgggtttctcaagtggcgatggttactttgaaaactctcctttgatgtctcaaccggtgtgggagagataccggcccgatcgcttcctaaactcaaacagcggactgcaagggctgcagttttaccggctgcaccgtgaggagcggcccaactaccggctcgagtgcctgcagtggcttaaatctcaacctcgttggccatcttggggctggaatcaagtatcctgtccctgcagttggcagcagggccgccgcgacctacggtttcagcccgtgtcaattggtcgatggggacttggttcgcgccagctgtgctctttcaccagctggagggggggggtatgttgtagctacgggccctggggcgagtttcgcgagggctggcacgtccaaaggccgtggcaactcgcccaggaactcgaacctcaatcctggtgttgcaggtggaatgacaaaccctacctgtgcgcgctgtaccagcagcgccgccctcatgttggctgcgccacctacaggcccccgcaaccagcttggatgttcggggaccctcatatcaccaccctggacggcgtgtcatataccttcaatggcctaggcgacttcttgcttgtaggagctcaggacgggaatagctcctttctgctgcaggggcgcacagctcagaccggctctgctcaggctacaaactttattgcttttgcagcccagtaccggtctagctcactcgggcccgtgacggtgcagtggctactcgagcctcatgatgccatcagagtacttctggacaaccagacagtaaccttccaacccgatcatgaagacgggggaggtcaggagacgttcaatgccaccggagtgctactatcccgcaatggctcggaagtgtctgcgagcttcgacggctgggctaccgtgtccgttatcgctctctctaatattcttcatgcctcagcctcgcttccccccgaataccagaacaggaccgaggggctcctaggagtttggaataacaatccagaagatgactttcgcatgccgaacggttcaactataccccctgggtctccagaggagatgctatttcacttcgggatgacatggcaaataaatggaaccggcctgctaggtaaacgaaatgatcaactcccgtctaattttacccccgtgttctacagtcaactgcaaaagaacagctcctgggccgagcacctgatctccaattgcgatggggactccagctgcatctatgataccttagccttgaggaacgcaagcattggcctgcacacacgagaagtgagcaagaactacgaacaggctaacgcgactctaaaccaatatcctcccagcattaatgggggccgggtgatcgaggcttacaaagggcagacaactctgattcaatacacgtctaacgcggaggacgccaacttcacattgagggactcttgcaccgatctcgagctgttcgagaacggaactctgctctggacccctaagagtctggaaccatttaccctggagatactcgctcgcagcgcaaagatcgggttggcatcagcactgcaacctcggacggtcgtctgccactgcaacgctgaatctcaatgtctgtataatcagactagtcgagttggaaactcatccctggaggtagccgggtgcaagtgcgatggcggtaccttcggtcgctattgtgaaggatctgaagatgcatgcgaagagccatgctttcccagcgttcattgtgtgcccgggaaggggtgcgaggcctgtccccctaacctgacaggagacggacgacattgtgctgcattaggaagctcattcctttgccagaatcaatcgtgtcctgtgaactattgctataatcagggacactgttatatctcacagacactcggctgtcagcccatgtgtacatgtccccccgcatttacagactccagatgttttctcgctgggaacaattttagtcctacagtgaatctggagcttcctctgagggttattcaactgttgctttccgaggaagaaaatgccagtatggcggaagtaaacgcttcagtggcttaccggctcggcaccctggatatgcgagcctttctccgaaattctcaggtggagcggatcgattctgcagctcctgccagcggaagtcctatccagcactggatggtgattagcgagttccagtataggccaagggggcctgtgattgactttctcaataaccagcttcttgctgcagtggttgaagcgtttctctaccatgtgccgcgacgaagcgaggaaccccggaatgacgtcgtttttcagcccatcagtggcgaggatgtgagggacgttactgccctgaacgtgtccactcttaaagcttatttccgttgcgacggctacaagggatacgatctggtctactcacctcagtctggtttcacgtgcgtgtccccttgctccaggggctactgcgaccacggtgggcaatgccaacacttgccctctggccctcgatgctcttgtgtaagtttttcaatctacacagcctggggcgagcactgcgaacatctcagcatgaaattggatgcgttcttcggaatcttctttggcgcactgggagggttgctccttctgggagtgggcacatttgtggtgctgaggttctggggatgctcgggtgcgagattcagctacttcctgaattcagctgaggccttaccatag

SEQ ID NO: 124931 - DNA, 5739 bp, Artificial Sequence
  Description of Artificial Sequence: Synthetic coding sequence
cctgggaccacagaggacaccctgatcaccggaagcaaaaccgcagccccggtgacctccactgggagcaccacagccactctggagggccaaagcacagccgcctcaagtcgaactagtaatcaagacatctctgcaagctcacagaatcatcagactaagagtacagaaaccacatctaaagcacagacagacaccctcactcagatgatgacgagcacgctgttctccagcccatctgttcacaatgtgatggagaccgctcctcctgacgaaatgaccacctcctttcccagttccgttaccaataccctgatgatgacgtccaagacgatcactatgactacctctaccgatagtacgctgggtaataccgaggagacctctaccgctggcaccgaaagtagtactccggtgactagcgccgtgtctattaccgccggacaggaggggcagtcacgcactacttcctggagaacttcaattcaggacacgtctgcctcctcgcagaatcactggacaaggtctacgcagacgacccgggaatctcaaacaagcaccctgacccaccgaaccacatctactcctagctttagcccttccgttcataatgtaacagggacagtgagtcagaagacgtccccctctggggagaccgccacttccagcctgtgcagcgttacaaacacatcaatgatgacttcagagaagattacagtcacaacctctactggttcgacactgggtaatcccggagagactagctctgtacccgtcacagggtccctcatgcctgtgacctccgccgcactcgtaaccttcgacccggaaggacagtcaccagctaccttctccagaactagcacacaggataccacagccttctctaaaaaccaccagactcagagcgtggagaccactagagtcagtcagattaacaccctgaacacactcacacctgtcacaacgtctactgtcctgtcgtcaccgtcaggcttcaatccttctggtacagtctcccaggagacttttcccagcggcgagacgacaacatccagcccctcttctgtttcgaatacattcttagttacatccaaagtattccgcatgcctacgtcgagggacagtacactagggaataccgaggagaccagcctgagcgtgtctggtacaatctcagcgataacatccaaggttagtacaatctggtggtctgacacactttctaccgcactctcgccctcatcccttccaccgaagattagtaccgcatttcacacccagcagagcgaaggtgctgaaaccaccggccggccccatgaacgttcctctttttcccccggcgtcagccaggaaatatttacactgcacgagacaactacctggccaagttctttttcttctaagggccacacgacgtggagccagactgagcttccaagtacttctacaggagccgctactaggctggtgaccggcaacccttccacaggaacagctggaactattcctcgcgtgcctagtaaggtatccgcaataggtgaaccgggggaacccactacctatagctctcactcaaccactctcccaaaaaccaccggcgccggagcacagacccagtggacccaggaaacaggcactaccggcgaggctctgctgagctcccccagctactcggttacacaaatgattaaaaccgccacaagcccatcttcatcaccaatgttggacagacacacctctcagcaaattacaactgccccctcgaccaaccattccaccatccattctacttctacttccccccaggagagcccagccgtgagtcagcggggacacacacaggcgcctcagacaacacaggaaagccagacgacacgatctgtaagccccatgacagatactaagaccgtgacgacacctggctcctcatttaccgcatccggacattctccttctgagatcgtcccccaggatgcgccaactatttctgccgcaaccaccttcgctcccgctccgaccggtgatggtcacaccacacaagcccctactaccgctttacaagcggcaccaagtagtcacgacgcgaccctgggaccaagcggtggcactagcctgagcaaaaccggcgctctgacactagccaactccgtggtcagcacccccggtggccccgagggccagtggacttcagctagcgccagcactagtcctgatacggccgccgcaatgacgcatacacatcaagccgagtctaccgaggcaagcggccaaacacaaacatcggagccggcatcgtctgggagcaggactacttcagctggcacagctacgccaagctcctctggggcaagcggtacgacgcctagcggatcagagggaatctctaccagtggagaaaccacccgcttttcatctaacccctcacgcgatagccataccactcagtcaactaccgagcttctttctgccagtgcaagccatggcgctatcccggtctccactgggatggccagctcgatcgtgcctggaacctttcatccaacactgtcggaagcatctactgctggaagacccaccggtcaatcatctcctacatccccatccgcctcaccacaggagacagccgccatctccagaatggctcaaacccagaggaccagaacctcccggggttctgacaccattagcctcgcctctcaggccactgatacattctctacagtgccccccacaccacctagcatcacctctacaggattaacaagtccacagacagagacccacactctgagcccatcaggaagcggaaagaccttcacaacggctctgattagcaacgcaactccactccctgtgacctacgcatccagcgcctccaccggacacgcaactccactggctgtgagcagcgccaccagcgccagcaccgtgagcagcgatagcccccttaagatggagacgcccggaatgaccactccttctctcaaaacagacggtgggcggagaactgcaacctctccacctccaaccacgagccagacaattattagcaccatacccagtaccgcaatgcatacgaggtctactgcggccccaatcccaatcctgcccgaacgcggggtctcccttttcccatacggcgccggggcgggagatctcgaatttgtgcgccggactgtggattttactagccctttgttcaaaccagcaaccggttttcccctcgggtctagcctgcgggactcactttattttaccgataacggccagataatcttcccggagagcgattaccagatttttagctacccgaatcccctgcccactgggttcaccggtagggaccccgtcgcactggtggcccctttctgggacgatgctgatttcagtactggcagaggcaccacattctaccaagagtacgaaaccttctatggggaacacagtctgctcgttcagcaggctgagtcctggatcagaaaaatgacgaacaacggcggctacaaggccaggtgggctttaaaagtaacgtgggtgaatgcacatgcgtatcccgcacagtggacactggggagcaacacataccaggcaatcctatctacagatggcagtagaagctacgcactgtttctgtaccagagcggcggtatgcaatgggatgttgcccaacggagcggaaatccagtcctcatgggcttttccagtggagacggttatttcgaaaattctccactaatgtctcagcctgtgtgggagaggtacagaccagataggttcctgaattcaaattcaggtctacaaggcctgcagttttatagactgcatagagaagaaagacctaactacagattagagtgtctgcagtggctgaaatcccagcctcggtggccatcttggggctggaatcaggttagctgcccctgctcctggcaacagggccgcagagacctgagattccagcccgcaagcttgccacccgagtatcagaaccggaccgaaggcctgctgggggtgtggaacaataaccccgaggacgactttcgaatgccaaatgggtccaccattccgccgggctctcctgaggagatgctgttccattttggcatgacctggcagattaacggcaccgggctactgggcaagagaaacgaccagctgccgtcaaactttacccccgtcttttattctcagctccagaaaaacagctcctgggctgagcacttaataagtaactgtgatggtgactcctcatgtatttacgacacgctagctctgagaaacgcgtctatcggcctccatacccgagaggttagcaaaaattacgaacaggctaatgctacattgaaccagtacccacctagtataaacggcggacgggtgatagaagcctacaaagggcagaccaccctcattcaatacacctccaatgcagaggacgcaaacttcacacttcgagactcatgtacggatctggagctcttcgagaacgggaccctgctatggaccccgaagtcactggagccatttacactggagatactcgccaggagtgccaagattggccttgcttccgcactgcagccaaggactgtggtttgtcattgcaatgccgagagccagtgcctgtacaaccagaccagtcgagtcgggaattccagtctggaagtagccggctgcaaatgcgatggaggaacttttggcaggtactgcgagggctccgaagacgcctgcgaagaaccctgcttccctagcgtgcactgcgtgcccggtaagggctgtgaggcatgccccccaaacctgacaggcgatggacgacactgcgcagctcttggatcctcgtttctttgtcaaaatcagagctgccccgtcaactactgctacaatcagggacattgctatatctctcagaccctcggttgccagcctatgtgcacctgcccaccagcctttacagatagtagatgcttcttagctggaaacaatttttctcctaccgtgaatcttgaactgcccttaagagtcattcagttgctgctgtctgaggaagaaaacgccagcatggcagaggtgaacgctagcgtggcttacagattggggactctggatatgagggccttcctccgcaatagccaggtagagcgcattgactcggctgcccctgcatcagggtcccctatacaacactggatggtcattagcgagtttcagtataggccgaggggccctgtgatcgactttctaaacaatcaactgctcgctgcggttgtcgaggcctttctgtatcacgtgcctcggaggtccgaggaaccccgtaatgacgtagtcttccagcctatatctggtgaagacgtccgggatgtaaccgccttgaacgttagcactctgaaggcctactttcgatgcgatggctataagggctatgacctggtctacagcccgcagtctgggtttacttgtgtgtctccttgttcgagggggtactgcgaccacggggggcaatgtcagcatctgcccagtgggccgagatgttcttgtgtgagtttttcaatctatactgcctggggggagcattgtgagcatttgtctatgaagttagacgccttctttggcattttctttggggccctgggtggcctgttactgctcggggtggggacatttgtggtcctgcgcttctggggatgctccggagcccgcttttcttattttctgaatagcgctgaggccttgccttag

SEQ ID NO: 124932 - DNA, 16239 bp, Artificial Sequence
  Description of Artificial Sequence: Synthetic coding sequence
atgaagggcgcccgctggaggagggtcccttgggtctccctgtcctgcctttgcctgtgcctgctccctcatgtagtccccggaaccacggaggacacactgatcaccgggtcgaaaaccgctgccccagttacttcgacaggatccaccacggccaccctggagggtcagtcaactgcagccagttccagaacctccaatcaggatatctctgccagctcgcagaatcatcagacgaagagcacagaaactacatcaaaggctcaaacagacaccctgacccaaatgatgaccagcacactattcagctcccctagtgtccacaatgtaatggagacagcccctcccgatgaaatgacaacctcattccccagcagcgtcaccaatactctgatgatgacctctaagactatcacgatgacgacatctacagactctaccctcggaaacactgaagaaacctctaccgccgggaccgagtcttcaactcccgtgacatctgccgtgtctattacggccggccaggaggggcagtcaagaactacttcatggcgaaccagcatccaggatactagtgcatcctcacagaatcactggacaagatccactcagaccacgcgtgaaagccagacaagcactttgactcaccggaccacatccacaccttctttttctccctccgtgcacaacgtgacaggaaccgtcagtcagaaaactagtccatcaggagagacagctacctcatccttgtgctccgtgaccaacacttctatgatgacctcagagaaaatcaccgtgaccacttctaccgggagcacgcttggaaatcccggggagacatcatccgtccccgttacaggctcactgatgcctgtgacctcggcggctcttgtaacgtttgatccagaggggcagagcccagccacattctcaaggaccagcacccaggacaccactgcgttctccaagaaccaccaaactcagagtgtggagacaacgagggtgtcacagataaataccttaaacacactgacacccgtcactactagcaccgtcttaagcagtccttctggcttcaatccatctggaacggtgagccaggagacgttccccagcggcgagactactacctctagtccatcatccgtgtccaatacttttcttgtgactagcaaagtctttcggatgcccacatcgcgggatagtaccttggggaacactgaggagacctccctctccgtctccggcacaatctcggcaattactagtaaggtgtccaccatttggtggtcggatacactctcaacagctctaagccccagttctctacctcctaagatttcaaccgctttccatactcagcagagcgagggagccgaaactaccggtcgccctcacgaacgttctagtttctcccccggcgtgtcccaggaaatctttactctacacgagaccactacatggccatcttcattcagttccaagggacatacaacctggtcgcagactgagttgccttctacgagcacgggagccgccacacggctcgtgactggtaatcctagcacaggaacagctggcacaatccccagggtgccctcaaaggtctccgccataggcgaacccggagagcccaccacctattctagtcactctactacgcttccaaaaaccacaggtgcaggggcacagacacaatggacacaggagaccgggacaaccggggaggcactcctgtcgtctccgagctactcggtaacgcagatgattaaaacggccaccagcccctcatcctcacccatgttggaccgccatacctcccaacagatcaccactgcgccaagtaccaaccactcaacaattcactcaacatctactagcccccaggaaagtcccgcagtgtcacagcgtggccatacacaggctcctcagactactcaagagagccaaacaactagatctgtctctcctatgaccgacaccaagacggtgaccacaccaggttcttccttcacggcctcaggccattctccttccgagatcgtcccccaggacgcccctactatctctgcggcgaccactttcgcccctgcccccacgggggacggccataccacgcaggcccctacgactgcgctgcaggccgccccttcttcacatgatgcgaccttgggtccatcagggggcacctcacttagcaaaaccggagccctaacgctcgccaacagtgtggtatcgactccaggcggccccgagggtcagtggaccagcgcatcagcgtctacctctccagacacggctgcagcaatgacccatacccatcaggctgagtccaccgaagctagtggacagacacagacaagcgaaccagccagtagcggatcgagaacgacctctgcaggtaccgccacacctagctcctctggagcaagcggtacaaccccaagtggcagtgagggcatttccacatctggtgaaaccactcgtttcagtagcaaccccagcagagacagccatactactcagagtacaaccgaactactatctgctagtgcaagtcacggggccatccctgtctccaccggcatggccagtagcatcgtgcccggcacttttcacccaacactgtcagaagccagcacggcgggccgccctaccggccagtcaagtccaacttcaccatcagcaagcccacaggaaaccgctgcaatctccaggatggcccaaactcagagaacaaggactagccggggatccgacaccatctccctcgcctcacaagccacagataccttcagcaccgtacccccaacacccccgtcgattacatctacggggctgacatctccacagacggagacacacactttgtctccctctggcagcggcaagacattcactacagccctcatctccaacgccacacccctccccgtgacctatgcttcgagtgcttccacaggtcacacaacccctttgcacgtcacagatgcatcgtcagtttctactggacacgctactcccttaccagtgacatcaccctcctccgtgagcacaggccacaccacgccattgcctgtgactgatacctcctcagagagtacgggacatgtgacgcctctccctgttacctccttcagcagtgcctcaacaggtgattccaccccactacctgtgacagacacgtcgtctgcatccaccggacatgtaaccccgttgccagtgaccagcctgtcctccgcgtcaacgggagatacgacaccattgccagtgaccgacacctctagcgcgagcaccggccatgccacgtccttacctgtgactgacacctcctccgtctccactgggcacaccacccccctgcccgtcacagatacgtcctcagcctccactggacatgccacctctctgcccgtgaccgatacttcttcagtgagcactggacatactacgccgctgcatgtgactgatgcttcttctgcttcaaccggtcaggccacccctctgcccgtcacttcattgtctagcgtctcaactggtgataccaccccactcccggttacttcgccttcctcagctagcaccggccacgccacaccattgcttgtgaccgatacatcctccgcctccacgggacacgctactccgctccctgtgactgatgcctcttccgttagcacggatcatgctaccagcctgcctgttaccatccctagtgccgccagtacgggccacactacccccctcccagtcacggacacatcgtcggcgtcaacaggccaggcaacaagcttacttgtaactgacaccagctcagtgtccacaggcgatacgacccccctccctgttacatcaacttcctccgccagtactggccatgtgacacccctccacgtgaccagcccctcttccgcatccactggacatgctacgcccctccccgtcacttcactgtcgtccgccagtacaggcgacaccatgccactgccagtgacttcaccatcctccgctagcactggagataccacaccgctccccgttactgatgcctcaagtgtttccaccggacataccacgcccctgcacgtcactgacgcatccagcgcttcaacaggccaggccacgcccctacctgtaacctccctgtcatcagtgtcgacgggagacacgacccccttaccggtcaccagcccttccagcgctagtaccggacatgcaaccccactcttggtgacggacacttctagtgcgagtaccggacacgccacgccgctgcccgtcaccgacgcaagttcagtaagcaccgaccacgctaccagcttgcccgtgacaattccatctgcggctagcacagggcacacgactccactccctgtcaccgacacctcctctgcctcgacaggccaggccacatccctgctggtgactgatacctctagcgtgtccaccggcgatactaccccgctgccagtgacctccacatcttctgcttcaacggggcacgtaacacctctccacgttacgtccccgtctagcgcgtccacaggacacgccactcccctcccagtcacctccctgagttctgcctctactggcgataccatgcccctgcccgtcacatctccgtcttccgcctctacaggggatacaaccccgttgccagtcaccgacgccagttcagtgtcgaccgggcatacaacacccctccccgttacaagcccttcaagcgccagtaccggacacaccacaccactgcctgtaacggatacgagctcagcctctaaaggggacactacacctctccccgtcacctctccatcctcagctagtactggtcacacgacgccactcccagttaccgacactagttctgcatccacaggcgacaccacccctctccctgttactaacgcatcatccttaagcactggacacgccaccccactccatgttacatctcccagctctgccagcaccgggcacgcgacaccacttccagtgactagcacaagttcggcatctacaggccacgctaccccacttcctgtgactggccttagtagcgccacgacagatgacacgacccgattgccagtcacagacgtaagtagcgcctccactgggcaggccacccctctgcccgttacatccctgtcctccgtttcaactggagatacaactccactgcctgtgaccagtcctagctccgctagcaccggccacgcaagccccttactggttacagacgcttcatccgcctcgactggccaggctactcccctacccgtgacagatacatcctctgtgagcacggctcacgccaccccattgcctgtgacggggctctctagtgccagcactgatgataccactagactgccagttaccgacgtctcttcagcatctaccggccaggccattcctctaccggtcacctccccctcatcagctagcaccggggacaccacaccccttccggtgactgacgcctcttctgctagcaccggagacactacctcattgccagtgaccattccatcatccgcttccagcgggcacaccaccagtttgccagttaccgacgccagctctgtcagtacagggcatgccacttcactgctcgttactgacgcctcatcagtttccacgggcgacactacccccctgccagttacagacaccaattctgccagcacaggggacaccaccccgctgcacgtgaccgatgcctcttctgtgtccacgggccacgctacctctctccccgtgacaagtctgtctagtgcgagcaccggagacaccactcctctgcccgtgacatcccctagcagcgcttcaagcggacataccaccccactgccagtcacagacgcgtcgagtgtaccaactgggcatgccacatccctacctgttactgatgcctcttcggtctccaccgggcatgccaccccactcccagtcaccgatgcaagtagcgtttccacaggtcatgccactcccttgcctgtcactgacacaagcagcgtctctaccggtcaggccacaccgctcccagttacatcactgagctccgcctccacaggcgatacaactccacttcctgtaactgacacttctagcgcctccactggccaggatacacccctgccagtgacatccctgagtagtgtctcaactggcgatactacacccctgcccgtcaccaaccccagctcggcatcgacggggcacgcaacacccctattagtgacagacgcatccagcatcagtaccggccacgcaaccagcttgctagtaactgatgcctcctccgttagtactggccatgccactgcgcttcatgacactgatgcttcgtctctgtccacgggagataccactcctctgccagttacctctcctagcagcacctcaacaggcgacactacgccattgccagtaaccgaaaccagtagcgtaagcaccggacatgctaccagcctccctgtgaccgatactagcagtgctagtaccgggcacgccactagcctccctgtgacagatacgagctccgcgagcaccggacatgctacccctctccctgttactgatacctcctccgcttcgacgggccaggccacgccactccccgtgacaagtcctagctctgcctctacaggccatgccatacccctgctggtgaccgacacatcctccgcttctacagggcaggccacaccacttcctgtcacaagtttgagctctgcatctaccggagacactacccccctgccggtaactgatgcctccagcgtgagcaccggccacgcaacgtccctacctgtgacctcactgtccagcgtttctactggtgacaccaccccacttcctgtgacaagccctagctctgcctccaccggacatgccactcccttacatgttacagatgcctcctccgcctccaccgggcatgcaactcctctgcccgtgaccagcttatccagcgcatccacaggcgataccacccccctcccggtgacatcaccctcatctgcaagcaccggacacgccacaccactgcatgtcaccgacgcctcctcagtgtctacgggcgataccacccccctgcccgtgacctctagctcctcggcaagctcaggccataccacgccactgccagtgactgatgcgtcaagcgcgagtaccggcgacaccacccccctccctgtcacagacacatcctctgccagtaccggtcatgcgacacacttgccagttaccggactgagttctgcctcgactggagacacaactcgcctcccagtgacgaacgtgtcatctgcaagcaccgggcatgcaactccccttcctgttacgagcaccagctctgcttccacaggagatactacacccttacccggaactgatacatcttcggtcagtaccggccacacaacccccctgcttgttaccgacgcaagctccgtttcaactggagatacaacccgactacccgttacgtctccctcctctgcttccacggggcacaccactcctctgcctgtcacagacactccctcagcttctacaggcgacacaacccccctgcctgtgactaacgccagctcactttcaactcggcacgcaacgtccttacacgtgactagtcctagttctgcatcaacaggccatgccacgtcactgcctgtaaccgatacttccgctgcaagtactggacatgccactcccctgcccgtcactagcacatcatcggcaagtactggagacactaccccgcttcccgtgacagacacctactcggcctctaccggccaggccacccctcttcccgtgaccagtctgagctctgttagcaccggagataccacaccactgccagttacttccccatcaagtgcctccacagggcacgcaacccccctgctggttacagacgcttccagcgcctcaacagggcaggctacccctttaccggttacatctctttccagtgttagcactggcgataccacccccttacctgttacttcaccctcgagcgcttctacagggcacgctacaagtctgcctgttaccgatacatcctccgcctctactggcgacactacatcactccccgtgacggacacaagcagcgcgtacactggggatactacaagtctcccagtgaccgatacttcttctagcagtaccggtgacactacaccattactagtaacagaaacgagttccgtgtccacaggcgacaccaccccattgccagtgacagacacgtcaagtgcctccactggtcacgctacacccttaccagtcaccaacacatcatctgtatcaactgggcacgccacacccttgcatgtcacgagcccaagcagtgcatctacaggacatacaacacctctgccagtgacggacgcttcaagcgtgtccactggccatgccactagcttaccggtgacagacgcatcgtcagtctttacaggacatgcaactagcttacctgtgactattccttccagcgctagctccggacatacgacccccctccccgtaaccgacgcaagctccgtcagcactgggcacgctacatccctgccagtgacagatgcttcaagtgtaagcaccgggcatgctacccccttgccggtgaccgacgcctcatctgtctctaccggccacgcgaccccgcttcctctaacatcactctcctctgtctccaccggagacaccacacccctgcctgtcaccgatacatcaagtgcttccacaggacaagcaactccgctccctgtgacctctctctcgtccgtaagcactggtgacactacccctctcccggtaacagacacatcctctgcttccaccgggcacgctaccagcttgcccgtgacagatacatccagcgcctctacagggcacgctactccactgcccgacacagacacaagctcagctagcaccggccatgcaacgctgttgcctgtgacagatacgtcatccgctagcattggccacgctactagtctccccgtcaccgatacctccagcataagcacaggccatgcaactccactccatgtgacgagcccttctagcgcaagcaccggacacgccacacctctgccagtgaccgacaccagctcagcctccactggccatgcaaaccctcttcacgtgaccagccccagcagtgccagtactgggcacgccacaccccttcctgtaacagatacttcctcagcctcgacggggcacgctactcctctgcccgtcacatctctctcaagcgtgagcacaggtgacacaaccccactacccgtaacttctccgtctagcgcttcaacgggacatacaactccactgcccgtgacagacactagtagtgcttccactggacaggcaacagcactgccagtgacctcaacctccagcgcgtctacaggggatacgacccctcttcctgtgaccgacacgtcatccgccagtaccggccaggcaacgcctctccctgtcaccagtctctcctccgtctccacaggagatacaaccccattgcctgtgacttctccctcctccgcctccaccggccatgcgactccattgttggtcaccgatgcatcctccgcctccacaggtcaggctacacccctcccagttacatctttatcctcggtgagcactggggatacaacacctctgccagtgacatcaccatcctccgccagcactgggcacgcaacaagtttgcctgtgacggatacatccagcgccagcactggcgataccacatcccttcctgtgaccgatacttcgagcgcctacactggcgacacgacatccctgccggtgacagacacatcatcttcttccacaggtgacacaacacccttgctggtcaccgagacctcctcagtgtcaacaggccatgccacccctcttttggtgaccgacgccagtagcgcctcgacgggtcatgccaccccactacacgtgactagccctagctctgccagtaccggggatacaactccagtaccggtgacagacaccagcagcgtgtccacagggcacgcgacccccctgcccgtgacagggctgtctagtgccagtacaggcgatacaacccgcctgccggtcactgacatctcctctgcatcaaccgggcaagctacgcccttgccagttactaatacaagctcagtgtccacgggggataccatgcctttacccgtgacttccccttccagcgcctcaactggtcatgcgactcctttacccgtgacttccacgagtagcgcttcaaccgggcatgcaacccccgttccagtgacatcaacatcgtcggccagcaccggccacactacacctctgcccgtgacagacacaagttccgcctccacaggagacacgaccccacttccagtgacaagtccctcctcagcctcaacagggcacacgaccccacttcacgtgacaattccgtcatcagcctccaccggggacacatcaaccctgccagtgaccggcgccagttccgcgtctacgggacatgcaactccactaccagtgactgacactagttccgtatctaccggacatgcaactcccctccctgtcacctcgttgtcctcagtgtcgacgggcgatactactccacttccagtaacagacgcttctagcgcatcaactggccaggccaccccattgcctgtgacaagcctgagcagcgtcagcacaggagacaccacccctctgctcgtgacagacgcctctagcgtcagtacaggacacgccacacccttacccgtgacagacaccagttccgcctcaactggcgataccacaagattgccagtgacagacacttcaagcgccagcacaggccaagcgacgccattgccggttacctccctgagcagcgttagcactggcgacacgactcctctgctcgtaacagacgcgagtagtgtgtccacgggccacgccaccccattacccgtgaccgataccagcagcgcaagcacaggcgatacaactcgactacccgtgaccgacacaagctccgcctctaccggccaggcaactccacttcctgttacaatccccagcagtagcagtagtggccatacaactcccctgcccgtgacgtctacgtccagcgtgtccaccggccatgtaacacccctgcacgtcacatctccaagcagtgcttctactggccatgttacccctctgccagtgacgtctaccagctcagcgtctacaggacatgcaacacccctcctcgtcaccgatgcttcttctgtcagtacaggtcacgctactccactgcctgttactgacgcctctagtgctagcaccggcgacactactccgctgcctgtgacagacacatccagtgccagcacaggtcaagctacccccctccctgtcacctctctgagtagcgtcagcaccggagacacaacacccctccctgttaccgacgccagctctgctagcacaggtcatgccacgcctctccccgtgacgattcctagctcagtctcaaccggagatacaatgccgctgccagtcacgagtccaagtagtgcatctactggtcatgccaccccgttaccggtgaccggcttatcctcggcctccacaggggacaccacaccacttcctgtcaccgatactagctccgcaagtacccgtcatgctacaccattacccgtgactgatacctcttcagccagtaccgatgacaccacccgattacctgtgactgacgtgtcttccgcgtcaactggccatgccacccctctgcctgttacatccacatcctcagcctctaccggggataccacacctttaccagtcaccgacaccagtagcgtcagtactggacacgctactagtctccctgtgacttcacgatctagcgcctcaacaggccatgctacacccctgccggtgacagacacaagttccgttagtacagggcatgccactcctctgcccgtgacctccacctctagcgtgtccaccggccatgccacccccttgccagtgacaagcccctcctccgccagcaccggacatgctacaccagtgccagtgacatccacaagttccgcaagcactggggacaccacaccattaccagtcactaatgccagttcactgagtacaggccatgccacacccctacatgtgacaagcccctcatctgcgtccagaggggacacctctactctccctgtgactgacgctagctccgcgtccacgggtcacgctactcccctgcctctgaccagcctgtcgagcgtatctaccggcgacactacgccattgcctgtgacagacacaagctctgcatctaccggccaggccacacccctgcctgtgaccagcctgtcttccgtgagtacaggcgataccacgcccctgccagtgacaattccctccagcgccagcagcggccataccacatcacttccagtaacggatgcctcctccgtcagcactggccatgggactcctcttcctgttacatcaactagcagtgcaagcaccggagataccacccccctgccagtgaccgatactagctcggcaagtacaggccacgccacacccctgcccgtcacagacactagttctgcttcgaccgggcacgctacccctcttccagtgacttcactgtcctctgtctccacaggccacgcgacaccactcgctgttagctcagccacatctgcatctaccgtgtccagcgattctccactgaagatggagaccccaggcatgactacaccctccctgaaaactgatggtggccgtagaacagctacatccccgcctcccactactagccaaactatcatatctacaattccctccactgctatgcacaccaggtccacagctgcacctattcccattctgccagagcgaggtgtgagcctctttccatatggggccggagcgggggatctcgagttcgttcgacgcaccgttgacttcacttcccccctgttcaagcccgcaactgggttccccctcggctctagtctacgtgactccctgtacttcaccgacaatggtcagataatttttcccgagagcgattaccagattttttcctacccaaaccccctccccacaggctttaccggcagagacccagtcgccctggtcgcgcccttctgggatgatgctgattttagtacaggccgaggcactactttctaccaggagtacgaaactttctacggggaacactccttacttgttcaacaggccgaatcttggatcaggaagatgacaaataatgggggatacaaggcacgttgggcattgaaggttacttgggtgaatgcccacgcatacccagcccagtggacattggggtccaatacctaccaagcgattctgtcaaccgacggcagccggtcttacgccttgttcttgtaccagagtggaggcatgcagtgggacgtggcccaaaggtccggaaaccccgtactgatggggttttcatccggcgacggttacttcgagaactccccattgatgagtcaacctgtgtgggaacggtacaggcctgatagatttcttaatagtaatagtggactgcaaggcctgcagttttaccggctgcaccgagaggaacgccctaattatcggctggagtgcctgcagtggctcaaatctcagccccggtggcccagttggggctggaaccaagtgtcctgcccttgttcttggcagcaggggagaagggacttgcgattccaacccgtgagtatcgggcgatggggtttaggtagcagacagctgtgcagtttcactagctggaggggcggagtgtgttgcagctacggtccatggggggagttcagagaaggatggcatgtccagcgcccctggcaactggcccaggagctcgagccccaaagctggtgttgtcgctggaacgataagccatatttatgcgctctgtaccagcagagacggccacacgtggggtgtgccacctatcgccctccccaacccgcctggatgtttggggaccctcacattacgacattagatggtgtctcctatacctttaatgggttaggcgactttcttctggtgggagctcaggacgggaattcttccttccttctgcaggggcgtactgcccagacggggagtgctcaggcgactaacttcatcgccttcgctgcacagtaccgttcctcatctctgggcccggtgaccgtgcagtggctcctggaaccccacgatgccattagggttctgctggataaccagaccgtgactttccaaccagatcacgaagacggtgggggtcaggagacatttaatgccacaggtgtccttctgagtcgaaacggcagcgaagtgtctgcttcatttgacgggtgggccactgtctctgttatagcgctgtctaacattctccacgcctccgcgagcctgcccccagaatatcagaacaggaccgaggggttactgggcgtttggaacaataaccccgaggatgactttaggatgccaaatggttcaaccattccaccgggatctccggaggaaatgttattccatttcggtatgacttggcagattaacggcacgggcctcctcggcaagaggaacgaccaattgcccagtaactttacacctgtgttttactcgcagctccagaaaaactcttcctgggccgaacatctcatttctaactgtgatggggattcaagttgcatctatgacaccctcgcactgcgcaatgctagcatcgggctgcacaccagggaagtgtctaaaaattacgaacaagcaaacgcgaccctcaaccaatacccaccatccatcaatgggggaagagttatcgaggcttataagggccagacgaccctgatccagtacactagcaacgcagaggacgcaaatttcaccctgcgtgatagctgcacagacctggagctgttcgaaaatgggacgctcctttggacacctaagagcctcgagccatttacactggaaatcttagcccgctctgctaagattggattagcttccgcactacagccccgaacagtggtgtgccattgtaacgccgagtcccagtgcttgtataatcagacgtcacgtgtggggaattccagtttagaagtagctgggtgcaagtgtgacggcgggacttttggcaggtactgcgaagggtctgaggacgcctgcgaggaaccctgtttcccaagcgtgcactgcgttcccggcaagggctgtgaggcttgtcccccaaacctgactggagacgggaggcactgcgccgcccttgggtcttcttttctctgccagaaccagagctgtccggtgaattactgttataatcagggccactgctacatatcccagacactggggtgccagccaatgtgtacgtgcccaccagcctttacagattcgcgttgttttctggctggcaataatttcagccccacagtcaacctcgaactgcctctccgtgtaatccagctcctgttatccgaggaggagaatgcttctatggctgaagttaatgctagcgttgcctatcggctcggtactctggatatgagagccttcctgaggaattctcaggtcgagcgtatcgactccgcagctccagcaagcggctctccaatccagcactggatggtgatttctgaatttcaatatagacctcgtggccctgttatagacttccttaataaccagctgcttgcggccgtcgttgaggcgtttctttatcacgtaccacgacggagtgaggagccccgcaacgacgttgtattccagcctatcagtggcgaggacgtgagagacgttaccgcgttaaatgtgtcaaccctaaaggcatatttccgatgtgacggctataagggctacgacttagtgtactctccgcagagtggcttcacctgcgtgtccccatgtagtagagggtactgtgatcatggaggacagtgccaacatctgccttcaggtccgcgctgctcttgcgtcagcttctccatctacacagcctggggcgagcattgcgagcatttgtcaatgaagctggacgcattctttggtatcttcttcggggctctcggcggcctcctcctgctcggcgtggggacctttgtagtgttgcggttctggggctgctctggagcccggtttagttattttctgaacagcgctgaagcactgccatag

SEQ ID NO: 124933 - DNA, 16083 bp, Artificial Sequence
  Description of Artificial Sequence: Synthetic coding sequence
atgaagggtgcccggtggaggagggtaccatgggttagtctttcctgtttatgcctgtgtctgcttccacatgttgtgcccgggaccacagaagacactctgatcaccggatccaagacagccgctccagtgacaagtaccggcagcacaacggccacattagaagggcagtccacagcagccagtagcaggacctcaaaccaagacatcagcgcctcctcccagaatcaccagaccaaaagtaccgaaaccaccagtaaagctcagacagataccctgacccagatgatgacctccaccctgtttagtagcccaagtgtgcataacgtcatggagactgctccgccagacgagatgacaaccagcttcccatccagtgtcacaaacacccttatgatgactagtaagaccataaccatgacaacctctacggactctacactgggcaacactgaagagacatctacggcgggcactgagagttccacaccagtaacttcagccgtcagcattacggctgggcaggaagggcagagccgcacaacttcctggcgaaccagcattcaggacacaagtgcgtcaagccagaatcattggacccgctccacccaaacgacgcgtgagtctcaaaccagtacactgacccaccgtacaacttctacaccctctttttccccttcggtacataacgtcactgggaccgtaagtcagaaaacctcaccttccggggaaacagccacgtcgtccctctgttcagtgacgaacacatcaatgatgacctccgaaaaaattactgtgacaacctctactggctctacgctcgggaatcctggtgagacttccagtgtcccagtcacagggtccctgatgcccgtgacaagcgccgccctggttaccttcgaccccgaggggcaatccccggctaccttttctcgcaccagcactcaggatactaccgccttttctaaaaaccaccagacacaatctgtggagaccacgagagtgtctcagatcaacaccctcaacaccctgacgccagtgaccacaagtacagtgttaagtagcccgtcaggcttcaacccttccgggactgtatcccaggaaaccttcccatccggagaaactaccactagcagcccaagtagtgtgtcaaacacgtttctggtcacgtcaaaggtgtttcgtatgcccacaagccgagactcgaccctcggcaacaccgaagagacctctctgagcgtgagcgggacgatctccgctattacttctaaggtcagtactatatggtggtccgatacgctgtcaacagccctgtcaccttcgagtttaccccccaaaatcagtactgcattccatacacaacaatcggagggcgctgagaccacaggccgtccacacgagcgatcctcctttagcccaggggtttctcaggaaattttcaccttgcacgagactacgacctggcctagctcgttctcttctaagggccacactacgtggagccaaaccgagctcccctccaccagtactggggccgctactcgcttagtgaccggcaacccaagcacaggcacggccggtactataccacgagtgccctcaaaagtttcggctatcggggaaccaggagagccgaccacatacagcagccacagcacaacccttcctaagacgaccggggcaggagcacagacccagtggacccaagagacagggaccaccggggaggctctgctgtcatccccgtcgtattctgtgacccagatgattaaaacggccacgagcccatctagcagtcctatgctcgacaggcatacttcccagcaaataacaactgcccctagcactaaccactccaccatccatagcacgtctacttccccccaggaaagccctgccgtctcccaacggggacacacccaggctcctcaaacaacacaagagagccagactacgaggagcgtgtcaccaatgaccgataccaaaaccgtcactactcctggtagttcattcaccgcttccggacattccccatcagaaattgtaccccaggacgccccgaccatttccgcggccaccactttcgcccctgcaccaacaggtgacgggcatacgactcaggcccctaccacagcgttgcaagccgctccaagctcacatgacgctaccctaggccccagtggcggaacatcactgagtaaaaccggggccctgaccctcgctaatagcgtggtaagcacacccggagggccagagggtcagtggacctctgctagcgcctccacaagtccagacacagccgctgccatgacccacactcatcaggccgagtccaccgaggccagcgggcagacccagaccagtgaacccgcttcctccggttctcgaacgaccagcgcgggaacagctacccctagctcatcaggggcatcaggcactactcctagcggctccgagggaatctccacttctggtgagacaaccaggttttcttcaaatccatcccgagatagccataccacgcagagcaccaccgaactgctgagtgccagcgccagccacggggccatcccagtttctaccggaatggccagttcaattgtgcccggaaccttccatccaactctctctgaagccagtactgctggacggcccaccggacaatcctcccctaccagtccgtccgcttcacctcaggagacagccgccataagtcgcatggcccagacgcagaggacgagaaccagccgcggatcggacacgatttccctcgcaagccaggcaacagacacattctctacagtcccccccactccccccagcatcacaagtacaggactgactagtccacagaccgagacacatactctgagtccgtcaggcagcgggaagaccttcactacagccctcatttcgaatgcaaccccactccccgttacatacgctagctcggcctccacagggcacacaacacccctccacgtcaccgacgccagctcagtttcaaccggtcacgccacccccctgcccgttacttcccccagttccgtcagcacaggccataccacccctttacccgtaactgatacctccagcgagagcaccgggcacgttacacctctgcccgtcactagttttagcagcgccagcacaggtgactccacccccctgcctgtgacggacacctcctccgcctctaccggccacgtgacacctttgcctgtcacctcccttagtagtgcctccaccggagatacaaccccgctgcccgttacggataccagcagcgcatctaccggccacgcaacctctctccccgtcaccgacacctcctcagtgtccacaggccacaccacccccctccccgtgaccgatacgtcttccgctagtaccggccatgctacaagtcttccggtgaccgacacatcatccgtgtccactggccataccaccccccttcacgtgaccgacgcatcttcagcatcaaccggtcaagctacccctttgcccgtaacctccctgtcgtcagtgtcaacaggggacacaaccccactaccagtaacgagcccaagcagcgctagcacaggccacgcaaccccccttctcgtcacggacacaagctcagctagcacaggccatgcaacccccctgcctgtcacagatgcctctagcgtctcaaccgatcatgctactagcctccccgttaccattccttctgccgccagcaccgggcacactaccccactgcctgtcaccgacaccagctccgcttctaccggccaagcgacatcccttctagtgacggacacttccagcgtgtccacaggcgacactacccctctgcccgtgacaagcacatctagtgctagcactggccacgtgacacctcttcacgttacatctcctagtagtgcctccacaggacatgcaacacctttacccgttacctctctgagtagcgcttccaccggagacactatgccacttcctgttacgtcaccctcgtcggccagcaccggcgataccaccccattaccagtcaccgatgccagtagcgtgtccacgggccacacgacaccactgcacgtcacagacgcctcttccgcttctaccggacaggccaccccgttaccagtgacatcgctgtcttcagtgtcgacgggagacacaacccccctcccggtgactagtccttcctctgcgtcaactggccatgccaccccattactggtgacagatacatcaagcgcttcgaccgggcatgccactccactccctgttacagatgcctcatccgtcagcaccgaccacgccacttcccttcctgtaacgatcccttctgcggcgtcgaccggacatacaactccactgcctgtgaccgacacttctagcgcaagcaccggtcaggctacatccctcctggtgacggacacgtccagcgtttctacaggagacacaacgccacttcccgtcacttccacatcaagcgccagcaccggtcacgtcacccctctgcatgtgacctcgccaagctctgcctcgacagggcacgcaacgcccctccccgtgacatctctgtcatccgcctctaccggcgatactatgccactccccgtcacttcgcccagcagcgcctctactggagatacaacccccctgccagtgaccgacgccagctccgtgagcaccggtcacaccacacctctgcctgtaacttccccgagcagcgcctccaccgggcatacaacccccttacccgttacggacaccagttccgccagtaagggggacacgacccccctcccggtgacttcaccctcgtccgcttccaccgggcacacgacccctctgccggtgacagatacctcttcggcatcaaccggcgacaccacccctctgcctgtcacgaacgcctcaagtctgagcaccggtcacgctacccccctgcacgtcacaagcccatcgtccgcctccacaggacatgcgacaccactgcccgtgacatcaacgtcctctgcttccaccggccacgcaacacctctgcctgttacaggcctgtcatccgcaacaacggacgataccacccgcctcccagtaacggacgtatcctcagcgtcaactgggcaggccacacctctgcccgtgacgtctttgtcctcagtgagcactggtgataccactcctctcccagtcaccagtccttcttctgcatcaaccggccatgccagtcctctgttagttaccgacgccagttccgcatccaccgggcaggcgactccattgcctgtcacagacacttcttctgtgagcaccgcacacgcaacccctcttccagttacggggctgagctcagcctctaccgatgatactacaagattaccagtgaccgacgtgtctagcgccagcacgggacaggcaataccactgcccgtaaccagtccctcgtcagctagtacgggcgatactaccccactgcccgtcacggacgccagcagcgccagcaccggggacactactagtctccccgtaaccatcccgagctccgcatcatctggacacactacctcgctgccagtgacagatgctagttccgtatccactggccatgctacctcacttttagtcaccgatgcaagttcagtgagcaccggggatacaactccacttcccgttaccgacacgaacagcgcaagcaccggggacaccacgccacttcacgtgacagatgcctcgtcagtatcaacaggtcacgccacctctcttccggtgactagtctgagcagtgcatccacaggggatactaccccattgccagttactagtcccagctccgcatcttcggggcacaccactccactgccagtgacagacgcgtctagcgtcccaaccgggcacgccacttcgctccccgttactgatgcatcctcagtgtcgaccggacatgccaccccgctgcccgtcacagatgcttcatctgttagtaccggacacgcaacaccactgcccgtgactgacacaagctctgtgagcaccggccaagcgaccccactaccagtgacgtccctctccagtgcaagtactggagatacgacacccctgcctgtgacagacacctcatctgcctccaccggtcaggatacgcccctgcccgttacctccctgagttctgtctctacgggtgacaccactccccttcctgtaacaaatccatcctccgcgagtacaggccatgcaactcccctgctggtgactgatgctagctcgatcagtacaggacacgcaacgagcctgctggtcacagatgcgagctccgtaagcactgggcacgcaacagcactgcacgacactgacgcctccagcttgagcactggcgacacaacacctttgccggtgacctcgcctagtagcactagcactggcgatacaactcctttgcccgtcacagagaccagctctgtctccactgggcatgcgacatcattgcctgtcaccgacacatcttctgccagcactggacacgccaccagccttcccgtcactgatacctcatccgcctccaccggacacgctacgccactccccgtaaccgatacatcttctgccagtaccggacaggcaactcccctgcccgtcacatctccttctagtgcttccacaggtcatgctatcccgctgctggtgactgatacctcctcagcctcgaccggacaggctactcccctgcccgtcaccagtctgtccagtgcctctaccggagatacgactcctctgcctgtgacggacgcaagttcagtctctactggacacgcaacatcactgccagttacctcacttagttcagtctcgacaggggacaccacgccgttgcctgtcaccagcccatcttccgcatcgaccggccacgccacacccctccacgtcactgacgcctctagcgcgtctacaggacatgccacacctctaccagtaacttcactgtcttcagcaagcaccggcgataccacaccactgccggttacttccccctcatccgccagcactggccacgcaacaccgctccacgtaactgatgcgagctcagtgagcactggagacactacccctctgccggtgacttcaagtagctcagccagctctggccacactacgccacttcccgtaacagatgccagttccgctagtacgggggatacaactccgttaccagtgaccgataccagtagtgctagcacaggtcatgctacgcatttacccgtaacgggactgagctctgcaagcaccggcgacacaacccggcttccagtaactaacgtaagctctgcttccactggacatgccacccctctgcccgtaacttcaacgagttccgcctctactggggacaccacaccactccctggaacagataccagcagtgtaagcacaggccacaccactcccctcctcgtaaccgacgcctcgagcgtgagcacgggagatactacgagacttccagtgacgtcaccttccagcgcttcaacaggccatacaaccccactgcccgttaccgatacaccaagtgcaagcacaggggatactactcctttgcctgttacaaacgcttcctccttgtcaactaggcacgctaccagccttcatgtcacaagcccctcaagcgcaagcactgggcatgccacgtccttaccggttacggatacatccgccgcctcaacaggccatgccactccattgcctgtaaccagtacaagcagcgcctctactggcgatacaacccctctgcctgtaaccgatacatatagcgcgagtaccggtcaggcaaccccacttcctgtgacgtctctgtcaagtgtctcaacaggcgatactaccccgttacctgttacaagcccatccagtgcttcaacgggtcacgccacgccccttctcgtcacggacgcctcgagcgcttccaccgggcaagcaacaccactgcccgtgacttccctcagtagcgtgtctaccggcgataccactccactgccagtaacttccccttcatcagccagcacaggccatgcaactagtctacctgtgactgatacctcaagcgcctccactggcgatacaacctctctaccggtcacagatacatccagcgcctacaccggcgatacaactagtctccctgtcacagacacttcaagctcatctaccggagatacaacacccctgctcgtgactgagacttccagcgtgagtactggcgatactacacctctaccggtgaccgatacaagctcagcctccaccggccatgctaccccattacccgtaactaataccagtagtgtgtccactggccacgccacaccactgcacgtaacgagtccttcctccgcctccacgggacacacaacacctctccccgtgacagacgcatcttcagtgtccacgggccatgcaacttcactgccggtaaccgatgcttcttctgtctttaccgggcatgccacaagtttgcccgtgaccattccaagtagtgcatcatcggggcacaccacaccactgcctgtgaccgatgcctcaagcgtgtctactggacacgcaacttcattgcctgtgaccgatgcatcaagcgtgagcactgggcatgccacccccctacctgtgacagatgcaagctctgttagcaccggccacgccacccccttgcctttgaccagcttatcctctgtgagtactggggacacgactcctttgcccgtgacagatacgagttcagcgtccactgggcaggccacgccactgccggtcacctccctgtccagcgtaagtacgggagatacaacacctctcccagtcactgacacatctagtgcatctactggccatgccacatcgctccctgtgactgacacatcttctgctagcactggccatgccacaccattgccggacaccgacacctccagcgcttctaccggccacgcgacattgttacctgtaactgataccagcagcgcatccatcgggcatgccacatctctgcctgtgaccgacacgagctccatcagtacagggcatgctacgcctttacatgtgacatcacctagttctgcatcaactggtcacgccaccccactacccgtcactgacacctcatcagcgtcaaccggccatgccaaccccctgcacgttaccagcccttccagcgcttcaaccggccacgcaacgcccctgccagtgactgacacctctagtgcgtcaaccggtcacgccaccccattacctgtcacgtcactaagctcagtttcaactggagatacaactccgctgccagttacatcacccagctctgcaagcaccggtcacactaccccccttcccgttaccgatacttctagcgctagtacaggtcaggccacggcacttcccgtcacatccacaagcagtgcctctacgggtgatacaacacccctaccagtgacagatacgtcgtccgccagcacgggacaggctacgcctctgcccgtgacttctttaagcagcgtgtccacaggagacaccactcccctccccgtgacctctccatcatccgcctcaacagggcacgcgaccccgttgctggtgaccgatgcaagttccgctagtaccggtcaggctacccctctgccagtcacatccctgtcttcagtcagcacaggcgacacaaccccattgcccgttaccagtccatcttccgcctcaactgggcacgccacaagtctgcccgtcaccgacacctcctcggcgtctaccggagatacaacaagtctgcctgttacagatacgtcgtctgcttacaccggtgataccacgagcctgccagtcacagacacctccagctccagcacaggagacaccactcctctgctggtcaccgaaacctctagcgtgtcaacaggccacgcgacacccctccttgtgacagatgccagctccgcgtcaaccggccacgcaacccccctgcacgttacgtctccatcttccgcttcaaccggagacaccacaccagtaccagtgaccgatacttcgagtgtgtcaacaggtcatgctacaccgctgccagtgacagggctatcatcagcttctaccggcgacacaacaagactcccagtaaccgacatctcaagcgccagcacgggccaggccactcccctgcctgttaccaatactagctcagtatccaccggtgacactatgcccctccctgtcacttcgccttcatctgcgagtactggccatgccacccctctccccgtgacctccacatcatctgcatccaccggtcacgcaaccccggtccctgtgacttctactagttcagcaagcacaggccatacaactcccctgcctgtcactgacacgtccagtgcgtcgaccggtgatactacacccctgcccgttacgtctccaagtagcgcatctacaggacacaccacaccccttcacgttacaatccccagcagtgcctccaccggggacacaagcaccctgccagtcacgggcgctagcagtgccagcaccggccacgccacaccactgcctgtaacagacactagtagcgtcagcaccggacatgccacaccattgccggtcacttcactgagcagcgttagcaccggggacaccaccccacttcccgtgaccgatgctagcagtgcctctacgggccaggcaacaccccttccagtcacaagcctctcatccgtttcaacaggcgacacgacaccactgctggtcaccgatgccagtagcgtgtctaccggccatgccacgcccctgcctgtaacggataccagcagtgcgtctactggagacactacccgccttcccgtgacggacactagcagcgcatcgacaggccaagcaactcccctcccggtgacctctctatcctctgtgtcaactggcgacacaactcctctgcttgtgacagatgcgagctcagtgagcaccggccatgccacaccactccctgtcactgatacgagcagcgcctccaccggcgataccacccgactgcccgtgactgacacatcgtctgccagcacgggacaagctacccctttacctgtgaccattcctagcagctctagttcaggccacactacaccactccccgtgacaagtaccagctccgttagcactggacacgtcacaccgctgcatgtgacctctccgagctctgcgtcaacgggccacgtcacccccttacccgttactagcactagctccgcctcaactggacacgccactcctctgcttgttacagacgcttctagcgttagtaccggacacgccactcctctcccggtgaccgacgcttcatcagcctcaacaggagataccaccccgcttcctgtcaccgacacttcctcagcctccacaggacaagccacgccccttccggtgacttctctgagttccgtgagtaccggcgacacaactccgcttcccgtcactgatgcttcctcggcatcaacaggacacgccacccccctgcctgtgacgattccaagctcagtgtctacaggggacaccatgcctctacccgtgacctctccctctagcgcaagcactggtcacgcgactccattgcccgtcaccggtctgtccagcgcaagcaccggcgacaccaccccacttccagtgactgataccagtagcgccagcacccgccacgccacacctctgccagtcaccgatactagttctgcatctaccgacgacacaacccggcttccagtgaccgacgtgagtagcgcgagcactggccatgccactcccctacccgtcacaagcaccagctctgcatccaccggcgacactacccccttgcctgttaccgatacatcttccgtgtcaacgggacacgcgacctccctgcctgtcacctctcgttcctctgcctctactggtcatgccacccctctgcccgtgacagatacgtcgagcgtcagcaccggacacgcaactcccctaccagtcacttctacgtcaagcgttagtacagggcacgcgaccccactcccagtcacatcaccgtcatccgccagtacaggtcacgccacccctgtgccagtgacctcaactagtagcgcctcaaccggagataccacccctctgcccgtaaccaatgcatcttcgctctctacaggccacgcgacacctttacacgtgacttctcctagtagcgcttcccgaggtgacacaagcacgttacccgtgactgacgcaagctccgcatcaacaggacacgcgacccctctcccacttacaagcctttcttcagtgagcactggagataccacgccgcttccggtaacagatactagttccgccagcaccgggcaggccacacccctgccagttacgagcctctcatcggtgagtacgggcgatactacacctctgcccgtgacaatccctagcagcgcgagctcaggccatacaacctctttgcccgtgactgacgcgtccagtgttagcactggacatggcactcctctgccagtgacgtctacctcttctgcctctacaggcgacacgactccgctgcccgtgaccgatacctccagcgcctccaccggccacgccacaccactacctgtcacagacactagctccgccagtacgggtcatgccactcctctgcccgtgacatcgctgtccagcgtgagcacaggacacgctacacccctagcagtgagcagcgctacttctgccagcaccgtgtctagtgatagcccactgaagatggagacccctggaatgacaacgccctcgctgaaaacagatggtggccgcaggactgcgacctccccgccgcctaccacgtcccagaccattattagcaccataccctctacagcaatgcacaccagaagcacagctgccccgattcctatccttccagagagaggagtgagcctgttcccttacggagctggagcaggagacctggagttcgttagacggacagttgactttacatcacccctgttcaagcccgcaaccggattcccactaggaagctccttaagggactcactctattttacagacaacggacaaatcatattccctgaatccgactatcagattttttcgtaccctaatcccctgcccacaggatttactgggagagatccagtcgccctggtggcccctttttgggacgatgccgacttctccacaggccgtgggacaaccttttaccagagtaatacttaccaggccattcttagcacagatgggagtcgcagctatgccttgttcctctaccagagcggtggaatgcagtgggatgtcgctcaacgcagtggaaatcccgtgctaatggggttcagcagtggagacggttactttgaaaacagtccgcttatgtctcagcctgtctgggagagatacaggcctgaccggtttctcaattcaaattcggggcttcagggactgcagttttaccggctccaccgtgaggagcggcctaactacaggctcgagtgtttgcagtggttgaagtcgcagccgcggtggccttcctggggatggaatcaagtctcgtgcccttgctcttggcagcagggccgcagggacctgaggtttcagccagttagtatcgggcgatgggggctgggcagtcggcagctttgtagctttacaagctggagggggggggtgtgctgctcctacggaccttggggggaattcagagaggggtggcacgtgcagcgtccctggcaactggcccaagaactggaaccccagtcatggtgctgtaggtggaatgacaagccctacctgtgcgctctgtatcagcagcggcgccctcacgtgggctgcgctacttatcgccctccacagcccgcctggatgtttggagaccctcacatcaccactttggatggcgtgagttatacttttaacgggctcggggactttctcttggtgggagctcaggatggcaactcttcctttttgctgcaaggaagaaccgctcagaccgggtcggcccaggcaactaacttcattgcctttgcggctcagtacaggagttccagcctgggcccggtcactgtgcagtggctgcttgagccccacgacgcaataagggttctcctggacaatcaaaccgtgaccttccagcctgatcacgaagacggagggggacaggaaactttcaacgcgactggggtgctgctcagtcgtaatggctctgaagtgagcgcatcttttgacggctgggctacagtgtccgttattgctctttcaaatattctgcatgcttccgccagcctgcctcctgaatatcagaaccgcaccgaaggccttctgggggtctggaacaacaaccctgaggacgactttcgcatgcctaatggctctacaattcctccaggctctcctgaggagatgttatttcactttgggatgacttggcagattaacgggaccggactcctgggtaaacggaacgaccaattgccgtctaacttcacacctgtgttctatagccaactccagaaaaattcctcgtgggcagagcacctgattagcaattgcgatggtgattcaagctgtatctacgacaccctggcattacgcaatgccagtattggtttgcacactcgtgaggtgagtaagaactacgagcaagccaatgcgacgttaaatcagtatcctccaagcattaacggcggcagggtgattgaagcttataagggacagacaacccttatccagtatacaagcaacgccgaggatgctaactttacgctgagagacagttgcacagacctggaactgtttgaaaacggcacattgctttggacgccaaagtctctggaaccgtttacccttgagatcctcgcccgtagtgccaagataggacttgcgagtgcactgcaaccgcgaacagtggtgtgccactgtaatgccgagagtcagtgcctgtataaccagacctcacgggtggggaacagcagcctcgaggttgcgggatgtaagtgcgacggcgggacatttggacgatattgtgaaggctcggaggacgcatgcgaggagccttgtttccctagcgtacattgcgtgccaggaaaaggatgtgaggcctgtcctcccaatctcacaggagatggtaggcattgcgccgcactgggttcaagcttcctctgtcagaaccagagctgccccgtcaattactgctacaatcagggccactgctacatctctcagaccctgggatgtcaacccatgtgcacatgtcctccggctttcactgactccagatgcttcctggcggggaataacttttcaccaactgtgaatctagagttgcccctgagagtgattcagctgttgctgtctgaggaagaaaacgccagcatggcagaagtgaacgctagtgtggcatacagattgggtacgctggacatgagagcctttctacgcaacagtcaggtggagcggatcgactccgccgctcctgcgtcgggatcaccaatccagcactggatggtcatctctgaatttcaatacagaccgcgggggcctgtgattgactttttaaataatcaactccttgccgccgtggtcgaggcctttttgtatcatgtgcccagacggtcagaagaacctcgcaacgatgttgttttccaaccaatatccggagaggatgtccgcgacgtgactgctctcaatgtgtctacacttaaggcatatttccgctgtgacggatacaaaggatatgacctggtgtacagccctcagagtgggtttacatgtgtgtccccctgttctaggggatattgcgatcacggtggtcagtgtcaacatttgccatcagggcctcgatgctcgtgtgtttcattcagcatctacacagcatggggtgagcattgtgagcacttgagcatgaaactagacgcgttcttcgggatttttttcggagccctaggcgggttacttctcctcggcgtggggacattcgttgtacttcgcttttggggatgtagtggcgctaggttctcttattttttgaactcagcagaagcgctgccctag

SEQ ID NO: 124934 - DNA, 1863 bp, Artificial Sequence
  Description of Artificial Sequence: Synthetic coding sequence
atgagcgttggcagaaggaaactcgccctgctctgggccctcgctctggccctagcatgtacaaggcacacaggccatgcacaggacggaagcagtgaaagtagctacaaacaccaccccgccctatccccgattgcccgaggcccatctggcgtccctcttcgaggggccacagtttttccatctctccgcaccatccctgtcgtaagggcgtctaacccagcccacaatgggagggtctgtagtacctgggggagcttccactacaaaactttcgacggggatgtctttaggttcccgggcctttgtaactatgtgttcagtgaacattgcggggcagcctatgaggactttaatccagccaccccacaacccggagtcagtggccctcatgccgagcagggcccacacgaggggggttggagaggccatcccgcagatcaggggctccgacctggtcagcgcccacccggaccagcagcccttcagccggtgtgggggccgcacagcagagcggctgccacacctagatggaggccggggtgggccctgagctcttgcggtactactatgacggcttgctgttggctggacaccaaatatgccaacaagttgtgggcattgtggggtctccagagggacgcaagaggacagcgggcaccattgccgcaacaccaggcagatacgcatggtattagggaacccgctagatggacaactcctaggtcttctgtgcgaaccctcagcctaaatccccggggaactgcacctctggcgttgggtatatgcgaagagttactgcatggtcagctattcagcgggtgcgtggctttagtagatgtgggttcctatttggaagcctgcaggcaagacctatgcttctgtgaggacacagacctcctctcatgcgtgtgccacacccttgctgagtacagcagacagtgtacccacgcaggagggctcccacaggactggagaggtccggacttttgtccccagaaatgccctaataatatgcagtaccatgagtgtagatcaccctgtgctgacacatgttcgaatcaggagcacagtagggcctgcgaagaccactgcgtcgccggctgcttctgccccgaaggaaccgtcctggacgacattggccagacaggctgtgttcccgtgagtaagtgcgcctgcgtgtataacggagcagcctatgcgcctggggctacttactcaacagactgcacaaactgcacctgttctggcgggaggtggtcatgccaggaagtgccgtgtccgggcacttgtagcgtattgggaggtgcccacttcagtacctttgatggcaagcagtacaccgttcatggcgactgttcttatgtgcttacaaagccctgcgactcctcagccttcaccgtgctggcagagctgcgtcggtgcggcctcactgacagcgagacttgcctgaagtctgtgactctctccctggatggagtccagacagtagtggtgattaaggctagtggcgaggtgtttcttaaccagatttatacacagttaccaatctcggccgccaacgtcacaattttcaggccgagcaccttctttatcatcgcgcaaaccagtctcggtctccaattaaatctgcagcttgtgcctactatgcagctctttatgcagctggccccaaagctgcgcggccaaacctgtggcctttgcgggaacttcaactcgatccaggctgacgattttcggactctgtcaggagtcgttgaggccactgccgctgcttttttcaacaccttcaagactcaggcagcctgccccaacatccggaactcctttgaagatccgtgcagcctttcagtggaaaattag

SEQ ID NO: 124935 - DNA, 1872 bp, Artificial Sequence
  Description of Artificial Sequence: Synthetic coding sequence
atgagcgtcggccggcggaagctggccctgctttgggcactcgccctcgcactagcttgtacaaggcacacaggacacgcacaggacggcagtagcgaaagctcatataagcaccatcccgccttgagtcccatcgctcggggtccctccggcgttcccctgcgaggagccaccgtgtttcctagcttgcgcactatcccagtggtcagagcctcaaaccccgcacataacggccgcgtgtgcagtacctggggttctttccactacaagacctttgacggcgatgtctttagattccctggactgtgcaactatgtctttagtgagcactgcggggcagcctatgaggactttaacattcaattacgaaggtcacaggagagcgcggctcccaccctgtcacgggttctgatgaaggtagacggcgtagtcattcagttgaccaagggttccgtacttgtgaacggacatcctgtactactgccatttagccaatctggagttctcatccagcagtcctcgagctacacaaaagtggaggcccggctgggactggtgctcatgtggaaccacgacgactcactcttgcttgagctagacaccaaatatgccaacaaaacctgtggcctgtgcggtgacttcaatggtatgcctgtcgtatctgaactgctttcacacaacactaagcttacgccgatggagttcggcaatctccagaaaatggacgaccccacagagcagtgccaagatcctgtgcctgaaccaccacgtaattgttcgacagggtttgggatttgcgaagagcttctgcatgggcagctgtttagcggctgcgttgcactcgttgacgtgggttcttacctcgaggcatgcaggcaagacctttgcttttgtgaggacaccgacctgttgagctgcgtgtgtcacactctcgcagaatacagtaggcagtgtacacatgcaggtggactgccccaggattggcgaggccccgatttctgtccacaaaaatgtcccaacaacatgcagtatcatgagtgtcgttctccttgtgccgatacatgtagcaaccaggagcattctagagcctgcgaagatcattgtgtggccggctgcttttgtcctgaaggcaccgtgcttgacgatattggccagactggttgtgtgcccgtgtcaaagtgtgcatgtgtctacaacggggccgcctatgcacctggagccacctactccactgactgcaccaactgtacgtgctcaggcggtagatggtcctgccaggaagttccctgcccggggacatgctccgtgttagggggcgcccatttctcaacctttgacggcaagcaatatactgtgcacggggactgctcatacgtcctgactaagccctgcgacagttccgccttcacagtgttagctgagttgagacgttgcgggttaactgattcagaaacgtgtctcaagtccgtgacactgtcactggacggcgtgcagacagtggttgtcatcaaggcgtcaggtgaggtgttcctgaaccagatctacacccagctccctatctccgctgctaacgtgaccatattcagacccagcacgttcttcataattgctcagacatcacttggcttacagctgaatctacagctggtccctaccatgcagctgttcatgcagctcgctccaaagctcagaggccaaacatgtggcctttgcgggaacttcaattctatccaggccgatgatttccgtacacttagcggtgtcgtagaagctaccgcggctgccttttttaatacgttcaagacccaggctgcgtgcccgaacatcagaaattcgtttgaggatccctgttccctgtcagtcgaaaattag

SEQ ID NO: 124936 - DNA, 17121 bp, Artificial Sequence
  Description of Artificial Sequence: Synthetic coding sequence
atgggtgccccttcagcctgcagaactttagtcctcgccttggcagccatgctcgttgtccctcaagcggaaacgcagggccctgttgaaccctcctgggaaaatgctggccacaccatggacgggggtgcgccgacaagttccccaacaaggcgggtgagcttcgtcccgcccgtgacagtgttcccttccctttctcctctgaaccccgcccacaatggacgtgtttgtagcacatggggtgactttcactacaagacctttgatggtgatgtgtttagattccccgggctttgtaattatgtgttttccgagcactgtcgtgcggcttatgaggacttcaatgtacaactccgccgagggcttgtcggaagtaggcccgtggtcacacgggtggtgatcaaggcccagggtctggtgctggaggcatcgaacggatcggtgttgatcaatgggcagcgggaagagctgccctacagccggacaggactcttggtcgaacagtctggagattacatcaaggtgagtatacggttggtgctcactttcctatggaatggtgaagacagcgcccttctcgaactggacccaaaatacgccaatcagacatgtgggctatgcggggactttaatggcctgcccgcattcaacgagttttacgcccataacgcacgtctaacacccttacagttcggcaacctgcagaagttggacgggcctaccgaacagtgccccgaccctctgccgttgcctgcaggaaattgcaccgatgaggaaggcatttgccataggacactgcttggtccagcgttcgctgagtgtcacgcacttgtcgattctacagcataccttgctgcttgcgcccaagacctttgtagatgtcccacttgcccctgtgcgacctttgtggaatatagtcgccaatgtgcacacgccggcggacagcctcggaattggagatgcccagaactctgcccccgcacctgtcctctgaatatgcaacaccaagaatgtggatccccttgtaccgatacgtgctctaacccccagcgcgcccagctgtgcgaggatcattgtgttgacggctgcttttgtccgcctgggtcaaccgttttggacgacatcacccatagcgggtgtctacccctcggtcagtgcccctgtacacacggtggcagaacatattctccgggaacctcctttaacaccacatgttcttcgtgcacttgcagtggtggactgtggcagtgtcaggacctgccatgtcctgggacttgtagcgtgcagggcggagcacacatctctacctatgacgagaagctctatgacctccacggggactgctcctatgtgctatctaaaaagtgcgcagattcttccttcaccgtcctagctgagctccgcaagtgtggcctgacagacaacgagaattgcctcaaagccgtgactctgtcgctggacggcggcgatactgccattcgggtccaagctgatgggggcgtatttctgaatagtatttatacacagctgcctctgtcagccgccaacatcaccctcttcaccccttcaagctttttcattgttgttcagacaggactgggtttacagttgctcgtccagctcgttcctctgatgcaagttttcgtacgcttggacccggcccaccagggccaaatgtgcggcctgtgcggcaatttcaatcagaaccaagccgatgacttcaccgccctcagtggagtggtcgaggccacaggggccgcctttgctaatacttggaaagctcaagcagcatgcgccaatgcaaggaacagcttcgaggacccttgcagccttagtgtcgagaacgagaactacgctcggcattggtgttctcggcttacagacccaaacagcgctttctcccggtgtcattcgattataaacccgaagccttttcattctaactgcatgtttgatacatgcaattgtgagcggtccgaagactgtctgtgcgccgccctatcgagttacgtccatgcctgcgccgcaaaaggcgttcaactgagtgattggcgggatggcgtctgtaccaagtacatgcagaactgccccaagtcacagaggtacgcctatgttgtggatgcctgccagccgacttgtagaggcttgtccgaggccgatgtgacctgtagcgtatccttcgtccccgtggacggttgcacttgccccgccggcactttcctcaacgacgctggcgcctgcgtgccagcgcaggaatgcccttgttatgcgcacggcaccgtgcttgcgcccggcgaagttgttcatgatgaaggagctgtttgctcctgcacgggcggcaaactgagctgccttggcgcgtctctccagaagtccacaggatgtgccgcgcccatggtatatctggactgtagtaattcgtcagccggtacccctggggctgaatgcctgagaagttgtcataccctagacgtgggttgtttcagtactcactgcgtgtctgggtgcgtctgtcccccagggcttgtcagcgacggcagcggaggatgcattgccgaagaggattgtccctgtgtccacaacgaggctacttacaaaccaggagagactataagagttgactgcaatacgtgtacatgccggaataggcgatgggagtgcagtcataggctttgcctgggaacgtgcgtggcatacggagatgggcattttattacttttgacggggatcgttacagcttcgaaggcagctgcgaatacatcctggcgcaggattactgcggcgacaataccactcacggcacttttcgcatcgtgaccgaaaatatcccttgcggaacaaccgggaccacatgcagcaaagcgatcaaacttttcgtggagtcttatgagttaattctgcaggaggggacatttaaagcagttgcccgtggccccggcggggacccaccctacaaaatcaggtacatgggtatttttctggttatcgagacccatggcatggccgtgtcttgggaccggaaaacctccgtgttcattcgactgcaccaggactataaaggcagggtgtgcgggttgtgcgggaattttgacgataatgcgatcaacgatttcgctaccagatctcgtagtgttgtgggcgatgctttggaattcggtaacagctggaaactgagcccaagctgtcctgatgcactagctccaaaggacccctgtacagccaatccttttcgaaagagctgggcccaaaaacagtgctccattctgcatggcccaacatttgcagcatgcagatcccaggtcgactctaccaaatattatgaagcttgcgttaatgacgcttgcgcgtgtgattcaggtggtgattgtgaatgtttttgtaccgccgtggctgcctacgcacaggcttgccatgatgctgggctctgcgtgtcatggaggactcctgatacttgtcctctgttctgcgacttttacaacccccacggagggtgtgaatggcattaccaaccatgtggtgctccctgcctaaagacttgtcggaatccctctggtcactgtcttgtggacctgcctgggctggaaggttgttacccaaagtgtccgccatcacagccattctttaacgaggaccagatgaagtgcgtcgcccagtgtggttgttatgacaaagatggcaattactacgacgtgggcgctcgcgtgcctacggccgagaactgccagagttgtaactgcacaccttctggtatacagtgcgcacacagcctcgaagcttgcacctgcacgtatgaagacaggacctatagctaccaggatgtgatttacaatactactgatggactgggtgcctgtctgatcgccatttgcggctcaaatggtacaattattcgtaaggccgttgcctgccctggtacccctgcaacgaccccattcacattcacaaccgcgtgggtgccacactctacaacatcaccagctctccccgtgagcaccgtgtgcgtgcgcgaggtatgtcggtggagcagctggtacaatgggcaccgtcccgaaccagggctcggaggaggggactttgagacttttgaaaacctccgccaaagggggtatcaggtgtgtccagtgcttgccgacattgagtgtcgggccgcccagttgccagatatgcccctggaagaactgggacaacaggttgattgtgaccgaatgcggggcctgatgtgcgccaatagccagcagagcccaccactctgccacgactacgagcttagagtcctgtgctgtgagtatgtcccgtgtgggccttcccccgctccagggactagtcctcaacctagtctgagcgctagtacagaacctgccgttcccacgcctacacagacaacggcaaccgagaagacaacgctgtgggtcaccccaagtatacgctcaaccgcagcccttacttcacaaaccggttcctcatccggacccgtcaccgttaccccctcagcacccggaacaactacctgccagcctcggtgccaatggactgaatggttcgacgaagactaccctaaatccgaacagctgggaggagacgtggagagctacgataagatccgcgctgccggcggtcacttatgtcaacaacctaaggatatcgaatgtcaggccgaaagcttcccaaactggactcttgcccaagtcggacagaaagtgcactgcgacgtacacttcggcctggtgtgccggaattgggagcaggaaggggttttcaagatgtgttacaattatcgcatacgagttctgtgctgctccgatgaccactgccggggacgggccaccactccacctcccaccacagagctggagaccgctactaccaccaccacccaggctctgttcagtaccccccagcctacatcaagtcccgggctgactcgtgcgcccccagcttcaaccacagcggtgcctacactgagcgagggactgaccagtcctagatatacgtcaacattgggaacagccacaaccggaggcccaaccacaccagcaggatcgacagagcccaccgtccccggcgtcgcaacaagtaccctaccaactcggtcagccctccccggcacaaccggctctttgggtacttggagaccttcgcagccacccaccttggctcccaccacgatggccacctctcgtgctagacccacaggcactgccagcaccgccagcaaggaacccctgactacttctctggcaccaactctgacgagcgagctcagtacgagccaagctgagacctctactccgcgaacagaaacaaccatgtctccactgacgaatactacaacctcccagggcactaccagatgccagccaaaatgtgagtggacggagtggttcgacgttgacttcccaacatcaggtgtcgctggcggcgacatggagaccttcgaaaatattagggctgctggaggaaagatgtgctgggctcctaagtctatagaatgccgcgccgagaattaccctgaggtgtcaatcgaccaagtgggacaggttctcacgtgctctctggaaacaggcctcacttgcaagaacgaggaccagactggacgattcaacatgtgtttcaactacaacgttcgtgtgctgtgctgtgacgattactcacattgtccctctacacctgcaacatcaagcaccgcaaccccctctagtacccccggaactacatggatcttaacaaaacccacaactactgcgaccactactgcatccactggctctacggcaaccccaacatctactctaaggaccgctccaccccccaaggtacttacaaccaccgcgactactccgaccgttacatcctctaaggccacccccagtagcagccctggcacggcaaccgccctgcccgccctccgctccaccgctacaacaccaacagctacaagcgtgacccctatcccatccagtagtctgggaacaacctggactagactctctcagaccacaacgccaactgctacaatgagcactgccaccccgagttctacgcctgagacagcccacacatccacagtcttgaccgccaccgctacaaccacgggagcgaccggttccgtagcgaccccttcttcaacgcccggaacagcccacacaacaaaagtgcccaccactaccaccacgggcttcaccgccactccttcttcatcaccgggcacagcactgacccctcccgtatggataagcacaactaccacaccgactactaggggttctacagtcacccccagttcaatccccggtaccacccataccgccactgtgcttacaaccacgacgactaccgtcgccacaggcagtatggccactccctcttccagtacgcagacctctggaactcccccttcccttacaaccacagccactacgataactgctacaggatctacaaccaatccttcttcaacccctgggacaaccccaattcctcccgtgctgaccacaaccgcgaccacccccgccgcaacttccaatacggtgactccaagctctgccttaggtaccactcatactcctcctgtaccgaatacaatggctaccacccacgggcggtctttgccgcctagtagccctcacacagtgcggaccgcatggacatctgccacaagtggcatcctgggcactacgcatataaccgaaccatctacagtcacatctcataccctggcggccaccacaggcacaacccaacatagtaccccagcactgtcctctccacaccctagttctcggaccacggagagccctcccagccctggtactaccactccaggccacaccaccgctacgtcacgtactacggccacggctaccccatctaaaacacgcacctcaactctgctgccgtcctcccccacatcagctccgatcaccacagtggtgacaatgggttgcgaaccccaatgcgcctggtcagagtggctcgactacagctatcccatgccagggccgtctgggggcgacttcgacacatacagtaatattcgcgcagccgggggtgctgtgtgtgaacagccactcggtcttgagtgtagggcacaggcccaacccggggtgccacttagagagctgggccaggtagtagagtgttctctggactttggcctggtctgcagaaatcgggaacaggtgggaaaatttaaaatgtgcttcaattatgagataagagtcttctgttgcaactacgggcactgccctagtactccagccacttcctctacggcgatgcccagctctacacctggcaccacctggatcctgaccgagttaacaacaactgcaaccactacagagtctacgggctccaccgccacaccttcttccacaccagccaccgccggtacccctcacgttagcactactgctactacacctactgtgacctcaagtaaggccaccccatttagctcgcccggcaccgcaacagcccttccagctctgaggtcaactgcaacaacaccgactgctacctctttcactgccattccgtctagctccctgggaactacatggacaagactttctcagacaaccactccaaccgctaccatgtctactgcaactccaagttcgactcccgagaccgtgcatacatctacagtgttgaccacgacagccaccaccactggcgccactgggtccgtggccacaccctccagtacacccggaacagcccacactaccaaagttttgacgacaacaaccactggctttaccgccacgccttctagcagcccaggaaccgcccgcactttacccgtctggataagcacaaccacaacacccactacaaggggcagcacggtgactccatccagcatacctggcactacccatactcctaccgtattgaccaccacaaccaccacagtggccacaggctcgatggccaccccctccagctccacccagacgagcggcactccaccatcccttaccactactgctactacaatcaccgcaacagggtcaactacaaacccttccagcacccctggaaccacccccattcccccagtgcttactacgacggccaccacacccgccgccacgagctctaccgtcacaccgagctcagcactggggactacccatactccccccgtacccaatactactgccacaacgcacggccgatccctgtctccttcttccccacataccgtgcggacagcttggacctcagccaccagcggaacacttgggaccactcatatcaccgaacccagtactggcacctcccatacaccagctgcaacaactggaaccactcaacatagcaccccagctctgagcagtccccatccttcaagccggaccacagagagtccacctagccccggcactacaactcccggacacactcgagccacctccagaaccacagccacggcgacacctagcaagactcggacaagcactctcctgccttcttcaccaacaagtgcaccaataacaacagtggtcacgatgggatgcgagccccagtgcgcttggagcgagtggttggactacagctaccccatgcctggtccctctgggggggatttcgatacttactctaatatccgagccgcaggcggggccgtgtgcgagcagcccctgggactcgaatgcagggcacaggcccagcctggggtgccacttagggagctcggacaggttgtggagtgcagcctggatttcggcctcgtatgtaggaaccgagaacaggttggtaagttcaagatgtgttttaactatgaaattcgtgtattctgctgcaactatgggcactgtcctagcacccctgctacttcttcgaccgcaactccctccagcacacccggaacaacctggatcctgacagaacagacgaccgccgcgaccacgaccgcgaccactggttccactgccattcccagttccacaccaggaacggcgcccccacccaaggtcctgacttccacggctaccacaccaaccgcaacgagcagcaaggcgacgtctagttcctctccacggaccgcaactaccctgccagtactaacttcgacggctaccaaatctaccgccacaagttttacacccattccaagctttacactaggaacgactgggaccttgccggaacagactaccactcccatggccaccatgtcaacaatccacccttcctctacaccagaaaccacccacacttccactgtcctcacaaccaaggccacgacgacccgggctacctcatcgatgagtacgccaagtagtacacccggcacgacctggatcttaaccgagctgaccaccgcggcaactaccaccgccgctactggacccacagctaccccatctagcactcctggcactacatggatcctgacagagcctagtactaccgcaacggtgaccgttcctaccggcagcaccgcaactgcctcctccaccagggcgaccgccggcacgctcaaagtgttgacctccacggccaccacccccaccgttatcagtagtcgggccactccctcatcatcaccaggtaccgcaactgcattgcccgccctgcgctcgacagccacgacacccaccgccacctcagtgaccgctatcccgtcctcttccctgggcaccgcttggacacggctatctcagacgaccacccctaccgccaccatgagtaccgcaacaccttcctccactccggaaacagttcacacctctactgtgctgacaacgacaacaaccaccactcgagccaccggcagcgtggctactcctagctccaccccaggaacggcacacaccactaaggtccctactaccaccacgacaggcttcaccgcgacaccgtcgtcctccccgggcactgccctcacaccccccgtatggatttctaccaccaccacaccgactaccaggggaagcaccgttaccccatcttctattcccgggaccactcacactgctacagttttgaccactacgactacaactgtggccaccgggtcaatggccaccccaagttcttctactcagacaagtggcacgcctcctagtttgaccacaaccgccacaacaatcactgcaacaggctcaaccaccaacccatcctcgactcctggaactaccccaatcccaccggtgttgaccactacagccactacccctgcagctacatcctcaactgtcaccccctcttctgctctgggcaccacccatacacctcctgtgcctaacaccactgcgaccacacacggccgtagcctgcctcccagcagcccccataccgttagaaccgcgtggacatcagcgacttccgggatacttggaactacacacatcacggagccctcaactgtaacgagtcacactccagccgcgaccacaagcactacacaacacagcaccccggccctgagttcgccacatcccagctctcgcaccactgagagtccaccctcgccaggcactacaacgccagggcacaccagaggcaccagtcgcaccactgccactgctactcccagcaagacccgaaccagcacgctcctgccctcttctccaacgtcagcacccattaccacagtagtcaccactggatgtgagccacagtgtgcctggtccgagtggctggactacagctatcctatgcccgggcccagcggcggcgactttgacacctattccaacatccgcgccgccggtggagctgtctgcgagcagccattaggtctggagtgtcgtgcgcaggctcagccgggtgtgcccctccgcgaactgggccaggtggtagagtgttcccttgactttgggctggtgtgtcggaaccgagaacaggtgggtaagtttaagatgtgttttaactatgagatccgcgtcttttgctgtaactatggccattgcccctccacccctgccaccagttcaacagctactccttcctcaaccccaggcacaacttggattctgacaaagctgacaacaaccgcaactacaacagagagtacggggagtacagcaaccccctcatctacgcctggagcaaccgcaggcactccgcatgttagtacaaccgccaccacacctacggtcacaagctccaaggctacgccgttcagtagccccggcacagctaccgctctgcccgccttacggagtacagcgacgaccccaaccgccacgtcttttacagccattccttctagtagcctggggaccacctggactaggctgtcccagacaaccaccccaaccgccaccatgtcaactgcaaccccgagctcgacaccagagacagcacatactagtacagtgctgaccacaacagccacgaccactcgggccacaggatcagtggctaccccttcttcaacacccgggacggcgcacaccaccaaagtccccacaacaacgactacgggtttcactgtgacgccctcctcttcaccgggcactgcacgcacccccccagtgtggatctccaccaccactacgccaaccacatccggcagcacagtgactccctcatctgttcctggaacaacgcacacaccaacggttcttaccactaccaccacaacagtagccaccggttctatggccactcctagtagtagcactcaaacaagcggtacgccaccaagcctcattacaacggccaccacaatcacagctacagggtccaccactaacccttcttccacgcccgggaccacaccaatacctccagtcttgacgaccaccgctacaacacccgcggccacctcaagcacggtcactccgagctcagcacttggcacaacccacactccacccgtacctaatactacagcgacgactcacggccgaagcctgtcgccctcaagcccgcatacagtgcgcacggcctggacatctgcaacatccggaacactgggcaccacccatataactgaaccatcgaccggaacatcccacacgccagctgcgacaacaggaacaactcagcacagcacgccagcactttcctcaccccatcccagctcaagaactacagagagccctccaagccccgggaccacgacaccgggtcatactaccgcaacaagccggacaactgccacagccactccgtctaaaacccgcaccagtacacttcttccatctagtcccacctctgcacctataacaacagtggtcacaactggatgcgagccacagtgcgcctggagcgaatggctcgattactcatacccgatgcccggaccatcagggggagatttcgatacctattctaacatcagggctgccggcggtgccgtgtgcgagcagccactggggctagagtgtagagcccaggctcagccaggcgtgcccctgggtgagctgggccaggttgtggagtgcagcctcgactttggcctggtctgccgcaaccgcgaacaggttggcaagttcaagatgtgtttcaattacgaaattagggtcttctgctgtaattatggccactgtccctcaacacctgcaactagctccactgcaatgccatcctcaacccccggcaccacctggattctgaccgaactgactacaactgcaacgacgactgcctcaaccggttcgaccgcgacacccagcagcactcccggaactgctcccccacccaaggtgctcacttcacctgcgacaacccctacagccacttcttccaaggcaacgagctcgtcctcacctcggaccgccacaaccctacctgtgcttaccagcaccgccactaaatccaccgctaccagcgtcaccccaatcccaagcagcacactggggacaactgggaccctcccggagcagaccacaaccccagtcgctactatgagcactattcaccccagctctaccccagagaccacgcacacatccactgtcctgaccactaaggctaccacaacccgcgcaactagctccactagcactccgagcagtacccccggtacgacatggattttgacagagctgacgactgccgccacaacaacagctgccacagggcccaccgcaaccccgagctctactcccggtactacatggattttgaccgagctgacaactactgccaccactactgcttcaaccggctcaaccgctacaccgtcaagtactcccggaacaacctggattctgacagaaccctctacaaccgcgaccgtgacggttcctacaggttctacagcaaccgcatcttccacacaggccacagctggtacaccgcatgtttctactacagccaccacccctaccgtgacatcttccaaggcaacaccttcctcctcaccaggcacggcgaccgccctgcccgccctgagatccaccgccactacccctactgccacctcctttactgccattccatcctcgtccttgggcactacgtggactcggctgtcacagactacgacccctacggccacgatgtccacagcaaccccctccagtacaccagaaaccgtccacacgagtactgtgctgaccgccaccgccaccactacaggcgccaccgggagtgtggcaacaccatcatcaacccccggaaccgcgcacactactaaggtacccaccacgacgaccacaggtttcaccgccacaccatcaagcagtcctggtaccgccttgacaccccccgtctggatctcgacgacgacaaccccaacaacgaccacacccacgacctctggtagcacagtgactccttcatctatccctggaactacccacacggcccgcgtgcttactaccacaacgacaactgtggctactggaagcatggctactcccagctcctctacacagacctccggcacacctccttctctgaccaccaccgccacaacgatcaccgctacgggctccacaacaaacccctccagcacgcccggcacgactcccattacccccgtgctgacatctacggcaacaaccccagcagccacatcaagcaaagcaacttcatcgagttctcccagaactgcgacaaccctgcccgttctcacttcgactgcaacaaagagcactgccacctcctttacaccgattcccagcagcacactttggaccacatggactgtccccgcccaaaccacaactcccatgtctaccatgtctacgatccatacttccagcacacctgaaaccacacacactagcaccgtgcttaccactacggcaaccatgactcgggccactaacagtacagccacccctagctccactctgggaaccactcgcatcttgacagagttaactaccacggcaaccacaaccgcagcaacgggttcaaccgcaacactgtcatctactccaggcaccacatggatcctgactgaaccctccactattgctacggtcatggtgccaactggaagtacagctaccgcctcatccaccctcggaacagcacatacccccaaggtcgtaactaccatggccactatgcccaccgccacggcttctacggtcccttcaagcagcactgtggggaccaccagaacccccgcagtgctcccatcttcgctgcccacttttagcgtgagcaccgtgtcttcctcagtgctgacaacgctgcggcccacaggttttccttcttctcactttagcacgccgtgcttttgtcgtgccttcggccagttcttctcacccggcgaagtgatatacaataaaacagaccgagccggctgtcatttctacgctgtgtgcaatcagcactgtgatattgaccgatttcagggggcgtgtcctaccagcccaccacccgtctccagcgcacctttatctagtccgtccccagcacccgggtgtgacaatgctataccccttcggcaagttaatgaaacatggaccctcgaaaactgcactgtggctcgttgtgtgggggacaatcgcgtggtgttattagaccccaaaccagtcgccaatgttacatgcgtgaataagcacctacctatcaaagtttctgaccctagtcagccatgtgactttcactatgaatgcgaatgcatttgctctatgtgggggggcagtcactatagcacatttgacggcaccagttataccttcaggggcaactgtacatatgtccttatgcgggaaattcacgccaggttcggcaacctatctctctatttggacaaccactactgtacagcaagcgctaccgccgccgcagctcgatgtccccgagccctgagcatccattacaaatcgatggatattgtgctgacagtgaccatggtgcacggtaaagaggagggcctgatcttgtttgaccagatacccgtgagtagcggattttccaaaaacggtgtgcttgtctcggtactcggtaccacaacgatgcgcgtggacatacctgcgttgggcgtttctgttacatttaacgggcaggtgttccaagctagactgccttattctttgttccacaacaacaccgaggggcagtgcgggacgtgcacaaataaccagagagatgattgtttgcaacgagatggaacaaccgccgccagttgcaaggacatggctaaaacctggctggtgcctgattctcgtaaagatggctgttgggctccgactggtacccctcctaccgcttccccggcagcaccggtcagcagcacccccaccccgacgccatgtccacctcagccactgtgtgatctcatgcttagccaggtattcgccgaatgtcacaatctcgtccccccaggacccttcttcaacgcttgtatatctgaccattgtcggggccggctggaggtcccatgccagtctctagaggcatacgcggaactgtgccgagcacgaggcgtgtgctccgactggcggggcgcaacaggcggactgtgcgacctcacctgcccccccacgaaagtgtataaaccttgcggcccaatccagcctgcaacgtgcaactcccgcaaccaatccccccaactggaggggatggcagaggggtgcttttgccccgaggaccaaattcttttcaacgcccatatggggatctgcgtgcaagcgtgtccctgcgtgggcccagatgggtttccgaagtttccgggagagcggtgggtctccaactgccagtcatgcgtatgtgatgagggaagcgtctcagtgcagtgtaagcctctcccgtgcgacgcacaaggccagccccctccgtgcaaccgacccggcttcgtgacagtcacccggccacgggcggagaatccatgctgtccagaaactgtgtgcgtctgcaacaccactacatgcccgcagagcctgcccgtctgcccccctggccaagaaagtatttgcacccaggaggagggggactgttgtcccacatttcgctgtagaccgcagttatgctcttacaatggaactttttatggagtcggggccactttcccgggggccctgccatgtcatatgtgtacctgtctttccggagacacccaggatcccacggttcagtgccaggaagatgcctgcaacaacaccacctgtccccaaggtttcgaatataagagagtggctggacaatgctgtggagagtgcgtccagaccgcatgcttgactcccgatggtcagcctgtgcaattgaatgaaacatgggtaaactcccacgtggacaattgtacggtgtacctctgtgaggctgaggggggcgtacatctactcaccccacagcctgcctcttgtcccgatgtgagttcatgtcggggctcgctaagaaagaccggatgctgctacagctgtgaagaggactcctgccaagtgcgaattaacacaactattctttggcaccaggggtgcgagaccgaagtgaatataacattctgcgaaggttcttgccccggagccagtaaatacagcgctgaggcacaagcaatgcagcatcagtgcacctgctgccaggagagaagagtgcatgaagaaaccgtgccactgcattgtcccaacggcagcgctattctgcatacctatacccatgtcgacgaatgtgggtgcacccctttctgcgtaccagctccgatggcaccacctcacaccaggggttttccagcccaggaggccaccgccgtctag

SEQ ID NO: 124937 - DNA, 16587 bp, Artificial Sequence
  Description of Artificial Sequence: Synthetic coding sequence
gcgcccaggatgggtgctccatccgcatgccgcactctagtcttggctcttgccgctatgcttgttgttccgcaggctggcaagtccccacctcttagacctctcagtcggaattctggggctggactcgatggaggagcgccaacctcctcaccaacccgcagagtcagctttgttccacctgtaacagtgtttcctagtctatcacgaaaacaaatgctcccccttcccgcgggcaaaggcgtcttcgcttccccgaaaggaggagggccagatctgggagtacaattgcccccagctctgaatccagctcacaacggtcgcgtgtgtagtacatggggagatttccactacaaaacttttgacggtgatgtgttcagatttccaggactgtgtaactacgtgttttccgaacattgccgagcggcctatgaggacttcaacgtccagctgcgtaggggcctcgtggggagccgtcctgtagtgacaagggtggttatcaaagcgcagggactagtgcttgaggcttcgaatggcagtgtcctaatcaacgggcagcgcgaggagctgccttactcacgaaccggcttactcgtagagcagagcggcgactatatcaaggtcagcattagactggtgttgactttcctctggaatggggaagactctgccttgcttgagctggaccctaagtatgctaatcagacctgcggactttgcggagacttcaacggtcttccggccttcaacgagttctacgcccacaacgctcgcttgaccccccttcagtttggcaacctgcagaaactggatggccccactgaacaatgccctgatcctctgccactgcctgctggtaactgtactgatgaagagggtatctgccatagaaccctcctaggccccgcttttgctgaatgccacgctctagtggactcgacagcctatctggccgcttgtgcacaggatctatgccggtgtcccacctgcccttgcgccaccttcgtggaatatagtcggcaatgcgcgcacgctggtggtcagccacgcaattggcgttgtccagagttgtgcccccgcacttgccctttaaacatgcagcatcaagaatgcgggagcccctgtactgatacttgcagtaacccccaaagggcgcagctgtgtgaggatcattgcgtcgacggatgtttttgcccgccggggcggtcatgtaccgttttggacgatattacgcacagtggatgcctgcctctaggacagtgtccttgtacccacggaggtaggacgtactcccctggaactagtttcaacacgacctgtagcagctgcacctgctcgggcgggctttggcagtgtcaggatctcccttgtccaggcacctgtagcgtgcaggggggggcgcatatctcaacgtatgacgagaagctgtacgaccttcatggggactgtagctatgtgttgagcaagaagtgcgccgattcatctttcacagtactggcagagctacgcaaatgtggactgaccgataacgagaactgtttgaaagctgtcactctgtctttggatggcggagacaccgccatccgggtacaggccgacgggggcgtgttccttaatagtatttacacacaactgcccctgtccgccgccaatattactttgttcacgccttcgagtttctttattgtcgttcagacaggcctgggtctgcagttacttgtgcagctggttcccctgatgcaggtttttgtgcgactggatcctgcccatcagggccagatgtgcggactgtgtggcaatttcaaccaaaaccaggccgacgatttcacagccctgtccggcgtggtcgaggccaccggcgctgcatttgcaaatacatggaaagcccaagccgcctgtgcgaatgctcgcaattctttcgaggacccttgttctctgagcgtcgaaaatgaaaattacgctcgccattggtgcagtcgtttgactgaccctaactccgcattttccaggtgccactccatcatcaatccaaaaccttttcatagtaactgtatgttcgatacttgtaattgcgagaggtcagaagactgtctctgtgctgccctgtcctcctacgtgcatgcttgcgctgccaagggggtccaactgtctgattggcgcgatggagtgtgtaccaagtatatgcaaaactgccctaagtcccaacgctacgcctatgtagtggacgcctgtcagccgacctgtcggggcttgagtgaagccgatgtgacttgtagcgtctctttcgttcctgtggatggctgtacttgccctgcaggtacgttcctcaacgacgccggggcatgcgtgccggcccaggagtgtccttgttacgcccatggcaccgtgctggctcccggcgaggtcgtgcacgacgaaggtgccgtctgctcctgcactgggggaaagctttcctgtctgggggcttctcttcaaaaatccactggctgcgcagcacccatggtgtacctggactgctcaaatagcagtgctggcacacccggtgccgagtgccttagaagttgccacaccctggatgtcgggtgtttctctactcattgtgtatccggttgcgtgtgtccgcccggattggtgtccgatggctcaggaggatgcattgcagaggaggactgcccctgtgttcataatgaggctacttacaaaccaggcgagactatcagggttgactgcaacacttgtacttgtaggaaccgacgctgggaatgttctcacaggctctgcctggggacctgtgtcgcctacggcgatggacatttcattacgttcgatggagaccggtacagcttcgaaggctcctgcgagtatatcctggcgcaggactactgtggagacaacaccacccatgggacattccgaattgttacagagaatattccatgtgggacaactggaactacctgttctaaggccattaaactttttgtggaggtgaggaccgcccccgccgtctctacccctgacccagccgcaaatgagccagctccccgcgaggcttccgtgggtttccgacagagactgccaccccttcagtcctacgagctaatcttacaagaagggacgttcaaagccgtcgctcgcggaccagggggtgaccctccctataaaatcagatatatggggatctttctggttattgaaacacacggtatggcggtaagctgggacagaaaaacttctgtcttcattcgacttcatcaggattacaagggaagagtttgcggcctctgcggcaattttgacgacaacgctatcaacgattttgctaccagaagccgatcagtggttggtgatgccctggagtttgggaacagctggaaactttcaccctcctgtcctgatgccctcgcccctaaggacccctgtactgccaatccattcagaaagtcatgggctcagaagcaatgttcaatccttcacggacccaccttcgcggcctgtagatctcaggtggacagcaccaagtactacgaagcgtgcgtcaacgacgcctgcgcatgtgactcagggggagactgcgaatgcttctgtacggctgtagccgcctatgcccaggcgtgccacgacgccggcctttgcgtgagctggagaacaccagacacttgtcctctgttttgtgatttctataatcctcacggaggctgtgagtggcattatcaaccgtgcggagccccatgtctgaagacttgcaggaaccctagcggtcactgcctagtcgatcttcctggtctggagggatgttacccaaaatgccctccgtcacagccattcttcaacgaggaccaaatgaaatgtgtcgcccagtgtggctgctatgacaaagatggcaactactacgacgtaggagctcgggtgcccacagccgagaattgccaatcatgtaattgtacaccgtccgggatccagtgcgcacacagcctcgaggcttgcacgtgcacctatgaggataggacatattcctaccaggacgtgatttacaacacgactgatggccttggtgcatgtctgatcgcaatttgtggaagcaacggtactattatcaggaaggccgtggcatgtcccggcactcccgccaccactccctttaccttcaccacagcctgggtgccacactctaccactagtcccgctctccccgtctcaactgtctgtgtgagggaagtgtgtaggtggtcttcttggtacaacggccacaggcctgagccaggactcggaggtggagacttcgagacctttgaaaacctccggcagcggggctaccaggtctgtccagtccttgcagatattgagtgtcgagcagcacagctcccggatatgcccctcgaggaattaggacagcaggtcgactgtgatcggatgcgcgggctgatgtgcgccaacagtcagcagagcccgccattgtgccatgattacgagcttagggtgctgtgttgtgagtacgtgccctgcggcccctcccctgcacccggtacaagccctcagccatctttatccgcttccactgaacccgccgtgcccacccccactcaaaccaccgctaccgagaaaaccacactgtgggttactccttcaatcaggagcactgccgctctgacctcgcagaccggaagttcaagcggtccggttaccgtaacaccttccgcccctgggactacgacctgtcaacctcgctgtcagtggaccgagtggtttgatgaagattaccctaagagtgaacagctgggaggagatgtggaaagctatgacaaaattagggctgccggaggacacctgtgtcagcagcctaaggacattgaatgtcaagcggagtccttccctaactggacccttgctcaggtgggacaaaaggtgcactgtgacgtgcatttcggactggtgtgtcggaattgggagcaggagggcgtcttcaaaatgtgttataactacagaatccgcgtcctgtgctgttcagatgaccactgcagaggccgggccacaacccctccccctaccaccgaactagaaacagctacaacgactacgacacaagccttgtttagtaccccccagcctacgtcttccccaggcctcacaagagcaccacctgccagcacgaccgctgtaccaacactatctgaaggactgacctcccctaggtatacttcaacacttggcaccgcgacaacaggcggtccaacaaccccagccggtagcacggagccaacggtgccaggcgtggcaacatccactctccccacaagaagtgctctgcccggtacaactggctctttgggcacatggagaccatctcagcccccaaccctggccccgacaactatggcaacctcacgggcacgccccactggaacagcatcaaccgcatccaaagagcccctcacaacctccctggcacctacgctaacctccgagttatctacatcccaagctgagacatctacaccacgtactgaaacaactatgtctcctcttacaaacacaacgacttcacaggggactacgcgatgccagccaaagtgtgagtggaccgagtggttcgatgtggacttccctacatccggggtggccggaggagacatggagaccttcgagaacatacgcgcggccgggggcaagatgtgctgggcaccaaagagcatcgaatgtcgcgccgagaattaccccgaagtgagtatagaccaagtgggacaggttctgacttgcagcctggagacagggctgacttgcaagaacgaggaccagacagggaggttcaacatgtgcttcaactataacgtgcgggtgctgtgctgcgacgattattcacactgcccgtccacaccagccaccagtagtactgccactcccagttcaacgcctgggaccacctggattctgactaaacccacaacgacagcgaccacgacagcctccaccggctcaacagccacgccaacttccaccttacgcacagcccccccaccaaaggttctgacgacaactgccactactccaacagtcacatcgagtaaagcaactccatcgtcgtccccaggaactgcgaccgcgctgccggctttgaggagcaccgctactacaccgacagcaaccagcgttaccccaatccccagctcatcactgggaactacatggacacggctgtctcagaccacaacccccactgccaccatgagcaccgccacacctagcagcacccccgagaccgcccacacatccaccgtactgactgcaacggctaccacaactggcgctaccgggtctgtggccactccttccagcacgcccgggacggcgcacaccaccaaagtgcccactaccaccacgacaggatttaccgcaacaccttcgtcaagtccaggtaccgcattaacacctccagtttggatctctacgacaacaacgccaacaactagaggcagcactgtgaccccctcctcaataccagggacaacacacaccgccaccgttctcaccaccacaacgacaacagtggccaccggctcgatggcgacaccaagctcgagcacccagaccagcggcaccacgcatacaccaccagtgccgaatacaatggctacaactcacgggagatccttgcctcccagctcaccacacaccgtgcggactgcgtggacctcggcaacttctggtattctcggtactacacacatcaccgagccatccacggtaacttctcatacactggccgctaccaccggaactacccagcacagtacacccgcattaagtagtcctcatcctagctctcggacaacagagtctccacccagccccgggacgacaactccaggccacactacagctacctctcggaccacagctaccgccaccccttccaaaacaagaacgagcactcttttgccatcttcccctaccagtgctccgatcacaacggttgtgacaatgggctgtgagccccagtgtgcatggtcagaatggttggactatagctaccccatgccaggtccctccggaggagattttgatacctacagcaacataagggctgctggtggagccgtgtgtgaacagccactgggacttgagtgtcgcgctcaggcccagcccggcgtgccactgagagaactgggtcaggttgttgagtgttctctggatttcggtttagtgtgtcggaaccgggagcaagtcggaaagttcaaaatgtgtttcaattacgaaatccgcgtgttctgttgtaactacggtcactgtccatccacacccgcaacaagctccacggcaatgccgagctccactccaggtaccacttggattcttaccgagcttacaactaccgcgaccaccacggagtcaactgggtcgacggccacgcccagtagcacgcctggaacaacctggatcctgacagagcctagcacaactgccaccgttaccgtgcccacgggctctaccgcaactgcaagtagcacacaggcgacggccggcaccccccacgtgtccaccactgccacgactccaaccgttacctccagcaaggccactcctttttcatccccagggaccgcaacggcactgccagcattaagatccaccgccacaactcccacagccacctcgtttacagctatcccttccagctcattaggcactacatggaccaggctgagccaaaccacgaccccaaccgccactatgtcaacagccaccccctcctctaccccggagactgtgcatacgagcacagtactaacaaccactgccaccactactggcgcaaccggctcggtcgccactccgagcagcactcccggcacagctcatacgaccaaagtgcttacaacaactacaaccggatttacagcgacaccctcctcctctccgggcaccgcccgtaccctgcccgtgtggatctccactacaacaacccccacgacgagaggttccacggttacaccctcaagtattccaggcactactcatacacccaccgtgcttactactaccactacaactgtggccactgggtcaatggctacccctagttcctccacccagactagcggcaccacccacacaccgcccgtgcctaacaccactgccactacacacggtaggtccttaagtccatcctccccacacaccgtaaggaccgcctggacttctgcaacatctggaacattaggcactacacacattaccgagccgtccaccgggacaagccataccccagccgccaccaccggcactacacagcatagtacccctgccctgtctagcccacacccatcatccagaacgaccgagtctcccccttccccgggcacaactacacctgggcacacccgggccacatcaaggacgacagctacagccacccctagtaagacccggacctctacgctgctccctagtagccctacaagtgctcctataacaactgtagtcaccatgggctgtgaaccacagtgtgcctggtctgagtggctcgattatagctatcccatgcccggcccgagcggcggggacttcgatacctattctaacatacgggctgccggcggcgccgtgtgcgaacaacctcttgggttggaatgtcgggcccaggcgcaacccggcgtgcctcttagagaactgggtcaggtggtcgaatgttccctcgactttggcctagtttgtcgcaacagggaacaggtgggtaagttcaagatgtgctttaattacgagattcgggttttctgctgcaattatggccactgcccttcgacacctgctaccagctcgaccgccactcctagttcaactcccggaactacgtggattctgactgagcaaaccaccgccgctacaacaacagcgacaaccggtagcaccgccattccctcgagtacacccggcactgcccctcctccaaaagtgttaaccagcactgccacgacccccacagcgactagtagcaaggcaaccagcagttcgtcacccagaaccgctaccactcttcccgtgctgacaagcactgccaccaaaagtacggccacatccttcacgcctatcccgtcattcaccttgggtacgacaggaaccttgccagagcaaactaccacccctatggccaccatgagcaccatacatccttcctctacccctgagactactcacacctctacagtcctgaccaccaaggccactacaacacgcgccacatcttcgatgtctacgccctcttccacacccggcacaacctggatcctcaccgaattgacaactgccgccacaactacggctgccaccggaccgactgccacacccagcagtacccccgggaccacctggattctcacagaaccatcaacaacagccacagtcaccgtgcccaccggtagcacagctactgcttcttcgacacgggctacagctggaacccttaaagtgctgacttctaccgcaactaccccgaccgtaatctccagccgggctacgccttcctccagccccgggactgctacagcactacctgccctccggtccacagccaccactcctaccgccacaagcgtaacagctatccctagtagttcactggggaccgcttggactaggctcagccagactacgactccaactgccactatgtcgactgctacaccttcatccactcccgagactgtgcacacctcaactgttcttaccactactactacaaccaccagggcaaccggatccgttgccacaccgtccagtacccccggtactgctcacactacgaaagtgccgacaactacaactactggattcactgccaccccgagctcatcccccggcaccgcactcacacctccagtttggatatccactacaacaactccgacaacacgcggttcaacggtcaccccctccagcatcccaggcacgactcatacagctacagtcttgacaacgacaactaccacggttgctacaggtagcatggcaacaccatcctcctccacgcagactagcggtacaactcacacaccccccgttccaaacacaacagctactactcacggtcgatccttgccccctagttccccccacacggtgagaaccgcctggacaagcgccacgagcgggatcctgggcactactcacattacggagccttctactgttacatcgcacacccccgcagccaccacttcaactacacagcactctacacccgccctctctagtccgcacccttcttcacgcactacagaatcaccaccttccccaggtacgaccacaccagggcacactagggggacaagcaggacgacagcgaccgccactccttctaagacaaggacctccaccctgctgccaagttctcccacaagtgccccgatcaccacggttgtcactactggttgtgaaccacaatgcgcatggtccgaatggcttgattattcatatcctatgccaggaccaagtggtggggatttcgacacttactcaaacatcagggctgcggggggtgctgtgtgcgagcagccgctggggctggagtgccgagcccaagcccaacccggcgtacctctgcgcgagctaggacaggtggtcgagtgctccctcgatttcggactggtatgcaggaacagagagcaggtgggcaaatttaaaatgtgtttcaactacgagatcagagttttctgctgcaactatggtcactgtccatctacacctgccactagtagcaccgccaccccctcaagcacccctggcaccacatggatactgaccaagctgactactaccgccactacgactgagtcaacaggctcaacggccacgccctcatcaacaccaggaactacttggattctgaccgaaccgtctacaactgccacagtgactgtgccaaccgggtctacagccacggcaagctccacacaagcaacagctggaacgccgcatgtgtctactacggccacaactccaaccgttacctcaagtaaggctacaccattttcctctcccggtaccgcaactgctttgcctgctctgaggtctacagccaccacacccactgctacttcgtttacagcaatcccctcctcatcactgggaaccacctggacccggctgtcccagacaactacccccacagccacgatgagtaccgcgaccccttccagtacaccggagacagcccacacaagtaccgtgctaactactactgctaccaccacacgtgccaccgggtctgtagctacacctagttcgacccccggaacagcacacacaactaaagtgcctacgacgaccacgacaggctttacagtcaccccctccagtagccccggtactgcgcgaactcctcccgtctggataagtactactacgacccctaccaccagcggttctaccgtgactccatcttcagtcccaggcacaacacacacacccacagtgctgacaacgacaacgactactgtcgccacaggcagtatggcgacgcccagttcctcaacacagacaagtggcaccactcatacccctccggtacctaataccaccgctacgactcatggcaggagtctgagcccttcaagccctcatacagtgcggactgcctggacctccgccacttctggcaccttgggtacaactcatatcaccgagcctagcaccgggacgtcccacacacctgccgcgactacagggaccactcaacattccacccctgcattgtcctcaccccatccaagtagcagaacgaccgaatctccacctagtcccgggaccacaactcccggtcacaccactgccacaagtagaacaacagccactgccaccccatcaaagactaggacgtctaccctcctgccctcatcgcctaccagcgcccctatcacgaccgttgttaccaccggttgcgaaccacagtgcgcatggagcgaatggctggattattcttatcctatgcccggtcccagtgggggagatttcgacacatatagcaatatccgcgcagccggcggcgccgtctgtgagcagccgctgggtttggaatgccgggcccaagcccagccgggggtcccgttgggtgaactgggtcaggtcgtggagtgctctctggacttcggattggtgtgccgcaatcgagagcaggtggggaaattcaaaatgtgtttcaattacgaaatcagagtgttctgctgcaactacggacattgtccaagcaccccagctactagctctaccgccatgcccagctcaacgccaggcacaacatggattctgaccgaactcactactaccgcaacaaccaccgccagcactggatcaactgcaaccccgtcatcaaccccaggaaccgcaccccctccaaaggtgctgacatctccagccacaacccctacggccacctcgtctaaggccacctcctcttcatctccaagaacggccaccacactcccagtgctgacatccaccgcgaccaaaagtactgcaacttccgtcaccccaatcccaagctcaactctgggaaccactggaacacttcctgagcagaccacaacacccgtagctacaatgtcgacgattcatccgtcttctacgcctgagactacgcatacttcaacagtacttactaccaaagcaactaccacgcgcgcaacatcctctacctctactccctcgagtacgccaggcactacttggatcttgacagagttgaccacggcagcaaccacgacagcagccactgggccaactgctactccgtcttcgactcccggaacaacatggattctgacggaactaacaaccacagccaccaccactgccagcaccggttccacagcaacgcctagttccacaccaggcacaacctggatcctgaccgaaccatccacaaccgccaccgttacggtccccactgggtctactgctaccgcctcaagtactcaagccacggctggcaccccccatgttagcacgacggcaactacgcctacagtgacttccagcaaggccacgcccagctcttcccccgggaccgcaacggctctgccagctttgcgcagtactgccacaactcccaccgccacttcatttacagccatccccagttccagtcttggcaccacctggactcggttgtctcagaccacaacaccaacggccaccatgtctacggccactccatcctcaactccagaaactgtccacacttccacagtgttgaccgcaacagctaccaccactggagcaacaggctctgtagccactcccagttctacccccggcaccgcacacacaaccaaggtgccaacgactaccacaacggggtttacagccactccctcttcctctcctggcacagccctcacccccccgaccacaacgccaatgagcactatgtctacgattcacaccagttctacacccgaaactacccatacttccacggtactaaccactacagcgactatgaccagagctacaaatagtaccgccacaccgtcttcaacgctcgggacaacacggatcctgactgagttgacaacaaccgcgacaactacggccgcaaccggatccacagccaccttgagttctacccccggcaccacgtggatacttactgaaccttctacaattgccactgttatggtgcctaccggttccaccgccacggcctcctctactctcggaacggcacatacacccaaggtggtcaccaccatggccactatgcctaccgctaccgcttcaacagtgcctagcagttctaccgtgggaacaacacggactccagcagtcctgccttcatccttgcctacctttagtgtatcgaccgtatcctcatccgttttgacaaccctgcgccccactgggttcccaagctcacactttagcacaccttgcttttgtcgggcattcgggcagttcttctcccccggggaagtgatctacaacaagacagacagggcaggatgccacttctatgcggtttgcaaccaacattgcgatatcgatcgatttcagggagcttgtcccacttctccccctcccgtgtcttccgcgccactgtcgtccccttctcctgcaccaggttgcgataatgcaattccattgcgccaggtcaatgaaacctggactcttgaaaactgcacggttgccaggtgtgtcggagataatcgagtggtgttgttggaccccaagcccgtcgctaacgttacttgcgtcaataagcatctgccgataaaagtgagcgaccctagtcagccctgtgatttccactacgagtgtgaatgtgagtgcgtgggaggccggggcattacccctggagccggtatttgctccatgtgggggggaagtcattattccacgttcgatgggacctcctataccttcagagggaattgtacctacgtcctcatgcgcgagattcacgcccgctttggcaacctgtccctgtatcttgacaaccattactgcactgctagcgccacagccgccgcagcccgttgcccacgtgcgctttctatacactataagtcaatggatattgttctgaccgtcaccatggtgcacggtaaagaagaggggctcatactcttcgaccagattcccgtctcgagtggcttctccaagaatggagtactggtttctgtacttgggacaactacaatgcgggtcgacattcccgctctgggtgtgagtgtcacattcaatggccaagtctttcaggccagactcccttacagtctatttcacaacaacactgaaggtcagtgcggaacctgcacgaacaatcagcgtgacgactgtctccagcgagatgggaccacagctgcctcatgcaaggacatggcaaagacttggttggtgcctgattccagaaaagatggctgttgggcgcccactggaaccccacccaccgcctctcccgccgcccctgtgtcttcaacacctacccctacaccctgccctccccagcctctgtgtgatctgatgctgtcccaggtgtttgccgaatgtcacaatttagtgccccccggaccatttttcaacgcgtgtattagcgatcactgcaggggtcggctagaggtcccttgccagagtctcgaagcctacgccgagttgtgcagagcgcgaggagtgtgttcagattggcggggcgcaactgggggcctttgtgatctaacatgcccccccacaaaggtgtataaaccatgcggcccaatacaaccagcaacatgtaactctcggaaccagagcccccagctcgagggcatggctgaagggtgcttctgcccagaagatcagatcctcttcaatgctcacatgggcatttgtgtccaagcctgcccatgtgttgggcccgatgggtttccaaaattccccggtgagaggtgggtaagcaattgccagtcctgcgtatgtgacgagggcagcgttagtgtgcaatgcaagcctctaccctgcgatgcccagggacaacctcctccatgcaacagaccggggtttgtgaccgttacaaggccaagggccgagaatccttgttgccccgaaactgtctgcgtgtgtaatactaccacatgcccacagagccttcccgtgtgccccccagggcaggagagcatctgtacccaggaggagggggattgttgcccaactttcagatgcaggccccagctgtgctcatacaacggaaccttctatggtgtgggcgccacctttccaggagccctgccctgccatatgtgcacgtgtctcagtggcgacactcaggatccaactgtccaatgccaggaagatgcctgcaacaatacaacctgcccgcaggggttcgaatataaaagagtggctgggcagtgttgcggcgaatgcgtccagactgcctgtctgacgcctgatggacagccggtccagctgaacgagacatgggtgaatagccacgtcgacaactgtaccgtgtacctctgtgaagcagaaggcggggtgcaccttctgacgccacagccggccagctgcccggacgttagttcttgccgaggtagcctgcggaaaaccggctgttgctactcgtgtgaagaggattcatgtcaggtgcgcattaatactacgattttgtggcatcaaggctgcgagactgaagtcaatatcaccttttgcgaaggttcctgccctggcgcgtccaagtatagcgccgaagctcaggccatgcagcaccaatgcacctgttgtcaggaacgccgggtgcatgaggaaacagttcctctgcattgccccaatggatccgctattctgcatacttacacccacgcggtgcaagtactgtgtggtctccttgcgtggggcctgcaggccggggggcatatcaggggcgctgtccaagatccacagcagcctctcaaggaccaagaggcatcagggaaggcgcgccagggcgggggctaccgacaaacagtggcctggggtgataagtccaacgctcgggcatggttacaaaagcccgtggtttgggtacagtccggtgctttcccaactccaggtcccgcttcggccctgtgcccatggtag

SEQ ID NO: 124938 - DNA, 17298 bp, Artificial Sequence
  Description of Artificial Sequence: Synthetic coding sequence
atgggtgcaccaagcgcgtgccgaacgcttgtacttgccctggccgcaatgctagttgttcctcaggccgaaacccagggcccagtcgaaccctcatgggagaacgctggacacactatggacgggggggcccccacgagttcgccaacaaggcgagtctcgtttgtaccacctgtgacggttttccccagcctgagtcctctgaatccagctcataatggccgcgtctgttccacctggggagattttcactacaaaacgtttgacggcgatgtcttccgattccccggactgtgcaattacgtgttctctgagcactgcagagcagcctacgaggacttcaatgtgcagttgagacgcggcctggttggcagtaggcccgtggttactcgagtagtgatcaaagcccagggcctggtccttgaagcgagcaatggcagcgtcctgatcaatggccagcgcgaggagttaccttactcgaggaccggcctgctggtggagcaatcgggcgactacataaaagttagcatccgactggttctcaccttcctgtggaatggagaggacagtgcacttctcgaattggacccaaagtatgccaatcagacctgtgggctgtgcggcgacttcaacggtctaccggctttcaatgagttctacgctcacaatgctaggctcacgcctctccagttcggaaatctccagaagctagacggacccactgagcaatgcccagatccactacctctgcccgctgggaactgcacagacgaggaggggatctgtcataggaccctacttggacctgccttcgctgaatgccacgccctggttgacagcacggcttatctggcggcctgcgcccaggacctctgcagatgccctacatgcccttgtgctacattcgtagaatactcccggcagtgtgctcatgccggagggcagccacgtaactggaggtgccctgagctttgtccacgtacctgccccctgaatatgcagcatcaggagtgcggctctccttgcaccgacacatgtagcaatcctcagagagcgcaattgtgcgaagaccactgcgtggacggatgcttctgtccccccggcagaagttgcaccgttttagacgacatcactcacagcggttgtctgcccctgggacagtgtccatgcactcatggcggacgcacttattcaccaggtactagctttaacactacctgctcttcttgtacgtgttcaggaggactctggcaatgccaagatttaccttgtccgggtacatgcagcgtccaggggggagcacacatttccacttatgatgagaaactttatgatttgcatggagattgctcctatgtgctctctaagaaatgtgctgactcctccttcactgtgctcgctgagctgaggaaatgcggcctgacagacaacgagaactgtctgaaggctgtaaccctatctctggacggcggagacacagccatcagagtgcaagccgacggtggggtttttttaaactcaatttacacccaactgcctctttccgcagccaacatcaccctatttaccccgtcaagttttttcattgtagtccagaccgggctgggtctgcagttgctcgtacagcttgtacctctaatgcaggtatttgtgcgtttggatcctgctcaccagggccaaatgtgcggcctctgcggtaatttcaaccagaaccaggccgacgattttacagctctctcaggtgtggtcgaggccaccggtgcagcctttgcaaacacttggaaggcccaggcagcttgtgcaaacgctcgcaattcctttgaggacccttgcagcctgagtgtagagaacgaaaactatgcacggcactggtgcagccgcctgacagatccaaacagcgcgttcagtcggtgtcatagcattatcaacccgaagcccttccattctaattgtatgttcgatacttgcaattgcgaacgctccgaagactgcctgtgcgccgcactgagctcctacgtgcacgcctgcgctgctaagggtgtgcagctgagcgattggagagatggtgtttgtacgaaatacatgcagaactgccccaagagtcagcgatatgcatatgttgtcgatgcatgtcagcccacttgtcggggcctcagcgaggctgatgtgacttgtagcgtgagcttcgtcccagtggatggatgtacttgtccggcgggcactttcctgaatgatgccggggcatgcgtccctgcccaagaatgtccatgttacgcccatgggaccgtcctggcacctggcgaggtggtacatgacgaaggcgcagtctgctcctgcacggggggcaagctgtcttgcctgggtgcgtctctgcaaaagtcaactgggtgcgctgcccccatggtgtatctcgactgctcaaatagcagtgccggtacaccaggagccgaatgcctgaggagttgtcacactctggatgtgggctgtttctctacccattgcgtatccgggtgtgtgtgtccacccggcctggtgtccgacggctccggtggttgtatagctgaggaagattgcccctgtgtgcacaatgaagctacgtacaagccaggagaaaccattcgcgtggattgcaatacatgcacatgccggaaccgaagatgggaatgttctcacaggttgtgtctgggcacgtgcgtggcctatggtgacggccactttatcacatttgatggtgacaggtatagttttgaaggaagctgcgagtatatcctcgcacaggattattgtggggacaacacgacccacggtactttcagaatcgtgacagagaacatcccatgcggtacgacaggaaccacctgtagtaaagccattaagttgttcgttgagtcatatgaactgatactgcaagaaggcacatttaaggccgtcgccaggggtccaggaggggatccaccctacaaaataaggtatatgggcattttcctggtgatcgaaacccacggcatggcggttagctgggacagaaagacctccgtgttcattagattgcatcaagactataagggtcgcgtttgcgggctttgtgggaatttcgatgataacgcaattaacgactttgcaacacgctctaggtcggtggtgggcgacgccctcgagttcgggaattcctggaagcttagcccttcctgccccgatgccctcgcacctaaagacccctgcacagcaaatccattccggaaaagctgggcccagaaacagtgcagcattctgcatggtcctactttcgctgcctgccggtcacaggtggacagcactaaatattatgaggcttgcgtcaatgatgcgtgcgcatgtgactccgggggcgactgtgaatgtttctgcaccgccgtggccgcctacgctcaggcatgccacgatgccggcttatgtgtgagttggaggactcctgatacatgcccactgttctgcgatttctataacccacacggcgggtgtgagtggcattaccagccatgtggggctccctgccttaaaacatgtcggaacccttcaggacattgtctggtagacttgcccggactggaggggtgttacccaaaatgccccccatcacagcccttttttaacgaggaccagatgaaatgcgtcgcccagtgcgggtgctatgacaaggacggtaattattacgatgtgggcgcacgggtgcccaccgccgagaattgccagagttgcaactgcactccttcagggattcagtgtgcccactccttagaagcctgcacttgtacttatgaggatcggacctattcttaccaggacgtaatatacaatactacagatgggctgggtgcctgcctgattgccatctgtggcagtaacggaactatcatacggaaagcggtagcatgccctggaactcctgcaacgactccattcactttcactacagcttgggtaccccactctactactagccccgccctgccggtgagcaccgtttgtgtgagagaagtgtgcagatggagttcctggtacaatggtcataggccagagcctggtcttggaggcggcgatttcgagactttcgaaaacttgcgtcaaaggggttaccaagtctgcccagttcttgccgatatagagtgtcgcgcggcacagctaccggacatgccactggaggaactcggccagcaggtggactgtgatcggatgagaggcttaatgtgcgctaattcacagcagtcacccccgctgtgtcatgactatgagctgagagtgttatgttgcgagtatgttccctgtggcccatctccagcacctggcacatcaccacagccttcattgtctgcaagtacagaacctgcagttccaactcccacccaaacgacagcaacagaaaagactaccctgtgggttacaccttcgattaggagcacagccgctctgacgagccagacagggagctcaagcgggccagtgaccgtcacgccatccgcgccgggcaccacaacctgtcaaccgagatgccagtggaccgaatggttcgacgaagactacccaaaatcagaacagttaggcggcgatgttgaatcttacgacaaaattcgagctgcaggcggtcacttatgtcagcagcctaaagatatcgaatgccaggccgagtcttttcctaactggactctggcccaggtcggccaaaaagttcattgtgatgtccacttcggactggtatgcaggaactgggagcaggagggcgtgtttaaaatgtgttacaactacagaattcgggttctatgctgtagtgacgatcattgcagggggagagctaccacccctcctcctacaacagaacttgagactgccaccaccactacaacccaggctctctttagtactccgcagccaactagctctccaggccttactcgggctcctcccgccagtaccaccgccgtgccaaccctgtccgagggacttactagccctcgctacacgagtaccctcggcacggcaactactgggggacccacaacacccgctgggagcaccgagcccacagtcccaggcgtcgctacgagcaccttgcccacccgcagcgccctacccggaacaacgggatcgctgggcacctggaggccttcacagccacctactctggcccctaccactatggcaacatcgagagcccgcccaaccggcacagccagtactgctagcaaggaacccctgaccactagcctggcacctactctcacctctgagctcagcacttcacaagctgagactagtacaccccgtaccgaaactaccatgagtcccctgaccaataccaccacatctcaggggacaaccaggtgccagccaaaatgcgagtggacggaatggtttgacgtagactttcctacctctggcgtcgctggcggcgatatggagacatttgagaacattagggccgctggtggaaagatgtgctgggcacccaaatcaatcgagtgtcgagctgaaaactatcccgaggtgtcaatcgatcaggtgggtcaggttttgacatgcagcctggagaccggtttaacgtgcaagaatgaagatcagacaggccgcttcaacatgtgtttcaactacaacgttagggtgctctgctgtgatgattactcgcactgtccgtccacacccgctacttcaagcactgccactcccagcagcacaccagggactacttggattctgacaaaacctaccaccaccgcaaccacgacagcttcgaccggcagcactgcaaccccgacatccactctgcggaccgcccctccgcccaaggtgttaacgaccaccgctacaacccctactgtgacatcaagcaaggccacaccatcttctagtcctggaaccgctactgcactgccagccttgcgctccacagccaccacccctacagctacaagcgtgactcccatccccagttcttcccttgggactacctggactcggctcagccagaccactactcccacggcaacgatgagtacagcaacccctagctccactccagagaccgcccacacctctaccgtacttacagctacagcaactacaaccggtgctaccggcagcgtggcaacaccaagcagtacaccaggcacagcacataccaccaaggtgcctacaacgacaactaccggctttaccgccactccttcaagttcaccggggacagccttgaccccccccgtgtggatcagtacgacgactacacctacaaccagaggcagtacagtaactccttctagcatccccggaacaacacatactgctaccgtgctaacaacaactaccactactgtcgccactggatcaatggccacaccttcgtcaagcacgcaaacctccggaactccacctagtctaacgactaccgcaacaactatcacagccacaggatcaacgaccaatccatcctctactcccggcacaactcccattcccccagtgttgacaactacggccacgacccctgccgccacaagcaatacagtaacacccagctcagctctgggaactacccacacgcctcccgtccccaacaccatggctactacccacgggagaagcctcccgccgtcgtcaccccataccgttagaacagcttggacttctgctacttccggcatcctgggaactacccatatcacggagccatcaacagtaacatcccacaccttggccgctactacaggcactactcagcacagcaccccagccctcagcagcccacacccctcgtcgcgaaccacagagtcacctccgtcacccggcacaactacccctggccacactacagctacaagccgcacaacagccactgccacgccaagtaaaacccgaactagcaccttgctccctagctcccccacaagtgcccccattacgaccgtggtcaccatgggctgtgagccacagtgcgcttggtccgagtggctggactactcgtaccctatgccggggccgagtgggggggacttcgacacgtattcgaacatccgcgctgcaggaggggccgtatgcgaacaacccttaggcttggagtgccgcgctcaagcccagcctggagtaccactgcgcgagctgggccaggtagtggaatgctcgctcgattttgggcttgtttgtaggaatagagagcaggtggggaaatttaagatgtgcttcaactacgaaatacgagtgttctgctgcaattacgggcactgcccatctacacctgctacctccagcaccgccatgcctagttccaccccagggacaacatggattttgactgagctaacgacgacggcaactactactgagagcaccggcagcactgccacaccaagcagcactccagggactacctggatcttaaccgaacccagcactaccgccacagtcactgtcccaacaggatctacagccacagcatctagcacacaggcgacagccggtactccacatgtgtccaccaccgccacaactccgactgttacttcttcaaaggcaacccctttctcatcacccggcactgccacggcactgcccgccctgcgctcaaccgctactactcccacagcaacatcatttactgctattccgtcctcatcactcggcaccacctggactcggctcagccaaacgacgacccccacagctacaatgagcaccgccacaccttcaagcaccccggaaacagtccatacaagtaccgttctcacgaccaccgcaaccactacgggggctacaggtagcgttgccacccctagctcgaccccaggcaccgcccacaccaccaaggtgctgacgaccaccacgacgggttttacggcaaccccttcctcatctcccggcaccgcccgaacactgcccgtgtggatcagcacaaccacaaccccaacaacccgcggaagtaccgtcacaccaagtagtattccagggactactcacacccctaccgttctgacaacaacaaccacgaccgttgcgacggggagtatggccactccctcttcttccacacaaaccagcggtacacccccaagcttaacgaccacagcaaccacaattaccgcaaccggaagtacgacaaacccttcttcaacccccgggaccaccccgataccgccagtactaacaacgactgccactacacccgccgctacatcttccaccgtaaccccgtcttctgcactgggcactactcataccccccccgtccccaacaccacggcaaccactcacggtcgatccctgagcccttcgagtcctcacaccgtcaggacagcatggactagtgccaccagtgggacactgggcacaactcacatcaccgagccttctacaggtaccagccacactcccgccgctaccactgggactacccaacactctaccccggcactctcatccccacaccctagttctcgtactaccgagagccccccaagtccaggaactaccacccctggccatacacgggcgaccagtaggaccacagctactgctaccccctccaagactcgcacgtctactctgctgccttcttcccccacgtctgcacctatcacgacagtggtcactatgggctgcgagccgcagtgcgcatggtctgagtggctagactatagttatccgatgcccgggccttctgggggagatttcgacacttactctaacattcgcgcagctggcggcgctgtgtgtgagcagcctctaggtctggagtgccgggcacaagcccaacccggggtccctctgagggagctgggacaagtcgtggagtgcagcctcgatttcggtttggtttgcaggaatagggaacaggtgggaaaattcaaaatgtgctttaactatgaaataagggttttctgttgcaattacggccactgtccatctacgcccgcgacaagctccaccgctacaccctcctctacgccaggaacaacttggattctaaccgaacaaaccaccgcagcaaccactacagcgaccaccgggagcaccgcgataccaagctcaacccccgggacagccccccctccaaaggtgctgacttcaacagcgactacgccaacagcaactagttccaaggctacctcctcttcgagcccacggacggcaacaactttaccggtgctaacttccaccgcaaccaagtccacagccactagctttacccccatcccctccttcacccttggtactacgggaacccttccagaacagactactactccaatggccacgatgtccacaatccaccccagtagcacaccggagacgacccacacaagtaccgtccttacaaccaaggccacaactacccgggccactagcagcatgtctacgccgtcctcaacaccgggtacaacgtggatactgactgagctaactactgcagcaacaactactgccgctactggtcctacagccacaccgagcagtacgccaggaactacctggattctgactgaaccatcgaccacagccaccgtgaccgttcccaccggaagtacagcgacggcatcctcaactagagctaccgcaggaacgcttaaagtgcttacgtccactgccaccacccccaccgtgatctcatctagagctactcccagttccagcccaggcaccgctactgcacttcccgcgttgcgatccacagccaccacccctaccgctacctcggttactgctatcccgtcctcatccctgggtaccgcatggaccaggttaagtcaaacgaccaccccaaccgcgacaatgtcaactgccacaccctccagtacccccgagacagtccataccagcaccgtgctgacaaccactaccaccacgactagagccaccggctcggtcgcaactccctctagcacgcctggcaccgcccacacaacaaaagtgccgacaacaaccactacagggtttactgcgacaccaagctctagccctggtacagcgctgactccacccgtttggatcagcaccacaaccactcccacaacgcgggggtctaccgtcacgccatcttctattcccggaacaacacacacagcgaccgtgttaacgacaacaactacaacggtggccacggggagcatggccacccctagtagctctacacagaccagcgggactccaccatctctgactactaccgccacaacaatcaccgcaactggttcaaccacaaatcctagcagtacgcccggcacaacaccaatcccaccagtcctgactacaacagctaccaccccagctgcaacctcatccaccgtgacacctagctcggccctcgggacgacccacacacctcccgtacctaacacaaccgccactactcacggacgttccttacccccaagttcacctcacacagtgagaaccgcatggacctcagcaacaagcgggatcctcggcactacccacattacagaaccctcgaccgtaaccagccatactccagccgctactactagtaccacccaacattctactcctgccctgtcaagcccccatccatccagcagaacgacagaaagtccgccctcccccggcactactacacccggccacactcggggtactagccgcacaacagccacagcgacaccaagcaagacccggacctctactttgctgccaagcagccccactagtgctccaatcacaaccgtggtgacaactggttgcgagcctcagtgtgcgtggagcgaatggctggattactcctaccctatgccgggaccttctggaggggacttcgatacttattccaacatacgtgctgctggaggagcagtatgtgagcagcccttaggtttagagtgtagagctcaagcccagccgggggtccccctgcgcgaactgggccaggtagtggaatgctcactagattttggacttgtgtgcagaaatagagagcaggtaggaaagtttaagatgtgtttcaattacgagatccgcgtcttctgttgtaattacggacattgcccatctacaccagccacctccagcaccgcaacccccagtagcacgccaggtacgacatggatcctcacaaaactcaccactacagccaccactacagaaagtacaggctctactgcaactcccagttccaccccaggaacaacatggattcttaccgagccatccaccaccgcgacagttaccgtgccaaccggtagtaccgctactgccagctccactcaggctacagcgggaacgccacacgtctctactaccgctacaacccccactgtgacaagctctaaagcaacccctttcagttctcccggtactgccaccgccctgccagcccttcgtagtaccgccaccactccgactgcaacgtcgttcacagccataccaagctctagtctaggcacaacatggacgcgactgagccagacgactacccccactgctacgatgtctaccgctaccccctcttctacaccagagacagctcatacttccacagtgctgacaaccacagctaccaccacccgggcgaccggttcagtcgccactccttcatccactcctggaaccgcacataccaccaaggttccaaccaccaccaccacaggcttcacagtcacaccaagctccagcccagggaccgcgaggaccccaccagtttggatatccaccactactacgcctaccacctctggaagcactgtaaccccgtcttccgtcccaggcactacccacactcccacagtcctgaccaccacaacaaccaccgttgcaacaggctctatggctaccccctcctcatcaacacagacaagcggcacaccacccagcctgattaccaccgccactactatcactgccactgggtccaccactaatcccagctccacacccgggactacccctatccctcctgtcctcacaactacagctaccacacccgcagctacaagcagcacggtgacgccatcctctgcgctgggcacgacccatacaccaccggtgcctaacacaacagctactacgcacggtcgctctctgtctccctccagtccacatacagtgcgtacagcctggaccagtgctacctcaggtactcttggcaccacacatatcacggaaccatcgaccgggacctctcataccccggctgctactaccggtacaacccagcattcgacccccgctttgtccagcccccaccccagctcccgtaccacagaaagtcctcccagcccaggtacaactacacccggtcataccaccgctacttccaggacaactgcaaccgccactccgtctaaaactagaactagcaccttgctcccaagctcacccaccagtgcgccaataacaaccgttgtgaccaccggctgtgagccacagtgtgcctggagtgagtggctggactacagctaccccatgccaggcccctccggtggcgactttgacacctacagtaatattagagctgcaggcggcgctgtgtgcgagcagcctctggggctggaatgtcgcgcacaggcacagccgggggttcctcttggggaacttggacaggtagttgagtgcagcctggacttcggcctggtgtgccgaaatcgcgagcaggtagggaaattcaagatgtgctttaattacgaaataagggtgttctgctgtaattatggacactgtcccagcaccccggctacaagttccacagcaatgcccagcagcacccccgggacaacctggattctcaccgagctaaccaccactgcaactaccacagcaagtaccgggagtaccgctacaccctcatccacccctggcactgctccacccccaaaggtactgacctctcccgctaccacccccaccgccacctcaagcaaggcaaccagttcgtcctcacccagaacggctaccactctcccagtgcttacgtctacggccactaaatccaccgccaccagcgtgacacctattccctcctccactcttgggacgacaggtactctccctgaacagaccaccacaccggtagcgacaatgtcaacaattcacccttcctctacccctgaaactacacatacctccacggtcctgaccactaaagccacaacgactagggcaaccagctctacttctaccccttccagcacacccggaaccacttggatcctgacggaactgacgacagcggccacaaccaccgccgcgacaggcccaacggccaccccctctagtactccaggcaccacatggatccttactgaattgacaaccacagccacaactacggcaagtacaggttcgactgctaccccctcctcaactcccggcaccacctggatcctcactgaaccttccaccactgccactgtgaccgtgcctacaggcagtacggcaaccgcctcatcgacacaggccactgccggaacaccccacgtcagcaccacagctaccacgcccactgtcacaagttcaaaagctacaccgtcttcttcacctggtacagccactgctttgcccgctctgcgcagtaccgctacgacgcccaccgctacaagttttaccgcaattcctagcagttctctgggtacaacttggaccaggctgtcccagaccactactcctaccgcaactatgagcaccgcaacccccagcagtacccccgaaaccgtgcatacatccacggtcctaactgccaccgctactaccaccggcgctactgggtctgttgctacacctagctccaccccaggcacggcacacaccacaaaggtccctaccactaccaccaccggtttcaccgccacaccatcaagttccccaggtaccgcgcttacccctcccgtatggatctcaaccacaacgactcccactaccaccacacccaccactagcggaagtacagtcacaccttctagcataccgggcaccacccacactgcccgcgttctgaccacaacaacgactaccgtggcgacgggaagcatggccactccatcctccagtacacaaacctccggaacccccccatctcttacaaccacagccacgacgatcactgcaacaggctccacaaccaatccttcgtctaccccaggcacaaccccaatcactcccgtattaacatctacggccacaacaccagcagcaacgtctagcaaagctacttccagtagtagcccccgaaccgcaaccaccctccctgtgcttacatctactgcaacaaaaagtacggccacgagctttaccccaatcccgtcctccaccctgtggacaacatggaccgtgccggcccagacgacaaccccaatgtcaacaatgtccacaatccacacttcctcaaccccggagaccacgcatacatctactgtcctaactaccacagccaccatgacgagggccaccaactctacggctacaccatcgtcaaccttgggaaccaccagaatactaactgagttgaccacgactgccacaaccacagctgctacggggtctacagctacactgtctagtacgcctggcacgacctggattttgacagagccgagcactatcgccactgtgatggtaccaaccggcagcaccgctaccgcaagcagcacactcggtaccgcccatactccgaaggtggtcacaactatggccacgatgcccacagccaccgcctctaccgtgccatcaagcagtacagtggggacgactcggacgcccgctgtcctgccatctagtctgcccaccttctctgtctcgaccgttagttcctctgtcttaacaaccctgaggcccaccggatttccaagtagccacttttccacaccttgtttttgccgggcatttggtcagttcttctccccaggcgaagtgatatataataagaccgatcgcgcgggctgccatttttatgccgtttgtaaccagcactgtgacatcgacaggttccaaggtgcttgccccacatctcccccccctgtgtccagtgcacctctcagctcaccctcacccgcacctggatgcgacaacgccattcccttgcgccaggtgaacgagacctggacactggaaaattgtacagtggcccgatgcgtgggcgacaatcgagtcgtgttactggacccaaaacctgttgcaaatgtcacctgcgttaacaagcacctccctataaaagtttctgaccccagccagccatgcgatttccactatgagtgcgaatgcatctgctctatgtggggcggctcacactactccacttttgatgggaccagctataccttcaggggtaattgcacttacgtgctcatgagagagattcatgcccgcttcggaaacttgtcactgtacctggacaatcattactgcacggctagtgccaccgcagccgcagccaggtgtccaagggccttgagcattcactataagtcaatggacatcgtgcttacggtgactatggtgcacgggaaggaagaggggctgattctttttgatcagatcccagttagtagcgggttttccaagaacggcgtgctcgtgtcagtgctggggactacaacgatgcgcgtcgatattccagccctgggagtgtcggtgacttttaacggccaggtgtttcaagcacgcttaccgtactctctcttccacaacaataccgagggacagtgtgggacctgcaccaacaatcagcgcgacgattgtctgcagagggatggcaccactgcggcaagctgcaaggacatggcaaagacatggctagtacctgacagccgcaaggatggatgctgggcacccactgggaccccgccaactgccagccctgccgcaccagtgtcctcaacgcccacacctactccttgtccccctcagcccctttgtgatttaatgctctcccaagttttcgccgagtgccataacttagtgcctccagggccattctttaacgcatgcattagcgatcactgccgcgggcgactagaggtaccttgccaaagtttggaagcttacgcggaactgtgccgtgcccgcggcgtgtgctctgattggcgtggggccacagggggactgtgtgatctgacctgtccccctacaaaggtctataagccttgcgggccgatccagccagcaacctgcaattcacggaaccagtccccccaactggagggaatggctgaaggttgcttttgcccggaagatcaaattctcttcaacgcccatatgggcatctgcgtgcaggcctgcccgtgtgttggtcccgatggcttccccaaatttcccggggaacgctgggtgtcaaattgccagagctgtgtgtgcgacgaaggcagtgtgagcgtacaatgcaaacctctaccatgtgacgctcagggacagccgcctccctgcaaccgcccagggttcgtgaccgtaacccggcctagagcagaaaacccatgttgtcccgagacggtgtgcgtctgtaataccactacgtgccctcagagtctgcccgtgtgcccacccggccaggagtccatctgcactcaggaggaaggcgattgttgtcccaccttccgttgtcgccctcagttgtgtagctacaacggaactttttacggcgttggggccacatttcctggcgccctgccatgtcacatgtgtacatgcctgagtggtgatactcaagaccctacagtgcagtgtcaagaggatgcgtgcaataatactacttgcccgcagggcttcgagtacaagagggtggcaggccagtgctgtggggagtgcgtccagacagcctgcctgactcctgacggacagccagtccagcttaacgaaacttgggtgaactcgcacgtggataactgtactgtgtacctatgcgaagctgaaggaggggtgcatcttctgaccccacagccagcatcatgtcccgacgtgagctcctgccgcgggtccctacgcaaaacagggtgctgctattcgtgtgaggaagactcgtgtcaggtgagaatcaatactaccattttatggcaccagggctgtgaaactgaggtgaacatcaccttctgcgagggctcatgtcccggcgcctcaaagtattcggctgaagcccaggccatgcagcatcaatgcacatgttgccaagagaggcgggtccacgaggagacagtgcctctgcattgccctaacggaagcgcaatcttgcacacatatacccacgtggatgagtgcggatgtacaccattctgtgtcccagcccccatggcaccacctcacactcgaggatttcctgcgcaggaagctaccgcagtgtag

SEQ ID NO: 124939 - DNA, 17289 bp, Artificial Sequence
  Description of Artificial Sequence: Synthetic coding sequence
atgggcgcccctagcgcctgcagaaccctggtgctggcactggcagccatgctggttgtgccccaggctgagacccaggggccagtggagcctagctgggagaatgccggtcatacaatggatggtggggccccaaccagtagccctacgcggcgcgtatcatttgtaccacctgtgacagtgttcccgtccctcagtccactaaaccctgcacataatggccgggtgtgttctacgtggggcgatttccattacaagacatttgacggggatgttttcagattccctgggttgtgcaattacgtgttttctgagcactgccgggcagcctacgaagatttcaacgttcaactgcggcgcggactcgtcggctccagacctgtcgtcactagagtggtcattaaggctcagggcctagttttagaggcctctaatgggagcgtattaattaatgggcagcgtgaagagctgccctactcaagaaccgggctgcttgtggaacagtccggcgattatatcaaggtcagcattcgactggtgctgacattcttgtggaacggggaggactcggctctcctggaacttgacccgaagtatgccaaccaaacatgcggcctgtgtggcgacttcaacgggttgccagcatttaatgaattctacgcccacaatgcacgtctgacccccttacaattcggtaatctacagaaactcgatggtcccacggagcagtgccccgatccactgcccctgcctgcaggaaactgcacagatgaggagggaatctgtcaccgaaccttgctgggccctgctttcgccgaatgccacgcccttgtggatagtactgcatatctggcggcttgtgcccaggacttgtgtagatgccctacctgcccttgtgccacctttgtcgaatatagccggcagtgtgcccacgcgggagggcaacccaggaactggaggtgtcccgagctgtgccctcggacttgtccactgaacatgcagcatcaggagtgcgggagcccgtgcacggacacatgttccaatccacagcgagctcagctttgcgaagaccattgcgttgatgggtgcttttgcccccctgggacggtcctggatgacatcacccactctggctgtctgcccctcggacaatgcccctgtacacacgggggaagaacatattcccctggaaccagtttcaacaccacatgcagtagttgcacatgcagcgggggactctggcaatgtcaggatttaccttgtcctggtacatgtagtgtgcagggtggagcgcatatctctacctacgacgaaaaactgtatgacctgcacggagactgctcctatgtcctgtcaaagaaatgtgctgactcatcctttaccgtgctggcagaactgcgcaagtgtggcctgactgacaacgagaactgccttaaggctgtaactctatcactggacggcggggataccgctattcgcgttcaggctgatgggggggtcttccttaactccatctacactcagcttccccttagcgccgccaatattactttattcaccccttctagcttctttatcgtcgtgcagaccgggttgggattacaactactcgttcagcttgtcccactgatgcaggtgtttgtgaggcttgatccagcccaccagggccagatgtgcgggttatgcggcaactttaaccaaaaccaggctgacgatttcacggccctgagcggagtcgttgaggcgactggcgccgcctttgccaatacctggaaagctcaggctgcatgcgctaacgcacgtaattctttcgaggatccttgctccctgtccgttgagaacgaaaactacgctagacattggtgcagtcgcctcacggatcctaattcagctttttcccgctgtcacagcattataaacccaaagccattccattcaaattgcatgtttgacacatgtaattgtgagcggtccgaagattgtctgtgcgctgccctgtcttcttatgtgcatgcctgcgccgctaagggggtgcagctgagtgactggcgcgatggagtatgcaccaagtatatgcagaactgccccaagagccaacggtatgcctacgtcgtggatgcatgccagcccacctgtcggggactgtccgaggcagacgtcacctgctctgtatcatttgtaccagtggacgggtgtacctgcccggccggcacatttctgaacgatgcaggagcctgcgtgcccgcccaggaatgtccatgttacgctcacggcactgtgcttgctcccggcgaggtggtgcacgacgaaggcgcggtgtgctcttgcactggtggcaagctgagttgcttgggggcctctcttcagaagtctactggctgtgcagcccctatggtttacctagactgtagcaacagctcagccgggacaccaggcgctgaatgcctgcggtcctgtcacacacttgatgtaggatgtttctcaactcattgtgtctcgggatgtgtgtgcccaccagggcttgtgagcgacggatctggcgggtgcatcgccgaggaagattgtccatgcgttcataatgaggctacgtacaaaccaggggaaactattcgggtggattgcaacacttgtacatgcagaaaccgccggtgggagtgctcccaccgattatgtctggggacatgcgtcgcctatggcgatggccacttcataacctttgacggggaccggtacagcttcgaagggtcgtgtgaatacatccttgcccaggattactgtggcgataacactactcacggcacgtttaggatcgtgacagagaatattccttgcggcaccaccggcactacttgctcgaaagccatcaagctattcgtggagagctacgagttgattttgcaggaaggcacattcaaagctgtcgctcggggtcccggaggcgaccccccctacaagatcagatatatgggcatttttctcgtcatagagactcatggaatggctgtgtcttgggataggaagacgagtgtcttcattcggctgcatcaggactataaagggagagtttgtggcctttgtggaaacttcgatgataacgccatcaatgacttcgcaacacgcagtaggtccgttgtgggagacgccctggagttcggtaacagttggaagctaagcccctcatgccccgacgccttggctcccaaagatccctgtacagccaatccgttccgtaaatcctgggcacagaagcagtgtagtattcttcatggccccacattcgcagcctgccggtcacaggtcgacagtactaagtactatgaggcctgtgttaacgacgcttgtgcatgcgattctggaggggattgcgagtgcttttgtacagctgtcgctgcatatgctcaggcgtgccacgacgccgggctgtgcgtgagctggcgcactccagatacatgcccactgttttgcgatttttataacccccatggagggtgcgaatggcattaccagccctgcggtgctccttgccttaagacctgtcgaaatcccagcggccactgcttggttgatctgccagggctggaaggttgttaccccaaatgcccaccaagccagccatttttcaatgaagaccagatgaagtgcgtcgcccaatgtggctgctacgataaggacgggaactactatgacgtgggagcgcgcgtgcctaccgccgaaaattgtcagtcgtgcaattgtacgccttcaggcatccagtgcgcccatagcttagaggcgtgtacttgtacatacgaagataggacttacagttatcaggatgtgatttacaataccaccgatggcctcggtgcttgcctaatagcaatctgtggcagcaacggcacgatcattcgaaaagctgttgcatgtcctggcacacctgctactacaccattcacctttacgaccgcctgggttccccattccaccacatctcctgccctgcccgttagcaccgtctgcgtgcgggaggtttgccggtggtccagctggtataacggccacagacccgaacctggtctgggggggggcgatttcgagacctttgaaaatctgcggcagcgtggctatcaggtgtgccctgtgctcgctgatattgagtgcagggcagctcagttacccgacatgcctctggaagaactgggacagcaggtggattgcgatagaatgcgggggttgatgtgcgcgaattcacagcagtccccccctctgtgtcatgactacgagctgcgggtgttatgttgcgaatatgtcccttgtggcccttcaccagctcccggcaccagcccacagccatctctcagtgcttctaccgagccggcggttccgaccccaacacagaccacagctaccgaaaagaccactctttgggttactcccagcataagaagcacagcagctctgacctcccagacaggtagtagttccgggcccgtgacggtgaccccctctgccccagggaccactacttgtcagccaagatgtcagtggacggaatggttcgacgaagactacccgaagtcagaacaactgggaggcgacgtggaaagttacgacaagatccgcgctgccgggggccatctgtgtcagcagccaaaggatatcgagtgccaggcagagtcctttcctaactggacgctagcccaggtcggacaaaaagtgcattgcgatgtgcatttcgggctcgtgtgcaggaactgggagcaggagggagttttcaaaatgtgttataactatagaattcgcgtgttgtgctgttcagatgatcattgtcgaggacgggccacaaccccgccacccactactgagctagaaaccgccacaacaaccaccacccaggcgctcttcagtaccccacaacctaccagcagccctgggttaaccagggcaccaccagcttccaccactgccgttcctactttgtccgaaggattgacgtccccgaggtatacttccaccctaggcacagcaacgactggaggccccaccacccctgctggctctacagagcctactgtgcctggcgtggcgacctcaacactacccaccaggagtgctctgcctggcacaaccggctctctgggcacatggcgccctagccagcctcctacacttgcgcccactaccatggctaccagtagggcaaggccaacaggtaccgcctccacagccagcaaagagcccctgacaacatcactggcaccaaccttgacttcagaactgagcacatcacaggcagaaacatctactcccagaactgagaccactatgagtcctttaacaaacaccacaacaagccagggtactactagatgtcaacccaagtgcgagtggactgaatggttcgacgtagacttcccaacctcaggtgttgctggtggagatatggagacatttgagaatattcgagccgccgggggaaagatgtgttgggcaccaaagagcatcgagtgtagggcggaaaactacccggaggtgagcattgaccaggtggggcaagtcctgacctgtagcctggagaccggattgacgtgtaaaaatgaggatcagactgggaggttcaatatgtgctttaactacaacgtgagggttctttgttgtgatgactacagtcactgcccgtccaccccagcaacttcgtccaccgccaccccctcgtcaacacccggcacaacatggatcctgaccaaaccaaccaccaccgctaccacaacagcaagcacaggatctacagccacacctacttccacacttcggaccgctccccccccaaaggtgctcaccaccacggccacaacgccaaccgtgacttccagcaaagcaacgccaagctcttctccaggcactgcgacggccttgccagctctgcgaagcactgctactacacctacagcaacttcggtgaccccaattccctccagctctctcggcacaacgtggacccggctgtcgcagacgactacgccgaccgcaaccatgtctacagcaacaccttccagtactccagaaaccgcacatacttccaccgtgctgacggccaccgctacgactacgggggccaccggctctgtagccaccccttcaagcactccagggacagcccatacgaccaaagtgccaaccacaacgactactggtttcactgcaactcctagcagtagcccagggaccgctctgacgccacccgtatggatcagcacgaccactacccccacaactcggggaagtaccgttactcccagcagcatacctggtacaacgcatactgccacagtccttactacaaccactacgaccgtggccaccggctcaatggccactcccagctcctccactcagacatcaggtacgcccccctccttgaccacaactgcgacaacgatcacagccactggatccaccactaatccctcatccactcccggaacaacccccattccgcctgtgctgacaaccaccgcaaccacgcctgcggcgactagcaatacagttaccccttcatcggccttagggactactcatactccacccgtgcctaacacgatggctaccacacacggccgatcacttccacccagcagcccacatacagtccggacagcttggacctccgccacttcaggcatcctcggcactactcacatcactgaaccaagcacagtaacaagccatacgcttgccgccactaccgggaccacacagcactcgaccccagcactgtcctccccacatccgtcttccagaacgaccgaatctcccccatcacccggcactacaaccccagggcatacaactgccacctcacggaccacggccaccgccacgcccagcaaaacacgcacttccaccctgctcccctcgtccccaaccagcgcacctattactactgtggtcacgatggggtgtgaacctcagtgcgcatggtccgagtggctggattatagctatcccatgccaggcccctcaggcggagattttgatacatattccaatatcagagccgccggaggcgccgtttgtgagcagcctctcgggcttgagtgcagagcccaggcccagcctggtgtcccactgagagagctcgggcaagtggtggagtgtagtcttgacttcggcctggtctgtcgcaatagggaacaggtgggaaaatttaaaatgtgctttaattacgagatcagggtattctgttgtaactatggacattgtcctagcacccccgctacttccagtacagctatgccgtcctcaacccccgggacaacctggattcttacagagctcacaacaacagccactacaaccgaaagtacagggagtactgcaaccccctcatcaacccccgggacaacatggatcctgactgagccaagcactaccgcgacagtgactgtgcccaccggctctacggctactgccagttctacccaagctacggctgggacaccccacgtgtccacaactgccacgactccgaccgttacgtcttcaaaagcaacccccttctcatcgcccggtacagcaaccgcactgcccgcactaaggagcactgccaccaccccaaccgccaccagttttaccgctattccaagcagctctctggggaccacttggacacggctatcccaaacaaccacaccaacggccactatgtcaaccgctaccccgagctcaaccccagagaccgtgcacacttcgactgtgctgaccacgacagcaacaaccactggcgccactggttcagttgcgacacccagctctacaccagggaccgctcacaccacaaaggttctgacaacgacaacgactggattcaccgctacaccatccagttctccagggacagcaaggaccctgccagtgtggatcagcacaactaccacgccaactactagaggcagtactgttaccccttcgtccataccgggcacaacgcacacaccaacggttctcactaccaccaccacgacggtagcaactggatctatggcgaccccaagctccagcacccaaaccagcggaaccccacctagcctcaccacaacagccacaaccatcactgcaacaggaagtaccaccaacccatccagcacccccgggaccaccccaatccctccagtgctaaccactaccgcgacaacacccgctgcaacgagttcaacggtgacacctagctctgccctcggtactacacacactccaccggtcccaaataccaccgccaccacacacggtcggtcgctgtctccttcgtccccccacaccgttcgcaccgcttggacatcagcaacctcaggcaccctcggaaccacacacatcacagaaccttcaacgggcacctcccacacacctgccgcaaccacaggcaccactcagcactccacacctgcactctcttcgccacacccatcttcacggaccacagaatcccccccctcccctgggaccacaacccccggacataccagggcaacttcacggaccaccgcgactgccactccgagcaagacgcgaaccagtaccttgctcccctcctctccaacatccgctcctatcacaacagtggtaacgatgggctgcgaacctcagtgtgcgtggtctgagtggctagattactcatacccgatgccagggccgagtggaggcgattttgacacttactcaaatattcgcgctgctggcggcgcagtgtgcgagcagcccctcggcttggagtgcagagcccaagctcagcctggggtgccgctgcgagaactaggccaggtggtggaatgcagcttggatttcggcctggtgtgtaggaaccgcgagcaagtcggcaaatttaaaatgtgtttcaactacgagatccgcgtgttttgttgcaattacggccattgtccaagcactcccgctactagctctactgctaccccctcctccactcctggtacaacatggatccttacagaacagaccacggccgccactaccacagcaaccacagggtcaactgccattccatcctctacgccaggtactgcacctcctccaaaagtgcttacatctacagctacaactccaacagcgacatcttctaaggcaacctcaagttctagcccccgaaccgctactacattacccgtgctgacaagcaccgcgaccaagagcacagctacaagctttactcccataccgtctttcacgctcggcactacagggacactgccagaacagactacaacacccatggctacaatgagcacaatacacccaagttccactcccgaaaccacacacacaagcaccgtgctcacaacgaaggccacgaccacgcgcgcgacctcaagcatgtcaacgccctcttccacgcccgggactacatggatcttaactgagctgacaacggccgctacaacgacggctgctacagggccaacagcaacacccagcagcaccccagggacaacctggatattgactgagccctcaactactgcaaccgtgacagtgccaactggaagtaccgccacggcctccagcactcgagcgaccgccgggaccctgaaagtcctgacctcgaccgctaccaccccgaccgtgatttccagcagagctacaccctctagttcccccggtaccgcgacagcgttgccggccctcagaagcactgcaaccacaccaactgctaccagcgtcacagctataccctctagtagccttggtacagcatggacacgcctctcgcaaactactactcccacagcaaccatgtctacggccactccctcctccactccagaaaccgtccatacatcaaccgtcctgacaacaaccactaccactacccgggccacagggtcagtggcaacaccaagctctacccccggaacagcccatactaccaaggtgccgacgaccacaaccaccgggtttactgccactccatcatcgagtcccggaaccgctctgactccaccagtgtggattagcactactacaactccaactacacgcggctcaaccgttacaccgtcaagcattcctggcacaacccatactgccacagtactgactacaaccaccacgaccgtcgcaaccgggagcatggccacacctagctccagcactcaaacctctggaactccaccatctctcaccaccacagcaaccaccatcacagccacagggagcaccactaatcctagctctactccagggaccacgccaattcctccagttctcacgaccactgctactacgcccgcagctacctcttcaaccgtgacgccaagtagcgctctgggaaccactcatacccctcccgtccccaacactacagctacaacacacggcagaagtctcccaccatccagcccacacactgtcagaaccgcctggacgtctgccactagtggaatcctcggcacaacacacatcacggagccctccaccgtcacgtctcatactcctgctgccaccacttcaacaacccagcactctacccctgccctcagttcaccacaccctagtagtcgaactactgagtctcctcccagccccggcacgaccactcctgggcatactaggggcaccagccgcactactgccactgccacaccctcgaagacaaggacatctacactgctcccctcgtcccccacgagtgcacctattactacggtggtgaccaccggctgcgagcctcagtgcgcgtggagtgagtggctcgactatagctaccctatgcccggtccgagcggaggggactttgacacatacagcaatatcagagcggctggaggggcggtttgcgaacagccccttggtttagagtgccgtgcccaagcccaacccggggtgccgcttagggagctcggccaggtggtcgagtgtagcctggattttggactagtctgtaggaatcgcgagcaggtgggtaagttcaagatgtgctttaattacgaaatcagggttttctgctgtaactatggacattgtcccagcaccccggcgacctcaagcaccgcaacgccctcttctaccccgggcaccacatggattctaaccaaattgacaactacagcgactactaccgagtctaccgggtctaccgctaccccatcttccactcccggaactacttggatcctaaccgagccaagcactacagccaccgtgactgttccaactgggtctactgctactgcatctagcacacaggccaccgccgggacaccacacgtctctacgacagccacaaccccaactgtgacaagctccaaagccacaccattctcaagcccaggaactgctactgcgctgccagctttgcgaagtacagccacgactcctactgctacatctttcacggcaattcctagcagttctcttggaaccacctggaccagactgagtcagaccacgactccaacggccacgatgtctactgctacacctagctctaccccagagacagctcacacctccacagtactgaccacaacggctaccacaactcgtgccacagggagcgtcgcaacccccagctctaccccggggactgcacataccacaaaagtgcctactaccacaactaccggttttaccgtaaccccaagttcaagccctggaaccgccagaacaccacccgtgtggatttcaaccaccaccacacctactacctccggtagcactgtgactccctcttcagtgccaggaaccacccacacccccactgtattaactactacaacaacaaccgtggcaacagggagcatggccacaccatctagttcaacacagactagcggtaccccccccagtctgatcactaccgcaactactatcactgctacagggtctaccactaatccttcttcaaccccaggcacgacacctattcctcctgtgctcaccaccaccgccacaacacccgcagcaaccagcagcacagtaacaccaagttcagctctcggaacaactcacaccccgcccgtacctaatactactgcgaccacccacggtaggagcctctcgcctagcagcccacacaccgtgaggaccgcttggacatctgcgacctccggaaccctaggtaccacccacattacagagcccagtactggcacttctcacactcccgcagccaccacaggtaccactcagcattcgactcctgccctgagttcaccccatccctcctctcgcactaccgaaagtccccccagccccggaactaccactccaggtcatacaaccgccaccagtcggactacagccacagccacgcctagcaaaacaagaacgtcaaccctgctgccttcttcccctacgtctgcccctattacaaccgttgtcacgacagggtgcgagcctcaatgtgcatggagtgaatggctggactactcttaccccatgccaggaccatcagggggcgacttcgacacttattctaacatcagggccgccggcggagctgtgtgcgagcagccgctggggctagaatgcagggcccaggcacaacctggcgtacccctcggcgagctggggcaagttgtggaatgttccttggacttcggtctggtttgcagaaacagggaacaggtgggcaagttcaaaatgtgtttcaactacgagatcagggtgttctgctgcaattatgggcactgccccagcacacctgcaacctcaagcactgctatgccctccagcaccccaggaaccacgtggattctgaccgagctgacaacaacagcgacaacaaccgccagtaccgggtccaccgctacacccagcagtacacccggtactgctccacctcccaaagtccttacatctcctgccaccactcccacagcaacttctagcaaggcaaccagttccagcagtcctcggaccgcaactaccctcccagtgctgacttccacagctacgaagagtacggccacctccgtgacacctattccatccagtacccttgggaccaccggcactcttcccgagcagacaacaacccccgttgcaacaatgtcaactatacatccttcctccacacccgagacgacccacacatccacagtgctgacaaccaaggctacaactacccgcgctaccagctctacatctacaccgtcctctacgcccggtactacctggatactgactgaactgacaaccgctgctaccacgaccgctgcaacaggtccaactgccacgccctcttcaaccccaggcactacctggatcctcactgaattaacgactacggcaactacgaccgcatctaccgggagcaccgccactccttctagcactcccggcacaacatggattctcacagaaccatctactaccgctaccgtcactgtgcccacaggttctactgcaactgcctcatcgacacaagcaaccgctggtacaccccatgtatccaccaccgcgaccacgccgactgtgacttccagtaaggcaacgcctagctcttcaccagggaccgcaacagccttgcccgcgttgagatctaccgcgaccacccctactgctacgagcttcaccgctattccatccagtagcctgggtacaacctggacgcgcctgagccagacaacaacccccactgccaccatgagcaccgctactcccagttctacccctgagaccgtacacacttcgaccgtactcaccgcaacagccaccaccacgggggccacgggaagtgtggccaccccttcgtccacccctggtaccgcgcatactaccaaggtacctactacaaccacgactggcttcaccgccacacctagcagttctcccggaactgcgctcacgccccccgtgtggatatccacaacgacaactccaaccactaccacgcctactaccagtggcagcaccgtgactccctctagtatccccggtaccacccataccgcaagggtcttgacaactactacaacgactgtcgctaccgggtctatggcgacaccttcatctagcactcagacttcaggcactccaccttcattaacaacaactgccacaaccataaccgctacgggaagcactaccaacccgtccagcacacccgggactacaccaatcacacccgtccttacctccaccgccactacgcctgctgcaacgtcaagcaaagcgacctcaagctcctctccaagaacagctaccacattacctgtgctgactagcacagcgaccaagagcactgcgaccagtttcactcctataccctcctctacactctggaccacttggactgtcccagcacagaccaccactccaatgtccaccatgtcaaccattcacacatcttccacaccagagacaacacatacctcaactgttctgacaaccaccgccaccatgacaagggcaaccaattcaactgccactccgtcgtccaccctggggaccactaggattctcacagaactgaccacaactgcgaccacaacggcagcgacagggtccaccgccacactttctagtacacccggaactacctggatcttaaccgaaccgtccaccattgctaccgtgatggtgcctacaggcagcacagcaaccgcaagttcgaccctagggacggcccatacccccaaagtggtaactaccatggccaccatgcctacagccaccgctagtacggtcccatcatcctccactgtcggcacaactcgtaccccagctgtgttgcccagcagcctgcctacattctcagtttccactgtatcatctagcgttttaacaacgctgcgccctaccggatttcccagctcgcattttagtactccctgcttctgtagggccttcggccagtttttctctccaggcgaagtgatctacaacaaaaccgatcgagctgggtgccatttctatgcagtgtgcaaccaacattgcgacatcgacaggttccaaggcgcatgtcctaccagtcccccaccagtgtcttcggctcccctctcctccccttcacctgctcccggctgcgacaacgccatacccttaaggcaagtgaatgagacatggaccctagagaactgtacggtggcccgctgtgttggcgacaatagagtggtcctcctggaccctaaacccgttgcgaatgtcacatgtgtgaataagcacctcccaatcaaggtctcagacccctcacagccctgtgactttcattatgagtgtgagtgcatctgctccatgtggggcgggtcccactacagtacatttgatggcacatcatacactttccgtggcaattgtacatacgtcctgatgagagagattcacgcacggttcggaaatctgtcgctgtacctggacaaccactactgcaccgcctcggccaccgcggctgctgcccggtgcccacgggctctgtcgatacactacaagagcatggacatcgtgttgacggtgaccatggtccacggtaaggaggaggggttgatcctgtttgaccagatccccgtaagctcaggatttagcaagaacggagttctggtatctgtgctaggtactactactatgagagtagatataccggcacttggcgtgtcagtaacctttaatggacaagttttccaggctcgtctgccgtattctctgtttcataataatacagaggggcagtgcgggacttgtaccaacaatcagcgggacgactgtctgcagagggatggaactaccgctgcatcatgcaaagatatggccaagacatggctcgtgcctgatagccgtaaagacggttgctgggctccaaccgggacacctcccactgcttctccagctgcccctgttagttcaaccccgacgccaacaccttgcccacctcaacctctatgcgaccttatgctttcacaagtcttcgcagaatgccataatctggtgccccccgggccctttttcaatgcgtgtatcagtgatcattgtcgtggcaggctggaggtcccctgtcaatcactagaggcttacgctgaactgtgccgcgcccggggggtgtgctccgattggcggggggcaacagggggactgtgtgatctcacgtgcccgcccacaaaagtgtacaagccttgtggcccaatccaacccgccacctgcaacagcagaaatcagagcccacagttggagggcatggccgaaggttgtttttgccccgaagatcagattctcttcaatgcccatatgggtatatgcgtgcaagcttgcccctgcgtggggcctgacgggttccctaagttccccggagagcggtgggtatctaattgtcagagttgtgtttgcgacgaaggctccgtgtccgtccagtgtaaaccgctaccttgcgatgctcaaggacagcctcctccttgcaacaggcctgggttcgttacagtcactcgtcctagagcagaaaatccttgttgtccagaaactgtgtgcgtttgtaacactacaacatgtccacagtcgttacccgtatgtcctcctggccaggaatctatctgcacacaggaagagggcgattgctgcccaacctttcggtgccggccacagctgtgtagttacaacgggactttctacggagtcggcgccactttccctggggcactcccttgccacatgtgcacttgtctgagcggggatacacaagaccccaccgtgcaatgtcaggaggacgcctgtaataatactacttgtcctcagggcttcgaatataagcgcgtggctggacagtgttgcggcgagtgcgtgcagactgcctgtctcaccccagatgggcagccagtgcagctgaatgagacatgggttaactcacatgtcgacaattgcacagtgtatttgtgtgaggccgaggggggagtgcatctgttgaccccacagccggctagttgtccagatgtctcatcgtgtagggggtccctcaggaaaacagggtgttgttactcctgcgaggaggattcctgtcaggtgcgaattaatacaacgatcctttggcaccaggggtgtgagacagaggttaatattaccttctgcgaggggtcttgtccgggagcgtcaaaatacagcgctgaggcgcaggcaatgcagcaccagtgtacatgctgtcaagagaggcgagtacacgaagagacagtgcccttgcattgcccaaacggcagcgctattctgcatacatacacgcacgtggacgagtgtggttgtacacccttttgtgtcccagcgccgatggctccacctcatacccgcggcttccccgcccaggaggctaccgccgtgtag

SEQ ID NO: 124940 - DNA, 1611 bp, Artificial Sequence
  Description of Artificial Sequence: Synthetic coding sequence
gtattctgctgtaattacggccattgccctcccagaccacctgctctgcgtccgtgccccccacccttgcgggggcggccaggaagcaccgagttgactacgactgccaccacaaccgcgtccacaggatcaacagcaactccttctagtacccccggaacagctccaccacccaaagtcttgacttcccccgccaccacccccaccgctacgtcttctaaagcaacctcatctagttccccgaggactgcaacaacacttcccgtcttgaccagcactgcaacaaagtctaccgccacctcagtaaccccaattccgtcctctacattaggaaccaccggaacgttgcctgaacagactaccacacccgttgcaactatgtcaactattcacccttcaagtactcctgagacaacacacacatccacggttttgaccactaaagctaccacaacacgagctacgagcagcacaagcaccccatctagtactcctggaactacatggattctgactgaactgactacggcggctacaaccaccgcagccaccggcccaacagccactccgtctagcacacccgggactacttggatcctgactgaactgaccacgaccgccaccactactgcatctaccgggtccacagccaccccgagtagtacaccaggcacaacttggatcctaacggagccctccactaccgccacagttacggtcccaactgggtccacagccactgccagcagtacacaagcaacagctggtaccccacatgttagtacaactgcgacaacgccaaccgtaaccagtagcaaagctacaccatctagcagccccggaaccgccacagctctgcctgccctccggtcgacggcaacgacccacagctaccagttgtatagccaccccttactcctccctacaacctggacaagactgagccagacaaccactcccaccgctacaatgtctacagccaccccgtcaagcacccccgagacagttcataccagcaccgttctgaccgccactgcaaccaccacgggccccgctctctggccacctcccccgcctccccaggagcagctgacccttcctaaatgcagactgcctcagccgcggcactcccatcccctgctccagccccgagatggcacccacgcttcatccgtcgatcagcacaaccaccatacccataaccaccatacccacaatcagtggctgcatggtgacccactgctccatccaggggaccatccgcatcgacagtcagcggaccaccaccatcacaattgcaccggaagcatggccaccccatctagtagtacccaaacttccgggaccccccctagtctgaccacaactgccaccactataaccgccaccggcagtaccacaaacccctcgagtacccccggcaccacccctatcacacctgtgctcactagcaccgctactaccccagctgcaacatcctctaaagcgacgagttcatccagtcctaggactgctactaccttgcctgtgcttacaagcactgcaaccaagtctaccgccacgtccttcactcccatcccttccccctgcggcccgaggggaccctcatag

SEQ ID NO: 124941 - DNA, 561 bp, Artificial Sequence
  Description of Artificial Sequence: Synthetic coding sequence
tctagcactcccggcactacttggattttaactgaaccatcgaccaccgctaccgtcacagttccaacaggctcgacggccaccgcctccagtacacaggccaccgcaggaacaccccacgtttctactactgcaaccacccccaccgtgacgtctagcaaagcaacaccctttagcagcccaggaaccgcgaccgccttgcctgcactgaggtccacagccactacacctacagccacttcctttactgccatccccagctcctgggccccccccggacctgcttatcaccgcccaccacaccccaggcctccctgtcctcaaccacacccccccccattgcagcggctgagtacgccacctcaatgtctgcctccaagaccaccccgcggccacaggttatgtggccacccacttctgcatccacggaactcttctcactaccagtcagcagactaccacaatcattttactgctaccccctcaagcagcccgggcaccgctaggacactgcctgtctggatttccacgactaccacccccactacacggggaagctag

SEQ ID NO: 124942 - DNA, 960 bp, Artificial Sequence
  Description of Artificial Sequence: Synthetic coding sequence
actaaggcaaccaccaccagagccaccagcagtatgagcacaccttcgagtacaccagggacgacatggatcctcacagaattgacgacagccgctactactaccgctgccaccccccacggacatcccgttcttcatcctagagatcacctggatccacacagggcccagcactacaccgtaacagtgccgacggggtccaccgcaacagcctcgtctacgagggccactgccgggaccctcaaggtgctgacctcgcaccatacccattctcaccaacttcagagccatagtctgctgcagagccgggactgcaatcgaccaagcagtaccgaaaaacattcgcaccatacacattcataccagaggtactctcacccattgtttttgcctaccgcttggacacggctttcacaaacgacaacccccaccgcaacaatgagtacagccactccctcaagtacacccgagaccgtgcacactagcaccgttcttaccaccaccaccacaaccacaagagccaccctttggccgccccccccccctccccaggaacaactcacgctgccaaagtgccgactcccgcagccccggcactcccatccactgcttcagcccagagatgggactcacgcgagtagtgtggaccagcacaaccatcacactcacaaccagcggctgcacggagatcccctactgcaccctaccacgcatactgccacagtcttaacgactacaaccactacccccctcgtgctctggcagcatcctccactggctcacaggccagtggtccccccttctctgacgaccaccgccaccactatcaccgctacaggttcgacaacgaatccgtcttcgacccccgggactacacctatcccccctgtgctgacgactactgcacatacttgctcccaccaacaacacagcgacagcctactgtgtcctcgagactag

SEQ ID NO: 124943 - DNA, 2007 bp, Artificial Sequence
  Description of Artificial Sequence: Synthetic coding sequence
atgcgagaaatccacgcaaggtttgggaatctaagtttgtacttggacaatcactactgcaccgcgagcgccactgcggcagcagcccgttgcccacgggctctgagcattcattataaaagcatggatattgtgctgacagtgactatggtccacggtaaagaagaggggcttattctgtttgaccagatccctgtttccagcgggtttagtaaaaacggagtgctggtctccgtattaggcacaaccactatgcgagttgatatccctgcattgggagttagcgtcaccttcaatggtcaagttttccaggcaagactcccatactctctcttccacaacaacaccgaaggacagtgcgggacctgcaccaataatcagagggatgattgtttacagagagacggcacaaccgctgcaagctgtaaagacatggccaagacttggctggttccggatagtcgcaaggacgggtgctgggcccctacagggactccccctactgcctcccctgctgcaccagtgagttctacccctaccccaacaccgtgccccccgcagccgttatgcgacttgatgctgagtcaggtcttcgcagaatgccacaacctcgtgccccccgggccttttttcaacgcctgcatctccgaccactgccgggggcgtctcgaagtgccttgccagtcattagaagcttatgccgagctttgcagggcccggggcgtctgttcagattggcgaggggccaccggcgggctgtgtgatctgacttgccctcctactaaggtatataaaccttgcgggcctatacagcccgcaacttgtaactcaaggaatcagagtccccagctcgagggtatggcggaaggctgcttctgccctgaggatcagattctcttcaatgctcacatgggcatctgtgtgcaagcctgtccgtgcgtgggacctgatggattccccaagttccccggcgagcggtgggtgtctaattgccaaagctgtgtgtgtgacgagggatctgtgtccgtccagtgcaagccgctgccttgtgacgcccagggtcagcccccaccctgcaaccgacctgggtttgttaccgtcaccagacccagagccgaaaatccctgctgtcccgagaccgtgtgcgtatgcaatactacaacttgcccccaatccctgcctgtgtgtccccccggacaggaatccatttgtacccaagaggagggagactgctgccctacatttcgatgccggccacagctctgttcttataacgggacattctacggcgttggcgcgacgttccccggcgctctgccatgccacatgtgtacctgcctgtcaggtgacacacaggacccaactgttcagtgtcaagaagatgcctgcaacaatactacttgtcctcaaggctttgaatacaaaagagttgctggccagtgctgtggcgagtgtgtgcagaccgcttgccttacccctgacggccagccggtgcagttgaatgaaacctgggtgaactcccatgtggacaactgcaccgtctatctgtgcgaggcggaggggggcgtgcacttgctgactccccagcccgcatcctgcccagacgtgtcgtcatgtcggggctctctacgcaagactggctgctgctatagctgcgaggaggatagttgccaggtgaggatcaatacaactatcctctggcatcagggctgcgaaacagaagtgaatatcactttttgtgaagggtcctgcccaggcgcctccaagtatagtgcggaggcccaggcaatgcaacaccaatgcacatgttgccaggaaagacgggtgcacgaggaaaccgtgcctctgcactgtcccaacggatctgcgattctacacacctatacccatgtcgatgagtgtggctgcacccctttctgcgtgccagcccctatgtccccccctgcttgtgtgtggcaccctgcccttagagcacccgccgctcatcttgggctagcccccccatag

SEQ ID NO: 124944 - DNA, 7320 bp, Artificial Sequence
  Description of Artificial Sequence: Synthetic coding sequence
atggtgcagcgatggctgctgctgtcctgctgcggggctctgctgtctgccggactagccaacacctcctacacatcgccagggttgcaacgactgaaagattcaccacaaacagcaccggacaagggacagtgcagcacatggggcgccgggcacttttccacatttgaccaccatgtgtacgacttctccggcacctgtaactacattttcgccgctacatgcaaggacgcatttcctacattttccgtacaactgagacgcgggcccgacggaagcatctctagaatcatcgtggagctcggcgcttcagttgttactgtgtcagaggcaataatcagcgtcaaggacattggcgtgatatcattgccctacacctcaaacggcttgcagattaccccattcggtcagtctgtcagactcgtcgctaagcagctcgagctcgagctcgaggtggtttggggtcctgactcgcacctgatggtgctagtggagagaaagtatatggggcagatgtgcggtctttgtggcaatttcgacggaaaggttactaatgaatttgtatcagaggaaggaaaattccttgaacctcataagtttgccgccctgcaaaagttagacgaccctggcgaaatctgcacatttcaggacattcctagtacacatgtgaggcaggcccagcatgcgaggatctgtacccaacttctcaccctggtagcccccgagtgctcagttagtaaggagcccttcgtcctgtcatgtcaggccgatgtggctgccgcaccacagcccggaccccagaattccagctgcgctacactgtccgagtatagccgccagtgcagtatggtcgggcagcctgttaggagatggagaagtcctggactttgcagcgtgggacagtgcccagctaaccaggtttaccaagaatgcgggtccgcctgtgttaagacatgctccaaccctcagcactcgtgcagctcatcttgtactttcggatgtttctgtcctgagggtacagtgctcaacgacctctcgaacaaccacacctgcgtgccagtgacacagtgcccttgcgtccttcacggcgctatgtatgcaccgggcgaagtgacgattgccgcttgtcaaacctgtcggtgcaccttgggcagatgggtctgtacagagaggccctgcccagggcattgctctctcgagggaggaagcttcgttaccactttcgacgcaagaccttaccggttccacggcacatgcacttacatcttgctacagtctccacagttgcctgaagacggcgccttgatggccgtctacgataagagcggcgtgtcccattctgagactagcctggtagccgtcgtctacttgtctcggcaggataaaatagtgatcagccaggatgaagtggtaactaacaatggcgaggcgaaatggctcccctataagacaaggaatataacagtgtttagacagaccagtacccacttgcagatggccaccagttttgggttagaactcgtggtgcagctgaggccaatcttccaggcttatgttacagtcggccctcaatttaggggtcagacccggggattatgtggaaacttcaatggggatactactgacgatttcactaccagcatggggatagccgaggggacggctagcttgttcgtggactcctggcgggcaggaaactgcccagcagctctagagcgggaaactgatccgtgttccatgtctcagttgaataaggtgtgcgccgaaacccactgcagcatgctgctgagaacaggaaccgtgtttgaaagatgccatgcaaccgtgaacccagcacccttctacaagagatgcgtgtatcaggcttgcaattatgaagagacctttccacacatttgtgctgccctgggcgattacgttcatgcttgctctttgcgcggagttcttctctggggctggcgcagttcagttgataactgtaccattccatgtactgggaatactaccttctcttacaactcccaggcctgcgagcggacctgtctatctctgagcgaccgagccaccgagtgtcaccacagcgccgtgcctgtagatggatgcaactgccccgatgggacttacttgaaccagaagggtgaatgtgtaagaaaagcccagtgcccatgcattctggagggctataagttcatcctagcagaacagtcaacggtaatcaacggcatcacatgccactgtatcaatggaagattaagttgcccacagcgcccccagatgtttctcgcttcctgtcaggcaccaaaaacttttaagagttgcagccaatcaagcgaaaacaaattcggggccgcctgtgccccgacctgccagatgcttgccacaggggttgcgtgtgtgcccaccaaatgcgagccagggtgcgtgtgcgccgaaggtttgtatgagaacgcggacggacagtgtgttccacccgaggagtgcccctgtgaattctctggcgtttcctatcctggtggagcagaactccacacggactgtcgtacctgcagctgcagcaggggaaggtgggcctgtcagcaaggtactcattgtccgtccacttgtaccctgtacggcgagggccatgtgatcacttttgacggacagagattcgtcttcgatgggaattgtgaatacatactggctaccgatgtctgcggcgtgaacgactctcagcccacattcaaaatcctaaccgaaaacgtaatctgtggaaatagcggagtcacatgctcaagagctatcaaaattttcctcggcgggctcagcgttgtactagccgatcggaactacacggtgaccggcgaggagccacacgtccagctgggcgtgacccccggagccctcagcctggtggtcgacataagtattcctgggaggtataatctgacactgatatggaatcgacatatgacaattcttatcaggattgcaagagcatcacaggatcccctatgtgggttgtgcgggaatttcaacggcaacatgaaggacgatttcgagacaaggagccgctacgttgcaagttcggagctggaactagtgaatagttggaaggagagcccattgtgcggtgatgtcagtttcgttacagatccttgctctctgaatgccttccggcgatcatgggccgagagaaaatgttctgttattaattctcagacatttgccacttgtcacagcaaagtgtaccatctcccatattacgaggcatgcgtccgcgacgcctgtggatgtgattcagggggcgattgcgagtgcctctgcgacgctgtcgccgcatacgcccaagcttgtctcgataagggcgtctgcgtggattggaggactccagcattctgccccatctactgtggtttttataacacccatacccaagatggacacggcgagtaccagtatacccaggaggctaactgtacgtggcactaccagccctgtctttgccccagccagccacagagcgttcccgggagcaacatcgagggctgctataactgctctcaagatgagtattttgaccacgaggagggggtgtgcgtgccatgtatgccaccaactactcctcagccgccaaccactccacaactgccaacaactgggtccagacccacgcaggtgtggcccatgacagggacctctacaacaataggactgctttccagcaccggaccaagcccatctagtaatcacacaccagccagtccaactcagaccccactattacctgccaccctgactagctcaaaaccaaccgcctcaagcggtgagcctccacggccaaccacggctgtgactcctcaggctacgtccggcctgccacccactgcaaccctgagaagcacagccaccaaacctacggtcactcaggccactacgagagcgacggcttccactgcttcccccgccaccaccagcacggcacagtctacgactaggacgactatgactctccccacccctgccactagcggaacatcccccacacttccgaaaagcacaaaccaagagctgcccggaacaaccgcgactcaaactaccgggcccagaccaactcccgcaagcactaccggcccaaccaccccgcagcctggccagcccaccaggccaactgccaccgagacaacacagacacggaccacgacagagtataccacgccccagacccctcatactacacacagtcccccgactgctgggtcacctgttccttccactggcccagttaccgccacatcttttcatgctactaccacctacccaactccttcgcaccctgaaacgacgctgccgacccacgtccctcccttctctacctccctggtcacccctagtactcacacagtgatcactcccacccatgcacagatggccactagcgcctcaaaccattctgcaccaactggaactatcccaccccctaccaccctgaaagctactggatctacccacacagcaccccccattactcccacaacatccggaaccagtcaggcccactcctccttttccacaaacaagacacccacttcccttcactctcacacgagctccacacaccatcccgaggtgacccccacatctactaccacgataaccccaaatcctacctcaacccggactcgcactccggtggctcatacaaatagtgccacgtctagtcgaccgccccccccctttaccacacatagtccccctaccggctcctcccctttctcaagcactggaccaatgactgcaacgtcctttaaaaccacgacaacctacccgacgcccagccacccacagacaactttgcctacacatgtccccccgttctccacgagtctggtgactccatctacccatacggtcattacacccacacacgcacagatggctacatctgccagtattcacagcatgccaactggtactatccccccaccaacaactttaaaagccacggggagcactcatactgcccccacaatgactctcacaacatctgggacaagtcaagccctgtcatcgctcaacacagccaaaacgtccaccagcttgcactcacatacatctagtactcaccacgctgaggctaccagcacttccacgacaaacatcacaccgaatcctacgagtaccggcacacccccgatgacggttaccacctccggaacttctcagagtaggagcagcttttctacagccaagacttctaccagtctccacagccacaccagctccacccaccaccccgaggtgaccagcacctcaacgacctccatcacgccaaaccacaccagtacaggaaccagaacccctgtggcccatactaccagtgccacgagctctaggctccccactccctttactacccactcccccccgacaggaacgacacctatatctagtactggaccagtgaccgcgacttcatttcagaccaccaccacctatcccacgccgtcccatccacacactaccttgcctacccacgtccctagtttttcgacttctctggtcacaccctcaacccacaccgttatcattcctacccacactcaaatggcaacttccgcttcaatacactccatgccgacgggaaccataccccctccaacgaccattaaagccacgggatcaacccataccgctcctcccatgactcccaccacctcaggtactagccagtctcctagctctttcagcactgccaagacatctacctccctgccctatcatacctccagtacgcaccacccagaagttaccccgacatctacgacaaacataacacctaagcacacgagtactgggacccgcacacctgtcgctcacacaaccagtgctagcagtagccgcctgccaacaccatttactacccattcacctcctactggatccagcccgtttagttctacggggccgatgacagctacgagcttccagaccactacaacttaccctaccccaagtcacccacagaccacactcccaactcacgtacctccattttccacatctctggtcacccccagcacccatacagttataatcactacacatacccagatggcaacttcggcaagcatccattccacccctacaggaacagtcccgcccccaacaacactgaaggccaccggctcaacccatactgctccgcctatgacagtgaccacgagcggcacctcccagacccactcatcattcagtaccgccactgcttccagtagttttatctcttcctcaagttggctgccccagaatagctccagtaggcccccttcaagcccgataaccacacagctgcctcatctatcaagtgctacaacacccgttagcacgacaaaccagctgtcttccagtttttccccttcacccagcgccccaagtaccgtcagtagttacgtgcctagttcacattccagccctcagacctcctcgcctagcgtgggcaccagctcaagttttgttagtgctccggtgcatagtaccactttatcgtcggggtcacacagcagtttaagcacccatcccaccacagcctctgtcagcgcgtcgccactgttcccaagttccccagccgcatctacgactatccgggccactctgccacacacaatcagcagccccttcaccctgtctgctctgctcccaatttcaacagttactgtgagtcctacgcccagctcccacctggcctcaagtaccatcgcctttccttccactccaaggaccaccgccagcacgcacacggctccggcattttcctcacagagcaccacaagtaggtccacctcccttacgacgagagttcccacctcaggatttgtatcccttacctctggagttactggcataccaacttcaccagtcacaaacctcaccaccaggcaccctggaccgactctgtccccgactactcggtttttaacctcgtccctcacggctcacggctcaaccccagcatctgctccggtaagcagcctcgggactccaacgcctacttcgcccggagtctgttcagttcgggaacagcaggaggagatcaccttcaagggctgcatggccaacgtgactgtgactcgatgcgagggggcgtgcatttccgccgcgagcttcaatattattacacagcaggtcgacgctaggtgcagttgttgtcgcccattgcacagttacgagcagcagcttgagctcccttgtccagacccctccacaccagggcggagactagtcttaaccctccaggtgtttagccactgcgtttgttcttccgtggcatgcggcgattag

SEQ ID NO: 124945 - DNA, 1134 bp, Artificial Sequence
  Description of Artificial Sequence: Synthetic coding sequence
atgaaaaccctacccctcttcgtctgcatctgcgcgttaagtgcttgtttttctttttccgaggggcgggagagagaccatgagctgagacaccgcaggcaccatcatcagtcccccaagtcacattttgaattgccacactatccgggattgctggcgcaccagaaaccatttatccgcaagtcctataagtgtttgcacaagcggtgccgccctaaattgcctccgagtcctaataaccctcctaagttccccaatccgcatcagccccctaagcaccccgacaagaacagctccgtggttaatcccactctggtcgccactactcagatcccctcagtaacattcccttctgcctctacaaagataactacactgcccaacgtgaccttcttgccccagaacgccaccactatctcatccagggagaacgtgaacactagctcttcagtcgcgaccctcgctcccgtcaattctccggcgcctcaggataccacggcagccccacccactccctcagctacgacccccgctcccccgtccagcagtgctccccctgagactacggcggccccgcctaccccttccgccacgacacaggcgccaccctctagtagcgccccccccgaaaccacagctgcaccgccaactccacctgctacgacgccagcccctccctcttcttcagcaccaccggagacaacagctgccccaccaacccccagcgcaaccacgcctgcccccctatcctccagcgctcctcctgagacaaccgcagtgcctccaaccccttcagccactacactagacccatcaagtgcatccgcaccaccagagacaaccgcagcccctccaaccccctccgctaccaccccagctccacccagctctccagctcctcaggaaaccaccgcagctccaataactacaccgaacagctctcccaccacacttgctccagacacttctgaaacaagcgccgctcctacccatcagactacaaccagcgtgacaacacagaccactactaccaagcaacccacgagcgccccagggcaaaacaaaatcagtcggtttctgctatatatgaagaatctgttgaaccgcatcattgatgatatggtcgagcagtag

SEQ ID NO: 124946 - DNA, 1134 bp, Artificial Sequence
  Description of Artificial Sequence: Synthetic coding sequence
atgaagaccttgccgctgttcgtgtgtatttgtgccttgtccgcgtgcttttctttttctgaaggtcgtgaacgagatcacgaattgcggcaccggcgccatcatcatcagagtcccaaaagccacttcgaacttcctcactatccaggtctacttgcccaccaaaagcccttcattcgtaagagctacaagtgtctgcacaagaggtgtcgcccaaagctcccaccctcaccgaataatcctcccaaatttccaaatccacaccagccccctaaacacccggataagaattcctcggtggtgaatccaacactcgttgcaaccacacaaataccatctgttacattcccctccgcctctacaaaaatcaccactctaccaaatgttacgtttcttccacagaacgccacaaccatctcttctagagagaatgtgaatactagtagctctgtagcaacgctggcccctgtcaactctcccgccccccaagacactacagcagccccgcctaccccatctgcgaccacgcctgccccgcccagctcctcggctcccccagaaactactgctgcgccaccaaccccaagtgcgaccacgcaggcaccccctagtagttcagctccaccggagaccacagccgccccacctacgcctccagctaccacaccagcgccgccgtcttcttcagccccaccggagactaccgctgcaccccccacaccatccgccacgacacctgcccccctcagctcgtccgccccgcccgaaaccacagctgtcccaccaactccttcagccactaccctcgacccaagcagcgccagcgctccacctgagaccacagctgcccccccaacaccatctgctacaacccccgcaccacctagttcacctgccccacaggaaacaaccgcagcacccatcacaacgcccaattcatcccccactactctggccccggatacaagcgaaacttctgccgccccaacccatcagacaaccacgtctgtcacaacccagacgacaaccactaagcaacccacatctgctccagggcaaaacaagatatctcgattcctgctttacatgaagaacctactcaatcgcatcatagacgatatggtggagcaatag

SEQ ID NO: 124947 - DNA, 1134 bp, Artificial Sequence
  Description of Artificial Sequence: Synthetic coding sequence
atgaagacattacctctctttgtttgtatctgtgccttgtcagcctgcttttccttctccgagggccgcgagagagatcacgaattgcggcatcgcaggcatcaccaccagagccccaagagccacttcgaactgccccactaccccggcctactggcgcaccaaaaacctttcatccgcaaatcatacaaatgcctccacaaaagatgtaggccaaaactgccccccagccctaacaatccccccaaatttcccaatccacaccagccacccaagcacccggacaaaaatagttctgttgtcaaccccacgctggtggcgacaacccaaatcccaagcgtgactttcccaagtgcctcgactaaaataactactctccctaatgtgacttttctgccccagaacgctacaacgatcagctccagggaaaatgtgaacaccagcagctcagtcgccactctcgctccagtgaacagtcccgcacctcaagacaccacggccgcccctcctacaccctcagcaacaacccccgcccctccttcctccagcgcgcctccagaaacaacagcggcacctcctacgccgagcgccaccactcaagctcctccatctagttccgccccccctgagacgactgcagcccccccgactccccctgccaccactcccgcgcctccctctagctctgccccccccgaaaccacagccgcacctccgactcctagcgccaccacgcctgcaccactctcatcaagcgcgccacccgaaaccacagcagtaccccccacaccatccgcgaccacccttgatcccagttctgcatcggcccctcctgaaaccactgcagctcctcctacgccatcagccacgactccagctcctcccagcagcccagccccccaggagaccacagctgctcccatcacaaccccaaacagtagcccaactacactggctcccgatacatccgagacctctgcggctcctacgcatcagactaccaccagtgtgacaacgcagaccaccacaactaaacagccaacaagcgccccaggtcagaacaagataagtcgctttttgctctatatgaaaaaccttctcaatcggattatcgatgatatggttgagcagtag

SEQ ID NO: 124948 - DNA, 411 bp, Artificial Sequence
  Description of Artificial Sequence: Synthetic coding sequence
atgaaaactttgccactgtttgtgtgcatctgcgcattgtctgcctgcttttctttcagtgaggggagagagcgggatcatgagctgaggcatcgaaggcatcaccaccagtctccaaaaagccatttcgagctgccccattatcccgggctcctcgcgcaccagaaaccgtttatcaggaaaagttataaatgcctacacaaacgttgtaggccaaaactgcctccaagccctaacaacccgcctaagtttccaaacccccaccaaccccccaaacatccagacaaaaacagcagcgtggttaacccgacgctggtggcaactacccagatcccatccgttactttccctagcgcgagcaccaagattaccaccctcccgaatgtgacattcctcccacagaatgcctag

SEQ ID NO: 124949 - DNA, 1743 bp, Artificial Sequence
  Description of Artificial Sequence: Synthetic coding sequence
atgaccgctcctgcagggccaaggggaagcgaaacagaaagacttctaaccccaaatcctggctatggcacccaggctggaccttctcccgccccacccacccctcccgaggaggaagatcttcggcgcagattaaaatactttttcatgtctccctgcgacaaattccgcgccaagggccgaaagccttgcaagctgatgctccaggtggtaaagatactggtggttactgttcaactgatcctgttcggcctgagcaaccagttggcggtcactttccgtgaagagaacaccatcgccttcagacatctcttcctgctaggctactcagacggtgcggacgatacctttgcggcctacacccgggagcaattatatcaagcgatcttccacgcagtggatcagtacctcgccctgcctgacgtttcattaggaagatacgcctatgtccggggaggcggggacccctggactaacgggtccggactggccctgtgccaacgctactaccatcggggtcatgtggatcctgccaatgacactttcgatatcgatcctatggttgttactgactgcatccaggtggatccccccgagcggccaccccctccacccagcgacgatttaacactgctggaatcaagctctagctacaagaacttgacccttaagttccacaagttggtgaatgtgacaattcacttcagactgaaaacaattaatcttcagtcactgatcaacaacgagatcccagattgttacacgttctcagttttgatcaccttcgacaacaaagcacacagcggcagaatccctatctcacttgagacccaggcccatattcaggaatgtaaacacccctccgtttttcagcacggggacaactcttttagactgcttttcgatgtggtggttattctgacctgttctctgtcctttctactgtgtgctcgaagcctcctccgagggttcctcctccagaatgaattcgttggcttcatgtggagacagagaggtagggtgatttcactttgggagagactggagttcgttaatgggtggtatatcctcctggtgacgtctgatgtcctgacaattagcggaactattatgaaaataggaattgaggcaaagaacctcgccagttatgatgtatgctcgatacttctcggaacatccacacttctggtgtgggtcggggtgattcggtacctgaccttctttcataactacaatatcctcatcgcgacgcttcgtgtggcattacccagcgtgatgaggttctgttgctgcgtcgccgtgatttatctgggctattgcttctgtggatggatcgtcttgggcccttaccacgttaagttccgctccctctcaatggtgtccgagtgtctgttcagcctgatcaacggtgacgatatgttcgtcacctttgcagcgatgcaggctcagcaaggaagatcctcccttgtgtggctgttttctcagctctatctgtactcctttatatctctcttcatctacatggttctgtctctctttatcgctctgattactggagcctatgacaccatcaaacaccctggtggcgctggggccgaggagtctgagctgcaggcgtacatcgctcagtgccaggattcaccaacctctggcaagtttcggcggggctcaggaagcgcttgcagtctgctgtgttgctgtggaagagacccctccgaggagcactcccttctggtgaattag

SEQ ID NO: 124950 - DNA, 1638 bp, Artificial Sequence
  Description of Artificial Sequence: Synthetic coding sequence
atgactccaagccagccgacccgaggcagctcatgcacaaggccttcttccatgttgtggacgagcacgtggagatgcttaacatgccattgggcaggaatgcggatgtccgtggtcggggtaacacttggcccgatggcccagggactgctatctgcatccggtacaacaaccgaagccacttggactcgcccaactacacacctgacgctcatcaggtggtggttactgaccgcctcaaggtggatccccccatccggtccactgcggccaccagctaccatatctccttcttggaaagccgccccggttacacggacgtcccgttccaacagcacttccaccgcctgttctctggaaggtgggcctggatggggtcgacaacacacccggcacagccacccctcaaattactttcccaaagttggaaccgggcctccaaggcctagatggtgcctcctgggagaacatttcccctgccagcttcagtctcagcacgtggcaggagatgccggtacctggggcagaaagggacccgaggatgccccagacccacatcccagccttcttccacggctcgtgaacgtgacaatccattttagactgaaaactataaacctgcagagtttaataaacaacgagattcccgattgctacaccttttcagttctgattacatttgataacaaagcccacagcggtcgaatcccaataagcttagaaacacaggcacacatacaagagtgcaaacacccatcagtatttcaacacggggataattctttcagactgctgtttgatgttgtggtgattttgacatgtagtttatccttcctgctatgtgcccgctcactgctgcgcgggtttctgctgcagaacgagttcgtcggcttcatgtggagacagcggggaagagtcatctccctgtgggaaaggctcgagttcgtaaatggttggtatatcctgctggttacctcggatgtgttgactatatcaggcaccatcatgaagatcggcattgaagcaaaaaatcttgcatcatacgatgtctgttcaatactcctcgggaccagtacgcttttggtgtgggtaggcgtaatcaggtacttgactttcttccataactataacattctaatcgctaccctgcgagtggctctgcctagtgtgatgcgcttctgttgttgcgtcgccgtgatttatctggggtactgcttttgtggatggattgtgctcggaccctatcatgtgaaattcaggagtctatctatggtgtcagaatgtctgttcagcttgataaacggtgacgacatgtttgtgacgttcgcagccatgcaagctcagcaggggagatcctcactggtgtggcttttttcacaactgtatctatacagcttcatctcactcttcatctatatggtcctgtctctgtttatcgccctcatcaccggcgcatacgataccatcaaacatccggggggcgctggagctgaggaatctgaactccaagcttatattgcccagtgtcaggattcaccaactagcggcaagtttaggagaggcagcgggtcagcgtgttctctgctgtgttgctgcgggcgggatccatcggaggagcattccctgctggttaactag

SEQ ID NO: 124951 - DNA, 1701 bp, Artificial Sequence
  Description of Artificial Sequence: Synthetic coding sequence
atggccaggcaaccatacaggttcccgcaagctagaataccggagcgaggtagcggggtcttcaggctcactgtcagaaacgccatggctcaccgtgattctgagatgaaagaggagtgtttacgggaggatctgaagttctatttcatgagtccctgcgagaaatacagagccaggaggcagatcccctggaaactcggactgcaaatccttaaaatcgtgatggtgacaactcaactggtgcgctttggactctcaaatcagcttgtcgtagcgtttaaagaggacaataccgtcgctttcaagcacctgtttcttaaggggtacagcggcaccgacgaggacgattatagctgttcggtgtatacccaggaagacgcctatgagagtattttcttcgctattaaccagtatcaccaattgaaggatattactcttggaacgctagggtatggagagaacgaggataaccgtattggcctgaaagtgtgcaagcaacactataagaagggcacaatgttcccctctaacgagacccttaatattgacaacgacgtcgaactggactgcgtgcagctggatcttcaggatttatcaaagaagccacccgactggaagaatagctcctttttccggctcgaattttacagactgcttcaagtcgagatttcctttcacctcaaaggtatagacctccagaccattcactctcgggagttgcccgattgttatgtttttcagaatactatcatcttcgacaacaaggctcactctgggaaaattaaaatctattttgattccgacgcaaagattgaggagtgcaaggatttgaatatttttgggagtactcagaaaaacgcccagtacgtgctggtgtttgatgccttcgtaatcgtgatctgcttggctagcctcatactgtgcacaaggtctattgtccttgccctgcgcctcagaaaaaggttcctcaacttctttttggaaaagtacaagcgacctgtgtgcgatacggaccaatgggagttcataaatgggtggtacgtgctggtgattattagtgaccttatgactatcattggcagcatcctgaagatggaaatcaaagcaaagaacctcactaactatgatttgtgttcaatttttcttggtacaagcacactgttggtctgggtcggcgtgatacgttacctgggatattttcaagcctacaatgtcctaattcttactatgcaggcgtccctccccaaagtgctccgtttctgcgcatgcgccggtatgatctacctgggatacacattctgcggatggatcgtcctcggaccctatcacgacaagttcgaaaatctcaatacggttgctgagtgcctcttcagcttagttaacggggacgacatgtttgcaacttttgcgcagatccagcaaaaaagcatcctggtctggctgttcagtcgcctttacctgtactcattcataagtctcttcatctacatgattttgagcttattcatcgcactgattaccgacagctatgacaccatcaagaaatttcagcagaacggcttccctgagacagacctccaggagttcctaaaggaatgcagtagtaaagaggagtatcaaaaagagtcatccgccttcctcagctgcatttgctgtcgtagaagaaagagatcagacgatcacctgattcccatatcctag

SEQ ID NO: 124952 - DNA, 1662 bp, Artificial Sequence
  Description of Artificial Sequence: Synthetic coding sequence
atggccgacccggaggtggtagtctcatcctgttcgagtcacgaagaagaaaaccgttgcaatttcaaccaacaaacatccccctctgaagagctactgctagaggaccagatgagaagaaagctgaaattctttttcatgaatccttgtgaaaaattctgggcccgggggcggaagccttggaaattagctattcagatcctcaagattgctatggtcacaatacagctggttctgtttgggctatccaatcagatggtggtcgcatttaaagaggagaacactattgcgttcaagcacttgttcctgaaaggatacatggatcgaatggatgacacctacgcagtgtatacacagtccgacgtgtacgaccagctgatcttcgccgttaatcagtatctgcagctgtataatgtctcggtagggaaccatgcttacgagaacaaggggaccaagcaatcagctatggctatctgccagcatttctacaagcgaggtaatatatacccgggaaatgacactttcgacatcgatcccgaaatcgaaacagaatgcttcttcgtggaacctgacgaaccctttcacatcgggacacccgccgagaataagctcaatttgacactcgactttcatcggttgctcactgttgaactacagttcaagcttaaggccattaacctgcaaaccgtgaggcatcaagaacttcctgactgctatgattttactctgacaatcacctttgataacaaggcccattccggccggattaaaatcagcctagacaacgatatctcaatacgcgaatgcaaagactggcacgtctctggatctatccagaagaacacccactatatgatgattttcgatgccttcgtgatcctgacctgtctggtgtcactcatactgtgcatcagatcagtgatccggggcctccagctccagcaggagtttgtaaacttctttttactccattacaaaaaggaagtttccgtaagtgatcagatggagtttgttaacggctggtacatcatgatcatcatctcagacatcctaacaatcatcggatcaatccttaaaatggagattcaggcaaaatctctgacaagctatgatgtctgctccatcctactggggacctcaactatgcttgtgtggttgggtgtcatccgctatttgggtttcttcgcgaagtataatctgcttattctgacactgcaagcagctctccctaacgtgattcgcttttgttgttgcgccgcgatgatctacctcggttactgcttctgcggatggattgtcctcgggccctaccacgacaaatttagaagcttaaatatggtctcagaatgcctgttttccctcattaacggagacgacatgttcgctacatttgccaaaatgcagcagaagagttatctggtctggttgtttagcagaatttacctttacagtttcatcagtctgtttatttacatgatcctgagcctgtttatcgcccttatcacagacacttatgagactattaagcagtatcagcaagacgggttccccgagactgagctgagaacttttatcagcgagtgtaaggatctccccaactccggcaaataccgacttgaagacgacccacctgtcagcttgttttgctgctgcaagaaatag

SEQ ID NO: 124953 - DNA, 1494 bp, Artificial Sequence
  Description of Artificial Sequence: Synthetic coding sequence
atggctgacccagaggtggtagttagcagctgtagctcacacgaagaagagaaccgttgcaattttaaccagcagacgagcccatcagaggagctactgttggaagaccagatgcgccgaaagttgaaattcttctttatgaacccctgcgagaaattctgggctagaggcaggaaaccttggaaactagcaatccaaatcctgaagattgcaatggtcaccattcagtaccttcagttgtataacgtgagtgtgggaaaccacgcatacgagaataaaggaacgaagcagagtgcgatggctatttgtcagcacttttacaaacgtggaaacatttatccaggtaacgacaccttcgacatcgatcccgaaattgaaactgagtgtttcttcgtggaacctgatgagccttttcacatcggtacgcccgcagaaaataagcttaacctaacactcgatttccatcggcttctgacagtcgagctccagtttaagctgaaagctatcaatcttcagacagtacgccatcaggagctcccagattgctatgattttacacttacgataacattcgataacaaagcgcacagtggacggattaagatcagtctggataacgacatttcaatccgcgaatgcaaggattggcacgtgagtggtagcatacagaagaatacacattatatgatgatcttcgacgcatttgtgatcctgacctgtcttgttagcttgattctgtgcataaggtcagtgattagaggacttcaactccagcaggagtttgtcaacttttttctgcttcactacaaaaaggaggtgagcgtctcggatcagatggagttcgtcaacggatggtacatcatgataattattagtgatattctgaccattatcggcagcattctcaaaatggagattcaggctaagtccttaacctcctatgatgtgtgcagcatcctgttaggcactagcaccatgttggtctggctgggcgtgattagatacctgggtttcttcgcaaaatacaatcttctgatactgacgcttcaggcggccctcccgaacgtaataaggttctgttgttgtgccgccatgatctatctgggctactgcttctgcgggtggattgtgctgggaccttatcatgacaagttccgtagcctgaatatggtcagcgagtgccttttctcgctgattaacggcgacgatatgttcgctacctttgcaaagatgcaacaaaaatcgtacctggtttggttgttcagtcggatctatttatacagctttatcagcctgttcatatacatgatattatccctgtttattgctcttatcacagatacctatgaaacaattaagcagtaccagcaagacgggttccccgagactgagctgcggacatttatttccgagtgcaaagacctgcctaacagcggcaagtacaggctcgaagatgatccccccgtctctctgttctgctgttgtaaaaagtag

SEQ ID NO: 124954 - DNA, 966 bp, Artificial Sequence
  Description of Artificial Sequence: Synthetic coding sequence
atggctgacccagaagttgttgtttcctcatgcagctcccacgaagaagaaaaccggtgcaatttcaatcaacagactagcccgtcagaggaactactcctcgaagatcagatgcggagaaaactgaagttcttttttatgaacccatgtgagaagttctgggcccgcggcagaaaaccatggaagctggccatacagatcctgaaaattgctatggtgacaatccagcttgttctgttcggcttgagcaatcagatggtcgtggcctttaaggaggagaacactatcgcttttaaacatttgttccttaaaggctatatggatcggatggatgacacttacgctgtttacacacagagcgatgtctacgaccagctcatctttgccgtaaatcagtacctgcagttgtacaatgtgagcgtcggaaatcacgcctacgaaaataaggggacgaaacagagtgccatggctatctgccagcatttttacaaacgggggaacatctatcccggaaatgacacctttgacattgacccagagatcgaaaccgaatgcttcttcgtcgagccagacgagcccttccatattgggactcctgcggagaacaagttaaatctaacgctggatttccatcgcttgctgacagtagagctccagtttaagctgaaagcgattaacctgcagactgttaggcatcaagaattgccagattgctatgactttactctgaccatcacctttgataacaaagcccacagtggacggatcaaaatttcactggacaatgatatcagcatcagagagtgtaaggattggcacgtctctggctcaatccagaaaaatacccattatatgatgatcttcgatgccttcgtgatacttacttgcctcgtgtctctcatcttatgtattaggagtgtcatccggggattacagctccaacaagtgggcaacgtggcattttag

SEQ ID NO: 124955 - DNA, 1494 bp, Artificial Sequence
  Description of Artificial Sequence: Synthetic coding sequence
atggccgatcctgaggtcgtggtctcatcatgttcaagtcatgaggaggagaaccgatgcaactttaatcagcagacttctcctagcgaggagctgctgttggaggaccagatgaggagaaaattaaagttcttctttatgaatccctgcgagaagttttgggctagagggaggaagccttggaagctggccatacagattctcaagattgcaatggtcacgattcaatatttgcaactgtacaatgtgtccgtggggaatcatgcgtacgagaataaggggacgaagcaatccgccatggccatttgccagcacttttacaagaggggcaatatctatcccggaaacgacaccttcgatatcgaccccgaaatcgagactgagtgtttttttgtggagcctgatgaaccgtttcacataggtacccccgcagaaaataagctgaaccttacactagacttccacaggctgttgacagtggagctgcagttcaagctgaaggccattaatctccaaaccgtacgccaccaggagctccctgactgctacgatttcacactgaccattaccttcgacaataaggcacattccggccgaataaagatttccctcgataacgacattagcatcagagagtgcaaagattggcacgttagcggtagcattcaaaagaacacacattatatgatgattttcgacgcttttgtcatactgacttgcctggtgtcgctgatactctgcattcgcagtgtcatcagggggcttcaacttcagcaggaattcgttaatttttttctgctgcactataagaaggaggtgtctgtgagtgaccagatggaattcgttaacggctggtatatcatgatcattattagtgacatattgactataatagggtctatactcaagatggagattcaggcaaaatccctgacatcctatgacgtgtgctccatccttctgggaacaagtacaatgctggtctggcttggggtgatccgatatctaggtttcttcgctaaatacaacctgctaatccttactttgcaagctgcacttcctaatgtcatccggttttgttgctgtgctgcgatgatctatctgggctactgtttttgtggctggatcgttttaggaccataccatgacaagtttcgctccctgaacatggtatccgagtgtttattttctctaattaatggcgatgacatgttcgctacctttgccaaaatgcagcagaaaagttaccttgtgtggctcttcagccggatctacctatacagctttatcagtttattcatatatatgatcctaagtttattcatcgccttgatcactgatacctatgagacgattaaacagtatcagcaagacgggtttcccgagacggagctgcggactttcatctccgaatgtaaggacctacccaactctggtaagtaccggttggaagacgaccctccagtgtccctcttctgttgttgcaagaaatag

SEQ ID NO: 124956 - DNA, 1662 bp, Artificial Sequence
  Description of Artificial Sequence: Synthetic coding sequence
atggctgatccggaggtcgtcgtcagtagctgttcctcccatgaagaggagaaccggtgtaactttaatcagcaaacatcgcccagtgaggagctgctgttagaggatcagatgcgtagaaagctgaagttctttttcatgaatccctgcgagaaattttgggcccggggccgcaagccctggaaactggcaatccagattcttaaaattgccatggttactatccagctggttctgttcggcctgtccaaccaaatggtggtggctttcaaggaagagaataccatcgcttttaagcatctgtttctaaaaggctatatggaccgaatggacgatacctatgccgtatatactcagagtgacgtctatgatcagctcatctttgctgtcaatcagtatcttcagctttacaacgtcagcgtgggcaaccacgcctatgaaaataagggtactaagcagtcagcaatggcgatctgtcagcatttttacaagagaggtaatatatacccgggcaacgatacgttcgatatcgaccctgagatcgagaccgagtgcttctttgtggagcccgatgaaccgttccatataggcacgcctgcagagaataaacttaacctcacactggacttccaccggcttctcacagtggagttacagtttaaacttaaggctattaatttgcaaaccgtgaggcatcaggagctgcctgattgctacgactttactctcaccataactttcgacaacaaggctcacagtgggcgcattaaaatcagccttgacaacgatattagcatccgggagtgcaaggattggcatgtcagcggatcaattcagaaaaatacccattacatgatgatttttgatgcatttgtgatccttacctgtttagtatctctgatactgtgcattagaagcgtgatccgcgggctgcagctgcagcaggagtttgtcaatttcttcctacttcattataaaaaggaagtgtctgtgtctgatcagatggaattcgtgaacgggtggtatattatgattatcatctccgatatcctcactattatcgggagcatcctcaagatggagattcaggccaagtctcttacctcgtatgacgtctgctctatcctgctcgggactagtaccatgctggtgtggctaggagtcattaggtacctgggtttctttgctaagtacaacctcctaattcttaccctgcaggctgccctgccaaacgtgatccggttctgctgttgcgccgcaatgatctacctcggttattgtttttgcggctggatagttttagggccataccatgataagttccgttcacttaatatggtcagcgaatgcctgtttagcctgatcaatggcgatgatatgttcgcaacatttgcgaagatgcagcagaaaagctatctcgtgtggctgttctctaggatatacctgtacagttttatcagccttttcatttacatgatactttctctgtttattgctctcatcacggacacctatgaaactatcaaacaatatcagcaagatggcttcccggagactgagttgcggacctttatttctgagtgtaaggacctgcccaactctggcaaataccggctcgaagatgaccctccagtgtctctgttttgctgttgcaagaaatag

SEQ ID NO: 124957 - DNA, 2442 bp, Artificial Sequence
  Description of Artificial Sequence: Synthetic coding sequence
atgtctctgctgggcgatcccctgcaggctctcccgccatccgctgcaccaactggccccttgttggccccaccggcgggggccacactgaaccggctgagggaaccactgctgcggcgactgtctgaactcctcgaccaagcgccagagggaagaggctggcgcaggttagcggagctggctggttcccgcggccgcttgcgactctcctgcctcgacctggagcagtgctccctgaaagtgctggaacccgaagggagccctagcctttgcttgctcaagctgatgggtgagaagggctgcactgtgaccgagctctcggatttcctccaagctatggagcacaccgaggtgctgcagttgctctctcctcccggtatcaaaatcacggtgaaccctgagtctaaggcggtgttagcaggtcagttcgtgaagctatgttgtagggcaactggccatcccttcgtccagtatcagtggtttaaaatgaacaaagaaatccctaatggcaatacatctgagctgattttcaatgccgttcacgtgaaagatgccgggttttacgtttgccgtgtcaacaacaatttcacattcgagttttcacagtggtcccagctcgacgtttgtgacattcctgaaagctttcaacgttcggtcgatggtgtcagtgagtcaaaacttcagatctgcgtggaaccaacatcacagaaactcatgcctggttcaaccctggtgcttcagtgtgtggccgtaggatcacctatacctcattatcagtggtttaaaaacgagttaccactcacacacgagactaaaaagctttacatggtcccttacgtcgacctggaacaccaggggacctactggtgccatgtgtacaatgatagggactcgcaggacagcaagaaagtcgaaatcatcatcgatgagctcaacaatctgggacaccccgataataaggagcagaccacagaccagcctttggcgaaagataaagttgcactgctgatagggaacatgaattatcgcgagcatccaaagctcaaggctcccctcgtcgacgtctatgagctgaccaatcttttacgccagctcgacttcaaggtagtgagcctgctcgatctcactgaatacgaaatgcgcaatgcagtggatgagtttttacttctgctggacaaaggggtatacgggctcttgtattacgctggccacggctatgaaaatttcggcaacagtttcatggtgcccgtcgacgcccccaatccatacagaagcgagaactgtctgtgtgtccaaaacattttgaaactcatgcaggagaaggaaactggtctgaatgtgttcctgctcgatatgtgtcggaagaggaacgactacgacgatactatccctattctcgatgctctgaaggtgacagcgaacatagtgtttggctacgccacctgtcagggggccgaggccttcgagatacagcacagcggattagcaaacgggatcttcatgaagttcctgaaagacaggctgttggaagataagaaaattactgtgttgttagacgaagttgcggaagatatggggaagtgtcaccttacaaaaggcaagcaggcgctggaaatccggtcgagcctctctgaaaagagggccctcaccgaccctatccagggcactgaatacagcgctgagagcctggtgcgcaatctgcagtgggcgaaggctcatgaactgcccgagtccatgtgcctcaaattcgactgcggggtgcaaattcaactcgggtttgccgcagagttttccaacgtcatgatcatctatactagcatcgtgtataaacctcctgaaatcatcatgtgtgatgcttacgtgacagacttccctctcgatctggacatcgatcccaaggacgctaacaagggtactcccgaggaaaccggaagttatcttgtgtccaaggacctccctaagcactgtctgtacactagactgagctcacttcaaaagctgaaggaacatttggtgttcaccgtttgcctttcttatcagtattctggtctggaggatacagtggaagacaaacaggaggttaacgtgggcaagcctctgattgcgaagcttgacatgcatagaggactaggccggaagacttgtttccaaacttgtctgatgtccaacgggccatatcaatcatccgcggcaacatctgggggagccggccattatcatagccttcaggaccccttccatggcgtctaccacagtcatccaggtaatccgagcaacgtgaccccggctgacagctgccactgttctcggacccccgatgcttttatatctagcttcgcccaccatgcctcttgccacttctcccgatctaacgtacctgtcgagaccaccgatgaaattcctttctccttttccgatcgactgcgcatttcagagaaatag

SEQ ID NO: 124958 - DNA, 2475 bp, Artificial Sequence
  Description of Artificial Sequence: Synthetic coding sequence
atgtcgctcttgggagatcccttgcaagctctgccaccatctgcagcacccacgggccccttgctcgcccctccagccggcgctactctgaatcgcctccgggagccactgctgaggagactgtctgaactcctggatcaggcccccgaggggagaggttggcggcgcttggccgaactcgccggatcaagagggaggctgcgcttgagctgtctcgacttggagcagtgctccctcaaagtgctcgaacccgagggttccccatccctgtgtctgctgaagctgatgggcgagaaggggtgcaccgtgaccgagttgtcagatttcctgcaggctatggagcacacggaagtcctgcagctcctctccccgcctggaatcaagattaccgtgaatccggaatctaaagcggttctggccggtcagttcgtcaagctgtgttgcagggcaacaggacatccctttgtccagtaccaatggttcaagatgaacaaggagatcccaaacggtaatacttccgagctgatcttcaacgccgttcatgtaaaagatgccgggttctacgtgtgccgcgtgaacaataatttcacctttgaattcagtcagtggtcccaactggacgtctgcgatatccctgagagcttccagcggtccgtggacggggtgtctgaatccaaactgcagatctgcgtggagcccacttcacagaagcttatgcctggctcgaccctggtgctacagtgcgtggccgtgggatctcccatccctcactaccaatggtttaagaacgagcttccccttactcacgaaacaaaaaaattgtacatggtaccatacgtggatctcgagcaccagggaacttattggtgtcacgtgtataacgaccgggatagtcaggactccaagaaggttgagattatcattggaagaacagacgaggccgtggaatgtactgaagacgagcttaacaacctgggtcaccctgacaacaaggaacagacaaccgatcaaccactcgctaaggataaggtggctcttctgataggaaacatgaattacagggagcatccaaagctgaaagccccacttgtcgacgtttatgaacttactaatctgctcaggcagctcgatttcaaagtggtttctctattagacctcaccgagtatgagatgcgaaacgcggtcgacgaattcctgctactgctcgacaagggagtatacggactcctctactacgctggccacggatatgaaaactttggcaacagcttcatggtcccggtcgatgcccccaatccctatcgatccgaaaactgtctgtgtgtgcagaacattctgaagttgatgcaagagaaagagacagggctgaatgtgtttctgctggatatgtgtcgcaaacgaaatgactacgacgatacgatccctatactggacgccttaaaggtcacagctaatatagtattcggttatgcgacttgtcagggcgccgaggctttcgagattcagcattccggattggcaaacgggattttcatgaagtttctcaaagaccggctgcttgaggataagaagattacggtattgttggatgaggtggctgaagacatgggcaaatgccacctgacaaagggcaaacaagcactggaaatacggtcaagccttagcgaaaagagagctttgacggatccaatacaagggacagaatattctgccgagagcctggtaagaaacctgcagtgggctaaggctcacgagctgccagaaagtatgtgtctaaagttcgactgcggggtgcagattcagctcggattcgcggctgagttttcaaacgttatgattatttatacttcaattgtgtacaagccgcccgaaataattatgtgcgacgcctacgttacagattttcctctggatttggatattgatcccaaggatgccaacaaggggacacctgaagagacgggctcatacctcgtgagcaaagatctcccaaaacactgtctgtacacacggctgagctctttgcagaagctcaaagaacacctggtgttcaccgtgtgtctttcctaccagtatagcggactcgaagatacagtggaggacaagcaggaggtgaatgtgggcaaacccctgatagccaagttggacatgcacaggggattggggcgcaagacgtgttttcagacatgtttaatgagcaacggcccctaccagtcttccgcagctacatccggaggagcaggccattaccactcacttcaagatccattccacggggtctatcattctcacccggggaacccatccaacgttacacctgctgattcatgtcactgctccaggacccctgatgcgttcatatcatctttcgcacatcacgctagctgccacttctctcgttcaaatgtgcccgtggagaccaccgacgaaatccccttttcattctctgatcggctgcggatctcagaaaagtag

SEQ ID NO: 124959 - DNA, 441 bp, Artificial Sequence
  Description of Artificial Sequence: Synthetic coding sequence
atgacaatgagatctctactccggacgccattcctgtgtggcctcctgtgggctttctgtgcccctggtgcacgagctgaagaacccgccgctagtttttcccagcccggcagtatgggcttagacaaaaataccgtgcacgatcaggagcatataatggaacacctcgaaggagtaatcaacaagcccgaagctgaaatgagccctcaggaattgcagttgcactactttaagatgcacgattacgacggcaataacttactggatggattggaactttctacagcaatcacccatgtccataaggaagagggctctgaacaggcgcctctgatgtcggaggacgagctaattaacattatcgacggagtcctcagagacgacgacaaaaacaacgatgggtatatcgactacgcagagttcgcaaagagtctgcaatag

SEQ ID NO: 124960 - DNA, 441 bp, Artificial Sequence
  Description of Artificial Sequence: Synthetic coding sequence
atgaccatgcggagtcttcttcgaacaccattcctgtgtggcttgctgtgggcattctgtgcacccggcgctcgcgcagaagaacccgcagccagcttttctcagcctgggtctatgggactggacaagaatacagtgcatgaccaagagcacatcatggaacacctagagggagtgattaacaaaccagaagccgagatgtcccctcaggagctgcagcttcactactttaagatgcatgactacgacggcaataatctactagatgggctggaactctccacagccattacccacgtgcataaggaagaaggatccgagcaggccccacttatgtcagaagacgagctgatcaatatcatcgatggcgtactgagggacgacgacaagaataatgacggatatatcgactatgccgagttcgccaaaagcctgcagtag

SEQ ID NO: 124961 - DNA, 285 bp, Artificial Sequence
  Description of Artificial Sequence: Synthetic coding sequence
atggaacacctggagggggtcatcaataagccagaggccgaaatgtctccacaagagctccagttacactacttcaagatgcacgactatgacggtaacaatcttctggatggtcttgagctgtccacagctatcacacacgtgcacaaagaagagggatccgaacaagcccccctgatgagtgaggacgaactcatcaatatcattgacggtgtgctgcgggacgacgataagaataatgacggttatatagactacgccgaattcgccaaatcattacagtag

SEQ ID NO: 124962 - DNA, 441 bp, Artificial Sequence
  Description of Artificial Sequence: Synthetic coding sequence
atgacaatgcgatcattgctgagaacgcccttcttgtgtgggttgttgtgggctttttgtgctcccggtgccagggctgaggaacccgctgcaagctttagccagccgggatcgatgggattggataaaaatacagttcacgaccaggaacatatcatggaacatctggagggcgtgatcaataagcctgaagccgagatgtcaccacaggagctacaactacactacttcaagatgcacgactatgacggcaacaacctgctcgatggcctcgaactcagcaccgcaatcacccacgtccacaaagaagagggaagcgagcaggctcctttgatgtcagaggacgaactgatcaatatcattgacggagtgctgagagacgatgacaaaaacaatgacgggtatatcgactatgccgagttcgccaagtccctgcaatag

SEQ ID NO: 124963 - DNA, 441 bp, Artificial Sequence
  Description of Artificial Sequence: Synthetic coding sequence
atgacgatgaggtctcttctgcggactccttttctgtgcggtctcctgtgggctttttgcgcacctggagcaagggcggaggagccagccgcaagcttttcccagcccgggtctatgggcctggacaagaacaccgtgcacgatcaggagcacatcatggagcacctggagggagtgattaacaagccagaagctgagatgagcccccaggagcttcaacttcactactttaaaatgcacgattacgacggaaacaacctactggacggcctggagctttctactgcaattacccatgtgcataaagaggaaggaagcgaacaggcacccctgatgtccgaagacgagctgattaatatcattgacggggtgctccgcgacgacgataaaaacaacgacgggtatattgattatgccgagttcgccaagtctttacaatag

SEQ ID NO: 124964 - DNA, 285 bp, Artificial Sequence
  Description of Artificial Sequence: Synthetic coding sequence
atggagcatcttgagggagtgataaataagcctgaggcagagatgagtccgcaagaactgcagctgcactattttaaaatgcatgactatgacgggaataacttgctggatgggctggagctctctaccgctataacccacgtgcataaagaagaagggtccgagcaggcccctcttatgagcgaagacgagcttatcaatataatcgacggtgtacttcgagacgacgataagaacaacgatggttacattgactacgccgagttcgcaaagagcctgcagtag

SEQ ID NO: 124965 - DNA, 285 bp, Artificial Sequence
  Description of Artificial Sequence: Synthetic coding sequence
atggagcatctcgagggggtgattaacaagccagaggcggagatgagcccccaggaactgcagcttcattatttcaagatgcacgactacgacggtaataacctgctggacggacttgagctaagcacagcaatcactcacgtgcataaggaggaaggctcggagcaagcacccttgatgtctgaggatgagctcattaacataatcgatggcgttctgcgcgacgacgacaagaacaacgatggatacattgattatgccgaattcgctaagagtttgcagtag

SEQ ID NO: 124966 - DNA, 441 bp, Artificial Sequence
  Description of Artificial Sequence: Synthetic coding sequence
atgactatgcgctccctgctgcggacgccttttctatgcggattgctgtgggcattctgtgctcccggtgctagagctgaggagcccgccgcgtcctttagtcagcccggctccatgggactcgataaaaacaccgtacatgaccaggaacacattatggagcacttggagggtgtgatcaacaagccggaagccgaaatgtctcctcaggaactgcagcttcactatttcaaaatgcatgattacgatggcaataatctcctcgatggcctggagctgagtactgccatcacacacgtgcacaaagaagaaggctctgagcaagcgccactaatgtcagaggacgagcttattaacatcatcgatggcgtcttaagggacgatgataaaaataacgacggctatatcgattacgctgagttcgcaaagtcgctgcagtag

SEQ ID NO: 124967 - DNA, 441 bp, Artificial Sequence
  Description of Artificial Sequence: Synthetic coding sequence
atgaccatgcgcagcctacttcgaaccccattcctgtgtggactgctctgggcattctgtgcccctggggcccgggcagaggaacccgccgcttcgtttagtcaacccggctccatgggccttgataaaaataccgtgcacgatcaggaacacatcatggaacaccttgaaggcgttattaataaacctgaggcggaaatgagtcctcaggaactgcagctgcattattttaagatgcatgattacgacggcaacaatctgcttgatggactggagctgagcactgcaatcacgcatgtacacaaggaggagggctcggagcaggctcccctaatgtccgaagatgagctgatcaacattatcgatggagtactgcgggacgacgataagaataacgacgggtacattgattatgcggaatttgccaagagtcttcagtag

SEQ ID NO: 124968 - DNA, 186 bp, Artificial Sequence
  Description of Artificial Sequence: Synthetic coding sequence
atgaccatgagatcgctgcttaggaccccatttttatgcggtcttctctgggccttctgcgcccccggagcccgcgcagaagaacctgctgcatcattttctcagccaggcagcatgggattagataagaatactgtccacgatcaagagcatatcatggaacaccttgaaggggttatcaattag

SEQ ID NO: 124969 - DNA, 384 bp, Artificial Sequence
  Description of Artificial Sequence: Synthetic coding sequence
atgttatcggtctgttcatgtcgcacctctagcggtatgcggagccaatggccctccgctcgtcagaggtcttcttccctgagcacatttcgccatattatggagcatctggagggggtaatcaacaagcccgaggctgagatgtcccctcaggagctccagcttcactattttaaaatgcatgattatgatggcaacaatctccttgatggcctcgagctgtcaaccgcaatcacccacgtccataaggaggagggatcagagcaagcccccctgatgtccgaggacgaactgatcaacatcattgatggcgtgctgcgagacgacgataagaacaacgacggctacattgactacgccgagttcgcaaagtcactccagtag

SEQ ID NO: 124970 - DNA, 3423 bp, Artificial Sequence
  Description of Artificial Sequence: Synthetic coding sequence
atggtcatcagccttaatagttgcctgagttttatctgcttattgttgtgtcactggatcggaaccgcatccccactgaacctggaggaccccaacgtgtgtagccattgggaatcttatagcgttaccgtgcaagaaagttatccacatccgttcgatcagatctactacaccagctgcacggatatcctcaactggtttaaatgtacgcgtcacagagtcagttatagaaccgcttataggcatggcgaaaagaccatgtacagacgcaaatcccagtgctgccccgggttctatgaatcaggcgaaatgtgcgtccctcattgtgccgataagtgcgtgcacgggcgctgtatcgctcccaatacctgccagtgtgaacctggatggggagggactaattgttcatcagcctgcgatggcgatcactggggtcctcactgcacatcaagatgccagtgcaaaaatggagctctgtgtaaccccatcaccggcgcctgccattgcgcagccggcttccgggggtggagatgcgaagatcgctgtgaacaggggacttacggcaatgactgtcatcagagatgtcagtgtcaaaacggcgcaacatgcgaccatgttaccggagagtgtcgttgccctcctgggtataccggtgcattttgtgaagatttatgcccccctggcaagcacggaccccagtgtgagcagcgatgcccctgtcagaacggcggagtgtgccatcacgtgacgggggaatgctcctgtccctctgggtggatgggcaccgtgtgtggacaaccctgcccagagggaagattcggaaaaaactgctctcaggaatgccaatgccataatggcggaacatgcgacgcagcaactgggcaatgtcactgctctcccgggtacactggcgaacgttgccaggacgagtgtcccgttggaacctacggagtgctttgtgcggagacttgtcaatgcgttaacggcggcaaatgttatcatgtatccggggcctgtctttgcgaggctgggtttgccggcgagagatgcgaagcacggctgtgtcccgagggcctctacggaattaaatgtgataaacggtgtccatgccacctggagaatacccacagttgccaccccatgagcggcgagtgcgcttgtaagcctggctggtcaggactatattgcaacgaaacgtgcagccccggattttacggagaagcctgccagcagatatgttcttgtcagaacggggcggattgcgactctgtcaccggcaaatgtacttgtgccccaggttttaagggtatcgactgcagcacaccttgtccacttggcacatacggcataaactgctcttcgcgctgtgggtgcaagaacgacgccgtctgttccccagttgatggttcttgcacttgtaaggctggatggcatggggtggattgtagcatacggtgcccaagtggcacatggggcttcgggtgtaatcttacatgtcaatgcctcaacggcggcgcctgtaatacgctagacgggacctgtacatgcgcacccggatggaggggggagaagtgtgagctgccatgtcaggatggtacttatggcctgaactgcgcagaacggtgcgactgttctcatgccgatgggtgccaccccactaccgggcattgtcggtgtttgcccggttggtctggggtgcactgcgactctgtgtgcgcagagggacgctggggtccaaattgttccctgccctgctattgcaaaaatggggcatcgtgctcacccgacgacggcatctgcgagtgtgcgccggggttcaggggtactacctgccagaggatatgctctcccgggttctacggtcacagatgcagccagacctgtcctcagtgtgtgcactcatcaggcccgtgccaccacatcacgggactctgtgattgcctcccaggattcacgggcgccctctgtaacgaagtttgcccaagcggacggtttggcaaaaactgcgccggaatctgcacttgtaccaacaacggaacctgcaatccaatcgaccggtcatgtcagtgttatcccggctggattggcagtgactgtagtcagccctgtccgcctgctcattggggaccaaattgcattcatacttgtaactgtcacaatggcgctttttgttctgcatatgatggagagtgtaaatgcacacccgggtggacaggcctgtactgcactcagagatgcccgctggggttctacgggaaggattgcgctctcatttgtcagtgtcagaatggcgccgattgcgaccatattagcggccaatgtacttgtagaaccgggtttatggggcgccattgtgagcagaaatgcccgagtggcacatacggatacggctgccgacagatctgcgattgcctcaataattcaacatgtgatcacatcaccgggacctgttattgcagtcctggctggaaaggggccaggtgtgaccaagccggggttatcatcgtgggcaatttgaatagcctcagtaggaccagcaccgccctccccgcggattcctatcagattggtgcaattgccggtatcattatcttggttctcgtggtgctctttctattggcattattcatcatctaccgtcataagcagaaggggaaagaatcttcgatgccagctgttacctacacccctgcaatgagagtcgttaatgccgactacactataagcgggactctcccacacagcaatggtggtaacgcaaacagccactacttcaccaatcctagctaccacacactgacgcagtgcgcaacctctccacacgtgaataatcgcgaccgaatgacagttactaaatcaaagaataaccagcttttcgtcaacctaaaaaacgtcaacccagggaagagaggtcccgtcggcgactgcaccgggacacttcccgccgattggaaacacggcgggtatttaaacgagttgggggcatttggactggatcgatcttatatgggcaagtcacttaaagacctgggcaaaaactctgaatacaattcttctaattgtagcctgtccagctctgaaaatccatatgccacaattaaagatccccctgtcctcattcccaagtctagtgaatgcgggtacgttgaaatgaaaagccccgctagaagagactcgccatacgctgagatcaataacagcacctccgccaatcgtaatgtttacgaagtggagccaaccgtcagcgtggtgcagggcgttttcagcaataatggccgtctgtctcaggatccctacgatctacctaaaaactctcacatcccctgccactacgacctgttacctgtaagagattcctcctcatcccccaaacaggaggatagcggcggatcatcttctaacagcagttcctcctcagaatag

SEQ ID NO: 124971 - DNA, 1704 bp, Artificial Sequence
  Description of Artificial Sequence: Synthetic coding sequence
atggtcatttccctcaattcctgcctcagctttatctgtcttctgctctgccactggattggtaccgctagcccccttaacctggaggatccaaatgtgtgctcccattgggaatcttactccgtcacagtgcaggaaagctatcctcacccttttgaccaaatttattatacctcctgtaccgacattctcaactggttcaagtgtacgcgacatcgagtcagttaccgcaccgcatatcggcacggagagaagaccatgtaccgtcgcaaatcgcagtgttgccctggcttctacgagagtggcgaaatgtgcgtgccccactgcgccgataagtgtgtgcacgggcgatgcattgcccccaatacatgccagtgcgaaccaggttggggggggaccaattgcagctccgcctgcgacggagaccattgggggccgcactgcaccagtaggtgtcaatgtaagaacggagctctctgcaaccctatcacgggcgcctgccactgcgcagccggattcaggggctggcggtgcgaagatcgctgtgagcaggggacatatggcaatgattgccatcaaagatgtcagtgccaaaatggggccacttgtgaccacgtgacaggagagtgtagatgtcctcccgggtatactggcgctttttgcgaggacctatgccctcccgggaaacacggaccccagtgtgagcaaagatgtccgtgccagaacggcggggtgtgccaccacgtgactggtgagtgttcttgtccctcagggtggatgggcaccgtttgtgggcagccttgtcccgagggaagattcggaaagaattgttcgcaggaatgccagtgtcacaatggtgggacctgtgacgcggcaaccggtcaatgccattgttctcctgggtataccggtgaacgatgccaggatgaatgccctgtgggaacatatggggttttgtgcgccgagacttgccagtgcgtgaacggtggcaagtgctaccacgtgtctggcgcatgcttatgtgaggctggcttcgccggcgaaaggtgcgaagcgcgcctgtgtccagaaggcctctatgggattaaatgcgataagagatgtccctgccacttggagaacactcatagttgtcatccaatgagtggcgaatgcgcttgtaaaccaggatggtctggattgtattgtaacgagacatgctcccctggtttttatggggaggcttgtcagcagatatgctcttgtcaaaacggcgccgactgtgatagcgtcacaggtaagtgcacctgcgctcctgggtttaaaggcatcgactgctcaacaccatgcccactgggcacctatggaatcaactgctctagtcgctgtggatgcaagaacgacgccgtgtgcagcccggtggacggttcctgcacatgtaaagccggctggcatggggtggattgttccatcagatgcccctctggcacgtggggctttggctgcaatctaacttgtcaatgtcttaacgggggcgcttgcaacacactggacgggacctgcacttgcgcccccggatggagaggagagaagtgcgaactgccctgtcaggatgggacatacggcctgaattgcgcggagcgttgtgactgtagccatgcagacgggtgccaccctacgactgggcattgtcgatgtctgcccgggtggagcgggttgttttag

SEQ ID NO: 124972 - DNA, 3423 bp, Artificial Sequence
  Description of Artificial Sequence: Synthetic coding sequence
atggtgatcagtctcaactcctgcttgtccttcatctgcctgctcctctgtcattggatcggaacggcaagccccttgaacttggaagacccaaacgtttgtagtcactgggaatcgtatagcgttacagttcaggaatcatacccacatccattcgaccaaatctattacacctcttgcactgacattttgaactggtttaagtgcacacggcatagagttagttataggaccgcatatagacacggcgagaaaaccatgtatagacggaagtctcagtgctgcccaggcttttatgaatccggcgagatgtgtgtcccccactgcgccgacaagtgcgttcatgggcgatgtattgctccgaacacctgtcagtgcgagcctgggtgggggggcaccaattgctcctcagcctgcgacggcgaccattgggggccccactgtacctctaggtgccagtgcaaaaatggtgccctctgtaacccgatcaccggggcttgtcattgcgcagcgggttttcgagggtggaggtgcgaggacagatgcgaacagggaacgtacggtaacgactgccatcagagatgtcaatgtcagaacggcgcgacatgtgatcacgtgactggagaatgccgatgcccccctggatacacaggagcattctgtgaagatctctgtccaccaggaaagcatggacctcaatgtgagcagagatgcccgtgtcagaatggcggggtatgtcatcatgtgaccggtgaatgttcctgccctagtggctggatgggcactgtttgcgggcagccttgtccagagggacgcttcggcaagaactgcagtcaggagtgccagtgccataacgggggcacatgtgacgcagccacagggcagtgtcattgcagccccggttataccggagagcgatgccaggacgagtgccctgtcgggacatatggggtgctgtgtgcagaaacctgccagtgcgtgaacggaggaaagtgttaccatgtgagcggagcctgcctgtgtgaggccgggttcgctggcgagagatgtgaggcaaggttatgcccggaaggactatatgggatcaagtgtgataaacgctgtccctgccacctggagaatacgcacagctgtcaccctatgtctggcgaatgcgcatgtaagccagggtggtccggcctctactgtaatgagacatgttcccccgggttttacggtgaagcctgccaacagatttgttcctgccaaaacggagccgactgcgattccgtcacgggcaaatgcacctgtgccccagggttcaaggggatcgattgcagcactccttgcccactgggtacgtacggaataaactgctcctctaggtgcggttgtaagaatgatgccgtttgcagtcccgttgacggcagttgtacttgcaaagccgggtggcacggcgtggactgctctataaggtgtccatctggaacgtggggattcggatgtaaccttacatgccagtgcttgaacgggggagcttgcaataccctggacggcacgtgtacatgcgctcctgggtggcgtggagaaaaatgtgaactgccctgtcaggacggcacctatggtctgaattgtgctgaaaggtgcgattgcagccacgccgacggctgccaccctaccacaggacattgtcgttgcctgcctggatggtctggtgtgcactgtgatagcgtttgcgctgagggccgttgggggcccaactgctcattgccgtgctactgcaagaacggcgcgagttgttcccccgacgatggcatttgcgagtgtgccccagggtttcgggggacgacttgccagcgtatctgctctcctggattctatggacatcgatgttctcagacttgcccccagtgcgtgcactcttctggcccttgtcatcacatcaccggtctctgtgattgtctgccaggtttcactggcgcactttgcaacgaagtgtgtccttcgggtcgcttcggcaaaaactgtgcaggcatttgcacgtgcactaacaatggaacatgtaatcctattgatagaagttgccagtgttacccaggctggatcggatctgactgctcccagccctgccctcctgcgcactggggccctaattgcatccacacctgtaactgccacaatggcgccttctgcagcgcttatgatggcgagtgtaagtgcactccaggctggaccgggctttactgcacccagagatgccccctgggcttctacggcaaggactgtgccctcatctgccagtgtcagaatggagctgactgcgatcacatctctgggcagtgcacttgtcggaccggatttatgggtagacactgcgagcagaaatgccctagcgggacatacgggtacggttgtcgccaaatatgcgactgcctgaacaattctacctgtgaccacattaccggtacttgctactgttccccaggttggaaaggggccaggtgcgaccaggctggcgtgatcatcgtgggcaatcttaattctctgagcaggaccagcactgctctgccagctgattcatatcagatcggggctatcgctggaattattattctggtgcttgtggtgctctttctgctggctctttttatcatctacaggcacaagcagaagggtaaggagagctctatgccggccgtgacttacacacctgctatgagggtagtgaacgcggactatactatcagcggcacccttccacatagcaacggaggaaacgcaaattcacactattttaccaacccatcctaccacacacttacacagtgcgcaacaagccctcatgtgaacaaccgggacagaatgacagtcacaaagtctaagaataatcagttattcgtcaatctaaagaatgtcaacccagggaagaggggacccgtcggtgactgtacaggaactcttcctgccgactggaagcacggaggatatctgaacgaactgggcgcctttggccttgataggtcctatatgggcaagagtttgaaggacctgggaaagaatagcgaatataacagctcaaattgttctttgagttcatcggaaaacccatatgcaaccatcaaagatcctcccgtgctgatccccaaatcttccgaatgcggctacgtggaaatgaagtctcctgcgcgaagagactctccttatgctgagatcaacaattcaacctccgcaaaccgcaacgtgtacgaagtggagcccacggtgagtgtcgtccaaggcgtattttcgaacaatggtcggctgtcacaggacccatatgacctgccaaaaaattcccatattccctgtcattacgatctcctccccgtgcgcgatagctcgagctcgcctaaacaggaagactctggggggagctcttctaacagttcaagcagcagtgagtag

SEQ ID NO: 124973 - DNA, 2910 bp, Artificial Sequence
  Description of Artificial Sequence: Synthetic coding sequence
atgcacaccccctccatccgtagcataacccacgacgcgcagacttccagtactgggtcctctgccccaggcacagctctttgcaccgaagagtgtgtgcatggccgttgtgtatcgcccgacacctgccattgtgagccaggttggggcgggcctgactgttcttctggttgcgactcagaccactggggtcctcactgctccaataggtgtcagtgtcaaaatggagccctgtgtaatccaattacaggcgcttgtgtttgcgccgcagggttccgaggatggagatgcgaagagctctgcgcccccggcacccacggtaagggctgccagctcccttgccagtgtagacacggcgcgtcctgtgacccaagagcaggggaatgcctgtgtgctcctggttacacaggcgtgtactgtgaggagctttgtcctcctgggagtcatggagcacattgcgaactccgctgcccttgccagaatggtggaacctgtcaccacattacgggcgagtgtgcctgtccacccgggtggactggggccgtgtgcgcccaaccttgcccacccggtacatttgggcaaaattgcagccaagactgcccatgtcatcatggggggcagtgtgatcatgtaaccgggcagtgtcattgcaccgccgggtacatgggcgatagatgccaggaagagtgtccgttcggctctttcgggttccagtgctctcagcactgcgactgtcacaacggggggcagtgctctcccacaactggagcctgtgagtgcgagcccggttataaggggcctcgctgtcaggagcggttgtgccctgaaggactccatggtcctggatgtactctaccttgtccgtgcgatgccgacaacacaatctcatgccaccccgtgacgggtgcgtgcacctgtcaacccggctggtccggccaccattgtaatgagtcgtgcccggtcggatactacggcgacgggtgtcaactgccatgcacatgtcagaatggcgctgattgtcactcgatcaccggtggatgtacatgtgctcccggattcatgggcgaggtgtgtgcagtctcctgtgcagccggcacgtatggccccaactgttccagcatctgctcatgtaacaacggtggcacgtgcagtcccgtcgacgggtcatgcacttgtaaggaaggttggcagggcctggattgcacgctcccttgcccatcagggacatggggactgaattgtaatgagagttgtacgtgcgctaatggggccgcctgctccccaatcgacggctcttgcagctgtaccccaggttggctgggtgatacatgtgaattaccttgccctgatggcacatttggcctaaattgcagtgagcactgtgattgctctcacgcggatggctgcgatccagttacaggacactgctgttgcctggccggttggacggggattcgctgtgactccacctgtcctcccggcaggtgggggccaaattgttccgttagttgttcttgtgagaacggaggcagttgctcgcctgaagatggcagctgtgagtgcgcccccgggttccggggcccgctttgccagagaatctgtccacctggcttttacggtcatggctgcgctcagccatgccctctctgcgtccacagcagcagaccttgccaccacatctccggcatctgtgaatgcctgccaggattttcaggcgcactatgtaatcaggtatgtgcagggggttacttcggacaggattgcgcccagctgtgtagctgcgctaataacgggacttgtagtcctattgatggttcatgccagtgttttcccggatggattgggaaggattgcagccaggcttgtccccccgggttctgggggcccgcttgctttcacgcctgctcctgccataacggcgcctcctgttctgcagaggacggagcctgtcactgcacccctggctggacaggccttttttgcacccagagatgccctgcagcattctttggaaaggattgtggaagagtatgtcagtgccagaacggggcttcctgtgatcatatctccgggaaatgtacctgcagaacggggtttaccggccagcactgcgagcaaagatgcgctccagggacttttggatacggatgccagcaactttgtgagtgtatgaacaatagcacatgcgatcatgttaccgggacttgttactgttcccccggctttaagggcatccgctgcgatcaggcggctctcatgatggaggaacttaacccttacacaaagatcagtcccgcactgggcgcagagaggcactctgttggagccgttacaggaattatgctgctgctcttcctgatagtggtgctgctgggcctgttcgcatggcataggagacgccaaaaagagaagggcagggaccttgctccccgggtcagctatactcccgctatgagaatgactagcacagattatagcctgtctggagcttgcggcatggaccgccgccaaaacacttacatcatggataagggatttaaggactatatgaaagagtcggtgtgcagcagctcaacatgcagtctgaatagctctgaaaacccctatgcaaccatcaaagatcctccaattcttacatgtaagcttcctgaatcctcctacgtggagatgaagtctccagtgcacatgggttccccttataccgatgtgccatctctcagtacctcaaacaagaatatatacgaagtcgagccgactgtatcagttgtccaagagggatgtgggcacaatagttcatacattcagaatgcatacgatctgcccagaaattctcatatccctggacactacgatctgctgccggtgcgacagtctcccgctaacggaccttctcaagataaacaatcctag

SEQ ID NO: 124974 - DNA, 2628 bp, Artificial Sequence
  Description of Artificial Sequence: Synthetic coding sequence
atggttttgagcctgactggcctcatcgcattcagcttcctccaggcaactctggctctcaatccagaagatcctaatgtttgttcacattgggagtcttatgccgtgacagtccaggagagctacgcacatcccttcgatcagatctactacaccaggtgtacagacatcctaaattggtttaaatgtacccgccatagaattagttataagactgcctatcgtcggggactccggactatgtatagaagaaggtcacaatgctgtcctggttactatgagtccggggacttttgtatccccctctgcaccgaagagtgcgtacacgggcgctgcgtttcacccgatacctgccattgtgagcccggttggggcggacctgattgctcttccgggtgcgactcagaccactggggcccccattgcagcaatagatgccagtgccagaatggtgctctctgcaatcccatcacgggggcgtgtgtctgtgccgcaggtttccgcggatggcgatgcgaggaactgtgcgcacccgggacccatggtaaggggtgtcagctcccctgtcagtgtcggcatggcgcatcctgcgaccctcgcgcaggggaatgcctgtgtgctcctggatataccggcgtatattgcgaagaactctgtccccccggcagtcatggagcccactgtgaactccgctgtccctgtcagaatgggggaacttgccatcatatcactggagaatgcgcctgtcctccagggtggactggagccgtctgtgcgcagccttgccccccagggacgttcgggcagaattgttcccaagactgtccctgccatcacggcggacagtgcgatcatgtaaccggccagtgccactgcactgcaggctacatgggagacagatgccaggaggagtgcccgtttggctccttcggctttcagtgcagtcagcactgtgactgccacaatgggggccagtgttcaccaacaacaggcgcgtgtgaatgcgaacccggctataagggtcctagatgccaggaaagactatgccccgagggactccatggccccggctgcacgttaccatgcccatgcgacgcggacaatacgatttcctgccacccagtgactggcgcctgtacgtgtcagccaggctggagtggccatcattgtaatgaaagctgccctgtgggatattatggagatggatgccagctgccctgcacttgccagaacggagccgactgccactccatcaccggggggtgcacatgcgccccaggcttcatgggcgaggtttgcgccgtaagttgcgcagccggcacttacggccctaactgcagttcaatttgttcttgtaacaatggaggcacatgttcaccagtcgacggcagctgtacatgtaaagaaggttggcagggcctggactgtaccctaccctgtccctctggcacttgggggcttaattgcaatgaaagctgtacttgcgccaatggggcagcttgctctcctatagatggcagctgtagctgtacacctgggtggctcggcgacacctgtgaactgccttgtcccgatggaacttttggactaaactgtagcgagcactgtgattgctcccatgcggatggttgtgatcccgtaactgggcactgctgctgtttggccggctggactgggattaggtgtgatagcacatgcccacctggccgatggggacctaattgttcagttagctgcagttgtgagaacggcggctcttgttccccagaagacggttcatgcgaatgcgcccctggattccgggggcccctctgccagaggatctgccccccaggcttctacggtcatggatgcgcccaaccatgccctctgtgtgtgcactcttcacggccatgccaccacatatcaggaatctgcgaatgtctccccggcttctcaggggctctgtgcaatcaggtgtgtgctggtgggtatttcggacaagattgtgcacagctgtgcagttgcgctaataacggtacatgctccccaatagacgggagctgtcagtgctttccaggatggatcggtaaagactgttcacaggcatgtccgccaggtttctggggacccgcatgcttccacgcatgcagctgccataatggagctagttgttcagcagaggacggcgcatgccactgtaccccgggctggaccgggctcttctgtactcaaagaaaacctcatcttctggcgagccagccactccgaatcccgtgctgtggcttgctcgctacagtgggtatcgtacagaccagccgcgagggagggatgcaggccgcccctgggcttgtggttcctgatagctgtccgaccagaactgaggagctgtgccggggatcgtcaaggccagactggattcagggaattgacaagcctaaggtactcgaagggcagggatgcaaagcggctcaacagcactttctcggccgcactgtgggggcatacgctagtgttcgcatggcacccgctgtcacaacctccgtggctagtgcccctgcagctcaggctagccctgggaatacagtgtctagagacgtaccgcaggagccactcgccatgggagtatcttcatacgtcagcgcgtag

SEQ ID NO: 124975 - DNA, 414 bp, Artificial Sequence
  Description of Artificial Sequence: Synthetic coding sequence
atgatggaagagctaaacccgtacaccaagatcagcccagcgctgggggcagaaaggcatagcgtgggcgcagtcaccggcattatgctgctgctcttcctgatagtggtgctgctcggcctgtttgcctggcacaggcgtcgtcagaaggagaagggacgcgatctggctccacgtgtttcctacacccctgccatgcgaatgacttctactgattacagcttaagtgcaagtacaaccccttggtggcccgttatggagcatctagctagaccatttagccaacgtccaagaacacagctttctaacaagtcgctggacagagacacggctgggtggaccccttattcgtatgtaaatgtgttggatcagtgtcccggagggcaagtccccgctagaggtctgctccattag

SEQ ID NO: 124976 - DNA, 2910 bp, Artificial Sequence
  Description of Artificial Sequence: Synthetic coding sequence
atgcacacccctagcattcggtctatcacccatgacgcccagacctcttctactggctcaagcgctcctgggaccgcgctatgcaccgaagaatgcgtacacggtcgttgtgtttccccagacacatgtcattgcgagcccggttggggtggccccgactgttctagcggctgcgactcagaccattggggaccccattgtagcaacagatgtcagtgccagaacggggctctctgtaatcccattacgggagcatgtgtgtgtgccgctgggttccggggatggcgttgtgaagaactgtgcgctccaggaactcatggaaagggatgccagctgccatgccagtgtagacatggagcctcatgcgatcctcgagccggtgagtgcttgtgtgctccaggatatactggcgtttactgcgaagaattgtgtccccccggtagccatggcgctcactgtgagctgcgttgtccatgtcagaatggaggaacatgccaccatattactggagagtgcgcctgtcctcccggctggaccggggccgtgtgtgcacagccttgccctcccgggacattcggccagaattgcagccaggactgtccatgccaccacgggggccagtgtgaccacgtgacaggtcagtgtcactgcaccgcaggttatatgggtgatcggtgtcaggaagaatgcccctttggctcctttggattccaatgcagtcagcattgtgactgccacaacggtggccaatgctcaccaactactggagcttgtgaatgtgagcctggctataagggtccccggtgtcaggagcggttgtgccccgaaggactgcatgggcctggctgtacactgccatgcccgtgtgatgccgacaacacaatttcttgccaccccgtgacgggcgcctgtacctgtcaacctggatggtctgggcatcactgcaacgaatcttgccccgtcggctattacggggatggatgccaactgccatgcacctgccagaatggagccgattgccactcaatcactggcgggtgtacttgcgcccccggtttcatgggagaggtgtgtgccgtctcatgtgctgctggcacctacggcccaaattgctcctccatctgttcttgtaacaatggaggtacttgctctccagtcgatggatcgtgcacttgtaaggagggatggcagggtctcgactgtacccttccgtgtccaagcggtacgtggggattgaactgcaatgaatcctgcacatgtgctaacggtgcagcctgcagtccgattgacggatcttgctcatgtaccccaggttggttaggagatacatgcgaactcccctgcccagacggaaccttcggtcttaattgcagcgagcactgtgactgctcccacgctgatggatgcgatcctgttactggtcactgctgttgtctggctggttggactgggatcaggtgcgattcgacatgtccaccgggacgttggggtccgaactgtagtgtcagctgtagctgcgagaacggtggcagttgtagccctgaggacgggtcatgtgagtgcgcccccggatttcgcggacctttatgccagaggatctgtccacctggattttatggacatggctgcgcccagccctgtcctctgtgtgtccactcctcccgtccgtgtcaccatatcagcgggatttgcgagtgtctccccggatttagcggagcgctgtgcaatcaggtctgtgccggtgggtattttggccaggactgtgctcagctgtgtagctgcgccaataatggaacctgtagccccattgatggctcctgtcagtgttttcccggctggattgggaaagactgcagtcaagcctgccctccagggttctggggaccagcctgctttcacgcctgcagttgtcacaacggcgcttcttgctccgccgaagacggagcttgccattgtacacctggctggaccgggcttttttgtacccagagatgtcctgctgccttctttggaaaggattgtgggcgggtctgtcagtgtcagaacggcgcatcatgcgatcatataagcggaaagtgcacttgcaggaccggcttcacgggtcagcactgcgagcagcgatgcgcgcctggtaccttcggctacggctgccagcagctttgtgagtgcatgaacaatagcacgtgcgatcatgtaaccggaacctgttactgtagcccaggcttcaaaggaatccgttgcgatcaagctgccctcatgatggaagagctgaacccctatacaaagatcagccccgctctgggagccgaacgtcactccgtgggcgccgtgacagggatcatgttactgctcttcctgatcgtggtgttgctcggcctcttcgcttggcaccggcgccgccagaaagaaaaggggagggatctcgccccaagggtcagctatacccccgcaatgcgcatgactagcacagactattccttgagcggggcctgtgggatggatcggagacaaaacacgtacatcatggacaaggggttcaaggactatatgaaggaaagcgtatgttcctcttccacgtgctccttaaattcatccgagaatccctatgctaccataaaagaccctccaattctcacctgtaaactgcccgagagctcatacgtcgagatgaagtcgccggtgcacatggggtccccctacaccgatgtcccttcgctcagtactagtaataagaatatatatgaagtcgagccaaccgtgagcgtcgtgcaggaagggtgtggtcacaattctagctacatccagaatgcgtatgatttgccaaggaattcccatatccctgggcattatgacctccttcctgtcagacagtctcccgccaacggtccgtctcaggacaagcaatcatag

SEQ ID NO: 124977 - DNA, 3135 bp, Artificial Sequence
  Description of Artificial Sequence: Synthetic coding sequence
atggttctttccctgacgggactaattgccttctcttttctgcaggcaactctggcactgaaccctgaagacccgaacgtgtgttctcattgggagtcctacgcggtgacggtacaagaatcttatgcccacccatttgatcagatttattatacaagatgtaccgacatccttaactggttcaagtgtacccgccaccggatctcctacaagaccgcataccggcgcgggctccgaactatgtaccggcggcggtctcagtgctgccctggatactacgagagcggcgacttctgcattcctctatgtacggaggagtgcgtccatggacgttgtgtctcccctgatacatgtcactgtgagcctgggtgggggggaccagattgtagcagcggttgcgattcagaccactggggccctcactgctctaaccgctgccagtgtcagaatggcgcgctttgcaatccgatcactggtgcttgcgtatgcgccgccggctttcgggggtggagatgcgaggagctgtgcgcacccggcactcatggcaagggctgccagctgccttgtcagtgtcgccacggagcctcctgtgatccacgagctggagagtgtctttgtgctcctggctacactggggtgtactgcgaagaattgtgtccccctggatcacacggcgcccattgtgagctgaggtgtccttgccaaaacggtgggacttgtcatcatatcaccggggagtgcgcttgcccccccggttggactggcgcggtgtgcgcccagccttgccctccaggaaccttcggacagaactgttcacaggactgtccctgccaccacgggggccaatgcgaccatgttaccggacagtgccactgtactgcaggctatatgggggaccggtgtcaggaagagtgcccattcggttcctttggcttccagtgcagccagcactgcgattgccacaacgggggccagtgctcacctaccacgggagcctgtgaatgtgagcctggatacaagggtccgaggtgtcaggagaggctatgccctgaaggactgcatggcccgggctgcaccttgccatgcccatgcgacgccgacaacacaatcagttgtcaccccgtcactggagcatgcacatgccagccagggtggagcggccaccattgcaacgaatcttgccctgtggggtattacggcgacggctgtcagctcccgtgtacttgtcaaaatggagctgattgtcattctattaccggcggctgcacttgcgcgcccggtttcatgggcgaagtgtgcgcagtgtcctgtgcagctggcacttatgggccaaactgctcaagcatctgttcatgtaacaacggtgggacgtgtagtcctgtggacggtagctgtacttgcaaggaaggttggcagggtttagattgcactctgccttgccccagtgggacatgggggctgaactgcaacgagtcttgtacatgtgccaacggagccgcttgcagccctatcgacggctcctgcagttgcactcctggctggttgggagatacctgcgagctcccttgtcccgacggcacctttgggttgaactgttcagaacattgtgactgctctcatgccgatgggtgtgaccccgtgaccggtcattgttgttgtcttgcaggatggactgggattcgctgcgatagtacatgccctccaggccgctggggccctaactgtagtgtgtcctgctcctgtgagaatggcggttcttgcagcccggaggatgggtcatgcgagtgtgcacccggctttcgcggcccactgtgccaaagaatttgtccccccgggttttatgggcacgggtgcgcccagccgtgtcccctctgcgtacactcatccaggccatgccaccacatcagcggtatctgtgaatgcctgcccggtttctctggggccttatgcaatcaggtttgtgcgggggggtactttggacaggactgcgctcagctgtgttcttgtgcaaacaacggcacctgctcccccatcgacgggtcgtgtcagtgcttcccgggctggatcggtaaagattgctctcaggcctgtccaccaggcttctggggtcctgcttgctttcatgcctgcagctgccacaatggagcgagctgctcagccgaggatggcgcctgtcactgtactcccggttggactggactcttttgcacgcagcggtgtcctgctgcattttttggcaaggattgcggaagggtctgtcagtgtcagaacggggcctcttgtgaccatatcagtggaaagtgtacgtgtcggactggcttcaccggacagcactgcgaacagaggtgcgcccccggtacttttggctatggttgccaacagttatgcgagtgtatgaataactcgacttgcgaccacgtgaccggaacttgctactgctcgcctggcttcaaagggattagatgcgaccaggctgccctaatgatggaagaacttaacccttacaccaagattagccccgctctcggggccgagcgccacagcgtgggcgccgtgacggggattatgcttttactgtttctgattgtggtattactgggtctgtttgcatggcatcgccggcgtcagaaggaaaagggaagggatcttgcccctagggtctcctatacccccgcaatgcgcatgaccagcactgattattccctgagtggcgcttgcggaatggacagacgccagaatacatacattatggataagggtttcaaggactatatgaaggagtctgtgtgctcatcctcaacatgttccttgaacagctctgagaatccttatgcaacaatcaaggatccaccaatactaacttgcaagctacccgagtcgagctacgtggaaatgaaaagtcctgtacatatgggttctccctacaccgacgtaccaagcttgtcaaccagtaacaagaacatctatgaggtagagccaactgtgtcagttgtgcaagaaggatgcggccataattccagctacatacaaaacgcctacgatctgcccagaaattctcacattccgggccactatgaccttctcccagtgcgtcagtctccagcaaatggcccatcccaggacaaacagagctag

SEQ ID NO: 124978 - DNA, 3135 bp, Artificial Sequence
  Description of Artificial Sequence: Synthetic coding sequence
atggtcctgtccctgacaggtttgatagccttcagcttccttcaggcgaccctcgctttgaatcccgaggaccccaatgtctgcagccactgggagtcatatgccgtgaccgtgcaggagtcttacgctcatccttttgaccagatttactacacacggtgtacagatattttaaactggtttaagtgtactcggcaccggatcagctataaaaccgcataccgcagaggacttcgcactatgtatcgaaggagaagtcagtgctgtcctgggtattacgaatccggggatttttgcattcccctgtgtactgaggaatgcgtacatggacgatgtgtttctcctgacacatgtcattgtgaacctggctggggcggtcctgattgtagcagcgggtgtgatagcgaccactggggccctcattgtagtaaccgttgccagtgtcagaacggcgcgctctgtaatccgatcactggggcttgtgtgtgcgcagccggttttcgcgggtggaggtgtgaggaactttgtgcaccaggtacgcacggaaaggggtgccagttgccctgtcaatgcaggcatggtgctagttgcgaccctagggccggggagtgtctgtgtgcaccgggttacacaggggtatactgtgaagagctgtgtcctcccggttcacatggagcccattgcgaactcagatgtccctgtcagaacggaggcacatgtcaccacattaccggggagtgcgcctgccctcctggatggacgggcgccgtctgcgcccagccctgtcctcccggcacttttggccaaaactgctcccaggattgcccctgccaccacggggggcagtgtgaccacgtgactggccagtgccactgtacagcgggttacatgggagaccgatgtcaggaggagtgccccttcggctcattcggatttcagtgctctcaacattgcgactgccacaatggcggccagtgtagccccacaacaggagcctgcgagtgcgagcctggatacaagggtccgagatgtcaggagaggctttgtcctgaaggactccacggccctggatgcacattaccgtgtccttgcgacgccgacaacacaatcagttgtcaccctgtgaccggtgcctgcacttgccagcctggttggtccgggcatcattgtaacgagtcatgtccagtgggttactacggagacggctgtcagctgccgtgtacttgccagaacggagctgattgtcattctatcaccggcggatgtacatgcgcgccgggcttcatgggcgaagtgtgcgccgtgtcctgtgccgcaggaacctacggcccgaactgctcttccatttgttcctgcaacaatggcggaacgtgtagccccgtggacgggagctgtacttgtaaagagggttggcaaggtctggactgtaccctgccatgtccgagcgggacttggggactgaattgcaacgaaagctgtacttgtgccaatggggctgcatgttcacctatagacgggagctgctcctgtacaccgggatggctaggtgatacgtgcgaacttccatgccccgatggaacatttgggctgaattgttcggagcactgtgactgttctcatgccgacggatgcgacccggttactggccactgttgctgcctggccggatggaccggtatccgctgtgattccacgtgtcctccaggcagatggggccccaactgttcggtcagctgtagttgcgaaaacggtggtagctgttcaccagaggacggctcatgtgagtgcgccccaggcttccgcgggccactgtgtcaacgcatctgccctccaggcttttacggacacgggtgtgcccagccatgtcctttgtgtgtgcattcatcccggccctgccaccacatctctggcatctgtgagtgcctccctggcttctcgggggcgctttgtaatcaggtgtgtgccgggggctatttcggtcaggactgcgctcaactgtgttcctgcgccaacaatggaacatgctctcccattgatgggtcgtgtcagtgcttccctgggtggattgggaaagattgcagccaggcatgcccccccgggttttggggacccgcttgcttccacgcttgtagttgccataatggagcgtcctgttcggcagaggacggtgcttgccactgcacgccagggtggaccggactcttctgtacccagaggtgcccagcagcgttctttggtaaagattgtggccgcgtatgtcagtgccagaacggggctagttgtgaccatatctcagggaagtgtacctgtaggactgggttcaccggtcagcattgcgagcaaaggtgtgctcctgggacatttgggtacggctgccagcagctgtgtgaatgcatgaacaactcgacatgcgaccacgtcactggaacctgctactgttcacccggctttaaaggaatccgttgtgatcaggccgccctgatgatggaggagctcaacccctatacaaagattagcccggccctgggcgctgaaagacattctgtgggggccgttaccggcatcatgctgctgctgttcctgatcgttgtgctgctggggctctttgcctggcaccgtaggagacaaaaggaaaagggcagagatctggctcctagggtctcctatacccctgctatgcgaatgacctctactgattactcactgagtggtgcctgcgggatggatagaagacagaatacatacatcatggataaggggtttaaggattatatgaaggagagtgtgtgttcctcatctacatgtagcttgaacagcagcgagaacccctacgcgacgattaaagatccgcccatcctgacgtgtaaactgccagagtcgtcgtatgttgagatgaaatcccctgttcacatgggctccccttacacggatgtgccgtctctgtccacttccaataaaaatatctacgaagtcgagcccacggtctctgtggtgcaggaagggtgcggacacaattcctcatatattcagaatgcttatgatctgcctcggaactcccacatcccaggccattacgaccttctccccgttaggcagtcacccgctaacggaccgtcacaggataagcagagctag

SEQ ID NO: 124979 - DNA, 3690 bp, Artificial Sequence
  Description of Artificial Sequence: Synthetic coding sequence
atgggtgcatcaagggacaggggtcttgcggcactttggtgcctcgggctgctagggggtctcgcacgggtggcgggcacacactaccgctatctctggcgaggctgctacccatgtcatttggggcaggcgggctaccccgtgtccgccggggatcaacggcctgatgtcgatgagtgtcgaacgcacaatggaggttgtcagcatagatgcgtgaacacacctggcagctatttatgtgaatgcaagccgggcttccgcctgcatacagattcacgcacctgcctggctataaatagttgcgccctcgggaacggagggtgtcagcatcattgcgtgcagctgactataaccagacaccgctgtcagtgtagacctggctttcaactgcaggaagacgggcggcactgcgttcgacgatctccttgtgctaataggaacggcagttgcatgcatcggtgtcaggttgtcaggggcctcgcacgctgcgaatgccacgtcgggtatcagctcgcagctgatggaaaagcgtgcgaggacgttgatgagtgcgccgcaggactcgcccaatgtgcacatggctgtcttaacactcaaggatctttcaaatgcgtctgtcatgctggctacgaacttggagctgatggtcggcaatgctaccgcatcgagatggagatcgtcaactcatgcgaggcaaacaatggcggctgttcccatggttgttcccacacctctgcgggacccctttgtacctgccccagaggatatgaacttgacaccgaccagagaacctgcatcgatgtggacgactgtgcggactccccctgctgccagcaagtgtgtaccaacaatccaggggggtatgagtgtggctgctatgccggataccggctgagcgccgatggttgcggctgtgaagatgtggacgagtgcgcgtcttctaggggcggctgtgaacatcattgtactaacctcgcggggtcatttcagtgttcttgcgaagccggttacaggttacacgaagaccgtcgcgggtgctcacctcttgaagaaccgatggtggacctcgacggcgagctaccttttgttaggcctctgccacatatagctgtactgcaggacgagctcccacagttgtttcaggacgatgacgttggcgcggatgaggaggaggccgaattgcgcggagagcacactcttactgaaaaatttgtctgtctagatgattcattcgggcacgattgcagtttgacatgcgatgattgtcggaacgggggcacctgtttactggggttagacggctgtgactgtcctgaagggtggacaggcctgatctgcaatgaaacctgccccccagatacttttggtaaaaattgttcattttcctgcagttgtcagaacggcggcacttgcgatagcgtgaccggtgcatgccgctgtccccccggggtgtcggggacaaattgcgaggacggatgccctaaaggttactatgggaagcactgtaggaaaaagtgtaactgtgccaatagggggagatgccatcgcctgtatggggcctgtctatgcgaccctggattgtatggtcggttttgtcatctcacttgcccgccctgggcgttcggccccgggtgctcagaagagtgccagtgcgtgcagccgcatacccagagctgtgacaaaagggacggcagctgttcatgtaaagctggcttccggggagagcggtgtcaggccgaatgtgaattaggctatttcggcccgggatgttggcaggcctgcacatgcccagtcggggtagcatgcgattccgtaagtggagaatgcggcaagcgctgccctgcagggtttcagggcgaggactgtggccaggaatgccccgtcggaacgttcggagtgaattgctcttcgtcttgttcctgtggaggtgcaccctgccatggagtgaccggccagtgtcgttgcccaccgggccgaaccggtgaagactgcgaggcagattgccccgaaggtagatgggggcttggttgtcaagagatatgcccagcttgtcagcatgcggcccggtgcgatcctgagaccggcgcttgcctatgtctgcctgggttcgtcgggagcagatgccaggatgtctgtccggcggggtggtatggtccctcatgtcagacacgatgttcttgcgcgaatgacggacactgccacccagccaccggtcactgctcctgcgctccagggtggactggtttctcctgtcagagagcttgtgacaccggacactggggccccgattgctctcatccttgcaattgttccgctggacacggctcttgcgatgccatctccgggttatgtctctgtgaggcaggctacgtagggccgaggtgcgagcagcagtgtccccagggccatttcggcccaggatgcgagcagagatgtcaatgtcaacacggagcggcttgtgatcatgttagtggcgcatgcacctgtcccgccggatggagagggactttctgtgaacatgcctgcccagctggattttttggacttgactgcaggagtgcttgtaactgtactgcaggggccgcatgtgacgctgtgaatggatcctgtttgtgtccagcagggcggcgaggaccaagatgcgccgaaaagtgcctgccgcgtgacgtcagggcaggctgccggcattcaggcggctgcctgaacggcggcctctgtgatcctcacaccggaagatgcctgtgtcctgccggctggacaggcgataaatgtcagtctccctgcctgaggggctggtttggcgaggcatgtgcacagcggtgttcttgccccccgggcgctgcatgccaccatgtaactggtgcttgccgttgtccacccggtttcaccggctcaggatgtgaacaggggtgccctcctggcaggtacggcccggggtgcgagcagttgtgcggttgtcttaatggcgggtcttgcgacgccgcaaccggtgcgtgccgctgcccaacaggctttctggggaccgattgtaacttgacatgccctcagggacgcttcggtcctaattgcacacatgtgtgtgggtgtggccaaggcgcagcgtgtgacccggtgacagggacctgcctttgtccacccgggagagctggggtacggtgtgagagaggttgtcctcagaatcgttttggagtgggctgtgagcatacctgcagctgcaggaatggcggtctttgccatgcgagcaacgggagttgctcatgtgggctcggctggaccggacgacactgtgaacttgcttgtccgccagggagatacggggccgcctgccacctggaatgtagctgccacaataattctacatgtgaacccgccacggggacatgtcgctgcggtcctggcttctacggccaggcttgcgagcatcgccggagtggggccacttgcaacctggactgcaggcgtggtcagttcggtccttcgtgcacattgcactgtgattgtggggggggggccgactgtgaccctgtgtcaggtcagtgtcattgcgtagacgggtacatgggacccacttgcagggagggtgggccactgaggttaccagaaaatcccagtctggcgcagggctcggctggaactctgccggcatcttctcggccaacaagccgcagcggaggtccggcacgtcattag

SEQ ID NO: 124980 - DNA, 4626 bp, Artificial Sequence
  Description of Artificial Sequence: Synthetic coding sequence
atgtcctttttggaggaagcccgggcagctggtagagctgttgttctggccttagtcctcctgctgttaccagcagtccctgtgggcgctagtgttcctcctcggcccctgttgcctctccagccaggaatgcctcacgtgtgtgcagagcaggagctgactttggtgggaagacggcagccgtgtgtgcaagccctgagccataccgtgcccgtttggaaggccggctgcggttggcaggcttggtgcgtgggccatgagcggcggaccgtatactatatgggctaccggcaggtgtataccacagaggcgcgaacagtgctcaggtgttgccggggttggatgcagcagcccgacgaggagggctgcctctcagctgagtgcagcgcatcactgtgtttccatggcggacgctgcgttcctggctctgcccaaccatgccattgtcctccggggtttcagggtccacgctgtcagtacgatgttgatgaatgtaggacgcacaatgggggatgtcaacatcggtgtgtcaacaccccaggatcctatttatgtgaatgtaagcccgggttccgactacacactgacagccgaacctgtttggcgattaactcttgtgctctggggaatggcgggtgccaacatcactgtgtccagcttaccattacccgccatcggtgccaatgccggccaggattccagctacaggaggatggtcggcattgcgtgcgtaggtcaccctgcgccaaccgcaatggtagttgcatgcaccggtgccaagtcgtgcgaggcttagcgagatgtgagtgtcatgtgggataccagcttgctgcagacggcaaagcatgtgaagatgtggacgagtgtgctgcagggctcgcccaatgtgcgcacggctgtcttaatacgcagggcagttttaaatgtgtctgtcatgcaggttatgagttgggagccgacggacgacagtgttaccggatagagatggaaatcgtcaactcctgtgaggccaacaatgggggatgtagccatgggtgcagccacacatcggctgggcctctgtgtacttgcccacggggttatgagcttgatactgaccagcgcacttgcatcgatgtggatgactgtgccgactccccatgttgtcagcaggtgtgcacgaacaatcctggcgggtatgaatgcgggtgctacgcagggtaccgcttgagtgcagacggctgcggctgtgaggatgtagacgagtgcgcctctagtcgcgggggatgtgagcatcactgcacgaatctggccggttcctttcaatgtagttgcgaggccggataccgcctgcacgaggaccgcagggggtgttcaccattggaagagccaatggtggatctagacggcgagctgcctttcgtgaggcctctaccgcacatagcggtgcttcaagatgaacttccccaactattccaggatgatgacgtaggtgccgatgaagaagaggctgagttaagaggcgagcatactcttacagagaagttcgtctgtcttgatgatagctttggccacgactgtagcctgacctgcgacgattgccggaacggtggaacatgcctgttggggctggacggctgcgattgtcctgagggctggacggggctcatctgcaacgaaacatgtccccctgacaccttcggaaagaactgcagcttctcgtgcagctgccaaaatggtggaacatgtgactccgtgacaggcgcatgtcggtgcccacctggtgtatcagggacgaactgtgaagacggttgtcccaagggctattatggcaagcattgccgaaaaaaatgcaattgcgcgaacagaggacgctgccataggctatacggagcatgcttatgcgatccaggtctgtatggacgattctgtcatctgacctgccccccttgggccttcggcccagggtgcagcgaggaatgccaatgcgtacagccccacacgcagtcctgcgataaacgggacggatcctgctcttgcaaggccggatttcgcggtgaacggtgtcaggccgagtgcgaattggggtacttcggccctggttgttggcaggcttgcacatgtccggtcggcgtcgcatgcgattccgtatctggagaatgcgggaaacggtgccccgctgggttccaaggagaagactgcgggcaggagtgtccggtcggaacatttggagtcaattgctcatctagttgctcttgtgggggagcgccctgtcatggcgtcaccgggcagtgtaggtgtcccccaggtcgtaccggcgaggactgcgaagcagattgccctgagggacggtggggcttagggtgccaggagatttgtccagcttgtcaacacgcggcccgatgcgatccagagacgggcgcctgcctgtgtctgccaggctttgttggctctagatgtcaagatgtttgtcctgcgggctggtatggcccctcttgccagactcggtgctcttgcgctaatgacggacattgtcaccctgctacaggccactgctcttgtgccccggggtggacggggttctcctgtcagcgcgcttgtgatacaggacactggggacccgattgctcccatccatgcaactgttctgcaggacacggctcctgtgacgccatttctgggctgtgcttgtgtgaagcaggatatgtcggcccccggtgcgagcaacagtgtccccaaggccattttggccccggctgtgaacagcgctgccagtgccaacacggagcagcctgcgaccatgtatctggagcatgcacttgccctgcggggtggcgggggacattctgtgagcatgcatgccctgcgggtttttttggtctcgattgcagatcagcttgcaactgtaccgcaggcgccgcttgtgacgccgtcaatggctcttgtctgtgccctgcagggcggagaggcccgagatgtgcagagacgtgtccggcgcacacctacggtcacaattgtagccaagcatgcgcttgtttcaatggagccagctgcgaccccgtgcacggccagtgccattgtgcccccggctggatggggccgtcctgtctacaggcgtgccccgccggactgtacggggacaactgtcgacacagctgcctatgtcagaacggtggcacatgtgacccggtatctggacactgcgcctgtcctgaaggttgggccggactggcctgtgaaaaggaatgtctcccgcgcgacgtacgcgccggctgtcgccactcgggaggctgtctaaatggagggctgtgtgaccctcatactggtaggtgcctgtgccctgccggatggacgggcgataaatgccagtcaccttgcctccgggggtggtttggggaagcctgcgcccaacgctgttcctgccccccgggcgcagcctgccaccatgttaccggcgcgtgccgttgcccacccggctttactggaagtggatgtgagcaggcctgtcctcccggatcatttggggaagactgcgcccagatgtgtcagtgtccaggcgagaatcctgcctgtcaccccgcaacaggtacttgctcttgcgctgcgggctaccacggtccttcttgtcagcagagatgtccccccggacgctatggccctggctgcgaacagctttgcggatgcctgaacgggggatcttgtgatgccgctacaggggcctgtcggtgcccaactgggtttttggggacagactgcaacctgacatgtccacagggccgctttggacctaattgcactcacgtctgcgggtgcggacagggcgccgcatgtgatcccgtgacaggaacgtgcctgtgcccccccgggcgcgccggtgtcaggtgcgagagggggtgccctcaaaatagattcggcgtaggttgcgaacatacgtgcagctgtcgaaatggaggactgtgccacgcgtccaacgggtcctgcagttgtgggcttggatggacaggcaggcactgtgaactggcgtgtcccccgggaaggtatggggcagcatgccatctcgagtgctcttgccataacaacagtacctgtgaaccagcaaccggcacctgcaggtgcggacccggcttttacgggcaggcgtgtgagcatccttgccctccaggttttcatggggccggttgccaggggttatgttggtgtcagcacggcgccccctgcgaccctatctctgggcgttgtctctgtccagcgggcttccacgggcacttctgtgagagaggctgtgagcccggcagcttcggcgaaggctgtcaccagcgatgtgattgtgatggtggcgccccatgcgatcctgttaccggcttatgcctgtgccctcctggtaggagtggagccacatgcaacctggactgccgacgggggcagttcgggccatcctgcacactgcactgtgactgcggagggggcgccgattgtgatccagttagcgggcaatgccactgtgttgacggctacatgggaccaacttgcagagaaggaggccccttgagactgcccgagaatccaagcctcgcccaaggcagtgcaggaactctgcctgcctccagccgcccaacttctagatcgggaggacccgctaggcactag

SEQ ID NO: 124981 - DNA, 8538 bp, Artificial Sequence
  Description of Artificial Sequence: Synthetic coding sequence
atggcactcggcaaagttttggccatggcgctggttctggcgctggctgttttgggctcgctgtctcctggcgcacgcgccggggattgtaaaggacaacgccaggttctgcgcgaggcacctggattcgtgacagacggagcagggaactattccgtgaacggcaactgcgaatggctgatcgaagccccctctccccagcaccggattctcctcgattttttgtttttagacactgagtgcacctatgattatctcttcgtgtacgacggcgactcaccccgggggccattactggcctctctctccggcagtacgagacccccaccaattgaggcatcgtccggtaagatgctgctacatttattcagtgacgctaactataatctgctagggttcaacgcttccttcagattttcactgtgcccaggcggatgccagtcacacggccagtgccagccacccggcgtttgcgcttgtgagccgggctggggtgggcccgactgtgggctgcaagagtgctctgcctactgcggctcccatggtacctgcgctagcccactcggaccttgcaggtgtgagcccggattcctcgggcgagcctgtgatcttcacctgtgggagaatcagggggccgggtggtggcataacgttagcgccagagacccagcgttttccgcgcgaataggcgccgccggcgccttcttaagtcctcctggcctactcgccgtattcggagggcaggatctgaacaacgccctgggcgatctagtgctatacaacttttctgcaaatacttgggaatcctgggacctgtcacctgcgccagccgccaggcattctcacgttgcagtcgcctgggcaggatccctcgtattgatgggcggagaactcgccgatggatctctcactaatgacgtttgggccttttcacccctgggaagaggccactgggaactcttagctcccccggcaagcagttcgtccgggccccctggtctggccggacacgccgcagcgctggtggatgatgtctggctatatgtgtcaggaggcaggacgccccatgacctcttttcttctgggctctttagatttaggctggactccacctctggaggatattgggaacaggtgattcccgctgggggccgccctccagccgccactggtcactctatggtgttccatgctcccagcagggctttgttagtacacggtgggcatagacctagcactgcccgattctccgtgcgagttaattccacagaactgttccacgtggacaggcatgtatggaccaccctgaaaggccgcgacggcctccagggcccaagggaacgggcatttcatactgcatctgtgctcggaaactatatggttgtttatggcggcaatgtgcacactcactatcaggaggagaagtgctatgaagacggaatatttttttaccacctcggctgccaccaatgggtttccggtgcagagttggcgccacccggcacccccgagggtagggccgctcccccttcaggacgctactcacacgttgctgccgtattgggaggaagcgtgttgctggttgccgggggatactctggacgtcccaggggcgacttaatggcctataaggttccaccattcgtattccaggccccagctcccgactaccatctggactattgcagcatgtataccgatcactccgtgtgctctagagatccagagtgtagctggtgtcagggggcctgtcaggccgccccccctcccggcacgcccttgggtgcctgtcctgcagctagctgtctgggcctggggcgcttactgggcgactgtcaggcctgcctggctttcagcagtcctactgctccaccacgggggccgggcaccctcggatggtgcgttcacaatgaatcatgcttgcctagacctgagcaggcaaggtgtcgtggagagcagataagtgggaccgttggatggtggggccctgctcctgtttttgtcacaagcctggaggcctgtgttactcagtcctttctgccaggcctgcatttgcttacatttcagcagccacccaacacaagccagcccgataaagtctccatcgttcgcagcacgacgattactctgacacctagcgcagaaactgacgtaagcctagtttacagaggtttcatttatcccatgctgccagggggcccaggcgggcccggcgctgaagatgtcgccgtttggactagggcgcagcgactgcatgtgctggccagaatggcccgaggccccgacaccgagaacatggaagaggttgggagatgggtcgcccatcaggagaaagagactaggcgcctacaaaggcccggaagcgctaggttgtttcctctgcccggcagggaccacaaatatgctgtggagatccagggtcagctgaacggcagcgccggacccgggcatagtgagctcacgctattgtgggacaggacaggcgtgcctggaggcagcgagatttccttcttctttttggagccctaccgtagttctagctgcacaagctactcttcctgcctgggctgcctggctgaccagggatgcgggtggtgtctcacttcggccacctgtcatctgcggcagggcggggcccattgcggcgacgacggcgccggaggcagtctgcttgtcctggttccaactctgtgcccactatgcgaagagcaccgggactgtcacgcctgcactcaggatccgttttgtgagtggcaccaaagtacctctagaaaaggtgacgccgcatgttcacggcgcggaaggggaagaggcgccctcaaaagccctgaagaatgcccccccctatgcagccaacgcctgacatgtgaggattgtttggccaatagttcccaatgcgcttggtgtcaaagtacgcatacttgttttctgttcgccgcctacttagccaggtacccacatggaggttgcaggggatgggacgacagcgtccactccgaaccacggtgcaggagttgtgatgggtttttaacgtgccacgagtgtctccagagccacgagtgcggctggtgcggcaatgaggacaacccaaccctcggtcgctgcctccaaggcgatttttccggacccttagggggggggaactgcagtctgtgggtgggcgaggggctcggcctgcccgtggccctgcctgctcgttgggcctatgcaaggtgcccagacgtggacgagtgccggctcgggctcgctcgatgtcatccccgcgctacatgcttgaatacacctctcagttatgagtgccattgtcagagaggttatcagggcgacggaatctcacattgcaaccggacctgcctcgaggactgtgggcatggagtgtgttctggcccaccagattttacttgtgtatgtgatttgggatggacgtcagatctgcccccccccactcccgcgccagggccccccgctccacgctgctcccgggattgcggatgttctttccacagtcactgtcggaaacgagggcccggtttctgcgacgagtgtcaggactggacatggggcgagcattgtgagagatgtcggcccgggagctttgggaacgccacagggagccgcggttgcagaccttgtcaatgcaacggacacggggaccccaggcgcggccactgcgacaacctctcaggcctgtgtttttgtcaggatcacaccgagggcgctcactgccagctgtgcagcccagggtactacggcgatccaagagctggcggctcctgcttccgcgaatgcgggggtagagccctgcttacaaatgtcagctctgttgccctgggctcacgccgagtgggcggacttcttcctcctggcgggggggcggcacgggctgggccggggctctcttattgcgtgtgggtggtgtcggctacagaagagttacagccctgtgctccggggactctttgtcctccactgacacttacctttagccccgacagctctaccccttgtactttgtcttacgtgttagctttcgacgggtttccccggttcttggatactggagttgtacagagtgatcgatctcttatcgctgcattttgcggccaacgccgcgaccgcccgctgacagtgcaagccctatctgggctgcttgttcttcactgggaggcgaatggctcatcgtcctggggctttaacgcaagtgttggatccgccagatgcggtagtggagggccaggatcctgtcctgtaccacaggaatgtgtgcctcaagatggcgctgctggggcaggactgtgtcggtgcccgcagggctgggcagggcctcactgcaggatggcactgtgcccagagaactgtaatgcacataccggggccggtacatgcaaccagagcctgggtgtttgcatttgcgccgaaggattcgggggccccgattgtgcaacaaagctggatggcggtcaactcgtgtgggaaactttgatggatagccgcctgtctgccgatacagcatccagattcctgcacaggctcgggcatacaatggttgacggccccgacgcgacactctggatgttcggaggcttaggcctaccccagggcttactgggaaatctgtacagatatagcgtttccgaaaggcgctggacgcaaatgctcgccggggctgaggatggagggccaggtccctcacccagatctttccacgctgctgcctatgtccccgccggcagaggtgccatgtacctgctgggcggcctcactgctggcggagtcaccagggacttctgggtgctaaatctgacaacacttcagtggcggcaggaaaaggccccacagactgtcgagcttcccgccgtggccggacacaccctgacggcacggcgtgggctgtccttgctgcttgtcggtggctacagccctgaaaacggttttaaccaacagttactggaataccagctggccaccggcacttgggtgtccggcgcccagtccggcacccccccaacaggcttatacgggcattcagctgtgtaccacgaagccaccgactctctttacgtcttcgggggatttcgcttccatgtggaactcgctgccccgtccccagagctgtactctctccactgccccgatcgcacctggtcacttctggctccctctcagggcgccaaaagggatcgcatgcgtaatgttcgaggctcctctagaggcctcggccaggtacctggggagcagcctggttcgtggggcttccgagaagttcgaaaaaaaatggccctgtgggcagctctggcgggtacaggagggtttctggaggagatttccccccacctcaaagagccacgcccacgcctgttccatgcgagcgctttgctcggagatactatggttgttttgggtggacgaagcgacccagacgagttcagctctgatgtactgctataccaggtgaactgcaatgcctggctgctgccagacctcactcggtctgcctccgtcgggcctccaatggaagaaagtgttgctcacgctgtggccgccgtcggctcccgactctatatcagtggaggctttgggggcgttgccttaggaagactcctggcactcacactgccgcccgatccatgtagactacttagctccccagaggcctgcaaccagtccggggcctgcacctggtgccacggcgcctgcctgtccggagaccaggcccataggttgggatgcggcggctccccctgctctccgatgccacgtagcccggaggagtgtcgtcgtctccggacatgttcagagtgcctggcaaggcacccccgaacactgcagccaggtgacggcgaggcttccacccctcggtgtaagtggtgtacaaactgtcctgaaggggcttgcatcggtaggaatggctcctgcaccagcgagaacgactgtagaatcaatcaacgggaagtgttctgggctggaaattgctctgaggcggcctgtggcgcagcagattgtgagcagtgcacaagggaggggaaatgcatgtggactaggcaattcaagagaacaggagaaacccggcggattctgtctgtacagcctacatacgattggacatgtttttcccacagcctcttaaacgtctcccccatgccagttgaatcatcaccccccctcccttgcccgacaccctgccacttgctgccaaattgtaccagttgcttggacagcaaaggtgcggatggaggctggcagcactgtgtttggtctagctccctgcagcaatgtctctctccaagctacctgcccctacggtgcatggctggagggtgcggccgcttgctgagagggcctgagtcctgctctttgggctgcgcccaggcgacccagtgtgccctttgcctcaggagaccacattgcgggtggtgcgcttggggaggacaggatggtgggggaaggtgtatggaaggtggcctgtcaggcccccgtgacgggctgacctgcgggaggcctggcgcttcctgggcatttctcagctgccccccggaggatgagtgcgctaacggccatcacgattgtaacgagacacagaactgtcacgaccagccccatgggtacgaatgcagctgcaagacagggtacaccatggacaacatgacaggcctgtgtagaccagtgtgtgcgcagggatgcgttaatggatcctgcgtagaacctgatcattgtcggtgccatttcgggttcgttggtaggaattgttccactgagtgccggtgcaaccgccattcagagtgtgcaggagttggcgcccgagatcactgtctcctatgtagaaaccacacaaaaggctctcactgcgaacaatgtttacccctgtttgtcggtagcgccgtgggcggtgggacgtgccgcccctgtcacgcattttgcaggggtaacagccatatttgtatctcacgcaaagagctccagatgtctaagggggagccgaaaaaatactctttggacccagaggaaattgagaattgggtaaccgaggggccaagcgaagatgaggctgtctgtgttaactgtcagaacaacagttacggcgaaaagtgcgaaagttgtctgcagggctactttctgctggacggcaaatgcaccaagtgccagtgtaacggccacgcggatacatgtaatgagcaggatggaaccggctgcccatgtcagaacaacactgagacaggaacctgtcagggcagttccccgagtgacagaagagactgttataaatatcagtgtgcaaagtgtagggagtccttccacggcagtcctctgggggggcagcaatgttatcgtcttattagcgttgagcaggagtgctgtcttgaccccacgtcacaaaccaattgttttcacgagccgaagcgaagagcactgggacccggacggacagtgctgtttggagttcagcccaaatttaccaacgtcgatatccggctgaccctagatgttacttttggcgctgtcgacttgtacgtcagcaccagttatgacacatttgtggtccgagtagcacccgataccggggtgcacacagtgcacatccagcctccccccgcccccccccccccccccccaccagccgacggtgggccaagaggggccggcgaccctggtggagccggcgctagttccggccccggtgctccagctgagccaagggtgcgagaagtgtggccgcgcggactaattacttatgtaactgtcactgaaccctcggccgttctggttgtccgaggcgtccgggatcgccttgtgataacctacccccacgaacatcacgccctgaagtcgtctcgtttttaccttcttctgctcggcgtgggcgacccgtcaggaccaggggccaacggttccgctgactcccagggcctactgttcttccggcaggaccaggcccatatcgacctgttcgtgttctttagtgtcttctttagctgtttcttcctattcctgtccctgtgcgtcttgctgtggaaggccaaacaggctctggaccagcggcaggagcagcgccgacatctgcaggaaatgacaaagatggcgagtagacctttcgccaaagttacagtctgttttccgcctgatcccacagccccagcttcagcctggaagcctgccgggctcccaccacctgcatttagaaggtccgagccttttctcgctcctctactccttacaggtgctggtggcccgtggggtcctatgggcggcggatgttgccctccagcgatcccagccacaaccgccggcctgcgcgcaggaccaattactctggaacctaccgaggacggtatggccggggttgccacactgctgctccagctgccaggtggtccacacgccccaaatggagcctgccttgggtcagcactggtgaccctccgccatagattgcacgaatattgcggtgggggcggtggggctggaggaagcgggcatggaacgggcgccgggcgtaaaggcctgttgagccaagataatctgacatccatgagcctctag

SEQ ID NO: 124982 - DNA, 8337 bp, Artificial Sequence
  Description of Artificial Sequence: Synthetic coding sequence
atggcgctcgggaaagtgctcgccatggcccttgtgctagccctggccgtgctgggatccctcagccctggggctagagcgggtgactgtaagggtcagaggcaagttctgagagaggcccccggctttgtgaccgacggcgctggtaactactccgtcaacggcaactgcgaatggctgatagaagcccccagccctcagcatcgtatcctcctcgatttcctgttccttgacacggagtgcacatatgattatctctttgtatacgacggggacagtccacgggggcccctcctggcgtccctcagcggatcgacacgcccacctcctatagaggccagctcaggaaagatgctgctccacctgttctcggacgctaactacaatcttcttggatttaacgcatcattcagattcagtttgtgtcctggcggatgccagagtcacggtcagtgtcagccaccgggtgtgtgtgcctgcgaacccggatggggaggtcccgattgtggccttcaggagtgctcagcttattgtggctcccacggcacatgtgctagtccactaggtccgtgccgctgcgagcccgggttcttagggcgggcctgcgacttgcacttatgggaaaaccaaggcgccggttggtggcacaacgtgtccgctcgcgatcctgccttttctgctagaatcggcgccgctggcgcgtttctctcaccaccagggctgcttgcagtgtttggtggtcaagacctgaataatgctctgggcgaccttgtgctttacaacttctctgccaatacatgggagtcctgggatttgtccccagcacccgccgcacggcacagccacgtggcggtggcatgggcgggaagtctggtcctcatgggaggggagcttgccgatggaagccttactaacgatgtgtgggcctttagccccctaggcaggggccattgggaactgctggccccaccagcaagctcttcttccggtccaccaggcctcgcaggccatgctgctgccttggtagacgacgtctggctttatgtgagcggaggtcgaaccccacacgacctctttagctctgggttgtttcggttccgcctggattcgacaagtggcggatactgggaacaagttattccagccggggggcgcccccccgctgccacgggccactctatggtgtttcacgctccgtcccgggccctgttggtgcacggagggcacaggcccagtacagcccggttctccgtgagagtgaatagtaccgaactttttcacgtggatagacacgtttggacaactctgaaaggacgggatggacttcaggggccacgcgagcgagcctttcatacggcgtcagtgcttggcaactatatggtagtgtatggaggcaatgtgcatacccactatcaggaagagaagtgttatgaagacggaattttcttttaccacttggggtgccaccaatgggtatctggtgctgagttggccccccctggcacccccgagggaagagcggctcctccaagcggccgatacagccacgtggcagctgttttaggcggttcagtccttctagttgccgggggatattctggcagaccgcggggcgatctcatggcctacaaggtgcccccatttgtgttccaggcacccgcccccgattatcatctagattattgttctatgtatacggatcactccgtctgctctagggatcccgagtgttcatggtgccagggcgcttgccaggctgctcctccacccgggacacctttgggcgcctgccctgcagctagttgcctgggcttagggaggctcctcggtgactgtcaggcctgtctggctttttcctcgcccactgcccccccaagaggcccaggaaccctcgggtggtgtgtacacaacgaatcttgcttgcctagaccagagcaggccagatgtcgaggagaacagatatcaggcaccgtcgggtggtgggggcctgcaccggtgttcgtcactagcctcgaggcctgcgtgactcaatctttcctccctggcctgcatctgcttacctttcagcagcctcccaacacctctcaaccagacaaggaggaagtaggtagatgggtagcacaccaggagaaagagacccgcagactgcagcgccccgggagtgcaaggctcttcccactcccaggccgtgaccacaaatacgccgtggagatccagggccagctaaacgggtcagccggtccgggccatagtgagttgacgcttctgtgggacaggaccggcgtgcctggcggttctgagatttctttcttctttcttgaaccttatcgctcctctagctgtacctcgtactcgtcgtgtttaggatgtcttgctgaccagggttgtgggtggtgtttaacatctgccacatgccaccttcgacagggcggtgctcactgtggcgatgatggcgcaggaggctctcttctagtccttgtgcccacattgtgtcctctctgcgaggaacatagagactgccatgcctgtacgcaggatcctttctgcgagtggcatcaatccaccagtagaaaaggagatgctgcttgctccagacgaggccggggacggggagctctcaagagtccagaagagtgcccccccctctgcagtcaacggctgacatgcgaggattgtctggccaattctagtcagtgcgcatggtgccaatctactcatacctgcttcttattcgcagcatatctagctcgatatccacacggcggatgccgcggctgggatgattctgtgcattctgaaccacggtgtagatcctgcgatggtttccttacttgtcacgaatgtttgcagagtcacgagtgtggctggtgtggcaacgaagacaatccaacattagggcgatgtctgcaaggggactttagtggacctctgggaggtgggaattgtagtctgtgggttggagaaggcctcgggttgcctgtggccttgccggcgaggtgggcctacgctcggtgtcctgatgtggacgagtgtagactgggcctcgcgcgctgtcatccccgcgccacttgtctgaacactcctctctcttacgagtgtcactgccagcgtggatatcagggggatggcattagccactgtaatagaacatgcctagaagactgcgggcacggggtttgtagcggtcctcccgacttcacatgcgtctgcgatttgggctggactagcgatctccccccaccaaccccagctccaggaccccccgctccgcgatgctcacgggattgtggatgctccttccactcgcactgccgcaaacggggacccggtttctgtgatgaatgtcaagattggacatggggcgaacactgcgagagatgcagacctggttcgtttggaaacgcgaccggatcacgggggtgtagaccgtgtcagtgtaatggccacggcgatccccgcagagggcattgtgacaacctcagcggcctctgtttctgccaagaccacacagagggcgcccattgtcagttatgtagccccggttactatggagacccccgcgccggcggcagttgcttccgggaatgtggtggtagagctctgttgaccaacgtgtcatccgtggcactggggagtagacgcgtgggcggactcctgccccccgggggtggcgcagcacgcgcagggcccggcttatcctactgtgtctgggtcgtctctgcaaccgaagagctccagccttgcgcgccaggcacgttatgtccaccactgacgttgactttcagccccgattcttccacaccatgtaccctgagctatgtgcttgcctttgacggatttccgcggttccttgataccggcgttgtgcaatcggacagaagtttgatcgccgccttctgtgggcaacgccgggaccgtcctctgaccgtgcaggccctctctggcctgctggtactacactgggaggccaatgggtccagttcctggggatttaacgcatcagtcgggtcagcccggtgcggaagtgggggtcctggcagttgtccagtccctcaggagtgtgtccctcaggatggggccgcaggtgcggggctgtgtcggtgcccccagggttgggcaggcccccactgccggatggctctgtgtcctgagaactgcaatgctcacacaggggctggcacctgcaaccagagtcttggcgtatgtatttgtgcggaagggttcggcgggccagactgtgcaacgaagctggatggaggacagctggtgtgggagaccctgatggactcacgcttgtctgctgatactgcaagtcggttcctccaccggttgggacatacaatggttgacggtccggatgccaccctatggatgtttggcggactaggactcccacaggggctgctaggcaatctttacaggtactccgtgagtgaaaggaggtggacacagatgctggccggagctgaggatggcggaccaggaccatcaccgcgctctttccacgctgccgcctatgttcccgcaggacgcggcgctatgtacctgttgggcgggctgactgcagggggcgttacaagagatttttgggttctgaacttaacgaccctccagtggcgacaggagaaagccccgcaaaccgtggagcttccagcagtcgctggacacacccttaccgcccgaagaggactctcactgctattggtgggagggtacagcccagagaatgggtttaaccagcagttgcttgagtatcaattagccaccgggacctgggtgtctggtgctcagagcggtacacctcccacgggcctctatggtcattctgccgtctatcacgaagccacggattccctgtacgtgttcggtggatttcggttccacgtggagttagccgcccctagcccagaactctacagccttcattgtccagaccgcacatggtctctgcttgcgccctcgcagggggctaaacgagatagaatgcggaacgtgaggggcagctccagaggactcgggcaggtgccaggagaacagcctggttcttggggttttagggaagtacggaaaaaaatggcattgtgggctgcactggcaggcaccggcggattcctagaagaaatttcaccccacctcaaggagcctcgccctcgtctattccacgcgagcgccctgctcggagataccatggtcgtgctgggaggtagaagcgatcctgacgagttcagctcagacgtgttgctttaccaggtgaactgcaatgcctggttgctgcccgatttaacccgcagcgcaagtgtgggcccccctatggaggaaagtgtggcacacgctgtggcagccgtgggctccagactgtacatctccggcgggttcggaggagtggctctgggaaggctcctggctctcacgctacccccagacccctgtcgattgctgagttcccctgaagcatgtaatcagagtggtgcttgcacatggtgccatggcgcctgtctgagcggagaccaggcacacaggctgggttgcgggggcagtccctgttctcctatgccgcggagccctgaggagtgtagaaggcttcggacttgctccgagtgtttagctcggcatcccagaactttacaacctggtgatggcgaggcatcaactccaagatgtaagtggtgtacgaactgcccagagggcgcttgtattggacggaacggttcttgcacatcggaaaacgactgccgcattaatcaacgtgaagtgttctgggcaggaaattgctccgaggctgcctgtggggctgctgattgcgaacagtgcaccagagaggggaaatgtatgtggactagacaattcaagcggaccggcgaaaccaggaggatactgagtgtccagcccacctacgactggacctgcttcagtcattctctgctgaacgtctcacctatgcccgtcgagagcagcccaccattgccgtgtccgacaccttgccatttactgccaaattgtacatcatgtttggatagtaaaggagcagacgggggatggcagcactgtgtgtggtcctcatcactgcagcagtgcttaagtccgagttacttaccactacgatgcatggccggaggttgtggccgtcttcttcgcggcccagagagttgctctctgggctgtgcacaggctacccaatgtgctctgtgtttgcgcaggccacactgcggatggtgtgcctgggggggacaggacggcggaggcagatgcatggaaggtggtctctcgggaccacgcgatggactgacctgtgggagacccggcgccagctgggctttcctcagctgcccacctgaggatgagtgtgccaacggccaccatgactgtaacgaaactcaaaattgtcacgaccagcctcacggttatgaatgtagctgcaaaactggatatacaatggataacatgactggcctctgtaggcctgtgtgtgcacaaggttgtgttaacggctcctgcgtggaaccggaccattgtcggtgtcactttgggtttgtagggcgcaattgctctacggagtgcagatgtaaccgccatagtgagtgcgccggcgtgggggccagggatcactgtcttctgtgccgtaatcatacaaagggctcgcattgtgagcagtgcttacccctcttcgtcggaagcgcagttggtggcggaacatgcaggccctgtcacgccttctgtaggggaaacagccatatatgcatcagccggaaagagctgcaaatgtccaagggggaaccgaaaaaatacagtttggacccagaagaaattgagaattgggtcacagaaggaccatccgaggacgaggcggtgtgtgtgaactgtcagaataatagttacggggaaaaatgtgagagctgcctgcaggggtatttcctcctagacggaaagtgcaccaagtgccaatgcaacggccacgcggacacttgcaatgagcaagacggaacggggtgcccatgtcaaaacaatacggaaactggtacttgccaagggtcatccccttccgaccgtagggactgctacaaataccaatgcgctaagtgtagggagtccttccacggaagtccgttggggggccagcagtgctacagactaattagcgtcgaacaggaatgttgcctggatcccacctctcaaactaactgctttcacgagcccaaaaggagggcccttgggcctgggaggacagtgttattcggggtgcagcccaaatttacaaacgttgatatcagactgacactggacgtcacctttggagctgtggatctctacgtcagcacatcctatgacacatttgtggtgcgagtcgccccagatactggggttcatacagtgcacatacaaccccccccagctccccctccgccacctcctcccgctgacggcggccccaggggagctggggatcccgggggtgccggagctagttctggtccgggagcccccgccgagccgcgggtccgggaggtgtggccgagaggtctcattacctatgtcactgttactgagccctccgccgtcctggttgtgcgtggggttagagaccgtctggtcatcacttacccgcatgagcatcacgccctcaaaagcagcagattttaccttttgctactgggagtgggcgatccatcgggtcccggcgctaatggctcagctgacagtcagggactcctgttcttccgccaagatcaggcccacattgatctgttcgtgtttttctccgttttttttagctgtttttttctctttttgagtctctgcgtcttactatggaaagcaaaacaggctctggaccagagacaggaacagagacggcacctgcaagaaatgaccaagatggcttctagacctttcgccaaggtgacagtttgtttcccacccgatcccactgcgccagcctcggcctggaagcccgcaggactaccgcccccggcttttagacgatccgagccatttctggctccccttcttctgacaggcgctggcggaccctggggcccaatgggcggcgggtgctgtcccccagccattcctgccactacagccggcctacgggccgggcctattacactggaaccaaccgaagacggcatggccggtgtggcaaccctgctactgcagctaccaggaggtcctcacgcccctaatggcgcttgccttggatccgcattggtgacccttaggcaccgcctgcacgagtattgtggggggggtggtggtgctggtggctcaggccatggtaccggagccggacgcaaggggctcttatctcaggacaatcttaccagcatgtccctgtag

SEQ ID NO: 124983 - DNA, 1320 bp, Artificial Sequence
  Description of Artificial Sequence: Synthetic coding sequence
atgagagaactcccagctggcctgttgccacccgggagagaagtgcaccagtgcgcgaagtgccgagagtcttttcatgggtcacccttgggcgggcagcagtgttatcggctcattagcgtggaacaggaatgctgtctggacccaacgagccagacaaattgttttcacgaaccaaaaaggagggccctgggccctggtcgcacggtcttatttggcgtgcagcctaagttcaccaacgtggatatcagactgaccctggacgtaaccttcggggccgtcgacctctatgtgagcacctcgtatgacaccttcgtggtccgggtagcacctgacacaggcgtccacacagttcatatccaacccccgccagcgccccccccaccccccccccctgcggatggagggcctagaggcgctggagaccctgggggagctggtgcctccagtggccccggcgcccccgcggagccaagagtgcgcgaagtctggcccagaggacttatcacctatgtcaccgttaccgaacctagcgccgtgctggtcgtacggggagtgagagaccgccttgtgatcacgtatccacatgaacatcatgccctgaagtccagcaggttctatttactcctgctgggggttggcgatccttccggaccaggcgctaacgggagcgccgactcccagggactgctgttttttaggcaagatcaggcccacatcgacttgttcgtgttcttcagtgtatttttctcctgtttttttttgtttctcagcctatgtgttctgctctggaaagccaagcaggccttggaccagagacaggagcaacgccggcaccttcaggagatgaccaaaatggcatctcgcccttttgctaaagtgaccgtgtgttttccccccgacccgaccgcccctgcctcagcttggaagcccgccggcctcccaccacccgcattccggcgttctgagcctttcttagcgcctctgttactcacgggagccggaggcccttggggccccatgggcgggggctgttgccctcccgcaattccggccacgaccgccggtttgcgcgccgggcccatcaccctcgagccgaccgaggatgggatggcgggcgtggccacccttctcttgcagctcccaggtggcccgcacgccccaaatggagcatgcctcggcagtgcactcgtaacactgcgacaccggttgcatgaatactgtggaggcggcggaggtgctggcgggtccggccatggcactggcgcaggtcggaagggacttctttcccaggacaatcttacatccatgtctctttag

SEQ ID NO: 124984 - DNA, 1809 bp, Artificial Sequence
  Description of Artificial Sequence: Synthetic coding sequence
atgaacggaggggctgaacgcgcgatgcggagccttcctagcctgggcggactggctctgctgtgctgtgctgccgcggctgctgcagctgccgtggcctcagcggcctccgctggaaatgtaacaggaggtgggggggccgctggccaggtggacgcctcccctggccccggactgcgaggagaaccctcgcatccctttcccagagctacagcccctactgcccaggcaccccggaccggccctcctagagctaccgttcaccggcctctggctgcaacgagcccggctcagagtcccgaaactactccactctgggcaacagcagggcccagcagcacgacatttcaggccccccttgggcctagccctacgactccacccgccgcagagagaacctctacgacttcccaggcccccactcggccagctccaacaaccctcagcaccaccaccggcccagcccccactacccctgtcgctacgaccgtccctgcccctaccaccccacggactcccacacctgacctaccatcaagctccaactcgtcagtcctccctacaccacctgccacagaagctccctcttccccaccccccgagtatgtgtgcaattgttctgtggtagggagccttaacgtaaatcgttgcaatcagacaacaggacagtgtgagtgtaggcccggataccaagggctgcactgtgagacttgcaaggagggtttttatctgaattatacaagcggcctgtgtcaaccatgcgactgtagtcctcatggggccttgtctattccttgtaattcaagtggtaagtgccagtgcaaagtcggagtgattggaagcatatgcgacaggtgtcaagatgggtattacggttttagcaagaacggatgcctcccttgccaatgcaataatcgctctgccagctgcgacgccctgacaggggcctgtctcaattgtcaggagaactcaaagggcaaccattgcgaagagtgtaaagaaggattctaccaaagccctgatgctaccaaggaatgcttaagatgtccatgttcagccgtgactagcaccggctcttgtagcatcaagagttcagagttagaacccgagtgtgatcagtgtaaagatggatacatcgggccaaattgcaacaagtgtgagaatgggtattacaatttcgatagcatttgcaggaagtgccaatgccacgggcacgttgaccccgtaaaaaccccaaagatatgcaagccagagtccggggaatgcattaattgtcttcacaataccacaggattctggtgtgagaattgcttggagggttacgtgcacgatctcgaggggaactgtatcaaaaaggaagtgatcctccctacacccgagggatcaactatactcgtgtcgaatgcgtcactcacgaccagtgtcccaactcccgtgattaatagcacattcactcccacgaccctgcagacaatcttctccgtctccaccagcgaaaattcgactagcgccctggccgatgttagttggacccaattcaatattattatactgaccgttatcattattgtagtggtcctgttaatggggttcgtaggagcggtctacatgtacagagaataccaaaatcgaaagctcaatgcacccttttggaccatcgaactgaaggaagacaatatctccttttcatcctatcacgattcaatccctaacgccgacgtttccggattacttgaggatgacgggaacgaggttgcccccaacgggcagctcaccctgaccactcccatccataattataaggcctag

SEQ ID NO: 124985 - DNA, 1920 bp, Artificial Sequence
  Description of Artificial Sequence: Synthetic coding sequence
atgaggtcgctcccgtcgcttggcgggctggcactcctctgttgtgcggcagctgccgctgctgcggcagtggcatccgccgcatccgctggtaacgtaaccggaggaggtggcgccgctggccaagtggacgccagccctggaccagggttgcggggggagccatcacatcccttcccccgtgcaacagccccaacagcacaggcaccccggactggaccgcctagggccacagttcatcgcccactggccgctacttcccccgcccagtcccctgagacaacccccctgtgggccaccgcaggcccctcatcgacaaccttccaggctccactgggtcccagcccaaccactcctccagccgctgaacggacttccaccacgtctcaggcacccacaaggcccgctcctaccaccctttctacaacgacaggacccgcccccaccacccccgttgccaccaccgttcccgcgcccactactccaagaactcctactcccgatctgccctctagttctaattcaagcgttctccccacaccgccagctacagaggctcccagttccccccctcctggccaccaatggccagtggcgaagatgcctcagaagtatttgggcaagtatgcgtgtgaatcaaacctgaagtctaagtacttgccactgacgcagcctgtgatgaatctgcgggtctcagaagctgtgaaaactgaatacgtgtgcaattgcagtgttgtcggctccctcaacgtgaaccggtgcaaccagacaaccggacagtgtgaatgtcgtcccgggtaccagggcctccattgcgaaacgtgtaaggagggattctatctgaattatacttctggcctgtgccagccctgcgattgcagtcctcacggagctttgtcaattccttgtaatagttctggcaaatgtcagtgtaaggtcggagtcattggaagtatctgcgacagatgccaagacggctactatggtttttcgaaaaatggctgtttaccgtgccaatgtaacaaccggtccgcttcttgtgacgccctcaccggggcttgtctaaattgtcaagaaaatagcaagggcaaccactgtgaagagtgcaaggaagggttctaccagagcccggatgctacaaaagagtgtctaaggtgcccttgcagtgccgtgacatctacgggtagctgctcaattaagtctagcgaactcgagcctgaatgcgaccaatgtaaggatggctatataggccccaattgcaacaaatgcgaaaatggatattataactttgattctatttgtcgtaagtgccagtgtcacggccacgtggaccctgtgaagactccaaaaatttgcaaacctgagtccggagagtgcattaattgtttacacaacacaactggattctggtgcgagaattgtttggaaggctatgtgcatgatctggaagggaattgcattaagaaggaggttatcctgcccacacctgaaggctccacgatcttggtctccaacgcctccctgaccacgtctgtcccaacaccagtcattaactcaacattcacaccaacaacgctgcagacaatctttagcgtctctactagtgagaatagtacctcagcgttggctgacgtgtcttggacgcagttcaatatcatcatcctgactgtcattattatcgttgttgttctgctcatgggattcgtcggggcagtatatatgtacagggagtatcagaaccgtaagctgaacgctcccttttggacgattgaactgaaagaggataatatctccttttccagctatcacgattcaatcccaaacgcagatgtgtcagggctccttgaagatgacgggaatgaggtcgcacccaatggccagttgacactgaccaccccaatccataactataaggcttag

SEQ ID NO: 124986 - DNA, 939 bp, Artificial Sequence
  Description of Artificial Sequence: Synthetic coding sequence
atgctgcgagcccctgggtgtcttctgagaacgagcgtggcgcccgctgccgctctagccgcggctctcctaagctctctggctaggtgtagcctgcttgaaccacgggacccagtagcctcttctctcagtccctattttgggaccaagacgagatacgaagatgtgaaccccgtgctcctctccggaccagaggccccatggcgcgacccagaactgctggaaggcacctgtactcctgtgcaattggtggcactgatcagacatgggaccagatatccaaccgtgaagcagatccgcaaactgcgccagcttcatggattactgcaggctcgcggatccagagacggtggcgcatcttccacaggaagcagggatcttggcgccgccctggccgactggcctctgtggtatgcggactggatggatggccagctcgttgaaaaaggccggcaagatatgcggcagttggctttgcggttagcctccctgttccccgctttgttttccagagagaactatggacgtcttaggctgatcacatctagcaaacatcgctgtatggactctagcgcagccttcctccagggcctctggcagcattatcatccaggcctgcccccccctgacgtcgctgatatggaattcggacctcctaccgttaacgataagctgatgcgcttttttgatcactgcgaaaaattccttacagaggtcgagaagaatgcaactgccctctaccacgtcgaggccttcaaaactggccccgagatgcagaacatactaaagaaagttgcggccacacttcaagtgcctgttaatgacctaaatgccggcttgtcccagttcctcctccaatcaagttctagcctggtcatgcagcgcctgttcttccattgctttttaagttgggctacatccaaaacaagaaatccgtag

SEQ ID NO: 124987 - DNA, 1464 bp, Artificial Sequence
  Description of Artificial Sequence: Synthetic coding sequence
atgttgcgggcaccaggttgcctcttacgaaccagcgtggcacccgcagctgctctggcagctgcgctcttgtcctcccttgcacgctgtagcttgttggaaccccgagatccggtcgccagctctctttcaccgtatttcgggacgaagacaagatatgaggacgtgaacccggtactcctttcagggcccgaggccccctggcgggatcccgaacttttggaaggaacttgcaccccggtgcaacttgttgccttgatccggcacggtaccaggtatcctacggttaagcagatccgaaagctcagacagctccatgggctcctgcaagcacggggatccagggacggtggggcctctagcacagggtcgcgcgacctgggcgcggcgttggccgattggcctctctggtatgcagattggatggatggacagcttgtcgagaagggtagacaggacatgcgccaattagcactgcgcctcgcctccctattccctgccctgttttccagagagaattacgggcggttgcggctgattacttctagcaaacaccggtgtatggactcttccgccgcgttcctacagggcttatggcagcattaccaccccggtttaccaccaccagacgtggctgatatggagtttgggccaccgaccgtgaacgataagctgatgaggttctttgaccactgtgagaaatttttaactgaagtggaaaagaacgctactgcactttaccacgtcgaagccttcaaaacaggccccgagatgcaaaacatcctgaaaaaggttgccgccacattacaagtccctgtgaacgacctcaacgccgatttaatccaggtggcctttttcacctgcagtttcgacctcgccattaagggcgtcaaatccccctggtgtgacgtcttcgacatcgatgatgcaaaagttctagagtatcttaatgacctcaaacagtactggaagcgaggctacgggtacacaatcaactcacgttcttcatgtaccctgttccaagatattttccagcatcttgataaggccgtcgagcagaaacaaaggagtcagcctatctcctccccagtcatcctgcagtttggacacgctgagacgttgcttccgctgctttccctaatgggatacttcaaagacaaggagccgcttacagcctacaactataagaaacagatgcatcggaagtttaggtccggcttaattgtgccctatgccagcaacttgatctttgtgctctatcattgcgaaaacgcgaaaacaccaaaggaacagttccgcgtgcagatgctgctgaatgaaaaggtgctgcctctggcttactcccaagaaactgttagtttctatgaagacctgaaaaatcactataaggacatactgcaaagttgccagacgtcagaggagtgcgagttagctagggcgaattcaacctcagacgagctttag

SEQ ID NO: 124988 - DNA, 861 bp, Artificial Sequence
  Description of Artificial Sequence: Synthetic coding sequence
atgtgtttgttccaactgtgtggacttgtgcgttatatggagtttggccctccaaccgtgaatgacaagctcatgagattttttgatcattgtgagaagtttctcaccgaggtggagaagaacgccacagctctctaccatgtggaggcttttaaaactggccccgagatgcagaatattctgaagaaggttgcagccactttgcaagttcctgtgaatgacctgaacgccgatctcattcaagtcgcattctttacttgctcttttgatttggcaatcaaaggcgtcaagagtccttggtgcgacgtattcgacatcgatgacgccaaggtgctggaatacctcaacgacctaaaacagtattggaagcgaggatacggttacacaatcaatagccggagttcatgcaccctcttccaggatatcttccagcatctggacaaggcggttgaacagaagcagcgttcacagccaatctcctccccagtgatcttgcagttcggccacgcggagactctgttgccgctgctgagtctgatgggatacttcaaagataaggaacccctgactgcttataattacaagaagcagatgcataggaagttccgcagcgggctgatagtgccttatgcgagcaacctcatattcgtgttatatcactgtgaaaacgctaagactcccaaggaacagttcagagtccaaatgctgctcaatgagaaagttcttcccctcgcctacagccaagaaaccgtcagtttttatgaagacctgaagaaccattataaggacattctccagtcctgtcagacttccgaggagtgcgaactggcccgagccaattctaccagcgacgagctgtag

SEQ ID NO: 124989 - DNA, 1041 bp, Artificial Sequence
  Description of Artificial Sequence: Synthetic coding sequence
atggatggacagctggtggaaaagggtcggcaggatatgaggcaactggccctccggttggcctccctctttcccgcgcttttctctagggaaaattacggccgtctgagactcatcactagtagcaagcaccggtgtatggactcaagcgccgcatttctgcagggattatggcaacattatcaccctggcttgcctccaccagacgtggcagatatggagtttgggccccccactgtgaatgacaaactcatgaggtttttcgatcattgcgagaagtttctcaccgaagtcgaaaagaacgcgacagcactataccatgtcgaagccttcaagactggccccgaaatgcagaacattctgaaaaaagtggcagccactcttcaggtgcctgttaacgacctcaatgcagacctgattcaagttgccttttttacctgtagcttcgatctggccatcaagggggtgaagtctccatggtgtgatgtcttcgatattgacgatgccaaggtgctcgagtatctcaacgacctgaaacagtattggaaaaggggctacggatataccattaacagtagaagctcatgcactctgttccaggacatttttcaacatctggacaaagccgtcgagcagaagcagaggagccagcccatctccagccccgtgattttacagtttgggcatgccgagacacttctgccactgctcagcctgatgggatactttaaggataaggagcctttgacagcgtataattacaaaaaacaaatgcatcggaagttccggtccggactgatagtcccatacgcttccaacttaattttcgtcctttaccactgcgagaacgcaaagacaccaaaggagcagttcagagtgcaaatgttgctgaacgaaaaagtgttgcccctggcttacagccaggaaactgtgagcttttacgaggatctgaaaaaccattataaagatatcttacaaagctgtcaaacaagcgaagagtgcgaactggcccgagctaactccacatctgacgagctatag

SEQ ID NO: 124990 - DNA, 6213 bp, Artificial Sequence
  Description of Artificial Sequence: Synthetic coding sequence
atgctcgaggcaatcgacaagaaccgcgccctccacgccgcagaaaggctgcagacaaaactgagagagagaggagatgtggccaacgaggataagctctctctcctgaagagtgtattgcagagtccactgttttcacaaatcttatctttacagacttcggttcaacagctcaaagaccaggtgaacatcgctacctcagcaacctccaatatagagtatgcacacgtgcctcatctgtcaccagctgtgattccgacgttacagaacgagagcttcctgctcagccccaacaacggtaatttagaagccctgaccggtccaggaataccgcacataaatggcaagccggcttgcgatgaattcgaccagctgataaaaaacatggctcagggcagacacgtcgaggtctttgaattgctgaagcctcctagcggagggctcggctttagcgttgttggcctacgttccgaaaacagaggtgaactaggaatttttgtgcaggagattcaggaaggctcagttgcacatcgggatggccggctcaaggaaaccgaccagatactcgcaatcaacgggcaggcccttgatcagactataacccatcagcaggcgatctcaatccttcaaaaagcaaaggatactgtacagttggtcatagccaggggatccttgcctcagttagtgtcccccattgtgtcccggagtccttccgcagcctctactataagtgctcattcaaatcccgtgcattggcagcatatggaaaccatcgaacttgtgaacgacgggtccggcctgggatttggcatcataggggggaaagctacaggcgttattgtgaagaccatcctgccgggaggagtggctgatcaacatggcagattgtgctctggggatcacatattaaagattggagataccgatctggccgggatgtcctccgaacaggtggcccaagtactccggcagtgcgggaacagagtgaaactcatgatagcccgcggtgctatcgaggagcggaccgcccctaccgccctaggcatcacactgagtagttcaccgacgtccacaccagaactaagagtcgatgcctctacacagaagggcgaggaaagtgagacttttgacgtggagctaactaagaatgttcaaggtctgggaataacaattgcggggtatatcggcgataagaaactggaacccagtgggattttcgtgaaatccatcaccaaaagctctgccgtagagcatgatggcagaattcagatcggcgaccaaatcattgcagtcgatggcactaacttacaggggttcacaaaccagcaggcagtcgaggtgcttcggcacacgggccagaccgttttgctgacccttatgagacgaggcatgaaacaggaagccgagctaatgagcagggaggacgtgaccaaagatgccgacttatctcctgtcaatgccagcattattaaggaaaattacgaaaaggatgaggactttctctccagcaccaggaacactaacatccttccaaccgaggaggaaggctaccccctgctgagcgccgagatagaggaaatagaggatgcacagaaacaggaggccgcgctgctcacaaaatggcagcgcatcatgggaatcaactatgagattgtggtggcccacgtctcaaagttcagcgagaattccgggctggggatctcactggaagccactgtagggcaccatttcatacggtccgtattgcctgaaggacccgtgggacacagcggcaagctattctccggcgacgagctacttgaggtcaacgggattacactgctcggtgaaaaccaccaagatgtcgttaatattctgaaggagttgccaatagaggtcaccatggtctgctgtagacgtaccgtccctcccacgacccagtcagagttggactcgctcgacttatgtgatatcgaactgaccgaaaaaccccacgttgatcttggggagtttataggcagttcggagactgaggaccctgttctcgctatgacagatgcgggacagtccacggaggaggttcaggcacccttggccatgtgggaggcaggtattcagcatattgaattggagaaagggtctaagggccttggtttttccatcctggactaccaggaccccatcgatcccgctagtacggtgattatcattcggagtctggtgcccgggggcattgcagagaaggatggcaggttgttacctggagatcgcctaatgtttgtcaacgatgttaacctggagaactccagccttgaagaggccgtcgaggccctgaagggtgccccaagtggaacggttagaatcggggtagcgaaaccgctgcccctgtcccctgaggaggggtacgtcagcgctaaagaggattcttttctctacccccctcacagctgtgaggaagctggcctggccgataaaccattgttccgtgctgaccttgcactcgtggggactaacgacgctgatctagtggacgaatctacattcgagtctccctattctccggagaacgactctatctacagcacgcaagcttccatcctgagcctgcacggtagcagctgtggagatggactgaattatgggtcgtcacttcccagtagccctcccaaggacgtaatagagaattcctgtgaccccgtgctggacctccatatgtctctggaagagttgtacacccagaacttgcttcagcgacaagacgaaaacactccttctgttgacatctccatgggccctgccagtggattcaccatcaatgattacacccccgccaatgccatcgaacagcagtatgagtgcgaaaatacgatcgtgtggaccgagtcacaccttccgtcagaagtgatctcgagtgccgagctcccaagcgtgctgcctgactctgccggtaagggtagtgaatacttactggagcagagttccctggcatgcaatgcagagtgtgtgatgctccagaatgtttctaaggagtcttttgaacggactatcaatatagctaagggaaacagcagcctcgggatgacggtctctgcaaataaagatggattaggaatgatcgtcaggagcatcatccatggaggagccatctcacgagatgggaggattgcaatcggcgattgtattctgagcatcaatgaggagtcgactatttctgttacaaacgcccaggcacgtgccatgctacgaaggcattctctcattggcccagacatcaagataacctacgtgccagcagagcatttagaagaattcaagattagtcttgggcagcagagcggcagggtcatggctctggatattttctcatcgtacacaggccgtgacatcccggagctgcctgagagggaggaaggggagggggaagagtctgagctccagaatactgcgtactctaactggaatcagccgagaagagtggagctctggcgtgaaccatcaaaatccctaggaattagtattgtgggcggacgcggcatgggaagccgcctgtccaatggggaggttatgcgcggtattttcataaaacacgtcctggaggattcccccgccgggaaaaacggaaccctgaagccaggggatcgcattgtagaggtggacggaatggacctgcgggatgcttcccacgaacaggccgtcgaggccatcaggaaggccggtaaccccgtggttttcatggtccaatccattattaaccggccacgaaaaagcccactgcccagcttgctccacaacctgtatcccaagtataacttttcttccaccaatcctttcgcggactctctccagatcaatgccgacaaggccccatcccagtctgagagtgagcctgaaaaggcaccactatgttccgtgccaccccctccaccttccgctttcgctgagatgggttctgaccacactcaatcatccgcatctaaaatttcacaggatgtggataaggaagacgagtttgggtatagttggaaaaatattcgtgaacggtacggcaccttgactggagagttgcatatgatagaactggagaaggggcactcagggctggggctgagtctcgctgggaataaagaccggagtcgcatgtccgtcttcattgtgggtattgatccaaacggcgccgctgggaaggatggtcggctccagatcgctgacgaactgttggagatcaatgggcagatcctgtacgggcgtagccaccagaatgcttcttcaatcattaagtgcgctcctagcaaggtcaaaattatttttatacgaaacaaggacgctgtaaaccaaatggcagtgtgccctggcaatgccgtggagcccttgccctcaaatagcgagaacctgcagaataaagagaccgaaccgacagtcaccacatcagacgcggccgtggatttaagttcttttaagaatgtgcaacatcttgagttgcctaaggaccaaggaggtctgggtattgcaatcagtgaagaggacacgctcagcggtgtcatcattaagtccctgacagagcacggcgtagccgccaccgacggacgtctgaaggttggggaccaaatcctggccgtagacgatgagatcgtggtcggctaccctattgaaaagtttatcagcctgctgaagaccgccaagatgacagtgaaactcaccatacatgcagagaatcccgatagccaggcagtgccttctgctgctggcgcagcctccggggagaaaaagaactccagccagagcctgatggtcccgcagagcggatctccagaacccgagtccatacgcaatacatctaggtcatccactcctgctatattcgcgagtgaccccgccacatgccctataatccctggctgcgaaaccaccattgaaatttccaaggggcgtaccggattgggcctgagcatcgttggaggtagcgatacactgctcggcgcgataattatccatgaagtgtacgaagaaggggctgcctgcaaggatggaagactttgggctggcgaccagatcctggaggtgaatgggatcgacctaagaaaggccactcatgatgaggcaatcaacgtcctgcgacagacccctcaaagggtcagattgaccctttatagggatgaggccccatataaagaggaggaggtttgtgatacgctgacgatcgaactccagaaaaaacccggcaaaggcctgggactctccatagtaggtaaaaggaacgacactggcgtatttgtaagtgatatcgtgaagggagggattgctgacgccgacggtaggttgatgcagggagatcagatcttaatggtgaatggtgaagacgtacgtaatgcaactcaggaagctgtcgcagccctactcaaatgctccctcggcaccgttacccttgaagtcgggaggattaaggccggtccttttcattccgagagaaggccctctcaatcctcccaggtttccgaaggatctctaagcagttttactttccccctcagtggatctagcacttcagagagcctagagagcagttctaaaaaaaatgctctggcgtctgaaatccaaggtttgcgaacagtagagatgaaaaaggggcctacagactcactggggatttccatcgcaggaggcgtcgggtcgccgttgggcgacgtcccaatatttatcgcgatgatgcaccccacgggggtggccgcacagactcagaagctgcgcgtgggggatcgtattgtgacgatttgcggaacaagtaccgaggggatgactcatacgcaggcggtgaatctgttaaaaaatgcctccggctcaatcgaaatgcaggtggtggcaggcggcgacgtatcggttgtgaccggccatcagcaggagcctgcctcaagctccttgtcctttacagggctaacgtcctcctctatttttcaggatgacttggggcccccccagtgcaagtctatcacccttgagcggggaccagatggattggggttttccatcgtaggcggttatggttctccccacggggaccttccaatctacgtaaagactgtgttcgccaagggtgccgcgtctgaggatggccggctgaagcgtggagatcaaattatcgctgtaaacggacagtccttagagggggttacccacgaggaagcagttgccatcctgaaacgaaccaaaggtacggtgactctgatggtactctcctag

SEQ ID NO: 124991 - DNA, 6213 bp, Artificial Sequence
  Description of Artificial Sequence: Synthetic coding sequence
atgttggaggcaatcgataagaatagggccctccacgctgccgaacgactgcagaccaaactgcgtgagaggggagacgtcgccaacgaagacaagctcagcctgttaaagagcgtgctgcagtccccactcttctcacagatcctcagcctgcagacaagcgtccagcagctgaaggatcaggtgaatattgccacctccgcaacaagcaacatcgaatatgctcacgtaccacacctgagtcctgccgtgattcccacactgcaaaacgaatcatttctgttgtcaccaaataacggcaacctcgaagccctgaccggccctggtattcctcacatcaacgggaagccagcttgcgacgagtttgaccagctgattaaaaacatggcacagggtcgccacgttgaggtttttgaattactcaagccaccgtcgggtggccttggattctccgttgtgggtctgagatctgagaacaggggagaactgggcatatttgtgcaggagatccaggaggggagtgtggcccatcgcgacggtcgtctaaaagagaccgatcaaatcctggccattaacggccaggctttggaccaaacaatcacccaccagcaggccatttctatcctgcagaaagccaaggatactgtgcagctcgttatcgcccggggctccctcccccagctagtgagtcctatcgtgtcacgtagtcctagcgcagcctccacgatttcagcacattctaatcctgttcattggcaacatatggaaaccattgaactcgtgaacgatggcagtggcctgggcttcgggatcattgggggcaaagctaccggggttattgtcaaaaccatattgcctgggggggtggctgaccagcacgggaggctgtgcagcggtgaccatatcctgaaaattggcgatacagacctggctggtatgagtagtgagcaagttgcccaggttttaagacagtgtggcaaccgagtgaagttgatgatagctagaggcgcaatagaggagagaacagcacctacagccttgggaattactctgtcgtcgtcaccaactagcacacccgagctgagagtagacgcttctacacagaaaggcgaggaatccgagacttttgacgttgagcttactaagaacgtccagggcttaggcattaccatcgccggatatattggagataagaaactcgaacctagcggtatctttgtaaaaagtattacaaagagtagcgccgtagaacacgatggcagaatccagattggggaccagattattgctgttgacggaaccaatctacagggcttcacgaatcaacaggccgtggaggtgcttaggcataccggccagaccgtcttactgactctaatgagaagaggcatgaagcaagaggccgagctaatgagccgggaagacgttaccaaagacgccgacttgagccccgttaatgctagcattatcaaggagaactacgagaaagacgaggacttcttgagcagcacgcgcaacaccaacatactgcccactgaggaggagggttacccactgttgtccgctgagatcgaagagattgaagacgctcaaaaacaggaggccgcgttgctcaccaagtggcagcgcattatgggtatcaactatgagatcgtcgtggctcacgtatctaagtttagcgaaaattccgggctggggatttcattggaggctacagtcggccaccacttcattcggtcagtgctgccggaggggccggttggtcatagtggcaagctcttttcaggcgacgagcttctcgaagtcaatggaattactctgctgggagaaaaccatcaggatgtggtcaacatactgaaggaattgcccatcgaagtcacgatggtctgctgtaggagaaccgtgcctccaactacacagagcgaattggactctctggatctatgtgacattgagctgactgaaaagccgcacgttgacctgggcgaattcattggtagtagcgaaaccgaggatcctgtgctggctatgaccgatgcaggtcagtcaactgaagaagtgcaagcgccactcgccatgtgggaggccgggatccagcacattgaacttgagaagggcagcaagggcctcgggttctccatcctcgactatcaggaccccatcgatcccgccagtaccgtaatcataattaggtcactggtgccaggcggtattgcggagaaggacgggcggctgttgccaggagacagactcatgttcgtcaatgatgtaaacctagaaaacagcagtctcgaggaagccgtggaagccctgaaaggtgccccaagcggcacagtgcgcatcggagtggctaaacctctccctctttcaccggaggagggctatgtgtctgccaaagaggattccttcctttaccccccccacagctgtgaggaagcagggcttgcggataaaccgttatttagagccgatctcgccctagtgggtaccaacgacgctgatttagttgatgagtccacttttgagtccccttatagccccgagaatgattccatctacagcactcaagctagtatcttgtcattacacggctctagctgtggggacgggctgaactacggatcatctctccctagtagcccacctaaagacgtgatcgaaaatagttgtgatccggtcctagaccttcacatgtccctcgaagagctgtacacgcagaacctcctgcagaggcaggatgagaatacacctagcgtcgacatcagtatgggtcctgccagtggttttactataaatgactacacacctgctaatgccatcgagcaacagtacgagtgtgaaaatacaatcgtctggaccgaaagccatcttcccagtgaagtcatctcgagcgcagaactcccaagcgtccttcctgacagcgcggggaagggttctgaatatctgctggaacaatcctccctggcgtgtaacgccgagtgtgttatgttacagaatgtgagcaaagaatcttttgagaggacaattaatattgcgaaagggaattctagcttgggcatgacggtgagtgctaataaggacggcctgggaatgatagttaggagtatcattcacgggggcgccatcagtcgggacggacgaatcgcgatcggagattgcattctgtctataaatgaagagagtaccatttcagtcactaatgcccaagcacgcgctatgcttcgccggcacagcctgataggacccgacattaagataacatacgtacctgctgagcaccttgaagaattcaagatctcattgggccagcagtccgggcgggttatggcacttgatatcttttcatcttatactggtcgggacattcccgaattaccggagcgggaagaaggtgagggcgaggaaagtgaactgcagaatacggcctactcaaactggaatcaacccaggagagtcgagctttggcgtgagccatcaaaatcactggggatttctattgttgggggccgtggaatggggagcaggctctcaaacggcgaagtcatgagggggatcttcattaagcacgtgctcgaagattccccggccggcaagaacggtaccctcaagccaggtgaccggatcgtagaagtcgacgggatggatcttcgggatgcttcacacgagcaagccgtggaggctatccgtaaagctggcaaccctgtagtgttcatggtacaatccattattaatcgtcctaggaaatctcccctgccttccctgctgcacaatctctatccaaaatataatttttccagcacgaacccctttgccgattccttgcaaattaatgctgacaaggccccctcgcaaagcgagagtgaaccggaaaaggctcctctatgtagcgtgccaccgcccccaccatccgccttcgcagagatgggtagcgatcatactcagtcctcagcctctaagattagtcaggatgttgataaggaggatgaattcggctattcatggaagaatataagagagaggtatgggacactgactggcgagcttcacatgatcgaactggaaaagggccactcagggctggggctcagcctcgctgggaataaagacagatctagaatgtctgtttttatcgttggcatagacccaaacggcgcagctggaaaggatggtcgcctgcagatcgccgacgaactgctcgagatcaacggacagattctgtacgggaggagtcaccagaatgccagctcaattatcaaatgtgctccgagcaaggtcaaaattatttttattaggaacaaagatgccgttaaccagatggccgtgtgccccggaaatgctgttgaacctctgcctagtaactccgagaacctccaaaataaagagaccgagccaaccgtgactacctctgacgcagccgttgatctcagctcattcaagaacgtccagcacctggagttaccaaaggaccagggcggcttgggcatcgccattagcgaagaggacactctctcaggggtgattattaaatcgcttacggagcacggagtcgcagcaacggacggacgcctcaaagtgggagatcagatactagctgtagacgacgaaattgtcgtgggctatcctatcgaaaagttcatctcacttctgaaaaccgcgaagatgacagtgaaattgactattcatgcagaaaatccagactcccaagctgtgcccagcgccgcaggggccgctagcggtgaaaagaagaacagctcgcagtcgctgatggtgcctcagtcaggatcccccgagcccgaaagtattcggaacacttccagatcaagcacccccgccatttttgccagcgacccagcaacctgccctattattcctgggtgcgagaccaccatagagatttccaagggccgcacgggactggggttaagcattgtgggggggtctgatacccttttgggagcaattattattcatgaagtttacgaagaaggggccgcctgtaaagatggacgtctctgggctggagatcagatcctggaagtgaacggcatcgacctgcggaaggccacccatgatgaggctataaacgtgctgagacagacaccgcagcgagtgagactgacactctaccgagatgaagcaccttacaaggaggaagaagtctgcgacacgctcacaattgaactacaaaagaagcctggtaaaggactgggactctcaatcgttggcaagagaaacgacaccggtgtcttcgtgtccgacatagtgaaaggcgggatagccgacgccgacggaagactgatgcagggtgatcagatacttatggttaacggagaagatgtgaggaacgcaacccaggaggccgtggccgccctgctgaagtgtagtctgggcacagtcacattagaagttggccgcatcaaagccggcccctttcatagcgaacgcagaccgtcgcagagcagccaggtatctgaaggcagtctgagcagctttacctttcctcttagtggttcctccacatcagagtccctggaatccagcagcaaaaagaatgccttagctagtgaaatacaggggctccgcactgtggagatgaagaaggggcccactgattcactagggatctccatagccggtggcgttggatctcctctgggcgacgtgcccatatttattgctatgatgcaccccacgggagtggccgctcagacccagaaacttcgggtaggagatagaattgtgacaatctgtggaacctcaacagagggaatgacccatacacaggccgtgaacctccttaagaatgcaagcggctctatcgagatgcaagttgtggcgggcggcgacgtgtcagtcgtgactgggcaccagcaggaaccagcgtcgagcagcctctccttcactggactgacgagctccagtatctttcaagatgatttagggcctccacagtgcaagtctatcacacttgagaggggccctgacggtctagggttctcaatcgtaggcggatatggttcacctcacggtgatcttccgatttacgtaaaaactgtgtttgcaaaaggcgcagccagtgaggatggacggttgaagcgcggtgatcagataattgccgtaaacgggcaatcgctcgagggtgttacacacgaagaggctgtggccattttaaagcgcacaaagggaactgtaacactgatggtcctgagctag

SEQ ID NO: 124992 - DNA, 6126 bp, Artificial Sequence
  Description of Artificial Sequence: Synthetic coding sequence
atgttggaggccatcgataagaacagagcactgcacgctgccgaacgccttcagacaaaactccgcgagaggggggacgtagccaacgaggataagctgagcctgctcaaatccgtgctgcagtcaccactcttttcccagatcctgagtctgcaaaccagcgtacagcagctcaaagaccaggtgaatattgccaccagcgcaacctcgaatattgaatacgcacacgtcccccacctcagccccgctgtaattcctaccctccaaaacgagagcttcctgctgagtccgaacaatgggaatttagaggcattgactggtcccggtattccccacatcaatggcaagcctgcgtgcgacgagttcgatcagcttatcaagaatatggcacagggcagacacgtggaagttttcgagctcctgaagcctccgagcggaggactgggcttcagtgtggttggactccgctcagaaaacaggggtgaattaggcatctttgtgcaagaaatccaagaggggtctgttgcacatcgcgacggtagattaaaagagactgaccagattctcgctattaacggccaagctctggatcaaacaatcactcatcagcaggctatttcaattcttcagaaagcaaaagatacagtgcagctggtaattgctcgaggctctctgccgcagttagtctcccccatcgtttcacgcagtcctagcgccgccagcaccataagtgcccactccaatcccgtccactggcaacatatggagactattgagcttgtgaatgatgggagcggactgggtttcggcatcatcggggggaaggccaccggggtgatcgtgaaaactatcctccccggcggagtggccgatcaacacggcaggctatgcagtggcgatcacatccttaagatcggcgacaccgacctggccggaatgagttctgaacaagtcgctcaggttctgagacaatgcgggaaccgtgtgaagctgatgatcgcacgaggagccatagaggagcgaactgcccccaccgcgttgggcatcactttgtcaagctctccgacttctacacccgagctgcgagtcgatgcttctactcagaagggcgaggaaagtgagacttttgatgtggaattaacgaagaatgtccagggattgggaatcaccatcgctgggtacatcggggataaaaagctagagcccagcggcatctttgtgaagagtattaccaagagttccgcagtcgaacacgacggtaggatccaaataggggaccagatcattgctgtcgatggaacaaatctccaggggttcaccaaccaacaggccgtggaggtgctgaggcatacaggccagaccgttcttctgacgctcatgcggagaggcatgaagcaagaggccgagctgatgtctagggaagacgtaaccaaggacgccgatctgagcccagttaatgctagcatcatcaaggagaattatgagaaagatgaagacttcctgagctctacaaggaacacaaatatcctcccaactgaggaggagggataccccctgttatctgcagagatcgaagaaatcgaggacgctcagaaacaggaagcagctctgctgacaaaatggcagcgcattatgggcattaattatgagatcgttgttgcacacgttagcaaattttccgagaactcaggtctcggcatctcgctagaagctactgtcggacatcacttcatcagatccgttttgccagaaggtcccgttggccactccggaaaattgttctctggggacgagctactggaagtgaacggtatcactctattgggagaaaaccatcaggacgtcgtgaacatcctgaaagaactccccatcgaggtgacaatggtgtgttgtagacggacagtcccccctacgacgcagagcgagctggattccctcgatctctgtgacatcgaactgactgagaagccccatgtcgatctgggggaattcattggaagcagtgagacagaggatccagtgcttgccatgactgacgccggtcagagtacagaagaggtgcaagccccccttgcaatgtgggaagccggtattcagcacattgaactggaaaaaggctcgaaggggttgggatttagtattctggactatcaggacccaatcgatccagcttccactgtaatcattatccggagtctcgtgcccggaggcatcgctgaaaaggatggacgcctgctacctggcgatcgcctcatgttcgtgaatgacgtgaatctggagaacagcagtctggaggaggcggtggaggcactgaaaggcgcaccctctggtacagtgagaataggtgttgctaagcccctgcccctctcacctgaagaggggtatgtgtccgctaaggaagacagttttctttatccccctcactcttgcgaagaggccgggctagcagataagccgctgttcagagctgatctggcactcgtcggcaccaacgatgcggatctcgtcgatgagagcacctttgagtctccttatagtcccgagaatgatagcatctattctactcaggccagcatcttgtccctgcacgggtcgtcatgtggagatggcttgaactacgggagcagcctgccatcttcccctcctaaggatgtgattgagaactcttgtgaccccgtgctggatttgcatatgtcactcgaagaactgtacacccagaacctgctgcagaggcaggacgagaatacaccaagcgtcgacatttcgatgggtcctgcttccggctttaccatcaacgattacacccctgctaatgccatcgaacaacagtatgagtgtgagaatacaatcgtttggactgaaagtcacctcccatccgaggtgatcagctccgcagagctgccctccgtcctaccggattcagcggggaaaggaagtgaataccttctagaacagagttccctcgcctgtaatgccgaatgcgtgatgctacagaacgtgagcaaggagtcctttgagcggactatcaatatcgccaaggggaacagctccctcggcatgactgtgtccgccaacaaagacggcctgggtatgattgtgaggagtatcatccatggcggagccatctctagggatggcaggattgccatcggagactgtattctatccatcaacgaggagagtaccatctccgtcaccaatgcacaggcaagggctatgctgcggagacactccctcattgggcccgacattaagataacatacgtgcctgccgagcacctagaggagtttaagatctccctcggccagcagagtggccgggtgatggcgttagacattttctcctcctacactggacgtgacatcccagagctgccggagcgcgaggagggcgagggggaagagtctgagctgcaaaacactgcctatagcaattggaaccagccaagaagggtggaactatggagagagccatccaagtccttgggaatttccatcgtcggtggacgagggatgggaagcagattgtccaacggtgaagtaatgagaggcatcttcattaagcacgtgctagaggattcacctgctgggaagaatggaaccttgaaaccaggtgatagaattgtggaagtcgatggcatggatctccgagatgcaagtcatgaacaggcagtcgaagccatcagaaaagcaggaaatccagtagtgttcatggtccagtctatcataaaccgccctcgaaaaagccctttacccagcctgctccacaatctgtaccctaaatataattttagctccaccaatcccttcgccgactctcttcaaattaatgccgacaaggcaccttctcagtcagaatctgagcccgaaaaagcccctctctgtagcgtgccccctcctcctccctccgcctttgccgaaatgggatccgaccacacccagtcttctgcttctaagatttctcaggacgtggacaaggaagatgagttcggctactcttggaagaacatccgagaacgatatggcactctaactggggagctacacatgatcgagctagaaaaaggccattcggggttaggcctctccttagcagggaacaaagatcgcagtagaatgagcgtgtttatcgtgggaatcgacccaaacggggccgccggcaaggacgggcgattgcagatagcagacgaactcttggaaataaacggacagatcctatacggtagaagccaccaaaatgcctcaagcatcatcaagtgtgctccatctaaggtaaaaattattttcataagaaataaggacgccgtaaaccagatggctgtgtgccccggaaatgctgtagaacccctcccaagcaatagcgaaaacctccagaacaaggaaacagagcctacggtgacaacctcagatgcagcggtggatctgtctagctttaagaacgtgcagcatctggagctgcctaaagatcaaggcggattagggatagcgatctcggaagaagacaccctctcaggcgtgattattaagagtctgactgagcatggggttgccgcaacagacggccgccttaaagtgggagaccagatcctggctgtggatgacgaaatcgtggtgggctacccgatcgaaaagttcatcagtttgctgaagaccgcgaaaatgaccgtgaaactcaccattcacgctgaaaatccggattctcaggcggtcccctccgcggctggtgcagctagtggagagaagaagaactccagtcagtcgttgatggttccccagtctggcagtcctgagccagaatccatcagaaacacatcacgttcaagtaccccagccattttcgcaagcgaccccgccacctgtccaatcatccccgggtgcgaaacaaccattgagattagtaaaggtcggaccggacttggcctctcgatagtgggaggatctgacacgctgctgggcgccatcatcatccacgaagtctatgaggaaggggctgcgtgcaaggacggccgcctctgggctggcgaccaaattttagaggtcaatggaattgacctgcgcaaagctacccatgatgaagctatcaacgtcctgcggcaaacgccccagagagtccgcctaacactttaccgggacgaagctccctacaaagaggaggaggtgtgtgacacgctcacaatcgaactccaaaaaaagcctggcaagggtcttggactttcaatcgttggtaagcgcaacgacaccggtgttttcgttagtgacatcgtcaaagggggcatcgcagatgccgacggtaggctgatgcagggcgatcagatcttgatggtcaacggcgaagatgtgaggaatgccactcaggaggccgtcgccgccttgcttaaagtttctgaagggtccctttcttcgtttacgttccccctgtcgggctcgtctactagcgagtctctcgaatcctctagcaagaaaaacgctctggctagcgagatccaagggctgcgcacagtggagatgaagaaaggtcccaccgactccctgggtatctcgatcgctgggggggtcggcagtcccctcggtgatgttcccatcttcatcgcaatgatgcatccgacgggagtagctgctcagacacaaaagctgagagtcggcgataggatcgttactatatgcggcacctctacagagggtatgactcatactcaagccgttaaccttctgaagaatgctagcggatcaattgaaatgcaggtcgtggcaggcggggatgtatcagtcgtgaccggccaccagcaagagcccgctagcagctccctatcttttactgggctgacaagcagctccatcttccaggatgatctgggccccccacaatgtaagtcaataacactggagagaggtcctgacgggctgggcttttccatcgttggcggatatggcagtccacacggtgacctgcccatatatgtgaagacagtgttcgctaagggagccgcctccgaggatgggcgactgaaacggggcgatcagatcatcgccgtgaacggtcagtccttggagggtgttactcacgaggaggctgtggctatcctcaagcgcaccaaaggtaccgtcactctcatggtgctctcctag

SEQ ID NO: 124993 - DNA, 5853 bp, Artificial Sequence
  Description of Artificial Sequence: Synthetic coding sequence
atgctggaagcgattgacaaaaatcgggcgctccacgctgccgagagactgcagacaaaattgagagagagaggtgatgtggcaaacgaagacaagctctccttactaaaatccgtgcttcagtcaccgcttttttcccagattctcagtttgcaaacatcagttcagcagttgaaggatcaagtgaatatcgccacctccgccacatctaacattgagtacgcccatgttccccacctctcccctgccgtcatccctacattacagaatgagagtttcctgttgtcccccaataacggcaacctcgaagctctgactggcccagggatccctcacatcaatggaaagcccgcttgcgacgaattcgaccagctgattaaaaacatggcacagggcaggcacgtagaggtgttcgagttgttgaagcctccatctggcggcctcggcttctccgtggtgggcttgagaagtgagaatagaggcgagctcggcatcttcgtgcaagagatccaggaaggctcagtcgcgcaccgggacggacgtctcaaggagacggaccagatcctggcaattaatggacaggcccttgatcagaccatcactcatcaacaggccatttctattctacagaaggctaaggatactgtgcagctagttattgcccgcggcagtctgcctcagcttgtatctcccattgtttcccgctctccaagcgctgcttcaacaatatccgcgcactctaatcccgtacattggcagcacatggagacaatcgagttggtcaacgacggatcgggattgggctttggaatcattgggggaaaagccactggcgtgatcgtgaagactatcctgcccggaggcgtagctgatcagcacggtagactgtgcagtggcgatcacatcttaaagattggcgacactgatctagccggaatgtcttctgagcaggtggcacaagttctgaggcagtgtgggaatcgggtgaagctcatgattgcgcgaggagccatagaagaacggacagctcccacagcactcggaatcacattatcttcctcccccacttctacacccgagctgagagtggacgcatctacacaaaaaggagaagagtccgagacattcgatgttgagctcaccaagaatgtccaaggcctcggaattactatcgccggatacatcggtgataagaaattagagcccagtggaatcttcgtaaagtcgatcacaaagtcaagcgctgtagaacacgatgggcgaatacagattggagatcagatcatagctgtggatgggacaaatttacagggcttcacaaatcagcaggccgtagaggtactcagacacactgggcagaccgtgctgctgactcttatgagacgggggatgaaacaggaagccgagctgatgagtcgggaggatgttacgaaggacgctgacctgtctcccgtaaatgccagtataatcaaggaaaactatgagaaagatgaggattttctgtcctcgacacgaaatactaacatcctccccacagaggaggaagggtacccactgctgtctgcagagattgaggaaattgaagacgctcaaaagcaggaagcagccctcctgactaaatggcagcgtatcatgggcattaactatgaaatcgtggttgctcacgtgagtaaattcagcgagaactccggccttggaatctctttagaagccaccgttggtcaccacttcattcggagtgttctgcctgaaggacccgttggccactccgggaagctgtttagcggtgatgagctcctagaggtgaacggtatcaccttgctgggcgagaatcaccaggatgtcgtgaatatccttaaagagctcccgatcgaagtcacaatggtgtgttgtagacggacggttccccccacgacccagagtgaactggattctctcggcatccagcacatcgaattagaaaaagggagcaagggcctcggcttttccatactcgattatcaagaccctattgacccagctagtaccgtgattatcatccggagcctggttcctggtggcatagccgagaaagacggaaggttactccccggcgaccggctgatgtttgtgaacgacgtcaatctcgagaactccagtctggaggaggccgtcgaggccctgaagggcgcaccctcggggaccgttcggatcggcgttgctaagccgctgccactcagccccgaggagggctatgtctcagcaaaggaagactcgttcttgtacccgccacactcatgtgaggaggcgggcctagcggataaacctctattcagggccgacctagctctcgtgggaactaatgacgccgaccttgtggatgagtcgactttcgaaagcccatattctcccgaaaacgatagcatctactctacacaggcttccatcctgagcctacacggctcatcttgcggggatggcctcaactacggcagcagtctgccctctagccctcctaaagatgttatcgagaatagctgcgaccccgtgttggaccttcacatgagtctagaagaactgtacacgcagaatttgctgcagagacaggacgaaaataccccttccgtggacatttccatgggccctgcctctggatttacaatcaatgactacacacccgccaacgctattgaacagcaatatgaatgtgagaacacgattgtctggacagagagccacttgccttccgaggttatctcttctgctgagctccccagtgttctgccagattccgccggtaagggatccgaatacctgctcgaacagagttctcttgcttgcaacgctgagtgcgtcatgcttcaaaacgtgtctaaagagtccttcgagcgcacaatcaatattgccaagggtaactctagccttggcatgacagtgtccgcaaacaaagacgggctcggaatgatcgtgcgcagtataattcacggtggggccatatcaagagatggtagaattgccatcggcgactgcattctatccattaatgaagagagcacaatctccgtgactaatgcacaggccagagcgatgctgcgccgccacagcttaattggacccgacatcaagattacctacgtacccgccgagcacctggaggaattcaagatctccctcggccagcagtcagggcgggtgatggccttggacatcttttcttcatacaccggaagagacatacccgagcttccggagcgcgaggagggggaaggggaggaatcggaactgcaaaatacagcatacagcaactggaaccaaccacggcgcgtcgagctttggcgagaaccctctaagtcacttggtatatcaatcgtgggtgggcgcgggatggggtcacgcctgagtaacggtgaagtgatgcgtggaattttcattaagcacgtgctggaggatagccctgctgggaaaaatggcacgctcaagccaggtgaccgcatcgtggaagctccttcgcagagcgagtccgagcccgaaaaagctcccctctgtagcgtgccgccccccccgccttccgccttcgccgagatggggagcgaccatacgcagagctccgcatccaagatctcccaggacgttgacaaagaggacgaatttggttatagctggaagaacattcgcgagagatacgggaccctgacaggggagctccatatgattgaattagagaaagggcacagtgggctcggcctgtctcttgccggaaacaaggaccgttcacggatgtccgtgttcattgttggcattgaccctaatggggctgcaggaaaagatggccgccttcagattgcggatgagctgctcgagattaacggacagatcttatacggcagatctcaccagaatgcctcttctatcataaagtgcgcccctagtaaagtcaaaatcattttcattagaaacaaggatgcggtcaaccagatggccgtgtgtccagggaacgccgtagaaccgctgccctccaatagtgaaaacctgcagaacaaagagaccgaacctacagtcacgacctcagacgccgccgtggacctctcctcctttaaaaacgtgcagcacttggagctacccaaagaccagggaggcctgggaattgcaatctcagaagaggatacgttgtcgggagtgatcataaaaagcctaacagaacatggagttgccgctaccgatgggaggttgaaggtcggtgaccagatccttgcggtcgatgatgagatcgtggtgggataccccattgagaaatttatctctctcttgaagacggccaagatgaccgtgaaacttaccatccatgctgagaatcctgatagccaggcggtgccatccgccgcaggagctgcatctggtgaaaagaagaactctagccagtctcttatggtgccacagtctggcagcccggagccggagagtattcggaatacgtcccggagctccacccccgctatattcgcttccgaccccgccacctgccctatcatcccgggttgtgagaccaccattgaaatcagtaaaggaagaaccgggctaggactgagcatcgtcggaggctctgatactctgctgggtgcaattatcattcacgaggtgtacgaggagggggccgcttgcaaagacggaagactgtgggccggtgatcagattctggaggtgaatgggatagatttacggaaggcaacacacgatgaggctatcaatgtgcttcgtcagacccctcagcgcgtgaggctcaccttgtacagagacgaggctccatataaggaagaggaagtgtgcgataccctcacaattgaattgcagaaaaaaccaggaaagggactgggcctgagtattgtgggcaagcgcaacgacacaggcgtctttgtctcggatatcgtcaagggcggcattgcggacgcagacggaaggcttatgcagggagaccagattctgatggtgaacggcgaagacgtgagaaatgcaacccaggaggctgtggcggctctcttaaaatgcagtctggggactgttacactagaggtcgggagaatcaaagccggcccattccactctgagcgcagaccatctcaatcatcacaggtcagtgagggcagcttatccagttttacattcccactgtcgggttcctccaccagcgagagcctggaaagcagctccaaaaaaaatgcgcttgcttcagagatccaaggactccgtactgtggagatgaaaaagggccctacagactctctcggcattagtatcgcagggggggtcggtagtcccttaggtgacgttcccatcttcatcgctatgatgcacccgacaggcgtcgctgctcagacgcagaaacttagggttggtgaccgtatcgttaccatttgcggcacctctaccgaggggatgacacatactcaggccgtgaatctgttgaagaatgcttccgggtctattgagatgcaggtcgtcgccgggggagatgtatctgtcgtgacgggccaccagcaagagcctgccagctctagcctaagttttacagggctgacaagttctagcatattccaggacgatctggggcctccacagtgtaagtccattaccctggaacgcggaccagacggtctcggattctcgattgtcggaggctacggatcacctcacggggatctcccaatttatgttaaaacggtgttcgccaagggtgccgcttcagaggatggacggctgaaaagaggggatcagatcatcgcagtgaacggccagagcctggagggggtgacacacgaagaagcagtggccattctgaagcggaccaagggtacagtcacactgatggtgcttagctag

SEQ ID NO: 124994 - DNA, 915 bp, Artificial Sequence
  Description of Artificial Sequence: Synthetic coding sequence
atgcaaggcgaccaaattttgatggtcaatggagaggatgtcagaaacgccacacaggaagccgtggccgccctcctcaagtgcagtctgggaacggtaactttggaggtcgggcgaataaaggccggccccttccactccgagcgccggcctagtcaaagctcacaggtgtctgaaggctccctctcttcgtttacatttccccttagtggatcttctacttctgagtcgctggagtcctcctccaaaaagaacgcacttgccagtgaaatacagggcttacggaccgtggagatgaagaaagggcccacggacagtctggggataagcattgctggtggagttggctcccctctgggggacgtaccaatatttattgccatgatgcatcccaccggggttgccgcacagacccaaaagctgagagtaggcgacagaatcgtaactatatgcgggacttccactgaggggatgacccacacccaagccgtgaacttactcaagaatgcaagcggatcaatcgaaatgcaggtggtggctggaggcgacgtgtcagttgtcaccggtcatcagcaggagcctgccagttcgtctctatcatttacaggcctgacctcgagctccatattccaggatgacctcgggcctcctcagtgcaaatccattaccttggaacgtggccccgacggactcggattcagcatcgtcggtggctacggctcacctcacggggatctacctatctacgttaagactgtgttcgcgaagggtgctgcttccgaggacggccggctaaagagaggagatcagattatagccgtgaatgggcagagcctggagggtgtcactcacgaggaagccgtggctatactgaaacgtactaagggtacagtaacattgatggttctatcatag

SEQ ID NO: 124995 - DNA, 6126 bp, Artificial Sequence
  Description of Artificial Sequence: Synthetic coding sequence
atgcttgaggcgatcgataaaaacagagctcttcacgccgccgagagattgcagacgaagctgcgcgagcgtggagacgtcgcaaatgaagataagctctctctcctcaaatctgtcctccagagtccactgttctcccagatcctgtccctgcaaacgtcagtgcagcagctgaaagaccaagtgaacattgctacttcagccaccagcaacatcgaatatgcccacgtgccccacttgagcccagccgttattccaactttacaaaacgagagcttcctgctgtcccctaataatggaaacttggaagccctgacaggccccgggattccgcatattaacggaaagcccgcgtgtgacgagttcgaccagctgatcaagaacatggcacaaggccggcacgttgaggtcttcgagctgttaaagcccccatccggaggccttgggttcagtgtagtaggacttcgaagtgagaacagaggggagctcgggatctttgttcaggagattcaggaaggctctgtagcacaccgagacggaaggctgaaggaaaccgatcagattctagcaatcaatggacaggctctggatcagactattacacaccagcaggctatctcaattctccagaaagcgaaggataccgtccagcttgtgatcgctcggggcagcctgccgcaactcgtgtctcccatcgtcagtaggtcaccatcggccgctagcaccatttccgcccatagtaacccggtacactggcagcacatggaaacaatcgaactggtgaacgacgggtctggcctcggatttggaataataggtgggaaagccacgggcgttatcgtcaagaccatcttgcctggaggggttgcagaccagcacggtagactgtgttcgggggaccacatcctgaaaataggagacaccgacctggcagggatgagttccgagcaagttgcacaggttcttcggcagtgtgggaaccgcgtgaagttgatgatagctcgaggcgcaatcgaggagcggaccgctccaacagctctaggcataaccttgagctcatcccctaccagtacgcctgaacttcgagtggatgcctcaacgcaaaagggagaagagagcgagacgtttgatgtagagctcaccaagaatgttcagggcctcggcattaccatagcagggtacatcggcgataagaaacttgaaccatcaggcatttttgttaaatcgatcactaaatcatccgcagtcgaacacgatggcaggatccagataggcgatcagatcatcgccgtggatggcaccaacctccaaggcttcacaaatcagcaagccgtagaggtgttgcgccataccggacagaccgtccttcttactctgatgcgaagaggtatgaagcaagaggcggagctgatgtcccgggaggacgtaaccaaagacgctgacctaagtcctgtcaacgctagcattatcaaagagaattatgaaaaggacgaagatttcttatcctctacaagaaatactaatattctgccaacggaggaagaagggtatcccctgctcagcgcagagatcgaagagattgaagacgctcagaagcaggaggctgccctactcaccaagtggcagcgtattatgggtataaattatgagatcgttgtggcacacgtgagtaagtttagtgaaaactccggcttaggaatctctctggaagctacggtgggacatcattttattagaagtgttttacccgaagggcctgtgggtcacagcggaaagcttttctcaggggacgagctcttagaggtgaacgggatcaccctgctgggggagaaccaccaggatgttgtgaacattctgaaagagctgcccatcgaagtgacaatggtgtgttgccggaggactgtgccacctactacgcaatccgagctggatagcctggatttatgcgacattgagctcaccgagaaaccccacgtggacctcggggaatttatcggttcctccgaaaccgaagaccctgtgctggctatgacagacgcaggtcagagcacagaggaagtgcaggcccccctggccatgtgggaagccggtattcagcatattgagctagaaaaaggttccaagggtctgggcttttccattttagactaccaggatcctattgacccagcatcaacggtcatcatcatcaggagtctagtgcccggcggaatcgctgagaaggacggtcgccttttaccgggtgataggctgatgttcgttaacgacgtgaacctggagaattcctcactcgaagaggccgtcgaagctctaaaaggcgctccatctggcacagtgagaatcggagtcgcgaagccacttccattatcacccgaggagggctatgtctcagccaaggaggactccttcctgtaccctccccattcatgtgaggaagcaggactggcagacaagcctctgttccgtgctgatctagctttggtgggaacaaacgatgcagaccttgtcgacgaaagcacctttgaatccccatattccccagagaatgattcgatttacagcacccaggcctcgattctgagtctgcatggatctagttgcggcgatgggctgaattatggttcaagtctgccatcatctcctcccaaagatgtcattgagaactcatgcgaccccgtgctagacttgcacatgagcctggaagagctttatacccaaaatctgctgcagaggcaggacgagaacacacccagcgtggacattagcatgggaccagcatccgggtttactattaatgactacacaccagcaaatgccatcgaacaacagtatgagtgcgaaaatacaatcgtgtggaccgagagccacctaccttcagaggtgatctccagcgctgagctcccatctgttctccccgattccgctggtaaaggttctgagtacctccttgaacagtcaagcttagcctgtaacgctgagtgcgtcatgctccagaacgtgagcaaggagtccttcgagagaaccataaatattgccaagggtaactcctcactgggcatgacggtttctgccaataaagatggtctgggtatgatcgtcagaagcatcatccacggcggagctatctcccgagacggtcgtattgctatcggggattgcatcctctcgatcaatgaggagagcacaatcagcgtgactaacgcccaggcccgcgccatgctgaggcggcacagtcttataggaccagatatcaaaattacttacgtgccggcagagcatcttgaagagttcaagatctcacttgggcagcagagcggccgagtcatggcactcgatatcttttcttcatacaccgggagagatattccggaactccctgagagagaggaaggtgagggcgaagaatccgaactgcaaaacacagcatattccaattggaaccagccacgccgggtggaactgtggagggagccgagtaaatcccttggcatatctatagtaggagggaggggaatgggtagccgtctgagtaacggcgaagtgatgaggggcatttttataaagcatgtgctggaggattctcctgcagggaaaaatggtaccctgaagcccggcgacagaatagtcgaagtggatggaatggacctgagagacgcatcccatgagcaggccgtggaggctatccgcaaagctggcaaccccgtggtcttcatggttcagtccattatcaatcgacccagaaaatctccactcccgtctcttctccataacctttacccaaagtataatttttcatccacaaatccttttgcggactccctgcaaatcaacgccgacaaggcaccaagtcagtcagaatcagagccagaaaaggcgcccctctgctctgtcccgcctccacctccatcagcatttgctgaaatgggatcagaccatacccagagcagcgcatctaaaatttcgcaagacgtggataaggaggatgagttcggttattcttggaaaaacatcagagaaagatacggcaccctgaccggcgaactgcacatgatagagctcgaaaagggacatagcggacttggcctcagtcttgctggcaataaggaccgttctagaatgtccgtgttcattgtgggaattgatccgaacggagccgcaggcaaggatgggcggctccagatagctgatgaactcctagagattaatggacagatcctttacggtcgaagccaccagaacgctagttccataattaagtgcgctccctctaaagtcaagatcatttttatacggaacaaggatgctgtgaatcagatggctgtgtgtccggggaacgcagttgagccactgccttccaacagcgagaacctccaaaacaaggagaccgagccaaccgtcacaacgtcggatgccgccgttgatctgagctcttttaagaatgtccagcacctggaattaccaaaagatcagggcggacttggtattgctatcagcgaagaagacaccctctccggggtgatcataaaatctttgaccgagcatggcgttgcagctacagacgggcgcttgaaggtaggggatcagatccttgccgttgacgatgagattgtcgtgggctacccaatcgaaaagtttatcagtttactcaagactgcaaagatgacagtgaaactgactatccatgccgagaacccggatagtcaggcggttccatccgcggcaggagccgcttcaggggagaagaagaactccagccagagcttaatggttcctcaaagtgggtctccagagcctgagtcgattcgcaatacctctcggagcagcacacccgcaatcttcgccagtgatccggccacatgccccatcatccccgggtgcgagacaaccatagaaataagcaaagggcggaccggactgggcctctcaattgttggcgggagtgatacattactgggcgctatcattattcacgaggtgtacgaagagggtgctgcgtgtaaagacgggcgtctttgggccggtgaccagatcttagaggtgaatggcatcgacctccggaaggcaacccacgacgaggctataaacgtgctgagacagaccccccagcgtgttcggttaacactgtaccgcgacgaggcgccatacaaggaggaagaagtctgcgatactttgacgatcgagctccagaagaagcccgggaaaggcctgggcttgtctatcgtaggtaagagaaacgataccggcgttttcgtgtcggacattgtcaagggcggaatcgcagatgcagatgggcggctgatgcagggcgaccagatccttatggtgaatggagaggacgttcggaatgcaacccaagaggccgtggctgcacttttaaaagtctccgaggggtcactcagttcctttacctttcccctgagcgggtcttccacctcagaatctctggaatctagcagcaagaagaatgccctggcttccgagatccagggcctccggacggtggagatgaagaagggaccgaccgactccctgggaatcagcattgcaggaggcgttggatctccactcggagatgttcccatctttattgcaatgatgcaccccactggggttgcagcacagacccagaaactcagagtaggcgaccggatcgtaacaatttgcggtacaagcactgaaggaatgacccatactcaggctgtgaacctgctgaagaacgcgtcggggtccatcgaaatgcaagtcgtggccggcggtgatgtgagcgtggtgacagggcatcaacaggagccagcaagctcttctctctctttcaccggcctgacgtcctcctctatcttccaggacgatctggggcccccccagtgcaaatcaattaccctggagagagggcccgatggcctaggcttctctatcgtgggcggctacggcagtccccatggcgatctacccatctatgtaaagaccgtttttgctaagggagccgcctcagaggatggccggttgaaaagaggagaccagatcattgcggtcaatgggcagtcccttgagggggttacccacgaagaggcagtggctattctgaagagaacgaaagggacagtgaccttaatggttcttagctag

SEQ ID NO: 124996 - DNA, 6114 bp, Artificial Sequence
  Description of Artificial Sequence: Synthetic coding sequence
atgctcgaggccatcgataaaaatagagccttgcatgctgccgaacggctgcaaaccaagttacgcgaaagaggagacgtggctaacgaagacaagctgagcctgctgaaatccgtgctgcagagccctctattcagccagattctgtccctccagacgagtgtgcagcagctgaaggatcaggtcaacattgccacaagtgctacgagtaacatcgagtatgcacacgtgcctcacctgagcccagccgtcattccaaccctgcagaatgaatccttcctgctgagtcctaacaacggtaacttggaggctctcacggggcccggcatcccacatatcaacggcaaacccgcgtgtgatgagtttgatcagctgattaaaaacatggcacaaggacggcacgtggaagtgtttgaattgcttaaacctccctccggcggtcttggtttcagcgtagtgggtctgagatctgagaaccgtggggagctcggaatctttgttcaggaaatccaggaggggtccgtggcacatagggacggacggttgaaagaaaccgaccaaatcttggccatcaatggccaagcattggaccagactatcactcatcagcaggcaatttcaattttacagaaggcaaaagatacagtacagctggtcatcgcaaggggatcactcccccagcttgtctcaccgatcgtgagcaggagcccatctgcggcttcgacaataagcgcccacagcaaccctgtgcattggcaacacatggagacaatcgaactggtgaacgatggaagtgggctgggatttggcattatcggggggaaagcaaccggcgtcatagttaaaaccatacttcctgggggggtggccgaccagcatggccgcctgtgttccggggatcacattctcaaaattggggacacagacttagcaggcatgagctcggagcaggtagctcaggtgctccggcagtgtggcaatagagtgaaactgatgatagcccgtggtgcgatcgaggagcggacagcgcctacggccctggggataacactgtcttcatcaccaacctctacacccgaattacgtgtcgacgcttccactcagaaaggcgaagagagcgagacttttgatgtagaattgaccaagaatgtgcaaggcttgggcatcaccatcgctggatacatcggggacaagaaactcgaaccctctgggattttcgtaaagtctataaccaagagctctgcagtggagcacgatgggagaattcagatcggcgaccagattatcgcagtcgacgggacaaacctacagggcttcacaaatcagcaggcagtcgaagtgctacggcacaccggccagacagtactactaacattaatgcggcggggaatgaagcaggaggccgagcttatgagcagagaagacgtgactaaggacgcagatctctcaccagtgaacgcatccataattaaggagaactacgagaaggacgaagacttcctaagctccacacggaatacaaatatccttccgaccgaggaggaggggtaccccttactgagtgcagaaattgaggaaattgaggacgcccagaaacaggaagcagctttgcttactaagtggcagaggattatggggattaattacgaaattgtcgtcgcccacgtctcaaaattcagcgagaattccggcctgggcatatcccttgaggcaacagtcggacaccatttcatcaggagcgtcctaccagagggaccagttgggcattcaggcaaattattcagcggcgacgagttgcttgaagtcaatggtatcacactgctgggtgagaatcatcaggatgtcgtcaacatcctgaaggaactgcccatcgaggtgaccatggtctgctgtagacgcactgtacccccaacaacccagtccgaacttgacagtttggacctttgtgatatagagttaacagaaaaaccccacgtggacctcggagagtttatcggaagcagcgagaccgaggacccagttctggctatgacagacgcagggcaaagcacagaggaggtccaggctccattagccatgtgggaggctggcatccagcacatagagcttgaaaagggatccaagggcctgggcttttccatactcgattatcaggacccaattgacccggcctcaactgtgatcatcattcgctctttggtgcccggtgggattgctgaaaaagacgggcgactgctgcccggtgatagactgatgtttgtgaacgacgttaatctggaaaattcgtctctcgaggaggcggtggaggccctcaagggtgcacctagtgggacagtccgaattggagtggccaagcctctgccccttagtcccgaggaggggtatgtgtcagccaaggaggacagcttcctttacccaccccatagctgcgaggaggctgggctggccgacaaacctctgttccgagcggacctcgccctggtggggactaacgacgccgatttggtggacgagtccactttcgagtcaccctactctcccgaaaacgactctatttactccacgcaggcgagcatcctcagcctgcacggatccagttgcggtgacggactgaactatggaagctcacttccctcttctcctccaaaagacgtaatcgaaaactcatgcgatcctgtcttggacctgcatatgtcattagaggaactgtatacacaaaacctattgcagaggcaggatgaaaacactccttccgttgatatttctatggggcctgcgagcgggtttaccataaacgactacacccccgctaacgctatcgaacagcagtatgagtgcgaaaacaccatcgtgtggaccgagtcacacctcccctccgaagtaattagcagcgccgagcttccttcagtgctgcccgatagcgccggaaagggcagcgaatacttgctggaacagtcctcactcgcctgtaatgctgagtgtgtaatgctgcaaaatgtgagcaaagagagtttcgagcggaccattaacatagcgaagggaaattcatcactgggaatgacagtctctgccaataaagacggactgggcatgattgtgaggagcatcattcacgggggggcaatctcacgggacggacgcatcgccatcggagactgcatactgtcaatcaacgaggaaagcaccatatctgtgacgaatgcgcaagccagagctatgttgcgacggcacagcctcataggacccgacatcaaaatcacatacgtgcctgctgagcatctggaagagtttaagatttctttaggtcagcaatcaggcagggttatggctctggacatcttctcttcttatactgggagagacatcccggagctacccgaacgagaagagggtgagggcgaggagagcgagctgcagaacacagcatacagtaattggaatcagccacgcagggtggagttgtggcgtgagccttcaaagtctctcggtatctctattgtgggcggaaggggcatgggcagccggttgtcaaatggggaggtgatgcgcggtatctttataaagcacgtgctggaggactcccctgcgggcaaaaacggcaccctgaaacctggggatcggatcgtagaagtggatggaatggacctgagggatgcttctcatgagcaggcagtagaggccattcggaaagctggcaacccagtagtgtttatggttcagagcattattaatagacccagggccccatcccagtccgagagcgagccagaaaaagcacctctctgctcggtaccccctcctcccccaagcgcttttgctgaaatgggtagtgaccacacccagtccagcgctagtaagattagccaggacgtcgataaagaagacgagttcggatattcttggaagaatatacgagaacgatacggtactctcactggcgagctgcacatgatcgagctggaaaaggggcacagtggtttagggctcagcttagcaggtaataaggaccgctctcgtatgagtgtgttcattgttgggatcgatcctaacggtgcggctggcaaggatggacggctgcagattgccgacgagttgctggaaatcaatgggcagatcttatacggccgaagtcaccaaaacgctagctctattataaagtgcgcgccatctaaagtgaaaataatcttcatccggaataaagatgccgtcaaccagatggcagtgtgtcccggtaatgcagtggaaccactgcccagtaactccgagaatctccagaataaggaaacagaaccaaccgtgactacatcagacgccgcagtggacttgagctcctttaaaaacgtgcagcatctggagttgcctaaggaccagggagggctgggcattgccatctctgaagaggatactctcagcggtgtgatcataaagtcactgacagaacacggggtggctgccaccgatggaagattgaaggtgggagaccagattctggcagtggatgatgagattgtggtcgggtaccctatagagaagtttatctccctcctgaaaacagcaaaaatgactgtcaagctcacaatccacgcggagaatcctgactcccaggcagtgcctagcgccgccggtgccgcctcaggggaaaagaaaaacagcagtcaatccctgatggttccacagtccggaagtccggaacccgagtctatcaggaatactagcagatcaagcacacctgcaatctttgcctctgaccccgccacctgcccaatcatacccggctgcgaaaccacaatcgagattagcaagggaaggaccggtctcggcctctccatagtggggggctccgacaccttactgggagcgattatcattcacgaggtctatgaagaaggagccgcatgcaaggacggacggctctgggccggcgaccaaatccttgaggtcaatggcatcgatctgaggaaagcgacgcacgatgaggctatcaacgtattaaggcagacaccgcagcgcgtccgcttaacactgtatagggacgaggccccctacaaggaggaggaggtatgcgacacactaaccattgagctgcagaaaaagcctggaaagggccttggactgtcgattgtggggaagaggaacgacaccggggtctttgtgtctgacatcgttaagggtggaatcgccgatgctgacggtagattgatgcaaggggatcaaatcctgatggtgaatggcgaggatgtcaggaatgccactcaggaggctgtggcggcgctcttgaagtgcagcctcggcaccgtgaccctggaggttggcaggatcaaagccggaccttttcattccgagaggaggccaagtcagtccagccaggtgtcagaggggtccctgtcctcattcaccttcccccttagtggatcttctacctccgaaagcctggagtcatcgagcaagaaaaacgccttggcctccgagatacaaggactgcggacggtagagatgaagaagggtcctacagactctctgggtatctcaatcgctggcggggttggctcccccctgggggacgtgccaatcttcatcgcaatgatgcatccaactggggtggctgcacagacacagaagctcagggttggtgaccggatcgttacaatctgcggaacttccactgagggaatgactcacacccaggccgtcaacctgctgaagaacgcctctggtagtattgaaatgcaagtggtagccggaggtgacgtcagtgtggtgaccggccaccaacaggaaccggcctctagctctctgagctttacaggactcacctcctctagtatctttcaagatgatcttgggccaccacagtgtaagtctattacactcgagcgcggccccgatggccttgggttcagcatcgtgggagggtatggatccccccacggtgacctcccaatatacgtcaagaccgtgtttgccaagggagcggcctctgaagatggtcgtcttaagcgcggcgaccagattatagcagtgaatggacagtctttggaaggtgtgacccacgaagaggccgtcgctatcttaaaacgcaccaagggtacagttaccctcatggtgctgagctag

SEQ ID NO: 124997 - DNA, 6027 bp, Artificial Sequence
  Description of Artificial Sequence: Synthetic coding sequence
atgcttgaggccatcgacaaaaaccgcgcactccacgctgccgaaagacttcagactaagttgcgcgagcggggcgacgtggccaatgaggacaagctgtctctgttaaaatctgtgctgcagtcccccctattttcacagatactgtcactccagacatctgttcagcagctcaaagaccaagttaacatcgccactagcgcgacatccaatattgagtacgcccatgtgcctcatcttagtccagcagtcatccctaccctgcaaaatgagagttttctcctgtcacccaataatggtaatttggaagcactaactggccctggaatcccccatattaacggcaaaccggcatgcgacgagtttgatcaactaatcaaaaacatggcccaagggagacacgtggaagttttcgagctgttaaaacctccctccggaggccttggattttcagtggtgggcctgcggagcgaaaacaggggagagctcgggattttcgtgcaggagatacaagagggcagtgtcgctcacagggatggacggctaaaggagactgatcagatccttgcaatcaacggtcaggccctggatcagacaataacacatcaacaagccatcagcatcctacagaaagccaaggatacggtacaacttgtcatcgccagaggcagcttaccccagctggtgtcccccatagtgagtagatcacccagtgccgctagcacaatcagcgcccattccaatcccgtacattggcaacatatggaaaccatagaactcgtaaacgacggctcggggttaggtttcggcataatagggggcaaggctacgggggtgattgtgaaaaccattctgccgggaggagtggccgaccagcacgggcgcctgtgctcgggggatcatatcctcaagatcggcgatacagatttggcaggcatgtcctccgagcaggttgcacaggtccttcgccagtgcggaaatcgagtgaaactgatgattgcccgaggcgccatcgaagagcggacggctcctactgccttaggtatcactctgtctagctccccaaccagtacacctgaacttcgtgtcgatgcctcgacacagaagggggaggagtccgagactttcgacgtggagcttacaaagaatgttcagggattgggaatcaccattgcaggctatataggcgacaagaagctcgaaccatccggtatcttcgttaagtcaattactaagagttccgctgtagagcacgacggccgtatccaaattggcgaccagatcatagctgtagatgggacaaatctgcaggggtttaccaatcagcaagccgtcgaagtattgaggcacaccggacaaaccgttctcctgaccctcatgcgacgaggcatgaagcaagaggcagaactgatgagcagggaagatgtcaccaaggatgccgatctcagtccagtgaatgcgtccataattaaagagaactacgagaaagacgaagactttttgagctcaacacgaaatacaaatattctccctaccgaggaagaaggctatcccctcctgagtgccgagattgaagaaattgaagacgctcagaagcaagaagcggccctgcttacgaaatggcagcgtatcatggggattaattatgaaattgttgtcgcccacgtcagtaaattctctgagaacagtggactgggaatctccctcgaagccacagttggccatcattttatcaggtccgtcttgcccgagggcccagtgggccattctggtaagctgttctctggagatgagctcctagaggtgaatgggatcaccctgctgggagagaaccatcaggatgtggtgaatatcctcaaggaattgccaatagaagtaacaatggtatgctgccgccgcacagttcctcccacgacccagtcggagctggatagcctcgatctgtgcgatatcgaattgacagagaaacctcatgttgatttgggcgagttcatcggtagcagcgagaccgaagatccagtcctggccatgacagacgcaggccagtcaacagaagaagtccaggcgccgctcgctatgtgggaggccggtatccaacacatcgagttggagaaggggtccaagggccttggcttcagtatcctggattatcaggaccctatcgaccctgcttccaccgtcatcatcattaggtccttggtacctggaggcatcgctgagaaagatggccggttactacctggtgatcggctcatgttcgtgaatgatgtcaatttggagaattcaagcctcgaagaggctgtggaggcactgaagggagctccatccggaacggttagaatcggagtggcaaaacctcttccactgtcacctgaagagggctatgtcagcgcgaaggaagactcatttctgtatcccccccatagttgcgaagaagcggggttagccgacaaacccctgttcagagctgacctggccttggtaggtaccaacgatgcagatcttgtggatgaaagcacctttgagagcccttacagcccggagaacgacagcatttattctacacaggctagtatactatccctccacggatcgtcatgtggcgatggattgaactacggttcaagcttgccatcttctcctccgaaggatgttatcgagaactcatgcgaccccgtgctggaccttcatatgtccttggaagagctttacacccagaatctcttgcagcggcaggacgagaacacaccatctgtggatatcagcatgggtccggccagtggtttcaccattaatgattacacacccgctaatgctatcgagcagcagtatgaatgcgaaaacactattgtatggacggagtcccatctcccctccgaggtgataagctctgcggaattgccaagtgtcctcccggactctgctggtaaaggctctgaatatctcctcgaacagagttccttggcatgcaacgccgaatgcgtgatgctccagaacgtgagcaaagagtcgtttgaaaggactatcaatatagctaagggaaattcttccttgggcatgaccgtaagcgccaacaaggacggactgggtatgattgtcagatccatcatacatggcggcgctatcagcagagatggacgcatcgctataggcgactgtatcctgagcattaacgaggaatccaccattagcgtaaccaatgcccaggccagggctatgctacgacgacactcgctcataggtcctgacataaagattacatacgtccccgccgaacacctcgaagaatttaaaatcagccttggccagcagtccggccgggtcatggcacttgacatattctcatcctacacaggaagagacatccctgagctgccagagagggaggagggggagggggaggagagcgaactccaaaacaccgcatacagtaactggaatcaaccaaggcgcgtggaactctggcgagagccctccaagagcctgggtatcagcatcgtgggtggaaggggtatggggagtcggctttcaaatggagaggttatgaggggcatcttcattaagcacgtgttggaggactccccagcaggcaaaaacggtactttaaagccgggagatcggattgtggaagtggacggcatggatctgcgagacgcctctcacgaacaggccgttgaggcaattcgtaaagccgggaatcctgtggtgtttatggtgcagtcaataattaacagacccagggccccatcccaaagtgagtcggagccagaaaaggcaccattgtgctccgttcctccccctcctcccagcgcattcgcagagatgggctctgatcacacccagtcctcagcttccaagattagccaagacgttgacaaggaggatgaattcgggtattcatggaaaaacatcagggaacggtacggcacactcacaggcgagttacacatgattgaactggaaaaaggccattccggtctcggcctctccctggccggcaacaaagacaggtctcggatgagcgtgttcatagtgggaattgaccccaacggagcggccggaaaagatgggcggctgcaaattgctgatgaacttttagagattaatgggcagatattgtacggtcgctcacatcagaacgcctctagcatcattaagtgtgcgccatctaaagtgaagatcatctttatacggaacaaagacgccgtcaaccagatggccgtctgccctgggaatgctgtggagcctctgccctctaactctgaaaaccttcaaaacaaggagaccgagcctaccgtcaccacgtccgatgctgccgttgatctgtcctcatttaaaaacgtccagcacctcgagctgcccaaggatcagggagggctggggatcgcaatctccgaggaagacactttgtcaggcgttatcatcaaaagtttgaccgaacacggtgttgccgctacggacggtagactgaaggttggagaccaaatcctcgccgtggatgacgagattgtggtcggttaccctatcgaaaagtttatcagcttacttaagaccgccaagatgaccgtgaaactgaccatacatgcagagaaccctgacagccaagctgtaccctcagccgccggggctgccagtggagagaaaaaaaactcctcgcagagcctgatggtcccacagagcgggtccccagaaccggaatctattcgaaacacctcaagatcctcaacccccgcaatattcgcttccgaccccgccacctgccccatcattcctggttgtgagacgactatagaaatcagtaaaggccgcaccggtctgggactgtcaatcgtgggtggctcagacaccctcctgggcgcaatcatcattcatgaagtgtatgaagagggcgcagcgtgcaaggatggccggttgtgggcgggagaccagatcttagaggtgaatggaatagatctgcgaaaagccacacacgacgaggccattaacgtgctgaggcagacacctcaaagagttaggctcacattgtacagagacgaggctccgtacaaggaggaagaagtatgcgacaccctcacaatcgagctccagaaaaaacctggaaagggcctggggctctctatcgttggcaagaggaacgacactggagtcttcgtgagtgatatcgttaaaggcggtatcgcggacgccgacgggcggctaatgcagggtgaccagatcctcatggtcaacggggaggatgtccgaaatgcaactcaagaggctgttgcagctttattgaaggtgtctgagggctcactgtcctccttcactttcccactgagtgggagttccacctccgaaagcctagagtcgtcctcaaaaaaaaatgctctcgcgtccgaaattcaggggttgcggaccgttgagatgaaaaagggaccgacggatagtctcggaatttcaatcgctggcggagtcgggagccctcttggagatgtgcccattttcatcgccatgatgcacccaaccggggtcgcggctcagacacaaaagcttcgcgtcggagataggatcgtcacaatctgtggaacaagtaccgagggcatgactcacacccaggccgtgaaccttctgaaaaacgccagcggctcgatcgaaatgcaggtcgttgctggcggcgatgtcagtgtggttactggtcatcagcaggaaccagcttcttcctcgctgtccttcactggcctgacctcatcctcaatctttcaggatgacctaggccctccccagtgcaagagtatcaccctggaaagaggaccagatgggttggggtttagcatagtgggaggctacgggtctcctcatggcgatctgcccatctacgtgaagacagtgttcgcgaagggcgcagccagcgaggacggacggctgaaacggggggatcagattatcgcggtgaatgggcagagcttagagggagttacacacgaggaggctgtagcaatactcaagcggactaagggtacagtgacgcttatggttctctcgtag

SEQ ID NO: 124998 - DNA, 1089 bp, Artificial Sequence
  Description of Artificial Sequence: Synthetic coding sequence
atggagacggacgccccccagcccggcctggctagtccagactcccctcacgacccctgcaagatgttcattggcgggctctcctggcagaccacacaggaggggctccgcgagtactttggccaatttggggaggttaaagaatgcttggtaatgagagaccctctcaccaagaggtctcgcgggtttggatttgtaacctttatggaccaggcgggagtggataaagtgctagcgcaatcccgtcatgagctggatagtaaaactatcgacccaaaagttgctttcccccgccgcgctcagccaaaaatggtaactcgaaccaagaagatttttgtaggaggactttcagtgaacacaacggtggaggacgttaagcaatattttgaacaattcgggaaagtggatgatgcaatgcttatgttcgacaagactacgaatcgccaccgcggcttcgggtttgtcacttttgagtctgaggacattgtggaaaaagtttgcgagattcatttccacgagattaacaacaagatggtggaatgtaagaaggctcagcccaaggaggtgatgtcgcctaccgggtctgcacgtggtcgaagtcgggtgatgccctatggcatggacgccttcatgttggggattggcatgctgggctaccccggattccaagctacgacatacgcctctaggagttatacggggttggcgcccgggtatacataccagtttcctgaattccgggtcgagcggacccctctgccatctgcacctgtgttaccggaattgacagcaatccccctgaccgcctacgggcccatggccgctgctgcagccgccgccgccgtggtgcgaggaacaggctctcacccctggacaatggccccccccccaggcagcaccccatcacggacagggggtttcttaggcacaacctctccaggccctatggcagagctgtatggagcagccaaccaagattcgggcgtgtccagttatatctccgcggcttcacctgcaccgtctaccggcttcggtcattctctcggcggcccacttattgccaccgcttttaccaacggctatcactag

SEQ ID NO: 124999 - DNA, 627 bp, Artificial Sequence
  Description of Artificial Sequence: Synthetic coding sequence
atggccacttccgcagttccatccgataacttgccaacatataagttagtggtggtcggtgacggcggggtgggaaaaagcgcactgaccatccagttcttccagaagatctttgtgccagactacgacccaaccattgaggatagctacctcaagcatactgagattgacaaccaatgggctatcctagatgtactggatacggctggacaggaggagtttagtgccatgcgcgagcagtacatgcgtacgggggatgggttcttaattgtgtattcagtgacggataaggccagtttcgaacatgtggaccggtttcaccagctgattttaagagtgaaggatagggagagcttcccaatgattcttgtcgctaataaagtagacctgatgcaccttcgtaaaatcacaagagagcaggggaaagaaatggctacaaagcacaacataccatacatcgaaacgagcgctaaggatccgcctctgaacgttgacaaggcttttcacgatttggtaagagtaattaggcagcagatccccgagaagtctcaaaaaaagaagaagaaaaccaagtggcggggcgatcgggcaacaggcactcacaagctgcagtgcgtcatactgtag

SEQ ID NO: 125000 - DNA, 627 bp, Artificial Sequence
  Description of Artificial Sequence: Synthetic coding sequence
atggctacaagtgccgtgccatccgataatctgcccacgtataaactcgtggtggtcggtgatggtggagttggaaaaagtgcgctgacaatccagttcttccagaaaatcttcgtacctgactatgaccctaccattgaggacagctatctcaaacacaccgagatcgataatcagtgggctatccttgatgtcctcgacaccgccggccaggaagagttctcagcgatgcgcgagcagtacatgaggaccggtgatggatttctaatcgtgtactcagtgaccgacaaggctagttttgagcatgttgaccggttccaccaattgattcttcgcgtcaaagatcgggagagttttccaatgatcctcgtggcaaacaaggtcgatctgatgcacctgcggaagataactagagaacagggaaaagaaatggcaacaaaacataatataccatatatagagacatccgctaaagacccgcctctgaacgttgataaggcattccatgatctcgtacgtgtgatcaggcagcaaattccggaaaagagtcagaagaaaaaaaagaagaccaaatggcgaggcgatagggcaacgggaactcataaacttcagtgcgtgatcctgtag

SEQ ID NO: 125001 - DNA, 399 bp, Artificial Sequence
  Description of Artificial Sequence: Synthetic coding sequence
atgcgggaacagtacatgagaacaggagatggattcttaattgtgtacagtgttactgacaaggcctcctttgagcatgtggaccgctttcaccagctgatcctgagagtgaaggatagagaatcttttcccatgatcctcgtagccaataaagtggatttaatgcacctgcggaagatcacaagagaacagggcaaagaaatggctacgaaacacaacataccatatattgagacatccgccaaagaccctcctcttaatgtggataaggccttccatgacctcgtcagggttattaggcaacagatacccgagaaaagccaaaaaaagaaaaagaagaccaagtggaggggggaccgcgccaccggtacccataaacttcaatgcgtgatcctgtag

SEQ ID NO: 125002 - DNA, 627 bp, Artificial Sequence
  Description of Artificial Sequence: Synthetic coding sequence
atggccacaagcgctgtaccttccgacaatcttccaacgtataagctcgttgtggtgggagacgggggggtcggaaagtctgcacttactatacaattctttcagaaaatcttcgtaccagattatgatcctacaatcgaagacagctacctgaaacatactgaaattgacaatcaatgggcaatcctggatgttctcgataccgctggacaggaggagttctcagccatgagggaacaatacatgagaaccggggacggttttctcatcgtgtattcagtcacggacaaagcctctttcgagcacgtggatcgttttcatcagctgatactaagagtgaaggatagggagtccttccctatgatcctcgtagccaataaagttgatctcatgcacctgcggaaaatcacgcgggaacagggaaaagagatggcaacaaaacacaatatcccgtatatcgaaacatccgccaaggacccccccttgaacgtggataaagcttttcatgacctcgttcgtgttatccgccaacagataccagagaaaagccagaaaaagaagaaaaagactaagtggagaggggacagagcaacaggcacgcataagttgcagtgtgtgatcctttag

SEQ ID NO: 125003 - DNA, 72 bp, Artificial Sequence
  Description of Artificial Sequence: Synthetic coding sequence
atggccacgtccgctgttcctagcgacaatcttccaacctacaaactcgttgtggtgggcgacgggggatag

SEQ ID NO: 125004 - DNA, 2628 bp, Artificial Sequence
  Description of Artificial Sequence: Synthetic coding sequence
atgagagagctagtgaacatccctttggtccatatcctgacactggttgcttttagtggtactgaaaagctgcctaaggcacctgttatcaccaccccactcgagacagttgatgcccttgtcgaagaggtagccacgtttatgtgtgccgtcgaaagctatccgcagcctgagatatcctggactcgcaacaaaatactgatcaaactttttgacacacggtactccattcgcgaaaatgggcaactgcttaccatcctaagtgttgaggacagcgacgatgggatttattgctgtacagctaacaacggagtcgggggagcggttgagagttgtggcgccctgcaggtcaaaatgaaacctaaaattacccggcctcccattaacgttaaaatcattgaagggcttaaggctgtgctgccttgcactacaatggggaaccccaagccgtccgtcagctggataaagggcgattccccattacgagaaaatagccgaattgcagtgctggaatcaggctccctccggatccacaatgtccagaaggaggacgcaggacaatatcggtgcgttgccaagaattctctgggcaccgcatacagcaaggttgtcaagctggaagtggaagtgttcgcgcggatcctccgagcgccagaaagccataacgtcacttttgggtcctttgtgacccttcattgtaccgcgactgggatacctgttccgaccatcacatggattgagaatggaaacgcggtttcatcaggatccatccaggagtccgttaaagatcgcgtcatagacagtaggttacaattgtttattaccaagcccggtctttatacttgtattgcgactaacaagcacggggaaaaattcagcacagctaaagctgcggcaaccatctcgatcgctgaaatgcttttcatcagcagcttttctaaaccacaaaaagataataagggctattgcgcacagtaccgcggggaggtctgtaatgcagttctcgccaaagatgccctggtctttcttaatacgtcatatgccgacccagaggaagcacaggagctgttggtccacacagcctggaatgagctgaaagtggtatctcccgtgtgccgccctgccgccgaagctttactgtgcaaccacatctttcaagagtgctcccccggggtggttcctactcctattcctatctgtcgagaatattgtctggccgttaaagagctcttctgtgcaaaagagtggctggtgatggaagaaaaaactcacagaggcctctatcgcagcgagatgcatctgctgagcgtgcccgaatgctccaagctgccaagcatgcactgggacccaactgcttgcgctcggttgccgcatctggattataataaagagaatctaaaaacattccctcccatgacgtcaagtaaacccagcgtggacatcccgaatctaccttcctcttcaagctcgtctttcagcgtcagtcccacctactcaatgaccgtgataatttcaattatgtcgagtttcgccatctttgtgctgctcacgatcactaccctgtactgctgccgcaggcgaaagcaatggaaaaacaagaaacgtgaaagcgcggctgttactcttaccaccctgccttcagagctcctgttagacaggctgcacccaaacccaatgtaccagagaatgccattactgctgaaccccaagctcctctctttagaatacccacgcaacaacattgagtatgtccgcgatatcggtgagggcgcgttcggccgagttttccaggcaagagcccctggactacttccctatgagccctttactatggtggccgtcaaaatgcttaaggaggaagcctcagccgacatgcaagccgacttccaaagagaggctgcccttatggcagaattcgataatccaaacattgtgaagcttctaggcgtgtgtgccgtggggaaaccaatgtgcctgctcttcgaatatatggcctacggcgatctgaacgaattcctgcgatcaatgtcaccacacactgtgtgttctctcagtcattccgatttaagcatgagagcccaggtgtcatcacccggaccccctccactgtcttgcgctgagcagctgtgcattgcaaggcaagtggccgccggcatggcctacttatcggaacgaaaattcgtacaccgagacctggcaacaaggaactgcctagtaggtgagaatatggtcgtcaagatcgcagattttgggcttagcagaaatatttatagcgctgattactacaaggctaatgagaatgatgcgattcccatacgatggatgcctcctgagagtatcttttataatcggtataccacggagagcgacgtgtgggcctacggagtcgtattgtgggagatattcagttatggactccaaccatattatggaatggctcacgaagaagtcatttattatgtccgggatggtaatatactgtcttgccctgaaaattgtcctgtcgaactttacaacttaatgcgtctctgctggtccaaactgccagcagaccgcccttcgttcacctccatccataggattctcgagaggatgtgtgaacgcgcggaaggtactgtgtctgtgtag

SEQ ID NO: 125005 - DNA, 570 bp, Artificial Sequence
  Description of Artificial Sequence: Synthetic coding sequence
atggctggcaacggtagggaggaccctcagcggacacttcaaatccgcgacgcattcgcagtccgcgcgcggatgcagcaggcatctcagcatgccctcggcccgcatggtttatgccagactgccacatcccgcgagtccgcagctgtcacgctcaccacactgcctagtgaacttctactggataggctgcacccaaatcctatgtatcagcgaatgccgttgttactgaaccccaagttactctctctggagtacccccgcaacaacatcgagtatgtacgggatatcggagaaggggcattcgggagagtattccaggcccgggcgccagggttactgccctatgagcccttcaccatggtagcagtgaaaatgcttaaagaggaagcctccgcagatatgcaggctgactttcaacgggaggctgccctgatggcagaattcgacaaccccaatatcgtaaaactgctcggtatgaaaattcaggtgagaatctgcataagcagtgagaacaggggatttccaagttttagccccctggtgcgagccttttccttctctccgtag

SEQ ID NO: 125006 - DNA, 351 bp, Artificial Sequence
  Description of Artificial Sequence: Synthetic coding sequence
atgaaacccaaaataacccgaccaccaatcaacgtcaaaatcatcgagggcctcaaggcagtcctaccctgcaccactatgggtaaccccaagcctagcgtttcttggattaaaggggatagccctttgagggagaactcccgcattgcggtactggagagtggctctctccggattcacaatgtccagaaggaggacgccggccaataccgttgcgttgccaagaactcattggggactgcctacagcaaagtcgttaagctggaggtcgaaggcgccaaaggtatccatacgcaattcgttgcttccgcactgcagctgcgcagcttcttgtcatgcccacagatctag

SEQ ID NO: 125007 - DNA, 351 bp, Artificial Sequence
  Description of Artificial Sequence: Synthetic coding sequence
atgaagccaaaaataacaagacccccaattaacgtgaagattattgaagggctgaaagccgtactgccatgcacgacgatgggaaatcctaaaccttccgtctcttggataaaaggagactcacctttaagggagaactctcgaatagctgtcctcgagtccggaagtctgagaattcacaatgtgcaaaaagaagatgccgggcagtaccgttgcgtggcaaagaatagcctcggcacagcttattccaaagtggtgaaattggaggtcgaaggcgccaagggtattcacacacagttcgtcgcttccgctctccaattaaggtcctttctttcatgtccacagatctag

SEQ ID NO: 125008 - DNA, 570 bp, Artificial Sequence
  Description of Artificial Sequence: Synthetic coding sequence
atggcaggcaacggtagggaggatccgcagaggacattgcaaattcgcgatgctttcgccgtgcgtgctaggatgcagcaggcatcccagcacgctctgggccctcatggattatgtcagactgccacgagtagagagtcagcggccgtgacactgactacgctcccatccgagctgctgctggaccggctccaccctaacccgatgtaccagaggatgcccctgctgctgaatcctaagctgttatcccttgaatatcctaggaacaacatagaatatgtgcgtgacattggagaaggggcttttggtcgagtgttccaggctcgcgcacccggcctgttgccgtacgaaccttttacaatggtggcagtgaagatgctcaaggaagaggcatccgccgatatgcaggctgacttccaacgggaggctgccctgatggctgaattcgacaatccgaatattgttaagttacttggtatgaaaattcaggtgcgaatttgtatttccagcgaaaaccggggcttcccgtcgttcagcccattggtgagagctttttctttctcaccttag

SEQ ID NO: 125009 - DNA, 2352 bp, Artificial Sequence
  Description of Artificial Sequence: Synthetic coding sequence
atgagggaactggtcaatatccccctggtccatatcctgacactcgtggcattttccggaactgagaaactgcccaaggctccagtgattacaacgcctctggagacagtagacgcattagtcgaggaggtcgccaccttcatgtgcgcggtcgagagctatccacagccagagatttcttggacgcggaataagattctgatcaagctcttcgatacacgctatagtataagggagaatggacagctgctgacaatactgtcagttgaagactctgatgatggcatttactgttgcacagccaacaacggagtcggaggcgctgtggagtcttgcggcgccttgcaggttaagatgaaacccaagatcacccgcccccccataaatgttaagattatcgagggactcaaagcggtgttgccatgcacgacgatgggcaatcctaaaccctctgtttcatggattaaaggagattccccgcttagggagaactcacggatcgccgtactggagtctgggtcactaagaattcacaacgtgcagaaagaagacgctggccagtacagatgtgtcgctaagaacagtcttggaacggcatattccaaagttgtgaaactcgaggttgaagaagaaagtgaaccggaacaagacacaaaggtgttcgctcggatactcagggcacctgaatcccacaatgtgacatttggttccttcgttacactgcactgtacagcaacagggatcccagttcctacaatcacctggattgagaatggcaatgcagtgagcagcggttcaattcaggagtctgtgaaggacagggtgatcgactccagacttcagctgtttatcactaaacccgggttatacacatgtatagctaccaataagcatggcgagaagttttccaccgccaaagccgctgctaccatcagcatagccgattttcgtgagtattgtcttgccgttaaggaactattctgcgcaaaagaatggctggtcatggaagaaaaaactcacagaggactgtatagaagcgaaatgcatctgctctctgtaccggagtgctcaaaactgcccagtatgcattgggatcccaccgcatgcgccaggcttccacacctagcattccctcccatgacctcatcaaagccgtccgtcgatatacctaacctcccctccagctcctcatcgtccttctctgtgtcacccacctactccatgactgtgattatctcaatcatgtccagcttcgccatatttgtgctgctcactataactaccctttactgctgcagacgccggaagcagtggaaaaataagaaacgcgagagcgctgccgtgactctcaccacactgcctagtgaactgttactcgaccgattgcatcccaatccaatgtatcaacgaatgcccctcctcttaaatcctaagctcctatcactggagtatccccggaacaacatcgagtatgttagggacattggtgagggggctttcggtagggtgttccaagccagagcacccgggcttctgccttatgagcctttcacaatggtcgcagtcaagatgcttaaggaagaagcttccgcagacatgcaggccgactttcagagggaagcggccctcatggcagaatttgataatcctaacattgttaagctcctgggtgtatgcgccgtcgggaagccgatgtgtcttctgtttgagtacatggcctacggagatttgaacgaattcctcaggtccatgagccctcataccgtgtgtagcttgtcacactctgacttatctatgagggctcaggtgtcttcgcccgggcccccccccttgtcttgtgctgaacagctatgtattgcgaggcaggtcgcggctgggatggcatatctgtccgaaagaaaatttgttcaccgcgatctggccacaaggaattgccttgttggggagaacatggtcgtgaagatcgctgattttggactgtccagaaatatttatagcgcagattactacaaagctaatgaaaacgacgccatccctatccgctggatgccccctgaatccatcttttacaatcggtacaccacagagagtgatgtgtgggcttacggcgtggtcctctgggaaattttttcttacggtctgcaaccctactacgggatggctcatgaagaagtcatctactacgtccgagacggaaatattctcagttgcccagaaaattgccccgttgagttatacaatctcatgaggctctgctggtccaagcttcccgcagataggcccagctttacatctatacacaggatcctggaaagaatgtgcgagcgggccgagggaactgtcagtgtgtag

SEQ ID NO: 125010 - DNA, 2610 bp, Artificial Sequence
  Description of Artificial Sequence: Synthetic coding sequence
atgagggaactggtaaacatcccactggtccacatcctgacgcttgtagctttttccgggactgagaagctgcccaaagcaccagtcatcacaacgcccttagaaaccgtagacgcgctggtggaggaggtggcaacattcatgtgcgccgtcgagagttatccacagccggagatctcgtggacacgtaacaagatcctgatcaaattgtttgacacacggtactctattagagagaatggccaactgttgactattctgtcagtcgaagactctgacgatggaatttattgttgtacggccaataacggagttggtggcgcagttgagagctgcggtgccttgcaggtgaaaatgaagccgaaaatcactcggcctcctatcaacgttaaaattattgagggcctgaaggcagtgctgccatgtactaccatgggcaatcctaagccatctgtttcgtggataaagggcgactcccctctcagggagaattcgcgcattgccgtgctcgaatctggatccttgcgcattcacaatgtgcaaaaggaagacgctggccagtatcggtgcgtcgcaaagaactcacttgggactgcctactccaaggtggtaaagctggaggtcgaggtttttgcccggattctcagggcgcctgagagccataacgtaactttcggctctttcgtcacccttcactgcacggcaaccgggattccggtcccgaccatcacatggatcgagaatgggaacgccgtgagcagtgggtcgattcaagagtcagttaaggacagagtgatcgactcgcgcctgcagctgtttatcaccaagccaggactctacacctgcatcgctactaataaacacggggagaaatttagcacagctaaggccgctgcgactatctccatagccgagtggtcaaagcctcaaaaggataataaaggctactgcgcacagtacagaggggaggtatgtaatgcagtgctggcaaaagacgctttggtctttctgaacactagctatgcagaccccgaggaggcacaggagcttctagttcacaccgcctggaacgagctgaaagtggtatctccggtctgtaggcccgctgcggaggccctgctgtgtaaccacattttccaggaatgctctccgggtgttgtccccacacctatcccaatttgccgagaatactgtcttgcagtcaaggaactgttctgcgctaaggaatggctggtgatggaggaaaaaacacataggggcttgtatcgttctgagatgcatctgctgtctgttccagaatgcagcaaactgccctcaatgcactgggaccccacagcctgtgcgcgactcccacatctggattacaataaggaaaatctgaagacttttccaccaatgaccagctccaaaccctcagtcgatattccaaatctccctagcagtagttcttccagtttctctgtatcacctacatactctatgaccgttatcatttccattatgtcgtccttcgctatttttgtgcttttgactattaccactttatattgctgtcgtaggaggaaacagtggaagaacaagaaacgagaatctgctgcagtgacattgaccacactgccatctgaacttcttctggacagacttcatccgaaccctatgtaccagaggatgcctttattgctcaatcccaaactgctgtcgctggaatatcctcgaaacaatattgagtacgtaagagacatcggggagggagcatttgggagagtatttcaggctagggcacccggtttgctcccctatgagcccttcactatggttgccgtgaaaatgttaaaggaagaagcctccgcagatatgcaggcagatttccagagagaggcagccctcatggccgagtttgacaatcccaacattgtaaaactactgggagtgtgtgccgttggtaaacctatgtgtctgcttttcgaatacatggcctacggggacttaaatgaatttctgagatcaatgtcccctcacaccgtctgtagtctttctcactctgatctgagcatgagagcccaagtgagctctccaggacccccccccctttcttgcgctgagcagttgtgcatcgctaggcaggtcgcagccggcatggcttacctgagcgaacgaaaattcgtgcaccgggatctcgctaccaggaactgcttggtgggagagaacatggtggtgaaaatcgcggatttcggcctgagcagaaatatctacagcgccgactattataaggcgaacgaaaatgatgctattccgataagatggatgcctcctgagtctatcttttacaacaggtacaccactgagagcgatgtatgggcctacggtgttgtgctttgggagatctttagctatggtctgcagccctactatggtatggcccacgaagaagtgatctactacgtccgcgatggcaatatcctcagttgccctgaaaattgccccgtggaattatataatcttatgcgattgtgctggtcaaaactgcctgccgacaggccatccttcactagcatccaccgcatcttggaacggatgtgtgagagggcggaagggaccgtatccgtctag

SEQ ID NO: 125011 - DNA, 2604 bp, Artificial Sequence
  Description of Artificial Sequence: Synthetic coding sequence
atgagggaactggtcaacatccctctggttcacatcttaaccctggtcgcattcagcgggaccgaaaaactccctaaggccccggtcattacgacccccctggagacggtggacgccttggtggaagaagttgccacatttatgtgcgccgtagagtcttacccgcagcccgagatttcctggacgagaaataagatcttaattaagttattcgacacaagatattcaatcagagagaatggccagctgttaaccattttgtcagtcgaggatagtgatgacggaatttactgctgcactgccaacaacggggtaggtggtgctgtagagagctgtggagcattacaagttaagatgaagcccaagattacccggccccccataaacgtcaagatcatcgaaggcctcaaggccgtgttgccctgcaccaccatgggaaaccccaaacccagtgtgtcctggatcaaaggagactccccattgcgggagaatagccggattgcagttctggaatcgggatctctgagaatccacaacgttcagaaagaggacgcaggccagtacagatgtgttgccaaaaacagtctgggaaccgcctactcaaaggtggttaagctcgaggtcgaggttttcgctcgaatattgagggctcccgaatcccacaacgtgacttttggttctttcgtcacgctacattgcacagctactggtatccctgtccccacaatcacttggatcgagaatgggaacgccgtctcatctggctctatccaggagagtgtcaaagaccgggttatcgactctagactacagctattcatcaccaaacccggcctgtacacatgcattgctacgaataaacatggagaaaagtttagcacggccaaggccgctgcaaccatttccatcgccgagatgttgtttatctcctcattttctaaaccacaaaaggacaataaagggtactgtgcccagtaccgcggcgaagtctgcaatgctgttctggccaaggacgccctggtgttcctcaacacctcttatgctgatcctgaagaggcccaggaacttctcgtccacaccgcgtggaacgagcttaaagtggttagccctgtgtgcaggccagccgcagaggccctactgtgtaatcacatcttccaggagtgtagccctggtgtggtgcctacacccattccgatttgtagggaatactgtctggcggtgaaggaattattttgtgccaaggaatggctcgtgatggaggagaaaacccatcgaggtttgtaccgttcagagatgcacctgttgtctgtgcctgagtgttccaagctgccgtccatgcactgggatccaactgcctgtgcaagactgcctcacctggccttcccacctatgactagctccaagccatctgtggatatcccaaatctgcccagcagcagctctagtagtttcagcgtgtctcctacttactctatgaccgtcatcatctctattatgtcttcatttgctatctttgtgcttctgaccataactaccctttactgctgtcggagacgaaaacagtggaagaataagaagagggaaagcgctgccgtcaccctgactacacttccctctgagctgctgctggatcgactgcacccgaatcctatgtatcagcggatgcccttacttctgaacccaaagttgctctcccttgagtatccaaggaataacatagagtacgttcgtgatattggggagggcgccttcgggcgggtgtttcaggccagagccccaggtttgctgccctacgaacccttcacaatggtggctgtgaagatgctaaaggaagaggccagcgccgacatgcaggccgactttcagagagaagccgctttgatggctgagttcgataaccctaatatagtaaagctgctgggggtctgtgcagtgggaaagcccatgtgcctcctcttcgagtatatggcctacggagatttgaatgagttcttgaggagtatgtcccctcacacagtgtgttcactttctcatagtgatctgagtatgagggcacaggttagttccccaggacccccaccactgagttgcgccgaacagctgtgcattgcgcggcaggtggcagcaggtatggcttatttgtccgagcgcaagttcgttcatagggatttagctacaaggaactgcctcgtgggagaaaatatggtggttaagattgctgactttggcctaagcaggaacatctatagcgccgactattacaaggcgaacgagaatgacgccattccaatccgctggatgcctccggaaagcatcttttacaaccgctataccaccgaaagtgacgtgtgggcctacggcgtcgtactctgggagattttcagttacggtttgcagccgtattatggaatggcacatgaggaggtgatatactatgtgcgcgatggaaatatcctttcctgtcccgaaaattgtcctgtggagttgtataatttgatgaggctgtgttggtctaaactcccggccgaccggccttctttcacctccatccatcgcattttagaaaggatgtgtgaacgggcggagggcacagtcagtgtatag

SEQ ID NO: 125012 - DNA, 2610 bp, Artificial Sequence
  Description of Artificial Sequence: Synthetic coding sequence
atgcgtgaactcgtcaatattccccttgttcatatcctcacactcgtagctttctccgggaccgagaagcttccgaaagctccagtcattacaacgccattggagacagttgatgcgttagtagaagaggtagccactttcatgtgcgcggtagaatcatatcctcagcctgagatcagttggacacggaacaagatcctgatcaaactttttgacacccggtattcaatccgagagaacggtcagttactaaccatactgtccgtcgaggattcggatgatggtatctactgctgtaccgctaataatggcgtgggcggagccgtggagagctgtggcgctctccaagtgaagatgaaacccaaaatcactcgcccacccatcaacgtgaagatcattgaggggctcaaggccgtgctgccatgtacaactatgggcaatcctaagccatccgtttcgtggattaagggcgactcacccctccgggagaattctcgtatcgctgtgctagagagtggctccctgaggatccataatgtgcagaaagaggatgccgggcagtacagatgcgtcgcgaagaattccctcgggacagcttatagcaaagtagtcaagttggaggtggaagtgttcgctcgtattctccgcgcaccagagtcccacaatgtcacattcggctcattcgtcaccctgcactgcactgccaccggcattccagtgccaacaatcacctggatagagaacgggaacgctgtctcaagcggaagcatacaggagtcagttaaagatcgcgtcattgattctagactccagttgtttataactaaaccgggactttatacctgcattgccactaataagcatggagagaaattttccaccgcaaaagctgctgcgactataagtatcgccgcattttctaagccccagaaggataacaagggctactgtgcacaatacaggggagaggtatgtaacgctgttctcgcaaaggatgcactcgtgttcctcaacacgtcctatgcagaccccgaggaggcacaggagctgctggtgcacacagcttggaatgagctcaaggtggtctcacccgtctgtagaccagccgccgaagccctgctttgtaaccatatcttccaagagtgttctcccggtgtagtcccaaccccaattcccatttgtcgggagtactgcctggcggtgaaggagctcttttgcgcgaaggagtggctggtcatggaggaaaaaactcacaggggcttgtaccgatccgagatgcatttgctgtccgtgcccgagtgtagtaagctgccatcaatgcattgggatcccaccgcctgcgcccgattgccccaccttgactacaataaagagaacctcaagacttttcccccaatgacctcatctaagccatcggtggacatcccaaacctccccagctccagcagctcttctttttctgttagtcctacatacagcatgaccgttatcatcagcatcatgtctagcttcgcaatctttgtgctgctaaccatcactactctgtactgctgtcgtcgtcgtaaacagtggaagaataagaaacgtgaatccgcggctgtaacactcactaccttgccttctgaactcctgttggatagactccacccaaatccaatgtaccagagaatgccccttctgctgaaccctaagctgttgtccctggaatacccccgcaataacattgagtatgtgcgcgacattggtgagggggctttcggtcgggtgttccaggcaagagcacccggactgctcccatacgagcctttcaccatggtcgctgtcaagatgctcaaagaagaggccagtgccgacatgcaggcagattttcaacgtgaggcagccctgatggccgaattcgacaaccctaatatcgttaagttgttaggggtgtgtgccgtgggcaagcccatgtgtcttctgttcgaatatatggcttatggcgatttgaacgagttcctccgctctatgtcaccccacactgtctgctccctgagccactccgacctcagcatgagggctcaggtgtcctctcccggaccgccacctctctcttgtgccgagcagctctgcatcgctcgacaggttgctgctgggatggcatacttaagtgagagaaagttcgttcatcgtgacttagccacccgtaattgcctggtcggcgaaaatatggtggtgaagatagctgatttcgggctgtctcggaatatctactccgccgactattacaaagccaatgagaacgatgccatcccaatcaggtggatgccccctgagagcatcttttacaatagatataccacagagtcggacgtttgggcttacggagttgtgctttgggaaatattctcctacggtctacagccctactacggcatggcacatgaggaggtgatctattatgtgcgcgatgggaatatcctgagttgtcctgagaattgtcctgtggaactgtataacctcatgagattatgttggagtaaactccctgctgatagaccatccttcaccagtatccaccgcatcctcgagcgcatgtgtgaaagagctgaggggaccgtttcagtctag

SEQ ID NO: 125013 - DNA, 2352 bp, Artificial Sequence
  Description of Artificial Sequence: Synthetic coding sequence
atgcgcgagttagtcaatattcctctagtccacatattaacacttgtggctttctcgggcactgagaaactccccaaggcaccggtcataacaacgcctttggagacagttgatgccctcgtggaagaggttgcaacgtttatgtgcgcggtggaatcttaccctcagccggagattagctggacaaggaataagatcttgataaagttgtttgatacaaggtactccataagagagaacggccagttgctgaccatcctgtccgtagaagactctgatgatggcatttactgttgcaccgccaacaatggtgtcggtggcgccgtggaaagttgcggagcattgcaggtgaaaatgaagcccaaaatcaccaggcctccgattaatgtaaagattatcgagggtctgaaggccgtgctgccttgtacaacaatgggtaacccaaaaccatcagtgtcctggatcaaaggagacagcccactcagggaaaactctcgaatcgccgtactagaaagcggtagcctgcggattcacaacgttcaaaaggaagacgccgggcaatacagatgtgtcgccaagaatagcttgggtactgcctactccaaggttgtgaagctcgaggtagaagaggagtccgaacccgaacaggatactaaggtgttcgcgaggatactgcgggctcccgagtctcacaatgtgactttcgggagttttgtgacattacactgtacggctactggcatacccgtccccacgattacctggattgagaatgggaacgcagtgagcagtgggtctattcaggagtctgtgaaggatcgggttatcgactcccgactccaactctttattacgaaacccggtctttatacctgtattgccaccaacaaacatggagagaagttctctaccgccaaagccgccgccactataagcatagctgcctggaaaaagtactgtctggccgttaaggagttattctgcgctaaagaatggcttgtaatggaggaaaagacccaccgcggcctctatcgcagcgagatgcatctgttgtccgtcccagaatgttccaagctgcccagtatgcactgggatcccacagcttgtgctcgcttgcctcatctcgccttccccccaatgaccagctccaaacccagtgtcgatatccccaatctgccctcaagcagtagcagctcattctctgtatcacctacctattctatgacggtgatcatcagtatcatgtctagcttcgccatttttgtgctgttaaccattaccaccctgtattgttgtcgtagacgcaagcagtggaagaacaaaaaaagagagagcgccgctgtgacactgacgactctgccgtctgaactcctcctggaccggctgcaccccaaccctatgtatcagcgcatgccattgctactgaaccccaaactcctgagcctggaatacccaaggaataacatcgaatacgtcagagatataggggaaggagcctttggacgggtcttccaggcccgcgctcccggactcctgccatatgagcccttcacaatggtggccgtgaaaatgctcaaggaggaggccagcgccgacatgcaggcagattttcaaagagaagccgcactgatggcagagtttgataacccgaatattgtcaagttgttgggtgtttgcgcagtagggaagcctatgtgtcttctcttcgaatatatggcctatggggacctgaatgaattcctgaggtcaatgagtcctcacacagtctgtagcctaagccactccgatctatcgatgcgcgctcaggtcagctctccgggcccgccgcctctaagctgcgctgaacagctgtgcattgctaggcaagtggcggctggcatggcctacttatccgaacgcaagttcgttcatagggatcttgctactcgtaattgtctggtgggagagaacatggtggttaaaatcgccgatttcgggctgtcccgtaatatctacagcgccgattattacaaagcaaacgaaaacgacgccatccccataaggtggatgcctcctgagtctatattctacaatagatatacaaccgaaagcgatgtgtgggcctatggagtagttctttgggaaattttctcatatgggttgcaaccttactacggaatggctcatgaggaagtgatttattacgtgagggatggtaacattctgtcttgtccagaaaactgcccagtagagttatataacctcatgaggctttgctggagtaagcttcccgccgaccggccgtcttttacgagtatccaccgcatcctggagagaatgtgcgaacgcgctgagggcacagtatccgtgtag

SEQ ID NO: 125014 - DNA, 1167 bp, Artificial Sequence
  Description of Artificial Sequence: Synthetic coding sequence
atggcagtgtcggttacacccatcagagacacaaaatggctgacattggaagtctgtcgggagtttcagcgcgggacatgttcccgacctgacactgaatgcaagttcgcgcacccatctaagtcctgtcaggtcgagaacgggcgtgtgattgcctgctttgattcacttaaaggtaggtgcagcagagagaactgcaaatacttacaccccccaccccatcttaagacacagctggaaataaacggccggaacaatctgatccagcaaaagaacatggccatgttagcccagcagatgcagctcgccaacgcgatgatgcccggagccccactgcagccagtgcccatgttctctgtagctccgagcctcgccactaacgcttctgcagccgcttttaacccatatctggggcctgtttctccgtctttagtgcctgccgagattctcccaacagcccctatgctggttaccggtaacccgggtgtgcctgtccccgccgcagcagctgctgcagctcagaagctaatgagaaccgatagactggaggtttgcagggagtaccagagaggcaactgtaaccgcggcgagaatgattgccgattcgctcaccccgctgacagtaccatgatagataccaatgacaacactgtcactgtctgcatggactacatcaaagggcgatgtagcagagaaaaatgcaagtactttcaccctccggcgcatttgcaagcgaaaatcaaggctgcacaatatcaagtaaatcaggcagccgctgcacaggccgccgccaccgctgcagctatgactcagtccgccgttaagtccctgaaacgccctttggaggccacttttgacctaggtattccccaagcagttctgcccccactgcccaagaggcccgcactggagaaaaccaatggtgctacagctgtgttcaacacggggatcttccaataccaacaagcgctcgcaaatatgcagcttcagcagcacactgccttcctgccgcctgttccaatggtgcacggagccaccccagcaacggttagtgcagcaaccacttctgccacttccgtgccattcgccgcgacagccacagctaaccagatcccaatcataagtgcggagcatctgacttcccacaagtacgtcacgcagatgtag

SEQ ID NO: 125015 - DNA, 909 bp, Artificial Sequence
  Description of Artificial Sequence: Synthetic coding sequence
atggctgtgtccgttacaccaattcgtgacactaagtggttgacactcgaggtgtgccgcgaatttcagagggggacctgcagtcggcccgatacggaatgtaaatttgctcatccctctaagagctgccaggtcgagaatggcagagtgatcgcttgtttcgactctctgaagggccggtgctccagagagaactgtaagtacttgcaccctcccccgcatctgaaaacgcagcttgaaatcaatggacgcaacaacctgattcaacaaaaaaacatggcaatgctggcacaacagatgcagttggccaatgccatgatgcccggagccccccttcagcccgttgtttgtagagaataccagcgagggaattgtaaccgtggcgaaaacgactgtaggtttgcacacccggccgacagtacaatgattgataccaatgataacaccgtgaccgtttgcatggattatatcaaaggcaggtgtagccgcgagaagtgtaaatactttcacccgcccgcccatctgcaagctaagattaaagccgcgcagtatcaggtcaaccaagcggctgctgcccaagcagctgccaccgcagctgccatgggcatcccacaggccgtactccctccgctccccaagcgtccggcattagaaaaaactaatggcgctaccgctgttttcaacacaggaatttttcagtaccagcaggctcttgcaaatatgcagctacagcagcatactgccttcctgcctcccgtccctatggtacacggtgccacgcccgccacagtttcggctgctacgaccagcgccacttcagtgccattcgctgccacagccacagcaaatcagatccccattatttctgctgagcaccttacgagccataagtacgttactcagatgtag

SEQ ID NO: 125016 - DNA, 1023 bp, Artificial Sequence
  Description of Artificial Sequence: Synthetic coding sequence
atggccgtgtcagtgacccccattcgagatactaagtggttgaccttggaagtgtgccgcgagtttcagagaggtacttgtagccgccctgacaccgagtgcaagtttgcacaccccagtaagagttgtcaggtcgagaacgggcgggtgatagcttgtttcgattccctcaagggccgctgcagccgagaaaactgtaaatacttacaccctccccctcatcttaagacccagctggagatcaatggacgcaacaacctgatccaacaaaagaatatggcgatgctggcccagcagatgcagctggcaaatgccatgatgccaggcgctcccctgcagcctgtgcccatgttttctgttgccccctccctggcaaccaacgcatcagcggcagcattcaatccatacctcggaccggtgtcgccatcgctggtgcctgcagaaattcttcccaccgccccaatgcttgtcaccggaaatcctggagttcccgtcccagccgctgcggcggccgccgcgcagaagctcatgcgtaccgacaggctggaagtatgccgggaatatcaaagaggaaactgtaatcgcggtgaaaacgactgccggttcgctcacccagccgactcgacaatgatcgacactaacgacaacactgtgaccgtgtgcatggactacattaaaggcaggtgcagcagagaaaaatgcaaatatttccacccaccagcccaccttcaggccaagatcaaggcagcgcaatatcaggtgaaccaggctgccgctgcccaggcagccgccactgctgcagccatgttcccttggtgcaccgttctgcgacagccactttgcccgcagcagcagcatttgcctcaggtcttcccatctttgcagcagccgcagcccacctccccgatactggatgcttccacactgctcggagcaacatcctgccctgctgcggccgggaaaatgatcccgattataagcgctgaacacctcactagccataagtacgtaacccagatgtag

SEQ ID NO: 125017 - DNA, 1149 bp, Artificial Sequence
  Description of Artificial Sequence: Synthetic coding sequence
atggccgtgtcagtgacaccaataagagataccaagtggctgacattagaagtttgtcgggagttccagcgcggaacatgttcccgtcctgatactgagtgcaagttcgcccacccttcgaagtcctgtcaggtagaaaatggacgagtgatcgcgtgctttgactccctgaagggccggtgtagccgtgagaactgcaaatacttgcatccccctccacatctcaagacacagctcgagatcaacggcaggaacaacttaatccaacagaagaacatggcgatgctggcgcagcagatgcaactggccaatgccatgatgcccggagcccctctgcagcccgttccaatgttttctgtggcaccttccttggcgactaacgcgtcggccgccgcgttcaacccctacctggggcccgtttcgcccagcttggttcccgccgagatactgcccaccgcaccaatgttggtgacgggcaaccctggcgttccggtgcccgccgctgccgccgcggccgcccagaagctcatgcggactgaccggctggaggtgtgcagagaatatcagcgaggaaattgcaataggggcgagaatgattgtcgctttgcgcatccagcggattcgacaatgattgataccaacgacaataccgttacagtgtgtatggactacatcaagggcagatgttcaagagagaaatgtaaatatttccacccacctgcacatctgcaagcaaagataaaagccgcacagtatcaagtcaatcaggccgccgctgcacaagctgccgccacagctgctgcaatgggaattccgcaagccgtacttccgccccttccaaaaagaccggcgttggagaaaaccaatggcgctacggcggtcttcaatacaggcatttttcagtatcaacaggcactagcaaacatgcagctgcagcagcatactgcattcctcccccccgggtctatcctgtgcatgacccccgcgacaagcgtggtccccatggtccacggtgccacacccgctacggtgtccgccgctacaacaagtgccactagcgtgcccttcgccgccaccgctacagccaaccagattccaatcatctcagctgagcaccttacatcacacaagtacgtgactcagatgtag

SEQ ID NO: 125018 - DNA, 1113 bp, Artificial Sequence
  Description of Artificial Sequence: Synthetic coding sequence
atggccgtctctgtcacgccaattcgcgatacaaagtggctgaccctcgaggtgtgcagagaattccaaaggggcacatgcagccgacctgacactgaatgtaaatttgcccatccgagcaagtcttgccaggtcgaaaatggtcgagtgatcgcctgcttcgactcccttaagggccggtgtagcagagagaactgtaagtacctacatccccctccccatctgaaaacccaattggagatcaacggccgcaacaatctgatccagcagaagaatatggcaatgctggcccagcagatgcagctagccaacgcaatgatgccaggcgcccccctccagccagtgccaatgttttccgtggcacccagcctcgctactaatgcgtcagcagcagccttcaacccctatctagggccggtctccccatcacttgtccctgcggagatcctgcccacagctcctatgctggttaccggaaatccaggggttccagttcctgctgcagctgctgccgctgctcagaagcttatgagaacggatagattggaggtgtgcagagagtatcagcgagggaattgcaataggggagagaacgattgtaggtttgcacatcctgctgactccacgatgatcgacacaaacgataacactgtgactgtatgtatggactatatcaaagggaggtgttctcgagagaagtgcaaatacttccatccacctgcccatttacaagcaaaaataaaagcagcccaatatcaggtcaatcaagcggcagctgctcaggcagcagctactgcagccgctatgggtatccctcaagccgtcctgcctcctcttcccaagagacccgctctggagaagacaaacggcgccactgctgtgttcaataccggcattttccagtaccagcaggccctggcaaatatgcagctgcagcagcacactgctttcctgccccctgtaccaatggtccacggggctacgcccgcaaccgttagcgctgccactacctcagccacgtccgtgccctttgcggccacagccactgctaaccagatacccattatttcagcagagcatctgacaagtcacaagtacgttactcaaatgtag

SEQ ID NO: 125019 - DNA, 1029 bp, Artificial Sequence
  Description of Artificial Sequence: Synthetic coding sequence
atggctgtctctgtgaccccaattagagacaccaagtggctaaccctcgaggtctgccgagagtttcagagagggacatgctcacgtcctgacactgagtgtaagttcgctcacccctcaaagtcctgccaagtcgaaaacgggagagtcattgcatgctttgacagcctcaagggaagatgcagccgagagaattgcaagtatctgcacccgcctcctcatctgaaaactcagttggaaataaacggcagaaacaatctcattcagcagaagaatatggcaatgttagcccagcagatgcagctagctaacgctatgatgcccggggccccactccaacctgtgccgatgttcagcgtggcaccttcactggctaccaacgcaagcgcagcggctttcaacccgtatctgggcccggtcagccccagtctagtgcctgcagaaattctgccaaccgcgcccatgctcgtgacaggcaacccaggtgttcctgtgcccgccgctgcagctgccgccgctcaaaagctgatgagaaccgatcggcttgaggtgtgtagggagtatcagagaggaaattgtaatcgtggggaaaatgactgccgcttcgcacacccagccgatagcaccatgatagacactaatgataatactgtaacagtgtgcatggattatatcaagggccgctgctccagggagaagtgtaagtacttccacccacccgcgcacctgcaggccaagatcaaggccgcccagtaccaagtgaaccaagccgccgcggcccaggcggcagctacagccgccgccatgggcataccgcaggccgtgttgccccccctccctaagcggcccgccctggaaaaaacaaatggcgccactgccgtgtttaacaccgggatctttcagtatcaacaggctctggccaatatgcaactgcagcagcacacagctttcctgccgccaggctctattctttgcatgacaccagcaacgagcgtcgacactcataatatctgcaggactagcgattag

SEQ ID NO: 125020 - DNA, 1167 bp, Artificial Sequence
  Description of Artificial Sequence: Synthetic coding sequence
atggcagtgtcagtgaccccaatccgagataccaagtggctaactctagaagtctgccgcgagtttcagcgggggacctgctcgagaccagacaccgaatgcaagtttgcacatccttctaagtcctgtcaggtagagaacggcagggtgattgcctgctttgacagcttgaaagggcgctgctcccgcgagaactgtaaatatctgcacccaccgccacacctgaagacacagctagagattaacggcaggaacaacctaatacagcaaaaaaacatggctatgctggctcagcagatgcagctggctaacgcaatgatgcccggcgctccattgcaacccgtaccaatgttctccgtggctccctccctggctactaacgcatctgcagcggcctttaacccgtacctgggcccagtcagccctagcctggttcccgcagagatcctgcctacggcccccatgctggtcaccggcaatccaggagttccagtccctgctgctgcagccgccgccgctcagaagttgatgcgcacagatcgtttagaggtgtgtcgggaataccagcgtggaaattgcaaccggggcgaaaacgactgtcgatttgctcacccggcagactccacgatgatagatactaacgacaacaccgttacagtgtgcatggattatatcaaaggcagatgcagtagggaaaagtgcaagtacttccatccgcccgctcacttacaggccaaaatcaaggccgcccagtatcaagtaaatcaggcagctgcagcccaggccgctgccaccgccgccgccatgacccagagcgccgtgaaatctctgaagagaccactagaggcaacttttgacctggggataccacaggcagtgctacctcccctgcctaagcggccggctctcgagaaaacaaacggggcgaccgctgtttttaatacgggaatttttcagtaccagcaggctttggcgaatatgcagctacaacaacatacagctttcttacccccggttcctatggtgcatggcgccacgcctgctaccgtgtccgccgcgaccacttctgccacctcggtccccttcgccgcgacagcaaccgccaaccagatacccattatcagtgcagagcacctcacatctcataagtacgtcacccaaatgtag

SEQ ID NO: 125021 - DNA, 1023 bp, Artificial Sequence
  Description of Artificial Sequence: Synthetic coding sequence
atggccgtgtcagttactccaatacgagatacaaaatggctgacactggaggtgtgcagggagttccagagaggcacatgctctaggcctgacacagagtgcaaattcgcccacccctccaagtcctgccaggtggaaaacggaagagtgattgcttgtttcgattccctgaagggtaggtgttcacgtgaaaactgcaagtatctacaccctcctccgcacctgaagactcagctggagatcaacggccggaacaacctaattcagcaaaagaacatggccatgctcgcacagcagatgcaactcgcaaatgccatgatgccaggcgcaccactccagcctgtgcctatgttctctgtggcaccttccctggcaactaacgcaagcgcggccgctttcaatccatatttggggccagtttcaccaagtctcgtgccagcagagatactgcctaccgccccgatgctggtcaccggaaatccgggtgtgccggtgccagctgccgccgcggctgctgcccagaaactcatgaggactgatcgactggaggtatgcagagagtatcagcgggggaactgcaaccgaggggagaacgactgcagattcgcccatcccgcagattccactatgattgataccaacgacaatactgtgaccgtgtgtatggattatattaaggggcgatgttccagagagaagtgcaaatattttcaccctccggcccaccttcaggccaaaatcaaggcagcccagtaccaggtgaaccaagctgctgctgcccaggcagccgctactgctgccgcgatgttcccttggtgcaccgttctgagacagccactgtgtcctcagcaacaacacctgcctcaggtattcccatccctgcagcagccacaacctacttcccccattctcgatgcctcaactctcctcggggccacttcttgtcccgcagcggcaggtaaaatgatacctatcatatcagctgaacatcttacttcccacaaatatgtaacccagatgtag

SEQ ID NO: 125022 - DNA, 909 bp, Artificial Sequence
  Description of Artificial Sequence: Synthetic coding sequence
atggcggtatctgtgacccccatacgtgacaccaagtggctcacactggaggtctgcagggaattccagcggggcacctgttcccgccctgacaccgaatgcaaatttgctcatccaagtaagtcttgtcaggtggagaacggcagggtgattgcatgtttcgactctctgaagggcaggtgtagtcgtgagaactgtaagtatctgcacccaccaccgcatttaaagacccagttggaaatcaacgggcgaaacaatcttattcaacagaaaaatatggcgatgctggcacaacaaatgcaacttgcgaacgcaatgatgccaggagcccctctccagccggtggtttgcagggaataccaacgaggcaattgtaaccggggtgaaaacgactgcaggttcgctcaccccgccgattccaccatgatcgatacgaacgataatactgtcacagtgtgtatggattacattaagggacgttgctctcgcgagaaatgtaaatattttcaccctcccgcccacctccaggccaagataaaggcagcccagtaccaagttaaccaggcggccgcagcccaagccgcagctaccgctgccgcaatgggcattcctcaggccgtgctccctcctttacctaagagacctgccctggaaaagacaaacggggctaccgccgtgttcaacacgggcatctttcaataccagcaggccctcgcgaatatgcagttgcaacagcacaccgcattcctgccccctgtaccaatggtacacggtgctacaccggcaactgtgtccgctgctacaacaagcgccacttctgtccctttcgcggctaccgccactgccaaccaaatcccaattatcagcgccgagcacctgacatcgcacaagtacgttactcagatgtag

SEQ ID NO: 125023 - DNA, 1029 bp, Artificial Sequence
  Description of Artificial Sequence: Synthetic coding sequence
atggccgtctccgtcactcccattagagacaccaagtggcttaccttggaagtgtgccgagagttccaacgtggcacttgcagccgtcctgacactgagtgtaagtttgcacatccatcaaagtcatgtcaggtcgaaaacggcagagtaatcgcgtgctttgatagcttgaaagggcggtgcagtcgggagaattgtaagtacttacatccccccccgcacctgaaaacacagcttgaaattaatggacggaataacctcattcagcaaaagaacatggccatgctcgcgcagcagatgcaactggctaatgcaatgatgcccggcgcacctctccagccggtgcccatgttttcagtagcccccagtttagccaccaacgcttcggcagcggctttcaacccgtatcttggacctgtgagccctagtctagtccccgctgagatactgcctaccgctcccatgctggtcacaggcaatccaggcgtgcctgttcccgcggccgctgccgctgccgctcagaaactgatgcggactgaccgtctagaagtgtgtagggagtatcagaggggtaattgtaaccgtggggaaaacgactgccggtttgctcaccccgccgattccactatgattgatacgaatgataatacagtgaccgtttgtatggattatattaagggccgttgttcccgggagaagtgcaagtacttccacccaccagctcacctgcaggccaagataaaagctgcccaatatcaggtgaatcaggccgctgctgctcaggcggccgccactgccgcagctatgggtattcctcaggctgttcttcctccgcttcccaaacgcccggctctggaaaagacgaacggcgccacagcagtttttaatacagggatcttccagtatcaacaggcactggccaacatgcaattgcagcagcacactgcttttctgcctcctggatcaatattatgtatgaccccagcgacttctgtggacacacacaacatttgtcgtacctccgattag

SEQ ID NO: 125024 - DNA, 1032 bp, Artificial Sequence
  Description of Artificial Sequence: Synthetic coding sequence
atgggccgatgttctcgggagaattgcaagtatttgcatcccccgccccatctcaagacacaactggaaatcaatggccgcaacaaccttattcagcaaaaaaatatggctatgttggctcagcagatgcaactcgccaatgccatgatgccaggagcccctcttcagccagtgcccatgttttctgtcgcgccctcgcttgcaactaatgcgtctgccgccgccttcaatccttaccttggcccagtttcaccctctctggtgccagcggagatcctaccaaccgcacccatgctggtgacaggaaacccaggggtcccagtgccagcagccgccgccgctgcagcacagaaactgatgcggactgacagattggaagtgtgtagggaataccagagagggaattgcaatcgcggggagaacgactgcagattcgctcatcccgcagacagtactatgattgatactaacgacaataccgtgaccgtgtgcatggactatattaaagggcggtgctcccgtgagaaatgcaagtacttccaccctcccgctcatttgcaggctaaaattaaagccgcgcaatatcaggtcaaccaggcagccgctgcccaggccgcagccactgccgctgcgatgacgcaatcggccgttaaaagtcttaagagaccgctcgaggccacttttgatctcggcatcccccaagctgtcttgcccccgttaccaaaacgtcctgctctcgaaaaaacaaatggcgccactgccgtttttaataccggtattttccaataccagcaagcactggccaacatgcagctgcaacagcatactgcattcctgccaccagggtccatcctgtgtatgacccccgcaaccagcgtggttccgatggtgcatggagcaacaccggcaaccgtgtctgccgccacaaccagcgcaactagcgtcccatttgctgccacagccaccgccaatcagatccccatcatctctgccgagcacttaacatcccataagtacgtgacacagatgtag

SEQ ID NO: 125025 - DNA, 945 bp, Artificial Sequence
  Description of Artificial Sequence: Synthetic coding sequence
atggccgtttctgtgacaccgatccgcgacacgaagtggttgacgcttgaagtctgtcgagagttccagcgcggtacatgctcccggcctgacacagagtgcaaattcgctcatcccagcaaatcttgccaggtggagaatgggcgggtgatcgcctgctttgacagtctaaagggccgttgttctagggaaaactgcaagtaccttcacccgccaccgcacctgaaaacacaactagaaatcaacggtaggaataaccttatacagcagaagaatatggccatgctcgcccagcagatgcagctcgccaacgccatgatgcccggagctcccctccagcctgtggtgtgtcgcgagtatcagaggggaaactgcaatagaggggagaatgattgtcgctttgcacacccagccgactcaaccatgattgacacgaacgataatactgttacagtgtgtatggactacatcaagggtagatgctctagagaaaagtgcaagtattttcaccctccagctcacctgcaggccaagatcaaggccgcccagtaccaggtaaaccaagccgccgccgcgcaagcagccgcaacagcggccgctatgggtattccccaggccgtcctcccacccctccctaagcggccagccctggagaagaccaatggagcgactgccgtgtttaataccggtatcttccagtatcaacaggcacttgcaaatatgcagctgcagcaacatactgcttttctgccgcctgggtctattctgtgcatgactcccgccaccagtgtggttcctatggtgcacggagcaactcctgctactgttagcgcggcaactacttctgccacgagcgtgcccttcgcagcaacagcaacggctaatcagatccctatcatctcagctgaacatctgactagccataagtacgtaactcagatgtag

SEQ ID NO: 125026 - DNA, 1005 bp, Artificial Sequence
  Description of Artificial Sequence: Synthetic coding sequence
atgaccgctgtgaatgtggctcttatccgtgatacaaagtggctcacattagaagtatgtcgggaattccagagaggaacatgctctcgggcagacgcagactgcaagttcgcgcacccacctagagtgtgccacgtcgagaacggtcgggtagtcgcctgctttgattccctgaaaggccgctgcacccgggagaattgtaaatatttgcacccacctccacacttaaaaacccagctggagatcaatggaaggaataatctgatccagcagaagaccgcggctgcaatgttcgctcagcagatgcagctgatgctgcagaatgcgcaaatgagttccctggggagctttcctatgacgccatccatccctgccaaccctcctatggcctttaacccatatatcccccaccccgggatggggttggttccagccgagctggtgcctaatacacctgttctgatccctggcaaccccccacttgcaatgcctggggctgtgggcccgaagttaatgcggagtgacaagctggaagtgtgtcgagaattccaacgtggaaattgcactaggggggagaacgactgccgctacgctcaccccactgacgcctctatgattgaagctagcgataacacagtcaccatctgtatggactatataaaggggcgatgtagccgtgagaagtgcaaatatttccacccccctgcacacctccaggcacgactcaaggccgcgcaccatcagatgaatcactcagctgcgtccgcaatggccctcaccaatcttcagttaccccagccggccttcatccccgccggccctatcctgtgtatggcacccgcgtcgaacatagtgcccatgatgcacggggcaacccctacgacagtgtccgccgccactacaccggccacttctgtcccattcgctgccccaacaacaggaaaccagattccccagctgagcattgatgagttgaatagttctatgtttgtttcacagatgtag

SEQ ID NO: 125027 - DNA, 777 bp, Artificial Sequence
  Description of Artificial Sequence: Synthetic coding sequence
atgttcgcccagcaaatgcaattaatgctgcagaatgcacaaatgtcctctctggggtctttcccgatgacaccttcaatccccgcgaaccccccaatggcttttaacccatacattccacaccccgggatgggactggtccccgcagaactcgtgcccaatactccagtgctcatccctgggaatcctcctttggctatgcccggagcagttggcccaaaattaatgagatcagacaaactagaagtgtgccgcgagtttcagagaggcaattgtacaaggggagagaatgactgccggtatgcccacccaaccgacgcatcaatgatagaggctagtgacaatactgtcacaatatgcatggattatattaaggggcgctgtagccgagagaagtgcaagtatttccacccccctgcgcaccttcaagcacggctaaaggctgcccaccatcagatgaaccattctgccgccagcgccatggcgctgcagcctggcaccctgcagctgattcccaaaagatctgcactggagaaacccaacggtgcgacacccgtgtttaaccctaccgttttccattgccaacaggcgttaacgaatctacaactcccacaacccgcctttatcccagcaggccccatcctgtgtatggccccagcatctaacatagtgccgatgatgcatggcgccacccccactacggtgagcgccgctaccacgcccgccacgtccgtccccttcgcggcaccgacgaccggcaaccagttgaaattttag

SEQ ID NO: 125028 - DNA, 915 bp, Artificial Sequence
  Description of Artificial Sequence: Synthetic coding sequence
atggaacgagccagtaagaatctgaaaggacggtgcacaagggagaattgtaagtatctccatcctcccccacaccttaagacgcagctggagataaacgggaggaacaacttgatccagcaaaaaacagctgccgcgatgttcgctcagcagatgcagcttatgcttcagaacgctcaaatgtcaagcctggggagctttccgatgaccccctcaattcctgcaaaccctccaatggctttcaacccatatattcctcatcccggcatgggtctcgtgcccgctgagctggtccctaatactcctgtcctaattcctggcaatcctcccttggcaatgcccggcgccgtcggacctaagctgatgaggtcagacaagctggaggtttgcagggaatttcagaggggcaattgcaccaggggggagaacgattgtcgctatgcccatccaacagacgcatccatgattgaggctagtgataacaccgtgacaatctgtatggactacatcaagggaaggtgttcaagagagaaatgcaagtattttcacccaccggcacacctccaagccaggctgaaggctgcccaccaccagatgaaccactctgccgcgagtgcaatggccttgcagccagggaccctccagttgatccccaagcgttcagcactagagaaacctaacggggccacaccagtttttaatccgaccgtgtttcactgccagcaggccctgactaacctgcagctaccacagccggcctttatccccgctggtcccatcctgtgcatggccccggccagcaatatcgtgccaatgatgcatggggctacaccgaccacagtcagtgccgctacaaccccggccacatcggtgccctttgccgctcccactactggcaaccagcttaaattttag

SEQ ID NO: 125029 - DNA, 1065 bp, Artificial Sequence
  Description of Artificial Sequence: Synthetic coding sequence
atgacagctgtaaatgtggcccttattagagataccaagtggttaaccctggaagtctgtagggaatttcaacgcggaacctgttcccgagctgatgccgactgtaaatttgcccaccctcctagggtgtgtcacgtcgagaacggtcgcgtggttgcttgcttcgactccctgaaaggccgctgcacacgagaaaattgcaagtaccttcatcctccaccccacctgaagacccagctcgagattaacgggcggaacaatttgatccagcaaaagacagcagctgccatgttcgcacagcagatgcagcttatgctgcaaaatgcccagatgtccagtctgggaagttttcctatgacccccagcattccagcaaacccccccatggcctttaatccctacatcccccatcctggcatgggcttagttcctgctgaacttgtccctaatacaccagtacttatacctggaaatccacctctggcaatgccaggtgccgtgggacctaagctcatgcggagcgacaaactggaagtctgtcgagaattccagaggggcaattgtacccgtggagagaacgactgcaggtacgcacatccgaccgatgccagcatgattgaggcctcggataacacagtaactatttgcatggactatattaaaggcaggtgttcccgggaaaagtgcaagtatttccatcctccagcccacttacaagcgagactgaaggccgctcaccatcagatgaatcattctgccgccagtgcaatggccctgcaacccggcaccctgcagctgattcctaaacgaagcgccctggagaaaccaaacggcgctacccccgttttcaatccaactgtttttcactgccaacaagctctgaccaacctgcagctcccccaaccggcttttattcccgcaggaccaatcctatgcatggccccagctagtaatattgtgccaatgatgcatggagccacccctactaccgtctctgccgccactacgcccgctaccagcgtgcccttcgctgcccctaccaccggcaaccagctcaagttttag

SEQ ID NO: 125030 - DNA, 1029 bp, Artificial Sequence
  Description of Artificial Sequence: Synthetic coding sequence
atgacagccgttaacgtggccctgatccgcgataccaagtggctaactctagaagtatgtcgcgagttccagagaggtacgtgctcccgggctgacgctgattgtaaattcgcccaccctcctagggtgtgccatgtcgaaaatggccgggtcgtggcttgcttcgattccttaaaagggaggtgtacaagggagaattgtaagtatctgcaccctccgcctcacctcaagactcagctggagattaatgggagaaacaatctgattcaacaaaaaaccgccgctgcaatgtttgctcagcaaatgcagcttatgctgcagaatgcccagatgagcagcctcggaagctttcccatgacaccctccattcccgccaaccctcctatggcatttaacccctacattccacaccctggaatgggcctcgtgcccgccgagctcgtccctaacacccccgtactgattcctggcaatcccccattagccatgccgggagcggtgggacccaaactgatgagaagcgataaactggaggtctgcagagaattccagcgaggcaattgcactcgaggcgaaaacgactgtcgatacgcacaccccacagatgctagcatgattgaggcctccgataatacagtcactatctgtatggattacatcaaaggacgatgttccagggagaagtgtaagtacttccacccgccagcacacctgcaggctagattaaaagctgcccaccaccagatgaatcattccgcagcttctgccatggccctacagcccgggacattacagctgataccaaagaggagtgccctggagaaaccaaacggggccacgccagtgtttaacccgaccgtcttccattgtcagcaggccctgacaaacctgcagctcccgcagcctgctttcatccccgcagttcccatgatgcacggcgcaactcccacgaccgtgtcggccgccacaacgcccgctaccagcgttcctttcgccgctcctaccacagggaaccaactcaaattttag

SEQ ID NO: 125031 - DNA, 777 bp, Artificial Sequence
  Description of Artificial Sequence: Synthetic coding sequence
atgtttgctcaacagatgcaactgatgctgcagaacgcccagatgtcttccttaggcagcttccctatgaccccttctataccggcaaatccacctatggcatttaacccttatattccccatcccgggatgggactggtgcctgcggaacttgtgcccaataccccagtcttgattcccggaaaccctcccctggctatgcctggcgcagttggacctaaactcatgcggtccgacaagctggaggtgtgtcgggagtttcaacgcggaaattgtacaaggggcgagaatgattgtaggtatgctcatcccacggatgcttcaatgatcgaggctagcgacaatactgtgaccatttgcatggactacataaaagggcggtgcagccgggaaaagtgtaagtattttcatccccccgcgcacctccaggcccgtctgaaagccgctcatcatcagatgaaccattccgctgcctcagccatggccctgcagcctggcacactgcagctaatccccaagcggagtgccttagaaaaaccaaatggcgctactcctgtgtttaacccgactgtgttccactgccagcaggccctcaccaatttgcagctgccacagcccgcattcatccccgctggccccattctgtgtatggctcctgccagcaacatcgtgccaatgatgcacggagcgactcccaccacagtgtctgccgccactactccagccacatctgtgccgttcgcagctcctaccactgggaaccagctaaaattttag

SEQ ID NO: 125032 - DNA, 672 bp, Artificial Sequence
  Description of Artificial Sequence: Synthetic coding sequence
atgttcgcccagcagatgcaattaatgctacaaaacgctcagatgtcatcattggggagcttccccatgaccccttcaattcccgctaaccctcccatggcctttaacccctacattcctcatcctggtatgggcctggtgcccgccgagctggtccccaataccccggttttaatccctggaaatcccccactggctatgccaggagccgtgggacctaagcttatgagatctgataagttggaagtgtgcagggaattccaaagggggaactgcactcgaggggagaatgactgccggtacgctcatcccaccgatgccagcatgatagaggcgtccgacaatactgtaacaatatgcatggattacatcaaagggaggtgttcgcgtgagaaatgtaaatatttccatcctccagctcatctccaggcccgcttgaaagctgcccatcaccagatgaatcatagtgcggcctcagcgatggctttacagcctggcactctccagctgatcccaaaacgatctgcgctggagaaacccaatggtgccactccagtcttcaatccaaccgtgttccattgccagcaggcgctgacaaatctgcagctacctcagcccgctttcatcccagcagggcccatattatgtatggcgccagcctcaaatatttag

SEQ ID NO: 125033 - DNA, 729 bp, Artificial Sequence
  Description of Artificial Sequence: Synthetic coding sequence
atgttcgcccaacagatgcagctgatgttacagaatgcacagatgtcgagtttagggagttttcccatgactccttcaatccctgccaaccctcctatggcttttaacccttatatccctcatccaggaatggggctggtgcctgctgaacttgtaccaaatacacctgttttaatccccggcaaccctccgctcgcaatgcctggggccgtgggaccaaaactcatgcggtctgacaagcttgaggtgtgccgggaatttcagaggggaaattgcactaggggggaaaatgactgcaggtatgctcaccctacagatgcaagtatgatcgaggcgagtgataatacagtgacaatctgcatggactatatcaagggacgctgttctcgtgaaaaatgtaagtattttcaccctcccgctcaccttcaggctaggttgaaggctgcacaccatcagatgaaccatagcgccgcaagcgctatggcactccagccgggcacgttgcaactcattcccaaacgctcagccctggagaaacctaatggcgccacccctgtcttcaacccaaccgtgtttcattgccagcaggctctcaccaatctccagctccctcaacctgctttcatcccagccggacccatactgtgcatggctcccgcgtctaacattgtacctatgatgcacggagccactcctactacggtgtccgctgcaactaccccggcttag

SEQ ID NO: 125034 - DNA, 453 bp, Artificial Sequence
  Description of Artificial Sequence: Synthetic coding sequence
atcaaaggcaggtgcagcagagagaaatgtaagtatttccatccccccgctcacctgcaggcacgacttaaggcggcccatcaccagatgaaccactccgccgcctcagcaatggctctccaacctggaacacttcaactcattccaaaacgaagtgccctcgagaagcccaatggagcaacacccgttttcaaccctactgtgttccactgccagcaagcgctgaccaatctccagctaccccagccagcatttatccctgccggtcccatcctgtgcatggctcctgctagcaatatagtccccatgatgcacggagccacccctacaactgtctctgccgccaccacgcccgcgacaagtgtgccttttgcagcccctaccacaggcaaccaaatcccacagcttagcatagatgagttaaactcctctatgtttgttagtcagatgtag

SEQ ID NO: 125035 - DNA, 879 bp, Artificial Sequence
  Description of Artificial Sequence: Synthetic coding sequence
atggaacgagcatccaagaacctgaaaggcaggtgcacccgcgaaaactgcaaatacctgcaccctccgccccacctcaaaactcagttggagattaatggtagaaataatctcatccaacaaaagacagcagccgccatgttcgcacagcagatgcaattaatgctgcagaatgcacagatgtcttccctggggtccttccccatgactccgagcattccggccaatccacccatggcgttcaacccatatattccacatcccgggatgggactggtcccagcagagttggtcccaaacactcctgttctgattcctggcaatccccccctggcgatgcccggagccgtcggccctaaactgatgcgttccgataaactggaagtgtgtagagagtttcagcgaggcaattgtactcgaggcgagaacgactgtcggtacgcacatccaactgatgcctcaatgatcgaagcgtctgataatacagtcaccatctgcatggattacataaaaggaaggtgctccagagagaaatgtaaatatttccatccccctgcacacctgcaggccaggctgaaggcagctcaccaccaaatgaatcactcagctgcctctgccatggcgttgcagccagggacactacagctcattcccaagagatccgctctggagaaaccaaatggcgctacccctgtcttcaaccctaccgtgtttcattgccaacaagctctgacaaatctacagctccctcagcccgcgttcatccccgcggtgcccatgatgcatggcgccacgcccacaactgtgagcgccgccactacccctgctactagcgtgcccttcgctgccccaacaacaggaaaccagttaaagttttag

SEQ ID NO: 125036 - DNA, 1377 bp, Artificial Sequence
  Description of Artificial Sequence: Synthetic coding sequence
atggaattagagaagagggaaaagagaagcctcctaaacaaaaatctcgaggagaagcttaccgtgtccgccggcggctctgaggccaagcccttaatttttacattcgtgccgactgttcggaggctgcctacgcatactcagcttgccgatacatccaagttcctggtgaagatcccagaagagagtagtgataagtccccagaaaccgtgaacagaagtaagtcgaacgactatttgacgctgaatgcaggatcgcaacaagagagggatcaggccaagctgacttgcccctccgaggtcagcggaacaattttgcaggagcgcgagtttgaggccaataagctccaggggatgcagcagagtgacctgtttaaagctgaatacgtgctcattgtagattcagagggcgaggatgaagccgcctcacggaaggtggagcaggggccaccaggcggtatcgggaccgccgccgttcgccccaagagcctagcaatcagttcatcactagttagtgacgtggtgagaccaaaaacgcagggaaccgacctcaagacgagttcacacccagaaatgctgcatggaatggctcctcaacagaagcatggacaacagtacaagaccaagtcctcctataaagccttcgccgctattcctactaatacactccttctcgaacaaaaggcattggacgagcctgctaaaacggagagcgtgagcaaggataacactcttgagcccccagtagagctctacttccctgcccaattgcggcagcagacagaagaattgtgtgccaccatcgataaggtcttacaggattcattgtctatgcatagttcggattcgccttcccgttctcctaagacccttctcggatctgacactgtgaaaacacccactacactgcctcgtgcagccggacgcgagacaaagtatgccaacctctcatcgccttctagcacagtgtccgagagtcaacttaccaagcctggtgttattcgccctgtccctgtaaaaagcagaattctcctcaagaaagaagaggaagtgtatgaaccaaatcctttttcaaaatatctggaggacaactctgatctgttctccgagcaagatgtcaccgtcccgcccaaacctgtatcgcttcatcccttgtaccaaactaaactatacccacctgcaaagagcctcttgcatccccagactctcagccacgctgattgtctggctcctggtccattctctcacttgagtttttcactctcggacgagcaggagaactcccacacactcctaagccacaatgcttgtaataagctgtcccatccgatggtggctatcccagagcacgaagcacttgatagcaaggagcagtag

SEQ ID NO: 125037 - DNA, 873 bp, Artificial Sequence
  Description of Artificial Sequence: Synthetic coding sequence
atgacatcgtgtatccttagcggtagcatccagacaaccccgcaagtgagcgctggaggctctgaagctaaacctctgattttcaccttcgtaccaaccgttcggaggctgccaacacatacacaactggctgatacatctaaattcctggtcaagatcccagaagagtccagtgacaagtctcctgaaaccgtaaatcgctcaaagagcaatgactatctgacgttgaatgcgggaagccaacaggagagagaccaggccaaactgacttgtcccagtgaggtttccggaaccatccttcaggaacgtgaattcgaggccaacaagctgcaaggaatgcaacagtcggacttgttcaaggcagaatatgtgctcattgtcgattcagaaggtgaggacgaagcagccagcaggaaggtggagcagggcccccctggcggcattgggacagctgccgttcggccgaagtcattagcaataagcagcagcctagtaagcgatgttgtacgccccaaaactcagggaacagatttgaagacttcctcacaccccgagatgctccatgggatggcaccgcaacagaaacatgggcagacacctacaacgctcccgagagctgccggtcgggaaaccaagtatgcgaatttgagtagcccctccagcacagttagcgagtcccagctcactaagcccggggtgattcggcccgtgcctgtgaagagcaggattcttctcaagaaagaggaagaagtctacgagcctaatccgttctcaaagtacctggaggacaactctgacttatttagcgaacagctctctcaccctatggtggccattccagagcacgaagccttggattcaaaggaacaatag

SEQ ID NO: 125038 - DNA, 705 bp, Artificial Sequence
  Description of Artificial Sequence: Synthetic coding sequence
atgtgttcgtggtacctgggttttgaatgtagctctaaatcgaacgactatcttaccttgaacgcaggaagtcaacaggagcgtgatcaggccaagttgacatgtccatctgaggtttccgggaccatcttgcaggagcgtgagtttgaggccaataaactacagggcatgcagcagtccgacctctttaaggctgagtatgtcctcattgtcgacagtgaaggcgaagatgaggcagcatcgcgcaaagtggagcaggggccgccaggtggaatcgggacagcagctgtgcgccctaaatctcttgcaatatctagttccctcgtaagcgatgttgtgcgtcccaaaactcaaggtactgaccttaagacctcttctcaccctgagatgctgcacggcatggccccacagcagaagcacggccagacacccaccactcttccacgggctgcggggcgcgaaacaaagtacgccaatttgtcttctccttcatccaccgtgtccgagtctcagttaacaaagcccggcgtgattcgaccggtccccgtcaaaagtcggatcctgctgaaaaaggaggaggaggtctacgaaccaaacccattttctaaatatttggaagacaattcggatctgttctcagaacaactatcacaccccatggtggcgatacccgaacacgaggccctagacagcaaagaacagtag

SEQ ID NO: 125039 - DNA, 489 bp, Artificial Sequence
  Description of Artificial Sequence: Synthetic coding sequence
atgcaacagtctgaccttttcaaagctgaatacgttcttattgtagacagtgaaggagaagacgaggcggcttcacgcaaggtggaacagggccctcccggaggcattggcaccgctgctgtgcgtccaaaatctctggccatatcttccagcctggtaagcgacgtggttcgacccaagacacagggaaccgatctgaaaacctcatcccatccagagatgcttcacggcatggcaccccagcagaaacacggacagcagtacaagactaagtcttcttataaggcattcgcggctatacctactaataccctgcttttggaacaaaaggcactggatgaacccgccaagactgagtcagtgtccaaggacaatactctggagcccccagtggagacacccacgacactcccacgcgctgccggtagagagaccaaatacgcaaacctatcatctcccagctcaacagtgagcgagagtcagttgtag

SEQ ID NO: 125040 - DNA, 2208 bp, Artificial Sequence
  Description of Artificial Sequence: Synthetic coding sequence
atggctgctggaggggccgtagcggccgcacccgaatgtagacttctgccatatgcactccataagtggtcgtcattcagcagtacttatttgcccgaaaatattctggtggataaaccaaatgaccagtctagccggtggagctccgagagtaactaccctccacaatacctgattctcaaattagaacgaccggccatcgtacagaatattactttcggtaagtacgagaagacacacgtgtgcaatctcaagaaatttaaagttttcggcgggatgaatgaagagaacatgactgaattgctctcttccggcctgaaaaacgactacaacaaggagacattcaccctaaagcacaaaatagatgaacagatgttcccctgccggtttatcaagatagtgccactactgagctggggccctagttttaattttagcatatggtatgtggagctcagcggcatcgacgatcctgacatcgtccagccctgcctcaattggtactctaagtacagagagcaggaggctatccgcttgtgcctgaaacacttcaggcagcataactatactgaggcctttgagtcactgcagaagaaaaccaagatcgccctagaacatcccatgctgactgacattcacgacaaactggtcctcaagggggacttcgatgcttgtgaagaattgatcgagaaggctgtgaacgacggcctttttaaccagtatatcagccagcaggagtacaagccccgatggagccagattataccgaagtctacaaaaggggatggtgaggacaatcggcccggtatgcgggggggccatcaaatggtcatcgacgtccagaccgagaccgtctatctgttcggcggctgggacggaacccaggacttagcagacttttgggcctactctgtcaaagagaaccagtggacctgtatttcacgcgacaccgagaaggaaaacggtccctccgcccgcagttgtcacaaaatgtgcattgatatccagcgccggcagatctacactctcggcagatatttggatagctccgtccggaactcgaaatcacttaagagcgacttttatcgatacgatatcgacacaaacacttggatgctcttgagcgaagacactgccgcagatggtgggcccaagctcgtgttcgatcaccagatgtgtatggacagtgaaaaacatatgatatatacattcggaggtcgcattctgacttgcaacgggtctgtggacgactctcgcgcctctgagcctcaattttctggactttttgcttttaactgccagtgtcagacatggaaactgttgcgtgaggactcctgtaacgcaggcccggaagacattcagtccaggattgggcattgtatgttgtttcattctaagaatcgatgtttgtatgtctttgggggccagcgcagcaaaacatacctgaacgacttcttctcatacgatgtcgatagtgaccatgtggacataatctcagatggaaccaagaaggacagcgggatggtcccgatgacaggctttacccagcgcgcgactatagaccctgagttgaacgagattcacgtgctaagcgggcttagcaaggacaaagaaaagcgggaggagaacgtgaggaactctttctggatttatgatattgtaagaaattcgtggtcctgcgtctataaaaacgaccaggcagccaaggacaatcctactaagtccctgcaagaggaggaaccatgccccaggtttgcccaccaactggtctacgacgagctacacaaggttcactatttgtttggcgggaatcctgggaagtcttgcagccccaaaatgcgacttgacgacttttggtccctcaaattatgcagacctagtaaggattatttgctccgtcattgtaagtacctgatccggaaacacaggttcgaggaaaaagcccaagttgatccccttagcgccttgaagtatctccagaacgatctgtatatcaccgtggatcactcggatccagaagagactaaagagttccagctacttgcttcagccctgttcaagtctggctcggactttaccgccttaggatttagcgacgttgaccacacttatgcccagcgaacccagctgtttgacacccttgttaacttctttccagactcaatgactcctcccaagggaaatttggtggaccttattactctgtag

SEQ ID NO: 125041 - DNA, 558 bp, Artificial Sequence
  Description of Artificial Sequence: Synthetic coding sequence
atgactgggtttactcagagggctactatagatcccgaactcaatgagatccacgtgctttccgggctgtcaaaggacaaggagaaacgcgaggagaatgttaggaactctttctggatctacgatatcgtgcgtaattcttggtcgtgtgtttacaaaaacgatcaagcagccaaggataacccaacaaaaagtctgcaggaagaagagccctgcccgcgcttcgcgcaccagctcgtgtacgatgagctgcacaaagtgcactacttgtttggcggaaacccaggcaaatcttgctcgcctaagatgcgcctggacgatttctggtcacttaagctgtgccggccatctaaggattatctgcttagacattgcaaataccttataagaaagcaccgatttgaagagaaggcacaggtggatcctctgtctgctttgaaatatttgcagaacgacctgtatatcaccgttgatcactcagaccctgaggagacaaaggaggctttcctcatgtggattacaccaatgctgaaggagctcagcagcctaacaccctag

SEQ ID NO: 125042 - DNA, 3060 bp, Artificial Sequence
  Description of Artificial Sequence: Synthetic coding sequence
atgatggccgccgcggcagcagctgcagccggttcttctagcagtggagggggggggggcggcagcggcagctcaagcagcagtagcgatacttctagtactggggaggaagagcggatgcgtcggcttttccagacatgcgacggcgatggcgacggctacatctcaaggaacgacttattaatggtgtgccgacagctcaacatggaagagtctgttgccgagatcatgaatcagctgggggcagacgagaatggaaagatcagctttcaagacttcacaaggtgtcggatgcagcttgtgagagaaatccggaaggaggaagtagatctttcagccaaatcggacaactcgtgcacaaagaagctcagggatcgcattgcctcctggccaacgtcctccgataactccctgggcgctctgagcgccgctcgtgaatcctgggaatacgatagcggagcgcgcgacttgcaatctccagacgtacagagccaatccgccctgcagaagcttctggaatacgggggttcctccctccatcagcaggccgccctgcataagctactgacccagtctccacatatcgggaactcggtggggggctcctacttggagctggcgaatactctccatagtgccgctttggccagtctgaaaggcgacatcgtggagctgaacaagcggcttcagcagaccgagagggagagagatttactggagaagaaacttgccaaagctcagtgtgagcagtcacacttgatgcgcgaacacgaggacgtgcaagaacggaccactttgcgttacgaagagcgcataactgagctgcactctgtcatcgcggagctgaacaagaaaatcgaccgactgcagggtacaaccatccgggaagaagacgagtactctgagctgaggtctgaactgtctcagtcccagcacgaggtgaatgaagattcgcgatctatggaccaggatcagactagtgtatctatccctgagaaccagagtacgatggtaaccgcggatatggataactgttccgacctgaactcagagttacagagggttctaacaggattggaaaacgtcgtctgtggtagaaagaagtctagctgtagcctgtccgtcgcagaggtggataaacacatagagcagctcactaccgctagcgagcactgcgaccttgctattaagaccgtggaagagatagagggggtgctggggcgtgatttgtatcctaatctagccgaagagaggtcacggtgggagaaggagctcgcaggtctgagagaggagaacgagtcgctgaccgccatgctctgcagcaaagaagaagagctgaataggaccaaagcaacgatgaatgctatccgcgaagaacgtgaccgccttaggcgtcgagtccgggagcttcagactcgactgcagagtgttcaagccaccgggccaagctctccaggccgccttacgtcaactaaccgtcctataaacccttctaccggcgaactgtctacctcctcctcgagtaacgatattcccattgcaaagatcgccgagcgagtgaaactgtcaaaaacacgttccgaaagcagcagtagtgaccggcccgtgttaggttccgagatttcatcgatcggggtttccagcagcgttgccgagcatctagcgcattccttgcaagactgtagcaatatacaggaaattttccaaaccctttatagtcatggatccgccataagtgagtccaagatcagggaattcgaagtggagacggagcgcttaaacagccggattgaacatcttaaatctcagaacgatcttctgactattactctcgaggagtgtaaaagcaacgcagaaagaatgagcatgcttgtggggaaatacgaatccaacgccaccgccctccgcctggccctgcagtacagcgaacaatgtatagaagcttacgaactgttactggccctggccgagtctgagcaatccctgatcctgggacaatttcgtgctgctggggtgggatctagtccgggcgaccagagcggggatgaaaatatcacacagatgttgaaacgggctcacgattgccggaagacggccgaaaatgcagctaaagcactgttgatgaaattggatggctcctgcggtggcgccttcgctgttgctggctgctctgtgcagccatgggagagcctgagttctaacagccacacctcaaccacttctagcaccgctagcagctgcgatactgagtttaccaaagaggatgagcagcggctcaaagattatatccaacagctgaaaaatgaccgagcagctgtcaagctaacaatgctggagttggaaagcattcacatcgacccgctttcgtacgacgtgaagcctagaggtgatagccaaaggctggacctcgagaatgcagttctaatgcaggagctgatggccatgaaagaagagatggcggagttgaaagcacagctgtaccttctagagaaagagaaaaaagcccttgaactgaaactttcaactagggaagcacaggaacaagcctaccttgtgcacatagaacatctcaaatccgaggttgaggagcagaaggaacagcggatgcggagcttatcttctacttcatctggatcaaaggataaacccggcaaggaatgcgctgacgccgcaagtccagcactgagcttggccgagctgaggactacttgttcagagaacgaacttgccgcagagttcaccaacgcaattaggagggaaaagaaactgaaggctcgagttcaggagctggtctcagcactggaaagattaacgaagtctagcgaaatccggcatcagcagtctgccgaatttgtgaacgatttaaagcgtgcgaatagcaacctagtggcagcctacgaaaaggccaagaagaaacaccagaacaagctaaaaaaattggaatcacagatgatggccatggtggagagacatgaaacccaagtacgcatgttgaaacagcggatagctcttcttgaggaagagaatagtcgaccacacaccaatgagacctcactgtag

SEQ ID NO: 125043 - DNA, 564 bp, Artificial Sequence
  Description of Artificial Sequence: Synthetic coding sequence
atgtcaggcggaggtactgaaactccagttggttgtgaggccgcccccgggggcggttctaaaaaaagagattctctcggtacggcaggaagtgcacacctgatcattaaagacttaggagagatccacagtagactcctagaccatcggccagtgatccagggggagacgagatacttcgtgaaagagttcgaggagaaacgaggccttagagagatgcgggtgctggagaaccttaagaacatgatacatgagactaacgagcacacactgccaaagtgtcgcgataccatgcgtgactccctatctcaggtccttcaacgcctccaggccgccaatgactcggtgtgtagacttcagcagagagagcaggaacgaaaaaagattcactccgaccatttggtcgcatctgagaagcagcatatgctgcagtgggataattttatgaaggagcagcctaacaagcgcgccgaggtcgatgaggaacatagaaaggcaatggagaggcttaaggaacaatatgccgagatggagaaggatctggcaaagttcagtaccttttag

SEQ ID NO: 125044 - DNA, 372 bp, Artificial Sequence
  Description of Artificial Sequence: Synthetic coding sequence
atggagaagcgcgggttgcgcgaaatgcgcgtgcttgagaacctgaagaacatgatccatgagaccaacgaacacacactgcccaaatgcagagacaccatgcgtgattcactgagccaggtattacaacgattacaggccgctaatgatagtgtctgtaggctccagcagcgcgaacaggagagaaaaaagattcacagcgatcacctcgtggcaagcgaaaagcagcacatgcttcagtgggataactttatgaaagagcaacctaacaagcgagccgaagtggatgaggaacacagaaaagcgatggagcgcctaaaggaacaatatgccgagatggaaaaagacctggcaaaattttcgaccttttag

SEQ ID NO: 125045 - DNA, 3987 bp, Artificial Sequence
  Description of Artificial Sequence: Synthetic coding sequence
atggagtccagagatcctgcacagcccatgtcacctggcgaagcaactcaatccggggccagacctgccgacagatacggattgctgaaacatagtagagagtttttggatttcttctgggatattgctaagccggaacaggagacccggttagccgctactgaaaagctcctggagtatttacgtggaagacctaagggctccgagatgaaatacgcattgaaaaggctgatcaccgggctcggcgtgggccgggagacagcacggccttgctactcactggccctggcccaactgctccagagttttgaggatttacccctgtgcagcatcctgcaacaaattcaggagaagtatgatctgcaccaggtgaagaaggccatgctccgcccggccctctttgccaatctattcggggtactggctcttttccagtctggtaggctggtgaaggaccaggaagcccttatgaaatctgtgaaattacttcaagcgctcgcgcagtaccagaatcatctccaggaacaacccaggaaggctctcgtggacattctgagtgaggtgtcgaaggccaccctccaggaaatcctgccagaagtcctgaaagccgatctgaacatcatcttatcatcacccgaacaactggaactgttcttactggctcaacaaaaagtaccctcaaaactgaagaaactggtcgggtcagtgaacctgttcagcgatgaaaatgttccccgactcgtcaatgttttgaaaatggcggctagttcagtgaagaaggacaggaagctaccagccattgcgctagacctcctacgcctagctctgaaagaggacaaatttcccaggttttggaaagaggttgtggagcaggggctcctcaaaatgcaattctggccagcgtcatatctgtgctttcggctgctcggagccgccctacccctcttgaccaaggaacagctgcatctagtaatgcagggtgatgtgatcaggcactacggggagcatgtgtgcactgcaaagttacccaagcagttcaaatttgctccagaaatggatgattacgtcggtaccttcctggaggggtgccaggacgatccagaacgtcagttagccgtgttggtggccttctcttccgtgaccaatcagggcctgcctgtgactcctacattctggagagtcgtcaggttcctctcccccccagccttgcaaggctatgtggcatggttgagggcgatgtttctgcaacccgatttagatagcttagttgatttttctactaataatcagaagaaagcccaggactcctcactgcatatgccagagcgagctgtctttagactgcgcaagtggataatcttcaggctggtgtcaatcgtggactctcttcacttggagatggaggaggctttgacagagcaggtggccagattctgtctgttccatagcttcttcgtgacaaagaagccaacctcacaaatccctgagaccaagcatcctttcagtttcccattggaaaatcaagcaagagaggcggtgagctcagcgttcttcagcctgctgcaaacattgagcactcagtttaaacaggccccgggacagacccagggtgggcagccatggacataccacctcgttcagtttgctgacctgttactgaaccattcccataatgttacaacagttactcccttcaccgcccagcaaaggcaggcatgggatcgaatgctacagaccttgaaagaattagaggcgcactctgctgaggcccgggctgctgcattccaacatctgttgctgctggtgggaatccacctgctgaaaagtcctgcagagtcctgcgacctactcggcgatattcaaacatgcatcagaaagagtttaggcgaaaaacctagacgctctagaacaaagactatcgacccccaggaacctccttgggtggaggtgttggtggaaatcctgctggcgcttctggctcagccgagtcatctgatgcgccaggttgcacggtcagtgttcggccatatctgcagccatcttacccctcgagcactccagttgattctcgatgtgctaaaccctgaaaccagcgaagacgaaaacgaccgggtggtggtaactgatgactccgatgaaaggcggttaaagggagcagaagacaaaagcgaggagggcgaagacaaccggtcgtccgagtctgaagaagagtctgagggggaggagtcagaggaggaagaacgagatggcgacgtcgatcagggtttccgcgagcagctgatgacagtgttgcaagcaggcaaggctctgggaggcgaagactcagagaacgaggaggaactcggtgacgaagcaatgatggcccttgaccagagccttgcaagcctttttgctgaacagaaactccgcatccaggctcgtcgcgacgagaaaaataaacttcaaaaggaaaaagccctaaggcgcgattttcaaatccgagtgcttgatttggtggaggtgttggtgactaagcagcccgaaaacgccctggtcctggagctgttggaaccactactctccataataagaaggtctcttaggagctccagcagcaagcaggagcaggatctgctgcataagacagctaggattttcactcatcacctgtgtagagcccgacgctattgccacgacctgggggagagagcaggggcactgcacgcgcaagtggagaggctagtgcagcaggcaggtcggcagcctgactcaccaacggctctctatcactttaacgcctcactgtatctgcttcgcgtgctgaaaggcaatactgcggaaggctgcgttcacgagacccaggaaaaacagaaggccggtaccgaccctagccatatgcccacaggccctcaagcagcatcctgcctcgatctgaacctggtgacccgagtgtattccacagccctgagttcatttctgacaaagaggaacagcccccttacagtccccatgttcctgtccttgttctcaagacatccagtgctgtgtcaaagtctcctgcccattttagtgcagcacatcaccgggccagtacgtcccagacatcaggcttgcttgttgttgcaaaaaaccctctcaatgcgagaggtgagatcctgctttgaggaccccgagtggaagcaactcatggggcaggtgctggcaaaggttaccgaaaatttgcgagttctcggagaagctcagaccaaagcacagcaccagcaggcgctctcttctctcgaactgctgaacgtgctgttcagaacctgcaaacatgaaaagttgactctggacttaacagtcctactgggcgtgctgcagggccagcagcagtccttgcaacagggcgctcacagcactggcagttcccgccttcatgatctgtattggcaggccatgaagactcttggggtgcagcgtcccaagctggagaaaaaggatgcaaaagagatcccaagcgcgacacagtctccaatatcgaagaagcggaaaaagaagggattcctcccagaaacgaagaaaaggaagaaacgaaaatccgaagatgggactccagcagaagatggaactcctgccgccaccggtggctcacagcccccaagtatggggagaaagaaacgaaaccggaccaaagctaaggtgccggcgcaagccaacgggacacccacaacgaagagtccagctccaggagcgccaacccgctctccttcaacacccgctaagagccctaaactgcagaagaagaaccagaaaccatcacaagttaacggtgccccaggttcacctacagagcctgcaggccagaaacaacaccagaaagcactgcctaagaaaggggtcctgggaaagagtcctctgagcgcactggccaggaagaaggcacgactcagtcttgtcatcaggtctccgtctctgttgcagtccggcgcaaagaaaaaagcccaagtgaggaaggctggtaagccgtag

SEQ ID NO: 125046 - DNA, 3999 bp, Artificial Sequence
  Description of Artificial Sequence: Synthetic coding sequence
atggagtcacgggatcctgcacagccaatgtctcccggagaagccactcagtcgggggctcgacccgcggatagatacggactcttgaagcactcccgggaatttctagacttcttctgggacattgcaaaaccagagcaagagactagactcgccgccaccgagaagctgctggagtacctcaggggtagaccgaagggatcagagatgaagtatgccttgaaacggttaatcacaggtctgggggtgggtcgcgagactgcaaggccatgttattcactggcactggcccagcttctacagtccttcgaggatttaccactctgttctatcctccagcagatccaggagaaatatgatcttcaccaggtaaaaaaggccatgctcagacctgccttatttgcaaatcttttcggagttttagcccttttccagtcagggcgcctggtgaaagaccaggaagctctcatgaagtctgtgaaactactccaggccttggcccagtaccagaaccacctgcaggagcagcctagaaaggccctggtcgatattcttagcgaggtgtcaaaagctacgctgcaggaaatcttgcccgaggtgctaaaggctgacctgaacataatcctgagcagccccgagcagctggagctcttcctgttggcccagcaaaaggtacccagcaaactgaaaaaactcgtggggagtgtgaatctcttttcagacgagaacgttcctcgtcttgtcaacgtcctgaagatggccgcctcttcagtaaagaaggatcgcaagctccctgctattgctttagacctgctccggctagccctcaaagaggacaagtttcctcgcttttggaaggaagtagttgagcaaggcttgctgaaaatgcagttctggccagccagctacctttgctttaggctgctcggagccgccctccctttgttgaccaaagaacagctgcacctcgttatgcagggcgacgtgattagacactacggcgagcacgtctgcaccgccaagctcccaaagcagtttaaattcgcgcctgaaatggatgactatgtgggcactttcctcgagggatgccaagatgacccagaacgccagctggctgtgctagtggcattcagtagtgtcacgaatcagggcttgcctgtcaccccaacattttggcgcgtggtgaggttcctctcccctcccgccctgcagggctacgtcgcctggctcagggctatgtttttacagcctgatctggactcattggtggatttctccacaaataaccagaaaaaggcccaagacagctctctccacatgcccgagagagccgtctttcgcctgcgcaagtggatcatattcaggcttgtgtctatcgtcgactcgcttcacctagaaatggaagaggcattgaccgaacaggtagcacggttctgtctctttcattcattcttcgttactaaaaagccaacctcccagattcccgagaccaagcacccgtttagcttcccactcgaaaaccaggctagggaggctgtctcctcggcattttttagtctcttgcagacactctccacacagttcaaacaggccccagggcagactcaaggggggcagccttggacctaccacttggtccagttcgccgatctgttgcttaaccattctcacaacgtgactaccgtcaccccttttaccgcccagcagcgacaggcatgggaccgcatgctccagactctcaaagagctcgaggcacacagtgccgaagccagggccgccgctttccaacacctattactcctggtcggaatccacctgctgaagagcccagctgagagctgcgatctgctgggtgacatccagacttgcataagaaaatcgctcggcgaaaagcctcggcgcagccggactaagacaatcgacccacaagagcctccctgggttgaagtcctggtggaaatcctgttggccctgctagcacagccaagccacttgatgagacaagtggcaaggtccgtgtttggccacatctgctctcacctaacacccagggcactccagttgatcctcgatgtgctcaaccccgagacgtcggaagatgaaaatgacagggtggtcgtgaccgatgacagcgatgagcgacggctcaagggggcggaagacaaatcagaggaaggtgaggacaatcggagtagcgagagcgaggaggagtctgagggcgaagagagcgaagaagaagaacgtgacggagatgttgaccaaggattccgtgagcaactcatgaccgtcttacaggccggcaaggcccttgggggagaggatagcgaaaacgaagaagaacttggggacgaggctatgatggccttggaccagagcctggctagtctgtttgctgaacagaaactgagaatacaggcccgtcgagacgaaaaaaataagctccagaaggagaaagcgcttcggcgcgactttcagatacgggtccttgatctcgtggaggttctggtcactaaacaacccgaaaatgcattagtgttagagctactggagcccctcttatctattatccgccgcagcctgcgtagtagttctagcaagcaagagcaggatctgcttcataaaactgccaggatattcacacaccatctgtgtcgcgctcgccgctactgccacgacttaggagaacgggccggagcactgcacgcacaggtcgaacggttggtacaacaagctggccgacaacccgattctcctactgccctctatcactttaatgcttcactgtacctgctgagggttctgaagggaaatactgctgagggatgcgtgcatgagactcaggaaaagcaaaaggctgggactgacccttcccatatgcccactgggcctcaggccgcctcctgcttggatcttaacttggtcacccgtgtgtatagcaccgctttgagcagctttcttactaagcggaacagcccactcacggtacctatgtttttgtctctgttctcacgtcacccagtgctctgccagtccctgttgcctatcctcgtccagcatatcacaggcccggtgcgacctcgccatcaagcgtgcctgttgctccagaagaccttaagtatgcgcgaggtgaggtcttgtttcgaggatcctgaatggaaacagctgatgggacaggtgctagccaaagtgacagagaatcttagagtcttgggggaggcccaaactaaggcccagcaccagcaagccctgtcgtcactggaacttctgaacgttctgtttcgcacttgtaagcatgaaaaattgacactcgacctaaccgtcttgcttggcgtattacaggggcagcagcaatcgctgcagcagggggctcatagtaccggcagctcccggctgcacgatttgtattggcaggcaatgaagactctcggtgtccagaggcccaagctcgagaaaaaagacgccaaggagatcccttctgccacccagtcgcctatatccaagaagcgcaagaagaaaggattccttcccgagacaaagaagcgtaagaagcggaagtccgaagacggcacgccagccgaggatggcacccccgctgctaccggcggcagtcagccacctagtatggggagaaagaagcgtaataggactaaagctaaggttcctgctcaagctaacggtacacctaccactaaaagtccagccccaggagcccctacacgaagcccatcgacacctgctaaatctccgaaactgcagaaaaagaatcagaagccgagccaagtcaatggagctcctggctcaccgacggagccggcaggccagaagcagcatcagaaggccttgcccaaaaagggtgtactgggcaagagtccgctttctgccctagctaggaagaaggctcgactctccctggtgatcaggtccccctccctcttgcaatcaggcgctaagaagaaggctcagacattgcgctttaccatcagctcctcaaagaaatag

SEQ ID NO: 125047 - DNA, 1812 bp, Artificial Sequence
  Description of Artificial Sequence: Synthetic coding sequence
atggagtctcgtgaccccgcgcagcccatgtctcctggggaagccacacaaagtggggccagacccgcagacagatatggcctgctaaagcacagccgtgaatttttagacttcttctgggacattgcaaagcccgaacaggaaacccgcttggcggctacggaaaagcttcttgaatacctgaggggtagaccgaaaggatccgaaatgaaatatgcactgaaacgactaataacaggtctgggggtcgggcgggagactgcacggccttgttactccctggccctggcacagcttcttcagagctttgaggatttaccactctgttccatcctccagcagatccaagaaaagtatgatctacatcaggttaagaaagcgatgctgcggccggcactgtttgcgaacctgtttggtgttctggcactcttccaaagcgggaggcttgtgaaggaccaggaggccctcatgaagtcagttaaactcttacaggcccttgcccagtaccaaaatcacctgcaagaacagccccggaaagctctggtcgatatcctctccgaagtatctaaggctactttacaggaaatcttgcctgaggtcctgaaggccgacctgaatataatcttgtcttcgccggaacagcttgagctcttcttgctggcccaacagaaggttccatcaaagctgaaaaagctggtaggaagcgtaaatctcttctcagatgaaaacgtgcctcgactggtgaatgtgctgaagatggcggcttcgtctgtgaaaaaagatcgaaaactgccggccatcgccttagatctactccggctggccttgaaggaagacaagttcccaagattttggaaagaggttgtagaacaggggttgctcaaaatgcaattctggcccgcaagctatctatgctttaggctgctcggcgccgcactgccactgcttacaaaagaacaactgcacctggttatgcagggggatgtgatacgtcattacggagaacacgtctgtaccgccaagttacctaagcagttcaaatttgcacccgagatggacgactacgtaggaacctttctcgaaggctgccaggatgaccctgagaggcagctcgccgtcctggttgctttcagtagtgtcacaaatcagggactcccggtaacccccaccttttggagagtggtgcgtttcctgtctccacccgccctgcagggatacgtggcctggcttcgagccatgttccttcaacctgacttagacagcctggtcgactttagtaccaataaccagaaaaaggcacaggactcctccctgcacatgccggagagggccgtgttcaggctccgcaaatggataatctttcggttggtttccatcgttgacagtttgcacctcgagatggaagaggccctcactgaacaagttgcacgcttctgcctatttcattcttttttcgtgaccaagaaaccaaccagccagattcccgagactaagccgcaggagagatctgaagggcctgctcagccaccacacgctcctggagggccagaaaggccaaaattagaaaaaaaagacgcaaaagagatcccaagcgctgaagacggcaccccagcagcaactggcgggtcacagcccccttccatgggtagaaaaaagcggaatcgcaccaaggctaaggtcccagcccaggcgaacggtactcccaccaccaagtccccggcacccggcgctcctactcggtcccccagtactccggctaaaagccccaagttgcagaagaaggctcaggtgcggaaagcaggaaagccctag

SEQ ID NO: 125048 - DNA, 2487 bp, Artificial Sequence
  Description of Artificial Sequence: Synthetic coding sequence
atggccgctgaggaagcagacgtcgacatagaaggggacgtcgtggcagctgcaggggctcagccaggatcaggggagaacactgcctctgtgctgcaaaaggatcactaccttgatagcagctggcggacggagaacggattaatcccatggactctggacaacaccatatccgaggagaatcgcgcagtcattgaaaagatgcttctagaggaagagtactatctctcgaaaaagagccagcccgagaaggtgtggcttgaccagaaagaggacgataaaaagtatatgaaatcactccagaagactgccaaaatcatggtccattcaccaactaagcctgcctcttattcggttaaatggactatcgaggaaaaggaactctttgagcaaggactggcaaagttcggccgccggtggactaagatatccaagctcattggctcccggaccgtcctgcaagttaaaagctatgcccggcaatacttcaagaacaaggtgaagtgtggactggacaaggaaactccgaaccagaaaactggccacaatcttcaggtcaaaaatgaagacaagggcacgaaggcatggactccttcgtgtctaagagggagagccgacccgaacctcaacgcggtaaagatcgagaaattaagtgatgacgaggaggttgatatcacagacgaggtggatgagttaagctcgcaaaccccacaaaagaacagctctagcgatctgcttctggacttcccaaactctaagatgcatgagacaaaccagggtgaatttatcacgagtgattctcaggaggcgttattcagcaagtcctcaagggggtgtttgcaaaatgagaagcaggacgagacactctcttcctctgaaatcactttgtggacggagaagcagtctaatggagataaaaagagcatcgaactgaacgatcaaaagtttaacgagctcatcaaaaactgcaacaagcatgatggtcgcggcattatcgtagatgcgcgacaactgcccagccctgagccttgtgagatacagaagaatctcaacgataatgagatgttgttccacagttgtcagatggtagaagagagccatgaagaagaggagctaaaacctcccgagcaggaaatagagattgaccgcaacattatccaggaagaagaaaagcaggcaattccggagttcttcgagggtcgccaggccaagacccctgaaaggtacctcaagatccgcaactacattctagaccaatgggagatctgcaagcctaaatatttgaataaaacgtctgtgaggcctggtcttaaaaactgtggagatgtgaattgtattggcaggatccacacataccttgagttaatcggagccattaactttgggtgtgagcaggccgtctacaaccggccccagacagttgacaaagtgcgaatacgcgaccggaaggacgccgtcgaagcctaccagctggctcagcgcctgcagagtatgcgcacccggcgtagacgggttagagatccttggggaaattggtgcgatgcaaaggatttagagggtcagactttcgaacacctgagcgcagaggagttggctaagcgacgtgaggaggaaaaaggtcgccccgtaaagagtctgaaggtgccaaggcccacaaaaagttctttcgaccccttccagctgattccctgcaactttttcagcgaagaaaaacaggaaccctttcaagtaaaagtggccagtgaggctctcctaattatggaccttcacgcccatgtgagtatggcagaggtcataggcctgctggggggcagatattctgaagtcgacaaagtggtggaggtctgtgctgcagagccctgtaatagcctcagcactggtcttcagtgcgaaatggacccagtgtctcagacccaggcctcagagactcttgctgtacgtggcttctcagtgatcgggtggtaccactcacatccagccttcgaccctaatccctcactccgggacatcgacacccaggctaagtaccaatcctacttttctagggggggtgctaagttcatcgggatgatcgtaagtccttataatagaaataacccactcccgtactcacagataacttgtttggtgatttccgaagagatctcgcctgatgggtcgtaccggctgccctacaagtttgaagttcagcaaatgctggaggaaccacagtgggggctggtgttcgagaaaacgcggtggattattgaaaagtatcgtctgtcccatagctctgtgccaatggacaaaatcttccgccgagactccgatttaacctgcctgcagaagttgctggagtgtatgaggaaaaccctgtcgaaggttacaaactgtttcatggccgaggaattcctgacagagattgagaatttgttcctcagtaactacaagtcaaatcaagaaaatggggtcactgaggagaattgcacgaaggagttactgatgtag

SEQ ID NO: 125049 - DNA, 843 bp, Artificial Sequence
  Description of Artificial Sequence: Synthetic coding sequence
atgccaaaaaaggccaagcctactgggtccgggaaagaggaggggcccgccccatgcaaacagatgaaactggaagccgcaggtggtcctagtgccctaaactttgactctccatctagtttattcgaatctttaatcagccctatcaagactgagacctttttcaaggagttctgggaacagaagccactcttgatccagagagatgacccagctctggctacttattacggtagtctcttcaaactgaccgacttgaagtcactgtgcagcaggggaatgtattatggaagagatgtgaacgtatgtcgctgtgtcaacggcaaaaagaaggtgctgaataaagatggtaaggctcatttccttcaactacggaaagactttgaccagaagcgcgccacgatccaattccatcaaccacagagattcaaggacgagctctggcgcatccaggaaaaactggaatgctatttcgggtcactggttgggagtaatgtgtatattaccccggccggcagtcagggtcttcctccacactacgacgatgtggaagtgttcatcctgcagctcgagggggaaaaacattggcggctttaccaccccaccgtgcctctggcacgggaatactcagtggaagccgaggaaagaattgggcggcctgtccatgaattcatgctcaagccaggggatcttctttactttccccgcggcaccatccaccaggccgacacccccgccggcctggcccattctacacacgtcaccatctctacttatcagaataacgacgccggcgccagaatgcgccgatgtgatctgcgagcgatcgccccacagaagtag

SEQ ID NO: 125050 - DNA, 1398 bp, Artificial Sequence
  Description of Artificial Sequence: Synthetic coding sequence
atgcctaagaaggctaagcccacgggctccggaaaagaggagggaccagctccttgtaagcagatgaaacttgaagcagcgggagggcccagtgcgctgaactttgactccccttcctcattattcgagtcactgattagtcctatcaagaccgagacctttttcaaagaattttgggagcagaagcctctgttaatccagagggacgacccagccctggcaacatactacggaagcttgttcaaactgacggacctgaaatcgctgtgctctaggggtatgtactacggcagagacgtcaatgtatgccgctgcgtgaacgggaaaaagaaagtgctgaacaaggatggcaaggcccattttctgcagcttcgaaaggattttgaccagaaacgcgccactattcagttccaccagcctcagaggttcaaggatgaattgtggagaatccaggaaaagcttgagtgctattttggttccctcgttgggagcaatgtgtacataacaccggctgggagtcagggacttccaccacactacgatgatgttgaagtattcattctgcaattggagggcgagaaacactggcgcctctaccaccccactgtaccgctggccagggaatacagcgtggaagccgaggagaggattggaagacccgtgcacgaatttatgctgaagccaggagacctgttatattttccaaggggaacgattcatcaggccgatactcccgcgggtctcgcccattccacacatgtgacaatatccacctaccagaataacagctggggggattttctgctggatactatctctgggctggtttttgataccgctaaggaggacgtggagctcaggaccggtatccctcgacagctgctgctgcaggtagaatctacaacagttgctacccggaggcttagtgggttcctgaggacgttggccgaccgccttgaagggacgaaggaattattgagctccgatatgaaaaaggactttataatgcatcgcttgcctccttactctgccggagacggcgccgaactttccacccctgggggcaaactgccccgactcgatagcgtggttaggctgcaatttaaagaccatattgtgcttacggtactcccggatcaagatcagtccgacgaagctcaggagaagatggtgtacatctaccactcactcaaaaactccagggaaactcacatgatgggaaacgaagaggagaccgagttccacggactccggttcccgctgtctcatctcgatgctcttaaacaaatctggaactcacctgctatctcagttaaagacctgaagttgacgacagacgaagagaaggagagtctggtactgtcgctgtggactgaatgccttattcaggtggtgtag

SEQ ID NO: 125051 - DNA, 1395 bp, Artificial Sequence
  Description of Artificial Sequence: Synthetic coding sequence
atgcctaaaaaagcaaagcctacaggatctggcaaggaggaaggtccagctccctgtaagcaaatgaagctcgaggccgccgggggtccttcagccttgaactttgacagtcctagctccctgttcgaatccctaatctcccccataaaaactgagacctttttcaaagagttttgggagcagaaacctctgctaatccagagagatgaccctgctctggctacatactacggcagtctctttaagctgacagatcttaaaagtctttgcagtcggggaatgtactacggcagagacgtgaacgtgtgtcgttgcgtaaatgggaaaaagaaagttttgaacaaggacggaaaggcacattttctgcagcttcgcaaagatttcgaccaaaagagggccacaatccagtttcatcagccccagaggttcaaggatgagctctggcggatacaggaaaaactggaatgctattttggctcgcttgtgggctccaacgtctatataacccccgcaggttctcagggcctacctccgcattacgacgacgtcgaagtgtttattctgcaactggagggtgaaaagcactggagattatatcacccgaccgtgcctctggctagagaatacagcgtcgaggcagaagaacgcataggacgacctgtgcacgaattcatgctcaagcccggggacctgctctatttccccaggggcaccatacaccaggcggacacacccgctggcctcgcccactccacccatgttacgatctcaacttaccagaataacagctggggagacttccttctcgacacaatcagcggactcgtgttcgacaccgctaaagaggacgtggaactcaggactggcatcccccggcaacttctcttggtcgagtctactaccgttgcgacacggcgtctcagcggatttctgaggacactggccgacagactagaaggcactaaagagttgctctcaagcgatatgaagaaggacttcattatgcaccggctacccccctattctgccggcgacggcgccgagctcagcacccctggaggtaaacttccccgcctggacagcgtggtccggctccagttcaaggaccacatcgtgctcacagtcctgcccgatcaagatcagagcgatgaggctcaggaaaaaatggtctacatataccatagtctgaaaaactcacgagagactcacatgatgggaaatgaagaggagacagaattccacggacttcggttccctctgagtcacctagacgccctgaagcaaatttggaactctcccgccatatcagtgaaggatttgaaacttacgaccgacgaggagaaggaatccctggtactcagcttgtggacggagtgcctaattcaggtggtgtag

SEQ ID NO: 125052 - DNA, 1398 bp, Artificial Sequence
  Description of Artificial Sequence: Synthetic coding sequence
atgcccaaaaaagcgaagcctaccggctcaggcaaagaggaaggtccagctccttgcaagcagatgaaacttgaggctgcaggaggcccatctgctctcaatttcgactccccaagcagccttttcgagtcactcatctcccctataaaaacagaaaccttctttaaggagttctgggaacagaaaccactcttgatccagagggacgatccggcactcgctacttactatgggtctcttttcaaacttaccgatctgaaaagcctgtgtagccgtggcatgtactatgggcgcgatgtcaatgtgtgtcggtgcgttaacgggaaaaaaaaggtgctgaataaagatggcaaggcccacttcctccagctcaggaaggattttgaccagaagagagctactatccaattccaccagcctcaaagatttaaggatgaattgtggcgcatccaagagaaactggaatgctactttgggtctcttgtcggcagtaacgtttacattaccccagcgggatctcagggcctccctccccattacgacgatgtggaagtgtttatcctgcagctggagggtgaaaagcactggagactctaccatccgacggttcctctagctagagaatattctgtagaggccgaagaacggattggtcgacccgtacatgaattcatgttgaaacctggggaccttctgtactttccccggggaaccattcaccaggctgatacgcccgccgggttggctcactccacacacgtcacgatttctacatatcagaataacagctggggagacttcctcctagacacaatctcaggcctcgtctttgatacagccaaagaggacgttgagctgagaacggggatacctcgccagttactgctgcaggtggagtctaccacagttgcaactaggcgcctatcaggattcctgaggacattagccgacaggctggagggaactaaggaactcttatcatctgacatgaagaaggactttatcatgcatcgcctgccaccttattctgccggagatggtgctgagctctctacacctggtggtaaattgcctagactcgatagcgtggtgagacttcaattcaaagaccacatcgtgctgaccgtgctgcccgaccaggatcaatccgacgaggcccaggagaagatggtttatatctatcacagcctgaaaaatagccgagagacgcacatgatgggaaatgaggaggaaacggagtttcatgggttgcgtttccccctttctcaccttgacgcccttaagcagatttggaactctcccgccatcagtgtgaaggaccttaaactgacgacagatgaagagaaggaatcactggtcttgtcactatggacagaatgcctgattcaggtggtgtag

SEQ ID NO: 125053 - DNA, 636 bp, Artificial Sequence
  Description of Artificial Sequence: Synthetic coding sequence
atgctgctgcaggtaccgtgcaacagctggggagactttcttctggacactatcagtggactggtgttcgataccgctaaagaggacgtggaactgcgtacgggcatcccccgccaactgctgctacaggtagagagtacaacagtagccacccgccgattgtccggctttttgaggactttagccgatcgcctagaaggcactaaggagctcctcagctcggatatgaaaaaagacttcatcatgcatagactccccccttatagcgctggggacggagctgagttgagcacccccggcggtaaactgcccagactggactccgtcgtcaggcttcagtttaaagatcacattgtgctcaccgttttacctgatcaggaccaaagtgatgaggcccaagagaagatggtctacatctatcactcactcaagaacagccgcgaaacccacatgatgggaaatgaggaggaaacagagtttcatggccttaggtttcccctgagtcaccttgatgcattaaaacagatctggaacagccctgccatttcggtgaaggatctgaagctcaccaccgacgaggagaaagagtctctggtgctgtcactgtggaccgagtgccttatccaagtggtctag

SEQ ID NO: 125054 - DNA, 339 bp, Artificial Sequence
  Description of Artificial Sequence: Synthetic coding sequence
atgcctaagaaggccaaacctactggaagtggcaaggaggagggcccggcaccctgtaagcaaatgaaactggaggcagccggcgggccctccgctttgaacttcgactcccccagcagtctgttcgaatcgctcatcagccccatcaagaccgagaccttctttaaggagttttgggagcagaagccactgttgatccaacgcgatgaccccgctctagctacttattacggatctctgttcaagctgacggacttgaagtccctctgtagccggggcatgtattacggcagagacgtgaacgtctgcaggtgtgtaaacgggaagaagaaagtgtag

SEQ ID NO: 125055 - DNA, 459 bp, Artificial Sequence
  Description of Artificial Sequence: Synthetic coding sequence
atggggccgccctcactgcactctcctaccccctccctggggcccctgggggcgctggtcctgtctagtcagcatacttccccggatagctgcaaatcaccatggacactgaaggccgtccgggctgctagacaggccgcggattttactctcaaagtggaagtggaatgctctagcttacaggaagcggtgcaggcagccgaggcgggggctgacctggtgctgttggacaactttaagccagaagagttgcatccaacggccaccgtgctgaaggctcaatttccctccgtggctgtcgaggcctccggaggaataacgttagataatctcccacagttttgcggccctcatatagatgtgatctcaatgggcatgttaacacaggcagcgccagctctggatttttctctaaaacttttcgcgaaggaggtggcccctgtgcccaaaatccactag

SEQ ID NO: 125056 - DNA, 1434 bp, Artificial Sequence
  Description of Artificial Sequence: Synthetic coding sequence
atgttcccagtgttcccctgcacattgctcgcccctccctttcctgtgctcggcttggactcccggggtgtcgggggcctcatgaattcgtttccaccacctcagggacatgcccagaacccactgcaggtgggtgcagaactacagtcccggttcttcgcgagccagggttgtgctcagagccccttccaggcagcacctgcccctccccctacccctcaggccccagccgcagagccgctgcaagttgacctccttcccgtcctcgccgctgcccaggaaagcgcggccgccgcagccgcggctgctgcagccgccgccgcggtcgcggccgcaccaccggctcccgctgcagcctccaccgtcgacactgccgcactaaagcagccaccagcccccccacccccccctcctcctgtctctgcccccgcagccgaagcagctccaccagccagcgcagccacaatagccgccgctgccgccacagccgttgtcgcgccaacatcaacagtcgcagtggcccccgtggccagtgcactcgagaagaagaccaaaagtaagggaccatatatctgtgcgctgtgcgccaaggagtttaagaacggctataacctaagacgtcacgaagccattcacaccggagctaaagccggacgagtgcctagcggtgccatgaagatgcctacaatggtgccactcagtctcctgtccgtcccacagctgagcggagccggagggggggggggagaagccggagccgggggcggcgccgccgctgtggccgctggcggggtggtgaccaccaccgctagcgggaagcgtatacggaaaaatcacgcatgtgaaatgtgtggaaaagcatttcgtgatgtttatcacctgaaccggcacaagctctcgcactccgatgagaagccctatcaatgcccagtgtgccagcaacgattcaaaaggaaggatcgcatgtcataccatgtgcgtagccacgacggtgcagtccacaaaccgtacaactgttcccactgcgggaagtcgttcagtcggcctgaccacctcaacagtcacgtaaggcaggtccatagtacagagagacccttcaagtgcgagaaatgtgaagccgcatttgctaccaaagacaggctgcgcgcccacactgtcagacatgaagagaaagtcccctgccacgtgtgcggcaagatgctgtcttccgcgtatattagtgaccatatgaaggttcactctcaggggcctcatcacgtgtgcgagctctgtaacaagggcaccggcgaggtctgccccatggcagccgcagccgctgcagcggccgccgccgctgcagccgccgttgctgccccaccaactgctgtaggctccctgagcggggcggaaggggtaccagtgagctcccagcccttaccatctcagccctggtag

SEQ ID NO: 125057 - DNA, 759 bp, Artificial Sequence
  Description of Artificial Sequence: Synthetic coding sequence
atgaaaatgccaactatggtccccctctcactactatctgtgccccagctgtctggcgccggcggcggcgggggtgaagcaggggctggaggcggagcagccgccgtggctgctggaggtgtcgtcacaaccaccgcatccggcaagaggatccggaagaatcacgcttgtgagatgtgcggcaaggcctttcgagatgtgtaccatctcaataggcacaagttgagccatagtgatgagaagccataccagtgcccagtgtgtcagcagaggtttaaacgtaaagaccgaatgtcctaccacgtccgaagccatagaaggtgtgccaagccttataattgtagccattgtggaaaaagctttagccgccctgaccacctaaactcccatgtccgccaggtgcattctactgagaggcccttcaaatgtgagaagtgtgaagcggcattcgcgaccaaggatagattgcgagcccacaccgttaggcatgaggagaaggtgccctgccatgtctgcggcaagatgctgtcctcggcctacatctctgatcatatgaaggtgcacagccagggtccccatcacgtgtgtgaactctgcaacaaaggtaccggcgaagtgtgcccgatggccgcggcggccgcagccgcagctgcagctgcagcagctgcagtggccgcaccaccaaccgccgtgggtagtctcagcggtgctgagggagtaccagtgagttctcagccgctacctagccagccatggtag

SEQ ID NO: 125058 - DNA, 1365 bp, Artificial Sequence
  Description of Artificial Sequence: Synthetic coding sequence
atggaccctagcaattggagttcttttatttttcagggacatgcccagaacccactccaggtcggcgccgagctgcagtccaggttttttgcttcccagggctgcgcacaatcccccttccaggctgcccccgccccccctcccactccccaggctcccgcagccgaacccctccaagttgatctcttgccagtactggctgccgctcaagaaagtgccgctgccgctgccgctgcagctgccgcagctgccgcggttgccgcggctcctcctgccccagcggcagctagtaccgtcgacaccgccgccctcaaacaaccacccgcacctcccccacctcccccccctgtgtcagcaccagccgccgaggcagccccacccgcatccgcggcaacaatcgctgccgccgccgctacagctgttgtcgcacccacctcaacagtggccgtcgcccctgtcgccagcgcgctggaaaagaagacgaaaagtaagggtccgtacatctgcgcactgtgtgctaaggaatttaagaatggatataatctgcggcgccacgaagcaatacataccggcgctaaagctggccgcgtgccgtcaggggctatgaagatgcctaccatggtgcctctctctcttttatctgtgcctcaactgagtggcgccggggggggtgggggagaggctggagcgggcgggggggcagccgcagtggccgcgggaggagttgtgaccactactgccagtgggaagcggattaggaagaatcatgcgtgtgagatgtgcgggaaagcatttagagacgtgtatcatctgaaccggcacaagttatctcactccgacgaaaaaccctatcagtgtcccgtttgtcagcagagattcaagaggaaggacagaatgtcataccacgtccggtcccatgacggggcggtccacaaaccttataattgctctcactgcggcaagtctttcagtagacctgaccatctgaactcccatgtgcggcaggtgcacagcactgaacggcctttcaaatgcgagaagtgcgaggccgctttcgctaccaaggaccgacttcgcgcccacaccgtgcgacacgaagagaaagttccttgccatgtatgtggaaaaatgcttagcagcgcatacatttccgatcatatgaaggttcattctcagggaccgcatcacgtttgcgaactgtgcaataagggcaccggggaagtctgtccaatggctgccgccgccgctgccgccgccgctgcagcagccgctgctgtcgctgctccccccacagcagtgggctccctctccggtgctgaaggcgtccctgtaagctctcagcctctgccatctcagccatggtag

SEQ ID NO: 125059 - DNA, 2955 bp, Artificial Sequence
  Description of Artificial Sequence: Synthetic coding sequence
atgagagctcctgctagaggaacagggtgctgcggccggagcggcggacggtggctggcaggagccgcgcagccgcgatgcttatgggcaggaggcgccggacaaaggttcatggtgcctggtgggaccatgaagagtcttaagaaagacagtagattgcgaatcacccctactaggcttctggaggcaagtgagaacgtcaaggaaaagaagcgcgccaaaggtccagaacagcctacccccactatccaggaagagccagagccagtgtctaacgtgttgcagggtgatgacattctggccctggccatcaagaaggaagatctgaaagagcagcatattccacgattgaccgaaaaggaagataagagggtgattactcagaagttcatcatccgcaagctcaaacctatggaccccaggagaaaagtgtgccatttagtggcacggcccgccaacccagacgaggcaactaaaccactcgattactccggccccggagactcttttgacggatcagatcagatactgccacaccacatattgggcagcctgcaggacttcaaacggattgccctcgcccggggcaatactcagctggccgaacgtatcccaacatctccatgccttatgacactgatctcagccgaaggggaatcaaaacaaaaggcccccaaggaggagaagcggccgccctgggcgcctccaccgcagcacaactttttgaagaattggcagaggaataccgcgctccggaagaagcagcaggaggccctgtcagagcacttgaagaagcctgtttctgaacttttgatgcacacaggagaaacctataggcgcattcaggaggaacgcgaattgattgactgcactctccctacgaggagggataggaaaagttgggaaaattccggtttctggtcacgtttggaatacctgggcgacgaaatgaccggcctggtcatgactaagaccaagactcagcggggcctcatggagcctatcacccacattcgaaagccgcatagcatccgtgtcgagaccggattgcccgcccagcgggacgcctcgtaccggtacacctgggacaggagcctgttccttatttataggaggaaggagctccaaaggattatggaggagctcgatttttctcaacaggatattgacggtctcgaggtggttggtaagggctggccattcagcgcagtaacagttgaagactacactgtgttcgagcgcagtcagggctcatcaagtgaagacaccgcctacctagggactcttgcttctagctccgacgtttccatgcccattctagggccctcactactgttctgcgggaagcctgcatgctggataagaggatcgaatcctcaggataagcgacaggtcggtattgccgcccacctgacttttgagaccttagaaggagagaaaacatccagcgaactcacagtagtgaacaacgggaccgtcgccatctggtatgattggcgccggcagcatcagccagatacattccaagatcttaagaaaaatagaatgcagcgcttctattttgacaaccgcgagggagttatactgcccggggagatcaagacttttactttctttttcaaatctttaaccgccggagtttttagggaattctgggagttcagaactcatccgactctactgggcggcgccatattgcaggtgaacctccacgccgttagcctgacccaggacgtgttcgaagatgaaagaaaggtgctagagtctaagttgaccgcccacgaggctgtgactgttgtaagagaagtcctgcaggagctgctgatgggtgtcctgaccccagagcggacaccttcaccagtggacgcctacctgactgaagaagacctgttccgccacaggaatccccctctgcattatgagcaccaggtggtccagagtctgcatcaactttggaggcaatacatgacattgcccgctaaagctgaggaggcccggccaggggacaaggagcatgtgtctccaattgcgacggagaaagctagcgtgaatgcagagttgctcccgcgcttcagatcccccatttcggaaacgcaagttcctcggcccgagaatgaggcacttcgggagagcgggtcacaaaaggcaagagtggggacaaagtccccacagcggaaatcaattatggaagagatcttggtcgaggaatctccagatgtggatagtacaaagagcccatgggagcctgatggactccccttgctggaatggaacctgtgtcttgaggactttagaaaagcggtgatggtgctgccagatgagaatcaccgagaggacgccctgatgaggctgaacaaagcagccttagagttgtgccagaagccccgacccctacagtccaacctgctgcatcagatgtgcttacaactgtggagggacgtcatcgactctctcgtcggccacagcatgtggctccgctcggtcctaggactgcccgaaaaagaaacgatatatttgaacgttccagaagaacaggaccagaaatctccccccatcatggaagtgaaggtaccggtgggcaaggctgggaaagaagaaaggaaaggcgctgctcaggagaaaaagcagttaggaatcaaagataaggaggataaaaagggtgctaagctgctggggaaggaggaccgccccaactctaagaaacacaaggctaaggatgacaagaaagttataaagtctgccagccaggacagattctctttggaggaccctactcccgatatcatcctcagcagccaagaaccaattgacccgctagtgatggggaaatatactcaatccctgcactcggaagttaggggactgctcgacactctggttactgacctcatggtgcttgccgacgagttgtccccgatcaaaaacgttgaggaagccctcaggctgtgcagatag

SEQ ID NO: 125060 - DNA, 2829 bp, Artificial Sequence
  Description of Artificial Sequence: Synthetic coding sequence
atggttcctggcgggaccatgaaaagcttaaagaaggatagccgcctgcgcattacacctaccagactgctggaagcctcagagaacgtgaaggagaagaagagagccaaaggcccagaacagcctacacccactatacaggaggagcccgaaccagttagtaacgtgcttcaaggggatgatattctggccctggctataaagaaggaagatctgaaggagcagcatatcccacggttaactgaaaaggaggacaagagggtgatcacccagaagttcatcattcgaaagctcaagccaatggaccctcgccgcaaagtctgtcacctggtggcccgccctgccaaccctgatgaagccactaagccactcgactattccggccctggagattcatttgatggctccgaccagatccttccacaccacatcctggggtcactccaagattttaagcgtatagcgctggctaggggcaatacacagcttgcagagcgcatcccaacatctccgtgtctgatgacccttatctctgccgagggggagtcaaaacagaaggcccctaaggaggaaaagcggcctccatgggcgcctcctcctcagcacaacttcctaaaaaattggcagcgcaataccgctctgaggaagaaacaacaagaggccctgtccgagcatctaaaaaagccagttagcgagctactcatgcatacgggggaaacttaccgcaggattcaagaagagagggaactgatcgactgtaccctgcctaccaggcgagatagaaagtcatgggagaattctgggttctggagtagactggaatacctgggcgacgagatgactggactggtgatgaccaagacaaagactcaacgaggtctgatggagccgattacccacattagaaagccgcactcaattagggtcgagaccgggctgcctgctcagagagacgcgtcatacaggtacacatgggaccggtcgctgtttctgatctatagaagaaaggagctccagcggataatggaggaactagacttttcccaacaggatatcgacggccttgaggtggtgggtaaaggctggcctttttctgcggtcaccgttgaagattacaccgtgttcgaaagatcccaaggctcctccagcgaagatacagcttacctcgggacactggccagttcatctgacgtctctatgcccatccttggacccagcctgctgttttgcggaaagcccgcctgctggatcagaggaagtaaccctcaggacaagcgtcaagttggcattgcggctcacctgactttcgaaaccctcgagggggagaaaacaagctcggagctcactgtggtgaataatgggacggtggctatttggtacgactggcgcaggcagcaccagcctgatacttttcaagatctgaaaaaaaatcgcatgcaaagattctatttcgataatcgagagggagttatactcccaggcgaaatcaagacatttacattcttctttaaaagtctgaccgccggtgtgtttagggaattctgggaatttaggacccaccctactttgttaggcggggcgatccttcaagtaaatctacacgctgtctcattgacacaagacgtcttcgaagatgagcgaaaagtgctggagtccaaactgactgcccacgaggccgtgacagtggtcagggaggtgctgcaggaactgctgatgggcgtgctgaccccagagaggaccccttcaccagtggacgcttatctgactgaggaggatctctttcgccataggaaccccccactacattacgagcaccaagtggttcagagtctgcatcaactgtggagacagtacatgaccctcccggcgaaagccgaggaagcccgaccaggggacaaggagcatgtgtcaccaatcgctacagaaaaggcctctgtcaacgctgaacttcttcccagatttaggtctcccatctctgaaacacaagtgccccgacctgaaaacgaagcgctcagagaaagcggctctcagaaggctagggtcggaactaaatcaccccagaggaaaagcatcatggaagagattctcgtagaggagagtcccgatgttgactctaccaagagcccctgggaacctgacggactgccactgttggaatggaatctgtgcctggaggacttcaggaaagccgttatggtcctgcccgacgaaaatcatcgcgaggatgctttgatgcggctcaacaaggccgctcttgaactttgtcagaaaccacgcccactgcagtcaaatctgctgcaccagatgtgtctgcagttatggcgggacgtcattgactctctagttggccatagcatgtggctgcgttccgtgcttggtctccccgagaaagaaactatctacttaaacgtcccagaggagcaggaccagaagagtcctcccatcatggaggtgaaggtccccgtcgggaaggctggcaaggaggagcgtaagggagctgcccaggagaagaagcagctcggaattaaagataaggaagacaaaaaaggagcgaagctgctagggaaggaagacagaccaaactcaaagaagcacaaagccaaagatgacaagaaagtgataaaaagcgcttcgcaagaccggttctcccttgaagaccctacccctgacatcattctatcttcgcaggagcccatcgaccctttagtgatgggtaagtatactcagtccctgcatagtgaggtgcacccaggcagatgtgttccctgggaaaacaccatgcagggcgcctttccatccaccacccggtgtggcggttcctgcctgtag

SEQ ID NO: 125061 - DNA, 1992 bp, Artificial Sequence
  Description of Artificial Sequence: Synthetic coding sequence
aggtctaggggggctgaggccacggagagcaaactgagtggcggtttccgctggacgcagaaaacctcacctactcaaggcgattctgctatcacgcatagcttgtacagaatgatctttctgacagcgctcccactattctggatcatgatcagtgccagcagaggagggcattggggagcctggatgccctcttcgatctccgcgtttgaaggtacatgtgtgagtattccatgccgcttcgatttccctgatgaacttagaccggctgtggtgcatggggtatggtatttcaactcgccatacccaaaaaattacccacccgtggtctttaagagccgcactcaggtggtgcatgaaagttttcaaggcaggtccaggttgctgggcgacttaggattgcgcaattgtaccctccttctttccaacgtctctcccgagcttggaggcaaatactactttcggggagatcttgggggatataatcagtacactttttccgaacactctgtcttagacatcgtgaatactccaaacatcgtggttcctcccgaggtggtggcgggcaccgaagtcgaagtgagctgcatggttccagacaactgccccgagctgagacccgagctatcatggcttggtcacgaaggcctgggggaacctgccgtcctgggtagacttagggaggacgaaggaacctgggtgcaagtgtccctgctgcattttgtgcctactcgagaggccaacggccaccgtcttggctgtcaggcttcttttccaaataccactctgcagttcgaagggtatgcaagcatggacgtgaagtacccccctgtgatcgtggagatgaatagtagcgtcgaggcaattgagggatcccacgtgagtctcttgtgcggcgcagacagcaatccacccccactcctgacgtggatgcgagacggcacagtattgcgcgaagctgttgctgaaagcctcctgctggaacttgaggaggtgaccccagctgaagacggtgtttacgcatgtttggctgagaatgcctatggccaggataaccgtactgtcggtcttagtgttatgtacgcaccttggaagccaaccgttaatggtacaatggtcgccgttgaaggagaaactgtgtctatcctgtgtagcacccagtctaatccagacccaattctgaccatcttcaaggaaaagcagatcctgtctaccgttatttacgaatctgaacttcagctggaactgccggcagtttcccctgaggatgatggagaatattggtgtgtcgccgaaaaccaatacggccaaagggcaactgctttcaaccttagtgtcgaattcgcgccagtgctgctcctggagtctcactgtgctgcagcccgcgatacagtccaatgcttatgtgtcgtaaagtccaatcccgagccctcagttgcgtttgagttgcctagtagaaacgtcaccgtcaatgagagcgagcgagagtttgtgtactccgagcggtcaggtctcgtgctgactagcattctgaccctgagaggacaggcccaggcacctccgagagtcatttgtactgctcgcaatctctacggggcaaagagtctggagctgccattccagggagcacaccgccttatgtgggccaagatcggacctgtgggggccgtggttgctttcgctattcttatcgccatagtgtgttacattacccagacccgaagaaaaaagaacgtgacagaatcccctagtttttctgccggagacaacccacctgttctgttttccagcgacttccgaatatccggagcccctgagaagtatgagagcgagaggagattgggtagcgagcgtcggttgctaggattaagaggagaaccgccagaattggatctcagctacagtcacagtgatttagggaagaggcccacaaaggactcatacacccttacagaagaactggccgaatacgccgagataagagtaaagtag

SEQ ID NO: 125062 - DNA, 1749 bp, Artificial Sequence
  Description of Artificial Sequence: Synthetic coding sequence
atgatctttctcacagcattgccgctgttctggataatgattagcgcaagtaggggaggccactggggcgcttggatgccatcttccatcagcgccttcgaaggtacgtgtgtgagcatcccttgtcgcttcgactttcccgacgagctgcggcctgccgtggtccacggggtttggtacttcaactctccataccctaagaattatcccccggtggtgtttaagtcacgcacgcaagtggtgcatgagtctttccaggggagatctagactcctgggggatctcgggcttagaaattgcacactgctgctgtcaaatgtgtctcctgagctcggaggcaaatactattttcgaggggacttgggtggatataaccagtacactttctccgagcactcagtacttgatattgtgaatacacctaatatcgtggtgcctccagaggtggtggccgggacggaagttgaggtctcctgtatggtgccagacaactgtcccgagctgagacccgaactttcttggctgggccatgagggactgggggaacccgccgtactgggcaggcttagggaggatgagggcacatgggttcaggtcagtttgctccacttcgtacctacccgcgaggctaacggtcaccgccttgggtgccaggcttcttttccaaatactacgctacaattcgaaggttacgcctctatggacgtcaagtacccacctgtcatagttgaaatgaactccagcgtcgaagccattgagggctcccatgtttccttgctctgtggagcggattctaacccccctcccctgctgacttggatgagggacggcaccgtgctgcgcgaggcagtagcagagagcctccttcttgagcttgaggaggtgacgccagcagaggatggcgtgtacgcgtgtcttgctgagaatgcctatggccaggataataggaccgtgggactgagcgtcatgtatgcgccatggaaacccacagttaacggaacaatggtggcagttgaaggggaaactgtgtctattctctgtagtacccagtccaatccggatcccatcctgactatctttaaggagaaacagattctaagtacggtcatttacgaaagcgagcttcagctcgagttaccagccgtcagtcctgaggatgacggagagtactggtgcgttgccgaaaaccagtatggacagcgtgcaaccgcctttaatttaagcgtggagtttgcccccgtcctgctgctagagtctcactgcgcagccgcccgggatacagtccagtgcctttgtgtagtgaagtccaaccccgagccaagcgtggccttcgagttaccctctaggaacgttaccgtaaacgagagtgaaagagaattcgtgtatagtgagaggtcaggtctcgtgctgacttctattctgaccctgagaggccaggcacaagctccccctcgcgtaatctgtaccgcccggaacttgtatggcgcaaaatctttggaactcccattccagggtgcccacaggttaatgtgggccaagataggccccgtgggagcagtggtggccttcgctatactcattgcaatcgtttgctacattactcagacaagacgaaaaaagaatgttacagagagcccttcattcagtgctggcgacaacccaccagtgctgttcagctccgattttcgcatcagcggcgcccctgaaaaatacgagtctaaggaagtaagtacacttgagagtcactag

SEQ ID NO: 125063 - DNA, 1881 bp, Artificial Sequence
  Description of Artificial Sequence: Synthetic coding sequence
atgatctttttgaccgccctgcccctcttctggatcatgatttccgccagtcgaggcggccactggggagcttggatgccaagctctattagcgctttcgaagggacctgcgtgtccatcccttgtaggtttgacttccctgacgaactcagaccggctgtggtgcacggagtctggtacttcaattctccataccctaaaaattacccacctgtagtgttcaaaagtcgaactcaggtcgtgcatgagtcattccagggccgttcgcgcttactgggggatctaggcctgcggaactgtacactgctgctttccaacgtctccccagagctggggggtaaatactatttccggggagatctgggtggttacaaccaatacactttctccgaacatagcgtgctggacattgtgaataccccgaacatagtggtgccacctgaggtagtggccggaactgaagtcgaggtctcttgtatggtgccagataattgtcctgagctgcgccccgagctgtcctggctgggtcatgaagggttgggagagcctgccgtgctgggtcgcctgagggaagatgaaggaacctgggtgcaggtgtctttactgcacttcgttccgactagagaagctaatggccatcgcctaggctgccaggcaagctttccaaatactacactacagttcgaaggttatgcttcaatggacgtgaagtaccccccagttatcgtcgagatgaacagttctgtcgaggccatcgaaggaagtcatgttagtctgctgtgtggcgctgatagcaatccacctcctctccttacgtggatgagggacgggacagtgttgcgggaagctgtggctgagagtcttctgctggaattagaggaagttacaccagccgaagacggggtgtatgcatgtcttgcagaaaatgcttatggccaggataacaggacagtgggcttaagcgtcatgtatgcaccttggaagccgaccgtgaatggcactatggtggcggtagaaggcgaaacggtatccatattgtgcagtacccaaagtaaccctgacccaattttaactatctttaaggaaaagcagatcctaagtacggtaatttacgagagtgagctgcaacttgagttgcccgcggtatcccccgaagacgatggagaatactggtgcgtcgccgagaatcagtacggacagagggctactgcgttcaacctgtctgtggagtttgcccccgtgctcttgctggagtcccactgcgctgccgcccgtgacacagtgcagtgcctttgcgtggtcaagtcaaatccggagccctctgtggcatttgagttgccttctcggaatgtcaccgtgaacgagagcgaaagagagtttgtctattcagaaaggtcaggcctggtactcacttctatcttgacccttaggggtcaggcccaggcaccgcccagagttatttgcacagcgcgaaatctatacggggcgaaaagccttgaattacccttccagggtgcccaccgcctgatgtgggctaaaataggacctgtcggggcagtcgtggcttttgccatattgatagccatcgtttgctatattacccagaccaggcgaaaaaagaatgtaactgaaagtccttctttttcagctggagacaacccccctgttcttttctccagtgacttccgcatttccggagccccagaaaaatacgagtccgagagacgattaggaagcgagagacgcttgctgggcctgcggggagagcccccagaactggacctgtcctatagccattctgacctcggcaagcgacccaccaaggactcatataccttaacagaggaacttgccgaatatgccgaaataagggtcaagtag

SEQ ID NO: 125064 - DNA, 1806 bp, Artificial Sequence
  Description of Artificial Sequence: Synthetic coding sequence
atgccctccagcatctctgcttttgagggtacatgcgtatccattccatgtaggtttgactttccggatgagctgcgcccagcagtggtgcacggagtgtggtactttaattccccctatccgaagaactatccccccgtcgttttcaagagcagaacacaggttgtccatgaaagcttccagggcagaagccgcttgttaggtgacttggggttgcggaattgtaccctgctgctgtcaaatgtgtctccagagctggggggcaaatactactttaggggagatcttggagggtacaaccaatacacattctcagagcatagcgtgctggatatcgtcaacaccccaaatatagtcgtgccccctgaggtggtggctgggaccgaggtcgaagtgagttgtatggtcccagacaactgccccgaattgagacctgaactcagctggttagggcacgagggcctgggagagcctgcagtcctgggccggctgagggaggacgaaggtacctgggttcaagtgtctttacttcatttcgtgccaactagggaagctaacggacatagactggggtgccaggcttcatttcccaacacaaccttacagttcgaagggtacgcctctatggacgttaagtacccacccgtgatcgtagaaatgaatagcagcgtcgaggccatagagggttctcatgtctctctgttgtgcggcgcggatagcaaccccccacctctgctgacctggatgcgggacggcactgtcctgcgggaagccgtagccgagtcccttctgctggagctcgaggaagttacccccgctgaagacggcgtatacgcctgcttggctgagaacgcctacggtcaggataatcgtacggtaggcctgtccgtgatgtacgccccttggaaacccactgtgaacggcaccatggttgcagtagaaggcgaaaccgtgtcaattttatgtagcacgcagtctaaccctgacccaatactgacaatttttaaagagaaacagatcttaagcaccgtcatctacgaaagcgaacttcagttggaactcccggcagtgtcgccggaagatgacggagaatactggtgcgttgctgagaatcagtatggacagcgcgccacggcctttaatctcagcgttgagttcgcccctgttttgttgctggagtctcattgcgcggctgcccgggataccgtacagtgcctttgcgttgtcaagagtaatcccgagccctcggtggccttcgagttgccaagtcgcaacgttaccgtaaacgaatccgagcgcgagttcgtttattctgaaaggtctgggctggtgttgacgagcattttgactctgagaggtcaggctcaggctccaccccgtgtcatttgcacagctaggaatctatacggagcaaaatctctggaacttccttttcagggcgcacacagacttatgtgggctaaaattggaccagtaggcgccgtggtggcttttgcaattctaatcgctattgtctgctacatcacccaaacacggcggaaaaagaatgtgactgaaagtcccagctttagtgcaggcgacaatcctccagttcttttcagctctgactttcgaatctccggtgctccggagaaatacgagtctgagagaaggctcggatccgaacgcaggttgctcgggctgagaggcgagccacctgagctggatctgtcttactcccacagtgatctcggaaaaagacctacgaaggatagttatacactgaccgaggaattggccgaatacgcagaaattcgcgtgaagtag

SEQ ID NO: 125065 - DNA, 915 bp, Artificial Sequence
  Description of Artificial Sequence: Synthetic coding sequence
atgggtaaccatgccgggaaaagggaactaaacgcagagaaagccagcacaaacagtgagaccaatagaggtgaatctgaaaagaagagaaacctgggagaactatcccgcactacaagcgaggacaatgaggtattcggggaagctgatgctaatcaaaataacgggacatcctcccaagatacagctgtcacggactccaaacggacggctgaccccaagaatgcttggcaagacgcccaccccgccgaccccggatcacggccacacctgatccggctgtttagcagggatgcacctgggcgtgaggacaacacatttaaagacagaccatctgaatctgacgaactacagacaatccaagaggatagtgcagccactagtgagagtttagatgttatggcctcacaaaagcgcccctcccaaagacatgggagcaaatacctagccacagctagcactatggatcatgctcggcacggatttcttccaagacatagggacacaggcatcctggacagcatcggccgcttcttcgggggagacaggggagccccaaagcgtggatccgggaaagattcccatcaccctgcaaggactgctcattacggctctctgcctcagaagtctcacggaagaacccaggatgagaaccctgtggtgcatttcttcaaaaatatcgtcaccccgcgaaccccacccccgagtcaggggaaggggcgtggcctgtccctgtccaggttttcctggggcgccgaggggcagcgcccaggattcggatacggtgggcgcgcctccgactacaagtccgcccacaaaggattcaaaggcgtcgatgcgcagggcacactcagtaaaatttttaagctgggcggacgggattcacgttccgggtcacctatggcccgcagatag

SEQ ID NO: 125066 - DNA, 561 bp, Artificial Sequence
  Description of Artificial Sequence: Synthetic coding sequence
atggcttctcagaagcgtccctcacaaagacatgggtcgaagtacctcgcaacagcaagcaccatggaccatgctagacatggatttctgcccagacatcgcgacacaggtatcctggacagcattggtagatttttcggcggcgatcgtggtgcccccaaacgagggtccgggaaggtcccgtggctcaaaccaggcaggtcgcccttacccagccacgcccggtcccagcccggtctgtgtaatatgtataaagattcacatcacccagcaaggactgcgcactacggttctctgcctcagaaaagccacggccggacccaggacgaaaatccagtggtccatttcttcaaaaatatcgtaaccccgagaactcctcctcccagccaaggcaaaggagctgagggtcagcgccctggtttcggctatggggggcgggcctccgattataaatccgcacacaagggctttaaaggagtggacgcccaaggtaccctgagcaagatctttaaactgggcggtcgtgactcccgaagcgggagccccatggccaggagatag

SEQ ID NO: 125067 - DNA, 594 bp, Artificial Sequence
  Description of Artificial Sequence: Synthetic coding sequence
atggcctcacagaaaagacccagccaacgacatggtagtaaatatctggcaacggctagcactatggatcacgctcgccatgggttcctgcctcgccatcgcgataccggaatccttgatagtataggcagatttttcggtggggatcggggggctccgaagcgtgggagcggaaaggttccatggctgaagcctggtaggtctccactgccatcacatgcccggagtcaaccagggctctgcaacatgtataaggatagccatcaccctgcacgaacagctcattatggcagcctaccccagaaatcacacggtaggacgcaggacgagaaccccgtggtccatttcttcaagaacatcgtgactcctcgaacacctccaccctctcaagggaaaggtcgaggactgtccctgtcccgctttagctggggcgcggaagggcagcggcccggatttggatacggggggagagcaagcgactacaaatccgcccataaaggcttcaaaggcgtggacgctcaaggaacactttctaaaatattcaaactgggcggtagagactctagaagcggctcccccatggcgagacgctag

SEQ ID NO: 125068 - DNA, 594 bp, Artificial Sequence
  Description of Artificial Sequence: Synthetic coding sequence
atggggaatcacgccggtaaacgcgaattgaatgcggagaaagcgtccacgaattccgagaccaatcgaggagagtctgaaaagaagcgaaatctgggcgaattatctaggactacctccgaagataacgaggtatttggagaagcagatgctaaccagaacaatggaacgagctcccaggacacagccgttacagactcaaaaagaaccgctgatcccaagaatgcctggcaagatgctcacccggccgaccccggtagccgacctcacctcatacggttgttctcacgtgacgcccctggcagggaagacaatactttcaaggaccgacccagtgagtccgatgagcttcagacaatccaagaggactccgccgccaccagtgaaagcctagacgtcatggcctctcagaaacgcccatctcagagacatggcagtaaatacctcgccacagcgtctaccatggatcatgccaggcacggcttcctgccaaggcaccgcgacacgggtatcctcgactcgatcggtcggttctttggaggtgaccggggagcccctaagcggggctcaggtaaagtgagctccgaggagtag

SEQ ID NO: 125069 - DNA, 594 bp, Artificial Sequence
  Description of Artificial Sequence: Synthetic coding sequence
atgggcaatcatgcaggcaagagggagctgaacgccgaaaaagcatcaaccaacagcgagaccaacaggggggagtcagaaaaaaaacgcaatctgggggaattgagccgcaccaccagcgaagacaacgaggtatttggcgaagccgacgctaatcaaaacaacgggactagttcgcaagacacagccgtcactgactccaaacgcacggctgatccaaagaatgcttggcaggatgcacacccagctgatccggggtcaagaccccacttgattcggctgttctcccgagatgcaccgggacgggaggacaacacgtttaaagaccgcccatcggagtcagacgagctgcagacgatccaggaagacagcgcagcaacctccgagagcctggatgtcatggcaagccagaagcggccctctcagaggcatggatcaaaatatcttgcaacagcgtccaccatggatcacgccaggcacgggtttttacctaggcaccgcgacactggaattctcgattctatcggtaggttcttcggcggggatcgcggcgctccaaaacgcgggagtggcaaagttagcagtgaggagtag

SEQ ID NO: 125070 - DNA, 483 bp, Artificial Sequence
  Description of Artificial Sequence: Synthetic coding sequence
atggcctcacagaagcgcccttctcagcgacacggatctaaatacctggccacagcctcaacaatggatcacgcaaggcatggcttcttgccccggcaccgggatactggcatcttagacagtataggtagatttttcggcggtgaccggggcgccccaaaaaggggcagcggcaaggattcacatcatcccgcgcgtacagctcattacgggagtctgccgcaaaaatctcatggtcgcacacaggacgagaatcccgtcgtgcacttttttaaaaatatcgtgactcctcggacgccacccccctcccagggcaaaggtgcggaggggcagagacctggttttgggtacggggggcgggcttccgactacaagtctgctcacaaggggttcaaaggggtagatgcccagggcactctgtctaagatcttcaagctgggggggcgggacagtagatccggtagccctatggctcgccgctag

SEQ ID NO: 125071 - DNA, 516 bp, Artificial Sequence
  Description of Artificial Sequence: Synthetic coding sequence
atggcatctcagaagaggccttcccagaggcacggctcgaagtatctcgcgacagcctcaacgatggatcatgcccgccatggatttctccctagacaccgcgacacaggcattctcgattcaatcggtcgttttttcgggggtgatcggggcgctcccaagcgcggaagtggaaaggactcccaccacccggcgagaacggcccattacgggtcgttgccacagaaatcacatggtaggactcaggacgagaaccctgtcgtgcacttctttaagaatatagtgacaccccgcacaccccctccctcccagggaaagggaagaggtctctccctctcccgtttctcttggggcgctgagggtcagaggcctggatttggttatgggggccgggcttccgactacaagtctgcccataaaggctttaaaggcgtggatgcgcaaggaaccctgtcaaaaatcttcaagctgggaggtagggacagtcgtagcggatcgcccatggcccggaggtag

SEQ ID NO: 125072 - DNA, 261 bp, Artificial Sequence
  Description of Artificial Sequence: Synthetic coding sequence
atggcctcccaaaagaggcccagccagcgacatggctctaagtacttggccactgcatctactatggaccacgcccgacacgggttcctgcccagacaccgagatactggaattcttgattccatcggccggttttttgggggagatcgtggcgccccaaagagagggagcgggaaggactcccatcatcccgcccgcaccgcgcactacgggtcactcccccagaaatctcacggtagaacccaggatgaaaatccatag

SEQ ID NO: 125073 - DNA, 888 bp, Artificial Sequence
  Description of Artificial Sequence: Synthetic coding sequence
atggccagtctctcaagacccagcctccctagttgtctgtgctcattcctgctgctgttattgcttcaggtgtctagctcctacgccgggcagtttagggttatcgggcctcgccaccccatccgtgcactcgttggggacgaagtcgaactgccctgcaggatcagccccggcaaaaacgcaaccggtatggaagtgggctggtaccgaccaccattctccagggttgtgcacctgtacagaaacggcaaggaccaagatggggatcaggctccagagtatagagggaggacagaactgctcaaggatgcaattggcgagggcaaagttactctacggatcaggaacgtaagatttagcgacgaaggcgggttcacctgtttcttcagggatcattcttaccaggaggaagcagctatggaacttaaagtcgaggacccattttactgggtctctccaggcgttctggtgctactcgctgtcctccctgtcctgctccttcaaataacagtgggtctcgtgtttttgtgtctccagtatcgattacgcggcaaactgcgggcagagattgagaacctgcacaggactttcgatccacatttcctcagggtcccctgctggaagatcacgctgtttgtaattgtccctgtactcggacccctcgtcgcgttgattatttgctataattggttacacagacgattagcagggcagtttctggaagagctacgtaagtttagttcactgtgttataagcagcgcataaagagccaggaaagagagaccgaagccactcgcggcagaggcggactcttacgggatcacatccctcgcggtaaggaggagctcgagtctctcggaggcggcaaaacaccgcccgggcggtag

SEQ ID NO: 125074 - DNA, 642 bp, Artificial Sequence
  Description of Artificial Sequence: Synthetic coding sequence
atggcctctctgtcccgcccaagcttaccctcatgcctgtgtagttttttgctgctgctgctgctccaagtgagcagctcgtacgcgggtcagttccgggtgataggaccaaggcatcccattcgggccctggtcggtgacgaagttgagctgccatgcagaataagcccaggcaagaacgcaacaggcatggaggttgggtggtatcgccctcccttcagccgggtggttcatttgtatcgcaatgggaaggaccaggacggagaccaggccccagaatatcgaggacggactgaattgctgaaagatgccattggtgagggaaaggttacgctgcgaatcaggaacgtgcggttttccgacgagggcgggtttacctgctttttcagggatcacagttaccaggaagaagcagcgatggaactgaaagtggaagatcccttttactgggtgtccccaggggtgcttgttctgctcgctgtgctcccggtgctccttctgcagataacggtgggactggtgtttctgtgtctccagtatcggttgaggggcaagctccgagccgagattgaaaacttacacaggacgtttggtcagttcttggaagagctcctgttccacctcgaggctttgtccggctag

SEQ ID NO: 125075 - DNA, 396 bp, Artificial Sequence
  Description of Artificial Sequence: Synthetic coding sequence
atggcgtccttatccaggccgtctttgccctcatgcctctgctcgtttctgctgctgctgctgctgcaggtgagctcctcttatgctgacccattctattgggtgtctcctggggtgctagttctgctggccgtgctcccagtgctgctgctgcagatcaccgtaggactcatctttttgtgtctgcagtacagactccgggggaagcttagagcagaaatagaaaacctccatcgaacttttgacccccatttcctgagggtgccatgctggaagatcaccctgttcgtgattgtgcctgtcctggggccccttgtcgccctcatcatttgctataactggttgcatagaagattggcaggtcaatttttggaagagttaagaaacccattctag

SEQ ID NO: 125076 - DNA, 621 bp, Artificial Sequence
  Description of Artificial Sequence: Synthetic coding sequence
atggcttccctgtctagaccgagcctcccaagctgtctgtgttccttcttgctgctgctattactgcaggtttcaagctcttatgctggacagtttagagtgattggacctcgccaccctataagggctctcgttggggacgaggtggagctgccatgtcgaatcagccctggcaaaaacgctaccggaatggaagtaggctggtatagacccccctttagcagggtcgtgcatctctataggaatggtaaagaccaggatggagaccaagcgcctgaatatcgaggacgtaccgaactgctgaaagatgccattggggaaggcaaggtaaccctgcgcatccgcaatgtacggttcagcgacgaaggtggcttcacatgctttttcagggatcatagctaccaagaagaggctgctatggagctgaaggttgaagatcccttctattgggtgtcccctggtgtgctggtcctcttggctgtgctgccagtgctccttctccagataaccgtggggctgattttcctctgccttcagtacaggctccgaggaaagctcagggccgaaattgaaaacctgcatagaaccttcgtgttccacctggaggcgctgtctgggtag

SEQ ID NO: 125077 - DNA, 759 bp, Artificial Sequence
  Description of Artificial Sequence: Synthetic coding sequence
atggctagtctgtctagacctagcctgcctagctgcctttgttctttccttttgttactcctgcttcaggtgagtagcagctacgctgggcagtttcgagttattggccctcgacacccaatccgggcactcgtgggtgatgaagtcgagctaccctgcagaattagtcccgggaagaacgctaccggaatggaggttgggtggtacagaccaccattctctcgggtggtgcacctgtacaggaatggcaaggaccaagacggagatcaggccccagagtacagaggccgtacagagttgctgaaggacgccattggcgaggggaaggtgactctccgaattcgaaacgtccgcttttccgatgaaggtgggttcacatgtttttttcgcgaccacagctatcaggaggaagctgcgatggagctgaaagtagaagacccattctattgggtatccccaggagttctcgttttgctcgccgtgttgcctgttctgctcctgcaaataacggtagggcttatctttctgtgcctccagtacaggctgaggggcaagttacgtgcggagatagagaacttgcatcggacctttgatccacactttctgcgcgtgccatgctggaagataaccctcttcgtaattgttcccgtgttgggcccactggtggctcttatcatctgttacaactggcttcacaggaggctggccggccaatttctggaggagctcttgtttcacttggaggccctgtccgggtag

SEQ ID NO: 125078 - DNA, 516 bp, Artificial Sequence
  Description of Artificial Sequence: Synthetic coding sequence
atggccagtttatcccgaccgagtctgccaagctgcctatgttcgttcctgttgctattgctgctgcaggtctcaagttcctacgccggacagttccgcgtaatcggccccaggcatcccatccgcgccctcgtcggggacgaggtcgaactcccttgcagaatctccccaggcaaaaatgccaccggcatggaggtcggctggtatagaccccccttctcccgggtagtgcatctataccgcaatgggaaggatcaggacggggaccaggctcccgagtatcgcggacgaacggagttattgaaggatgctatcggagaggggaaagtcactcttcgcatcaggaatgtgcgtttctccgatgaagggggctttacctgcttttttcgtgaccatagttaccaggaggaggctgcaatggaactaaaggttgaggtgagccactctgtaactcaggactggctccagtggcacgaccatgggagcctgcagccccctccgccaagactgaagtag

SEQ ID NO: 125079 - DNA, 744 bp, Artificial Sequence
  Description of Artificial Sequence: Synthetic coding sequence
atggcttcgctgagtaggccaagcttgcctagctgcctgtgtagtttcctcttgctccttttacttcaagtaagtagctcctacgcagggcagttcagagtaatcgggccccgacatccaatcagggcattggtaggggacgaggtggagcttccatgccggatcagtcctggcaaaaatgcaaccggcatggaggtgggttggtacagaccccctttttcaagagttgttcacttgtaccgcaacggcaaggaccaggatggggaccaggcccccgagtaccgaggcaggaccgagctcctcaaagatgcaattggcgagggtaaagtcacattaaggattagaaatgttagatttagcgatgagggtggctttacatgcttcttccgggaccattcttaccaagaggaagccgcgatggagctgaaagtggaggaccccttctactgggtgtcaccgggggtgctggtgttgctggctgtgttgccagttctgctgctccagattacagtgggactcattttcctctgtctgcaatataggctacgggggaagctgcgggcagaaatagagaacctgcaccgaacatttgacccccacttccttcgagtgccttgctggaagattactttgtttgttattgtccctgtgctgggcccactggtggctctgattatctgttacaattggctacaccggaggctggccgggcagttccttgaggaactgcggaatcctttttag

SEQ ID NO: 125080 - DNA, 396 bp, Artificial Sequence
  Description of Artificial Sequence: Synthetic coding sequence
atggccagtctctccagacccagtctaccctcctgcctctgctccttcctgcttctgcttctgctacaggtcagttcgtcttatgccgacccgttctattgggttagtccaggcgtgctggtgcttctagctgtgctgcctgttcttctattacaaattactgtgggactggtgttcctctgtctgcaataccgccttcgcggaaagcttcgggcagagattgaaaatctgcatcgcacatttgatccccacttcctcagagttccctgttggaaaataaccctgttcgtgatcgtgccggtcctgggcccactcgtggccctgatcatatgttacaattggctgcatcgccgactggccggccagttcttagaagaactcaggaacccgttttag

SEQ ID NO: 125081 - DNA, 744 bp, Artificial Sequence
  Description of Artificial Sequence: Synthetic coding sequence
atggcatctctgagcagacccagccttcccagctgtctgtgctctttcttactgctgctcctcctccaggtaagtagttcttacgctgggcagtttcgggtgatcggcccccgacacccaatcagagccctcgtcggagacgaggtggaactgccctgccgaatatcgcctggtaagaacgctactggcatggaagtggggtggtataggcctccgttctcccgagtggtacacctgtatcgcaacgggaaagatcaggacggagatcaagcaccggagtaccgcgggcgaacggagctactgaaggacgccatcggggagggcaaggtgacactcaggataaggaatgtgagattctcagacgaaggaggattcacctgcttctttcgggaccacagttaccaagaggaggctgctatggagttgaaggtggaggacccattctactgggtatcccccggcgtcctcgtgcttctcgctgttctccctgttttgctgctgcagatcacagtgggactcgtttttctttgtctgcagtaccgattgagaggaaaactgagggccgaaattgagaatctgcaccgtacgttcgatccgcactttctgcgggtgccttgctggaaaattaccctttttgtaattgtgcccgttcttggccctctcgttgcattaattatctgttataactggctccataggaggctcgccggccagttcttagaggaactgagaaacccgttttag

SEQ ID NO: 125082 - DNA, 744 bp, Artificial Sequence
  Description of Artificial Sequence: Synthetic coding sequence
atggctagcctgagcagaccctcacttccctcctgtctgtgcagctttctgctgctgttgctcttgcaggtgagttcttcctacgcaggacagtttagagtcatcggcccacgccaccctattcgggctttggtgggggatgaggtagagttgccttgcagaatctctcccggaaagaacgctacaggtatggaagtggggtggtacaggccgccctttagccgcgtggtgcacctgtaccgcaatggtaaggaccaggacggggaccaagccccagaatatagggggcgcaccgaactgctcaaagatgcaatcggcgaagggaaggtgaccctgcgtattcgaaatgtgcggttctctgatgagggtgggtttacatgtttcttccgggatcatagttaccaggaggaggctgctatggaacttaaggtggaggatcctttttactgggtgagccctggggtactcgttttactcgcagtcctgcctgtccttctgctgcagattaccgtcggcctagtgttcctgtgcctgcaatacagacttagagggaagctcagggccgaaattgagaacttgcatcgcaccttcgatcctcacttcttacgggtgccatgttggaagatcacccttttcgttatcgtccccgtgttgggacctctggtggcgttgatcatttgttacaattggctgcacagaaggctagccgggcagttccttgaggaattacgcaacccattctag

SEQ ID NO: 125083 - DNA, 690 bp, Artificial Sequence
  Description of Artificial Sequence: Synthetic coding sequence
atggctagcctgagtcgcccctccctgccaagctgtttgtgtagcttcctgctgctgctactgctgcaggtgagcagcagttacgcaggtcagtttagggttattggccctaggcatcctatccgagcgctcgtgggtgacgaagtggagctcccctgtagaatctctcctgggaagaatgccactggaatggaggtcgggtggtataggcccccgttcagtcgagttgtgcatctttacagaaacggcaaggaccaagatggagaccaggcaccagagtatcgggggcgtacagagctcctaaaggacgccattggagagggcaaggtcactttacgaatcagaaatgtcagattttcagatgagggaggatttacgtgctttttccgcgaccactcctaccaagaggaggccgcaatggaactgaaagttgaggatcctttttactgggttagcccgggcgtccttgtccttttggcggtactgcccgtgttgttgcttcagattaccgtggggctggtcttcctctgtcttcagtatagactccgcggtaagctgcgggcggagatcgaaaatttacaccgtactttcgagtctttcggggtcctgggaccacaggtaaaagaacccaaaaagaccggacaatttctggaggagctgctgtttcatcttgaggcactttcagggtag

SEQ ID NO: 125084 - DNA, 642 bp, Artificial Sequence
  Description of Artificial Sequence: Synthetic coding sequence
atggcttccctctctagaccatccctaccgtcttgtctgtgttcctttttactgttgttgctgttgcaggtcagctcctcttacgccggacagttcagagtcatcggacccaggcatcccattcgcgccctggtaggagacgaggtggaactgccctgtaggatctcccctggaaaaaatgccacagggatggaggttgggtggtaccgacctcctttttcacgcgtagtgcacctgtacagaaatgggaaggaccaagatggagatcaggctccagaatataggggcaggactgagctcctgaaggacgccatcggagagggcaaggtaaccttaaggatcagaaatgtcaggtttagcgatgaaggagggttcacatgtttttttcgggatcactcctaccaagaggaggccgcgatggagctgaaggtggaggatccattctactgggtctcccctggagttcttgttcttttagccgttctgcctgtgttgctcttgcagatcacggtcgggctgatttttctgtgccttcaataccgactgcgcggtaaactccgcgcagagattgaaaatttgcacagaaccttcgggcagttccttgaagagcttctgtttcacctggaagctctgagcggatag

SEQ ID NO: 125085 - DNA, 675 bp, Artificial Sequence
  Description of Artificial Sequence: Synthetic coding sequence
atggctagtctgagcagaccgagtctgccaagttgcctatgctcatttctcctcctgttgctcctccaggtcagctcctcctacgcggggcagttccgggtgataggtccccggcaccccattagagctctggtcggggatgaggttgaattgccttgccggatatcgcccggcaagaatgccacagggatggaggtgggatggtacaggcctccgttctctcgggttgtccacctgtacaggaatggaaaggaccaggatggcgaccaggcccctgaataccgtggacgtacagaattacttaaggacgcaattggggaagggaaggttacgctgcgaatccgtaatgtccgtttttctgatgagggcggttttacatgttttttccgggaccactcttaccaggaagaggctgcgatggagctgaaggtagaggaccctttctattgggtctctcctggggttctggtcctactcgctgtcctgcccgtcctcctgctgcagataactgtgggactaatcttcttgtgcctccagtacaggcttcgagggaaactcagggctgagatcgaaaacctacacaggacctttgaatccttcggagtgctgggaccccaagtgaaggagccgaaaaagacaggacaatttctcgaagagcttcggaaccccttctag

SEQ ID NO: 125086 - DNA, 675 bp, Artificial Sequence
  Description of Artificial Sequence: Synthetic coding sequence
atggcctcgctatcacgtcccagcctccccagctgcctctgtagtttcctgctgcttctcctgcttcaggtgtcttcttcctacgctggccagttccgtgtgatcggaccgaggcaccctattcgggccttggtcggtgacgaggtggagttaccttgtcggatttctcccggcaagaatgcaactggaatggaggttggatggtataggccccctttctccagggttgtccacctgtatcggaacggcaaggatcaggatggtgatcaggcccctgaatatagagggaggactgagttactgaaggacgccatcggcgaaggcaaagtgacactgaggatccgaaacgtgcggttcagcgacgaaggtgggttcacatgcttcttccgggatcactcctaccaagaggaggctgcgatggagttaaaagtggaggacccattctattgggtaagccccggggtgctggttctcctggcggttctgcccgtgctgcttctacagatcaccttgggcttagtgtttttgtgcttgcagtaccggctgcggggcaagctgcgcgccgagatcgaaaacctccaccgaacatttgagtcatttggggtgctgggacctcaagtaaaggaaccaaagaaaacaggccaatttctagaggaactaaggaacccattttag

SEQ ID NO: 125087 - DNA, 690 bp, Artificial Sequence
  Description of Artificial Sequence: Synthetic coding sequence
atggcaagcctcagccgaccctccctcccttcatgtctgtgcagttttctgttgcttctgctgctgcaggtttcatcatcctacgccggacaattccgcgtgatcggtcctcgccaccctatcagggcactcgtcggagacgaagttgaactgccatgtcgaatcagccctggaaagaacgccactggtatggaggttggctggtatagacccccgttctccagagtggtgcacctttaccgaaacggaaaagaccaggacggggaccaggctcctgaatatcgcggacggactgagctcctaaaggacgcaattggggagggcaaagtgacactcagaatcaggaacgttagattcagcgatgaaggcggtttcacatgtttttttcgcgatcactcctaccaggaggaagccgcaatggagctgaaagttgaggacccattctactgggtgtctcctggggtgcttgttttactcgccgtcctgcccgtgctcctgctgcaaatcaccgtggggctggtgttcctgtgtctacagtaccgcctgcgtggcaagcttagagctgagattgaaaacttacatagaacatttgagtcattcggcgtgctgggtccgcaggtcaaagagcctaagaagaccggacaattcctggaggagttgctcttccacctggaagcactgagcgggtag

SEQ ID NO: 125088 - DNA, 642 bp, Artificial Sequence
  Description of Artificial Sequence: Synthetic coding sequence
atggcttccctgtccagacctagtttgccctcatgcctgtgctcttttctattgctgcttctgcttcaggtctcttctagctacgctgggcagttcagagtgatcggtccgagacatccgatccgtgccctagttggcgacgaagttgagctgccctgtcgaatttctcccggcaagaacgcgaccgggatggaagtgggatggtacagaccaccattttcaagggtggtccacttataccgcaacgggaaggatcaggatggggatcaagccccagaataccgcgggcggactgaactgctgaaagacgccatcggcgaaggcaaggtgaccctgcgcattcggaatgtgcgcttcagcgacgagggcgggttcacgtgttttttccgcgaccattcttatcaggaggaagcggccatggagttgaaggtggaagacccattctattgggtgtcacctggtgttctcgtactcctagccgtcctgccagtcctgctgctgcagatcacagtgggattagtcttcctatgtctgcagtataggctccgagggaaactgcgcgctgagattgaaaatcttcataggacctttggtcagtttctggaggagctgctgtttcatctggaagcgctctcaggctag

SEQ ID NO: 125089 - DNA, 540 bp, Artificial Sequence
  Description of Artificial Sequence: Synthetic coding sequence
taacagtttcgggtaataggcccccggcaccctattcgcgctttggtcggggacgaagtcgagttaccttgtcggatttcccctggaaagaatgcaacaggtatggaggtgggatggtatcggcccccattttcgcgggttgtgcacctgtacaggaacggaaaggatcaagacggagatcaagctcccgagtatcgcggtaggaccgagctgcttaaagatgctattggggaggggaaggtgaccttacggattcgaaacgtccgattcagcgacgagggcggctttacatgctttttcagagaccactcatatcaggaggaggcagcaatggaattaaaggttgaggacccattctactgggtgtctcctggcgtcttggttctactggccgtactccccgtgctcctgttgcagattaccgtaggcctcgtgtttttgtgtctgcaataccggctacgggggaaactacgggccgaaattgagaacttacatcgtacttttggtcaatttctggaggagttaaggaacccattctag

SEQ ID NO: 125090 - DNA, 396 bp, Artificial Sequence
  Description of Artificial Sequence: Synthetic coding sequence
atggccagtctaagtcgccctagccttccttcctgtctgtgctctttcctcctcctccttcttctacaggtgtctagttcgtacgcagaccccttctattgggtgtctcccggtgtgcttgtgctgcttgcagttttacctgtgctgctgctgcagattacagtgggactagtgtttctctgtctgcaataccgattgagaggcaaactacgcgcggagatcgaaaatctgcaccgcactttcgatccacattttttgcgcgtgccatgctggaaaatcacattgttcgtcatagtccccgtgctcggacctttggtggcgcttatcatatgttataactggctccacagacgcctggcaggacagtttttggaggagctgaggaacccattctag

SEQ ID NO: 125091 - DNA, 615 bp, Artificial Sequence
  Description of Artificial Sequence: Synthetic coding sequence
agcttaagtaggccatcactgcccagctgcctgtgctccttccttttgctcttattgcttcaggtcagttccagctacgcagggcagtttagggttatcgggccacgacaccctataagggcccttgtaggcgatgaggttgaattaccatgccgcatttcacccgggaaaaacgctacaggcatggaggttgggtggtatagacccccgttttcccgcgttgtgcatttatatcgcaatggaaaggaccaagatggtgaccaggccccggaatataggggccggacagagctgttgaaggatgccattggtgaggggaaggtcactctaagaatccggaacgtccggttctctgatgagggcggttttacctgtttttttagggaccattcatatcaagaggaagctgcaatggagctcaaagtggaggatccattctattgggtgagtcctggagtgctggtgctactagctgtactccccgtgctgctcctccagatcacagttggactggttttcctgtgcctacagtacaggctgcgcggaaagctgcgggctgagattgagaatctgcatagaacttttgtgtttcacctcgaagctctgtctggctag

SEQ ID NO: 125092 - DNA, 396 bp, Artificial Sequence
  Description of Artificial Sequence: Synthetic coding sequence
atggcctctctctccagacccagtctgccctcctgcctgtgttcattcctgctactcctgctgctgcaggtctccagttcctacgccgacccattctattgggtgtcccccggcgtgttggtcctgctcgcagttctgccagtgctgcttctccagattacactaggcttggtattcctatgtcttcagtaccgtctccgcggcaagcttcgagccgaaattgagaacctgcaccggacattcgaccctcattttctgagggtcccatgttggaagatcactctgtttgttatagtacctgtgctcggacctctggtggccctgattatttgttacaactggttgcacaggaggttggcaggtcaattccttgaggagctgcgaaatcccttttag

SEQ ID NO: 125093 - DNA, 675 bp, Artificial Sequence
  Description of Artificial Sequence: Synthetic coding sequence
atggcctctctatctagaccaagcctgccctcatgtttatgctcattcctccttctgttactactccaggtttcgtcctcgtatgccggtcagttccgcgtgattggcccaaggcatccgataagagcgttagtcggagatgaggtggagctgccctgtcgcatctcccccgggaagaatgccaccggcatggaagtcggttggtatcgtccccctttctcccgggtagtccacctgtaccgcaacggtaaggatcaagatggggatcaagcccccgaatatagaggacgtacagaattgctgaaggatgctatcggggagggcaaggtaaccctgagaatcaggaatgtgaggttcagcgacgaagggggatttacatgctttttcagagaccactcttatcaggaggaagcggctatggaattaaaagtggaagatccattctactgggttagtcccggagtacttgtcctgttagccgtgttgccagtgctcctgctccagattacagtgggcttagtcttcctgtgcctccagtatagactgaggggtaagttgagagctgaaatcgaaaaccttcatcgcacatttgagagcttcggcgtgctagggccccaagtgaaggagccgaagaaaaccggtcaatttctcgaagaattgaggaaccctttctag

SEQ ID NO: 125094 - DNA, 675 bp, Artificial Sequence
  Description of Artificial Sequence: Synthetic coding sequence
atggcttcactatctcgtccctctttgccttcttgtctatgttccttcttgcttctgctgctgctccaggtgagttcgtcctatgctggccaatttagagtgataggccctaggcaccctatccgggcacttgtgggtgatgaggtggagctgccttgtcgcataagccctggcaagaatgctaccggaatggaggtagggtggtacaggcctcccttctctcgtgtggtccacctctaccgcaacggcaaggaccaggacggcgatcaggccccagagtatcgtggcagaacggaactgctgaaagacgcaataggggagggcaaggtgaccttaaggattcgaaatgtcaggttctctgacgagggcggctttacatgcttttttcgggatcactcttatcaagaggaggcggctatggaactgaaagtggaagacccattttactgggtatcaccaggagtgctcgtcttgctggctgtcctgccagtcctgctgttacaaatcacagtaggcctggtcttcctttgcctgcagtacaggttgcgcggaaagctaagggctgagattgagaacctgcatcggacctttgagtcctttggagtgttgggccctcaggtcaaagagcctaagaaaactggccagtttcttgaggagctccggaacccgttctag

SEQ ID NO: 125095 - DNA, 675 bp, Artificial Sequence
  Description of Artificial Sequence: Synthetic coding sequence
atggcatccttgtcacgccccagccttccatcttgcttgtgtagctttctcctgttgctgcttctccaggtctccagctcatatgctggacagttccgcgtgatcggaccacgtcatccaatcagggcgcttgtgggcgacgaggtagaactgccttgtcggattagcccgggcaagaatgctaccggaatggaagttggctggtatagacctccctttagtagggtggtccacctgtatcggaacgggaaagatcaggacggtgaccaggcaccagaatatagagggcgaaccgagctgctgaaagatgccatcggggagggtaaagtaacacttcgaattcgaaacgtgagattcagtgacgagggtggcttcacatgtttcttccgggatcattcctaccaggaagaagccgccatggaactcaaggtggaggaccccttctactgggtctccccaggagtgctggtgttactggccgtacttccggtgctgctgttacagattactgtcggactggtgtttttgtgtcttcagtaccgcctgagagggaagctcagggccgagatagagaacctgcacagaacatttgaatcattcggtgtgctgggccctcaagtgaaggagccgaaaaaaacggggcagttcctggaggagctgaggaacccattttag

SEQ ID NO: 125096 - DNA, 759 bp, Artificial Sequence
  Description of Artificial Sequence: Synthetic coding sequence
atggcaagcctttcccgcccatctctgcctagctgtctttgttcttttctgcttctcttactcctgcaggtaagctccagttacgctggacagttccgcgtcattggtccccggcatcctatccgggccttggttggggatgaggtcgaactcccatgtaggatatccccaggaaagaatgcaaccggcatggaagtaggatggtaccgaccaccattctcacgagtagttcatctctacaggaatggcaaggaccaggatggcgaccaggctcccgagtacagagggagaacagaattgttaaaggacgctatcggcgaaggaaaggtcaccctgagaattcggaatgttcgatttagtgacgaaggtggcttcacctgcttcttccgagatcacagctatcaggaggaagctgccatggagctgaaggtggaggacccgttttactgggtctcacccggtgtgctcgtgctgctggctgtgctgccagtgcttttgttacagataaccgttggactcgtcttcttgtgtctccagtatagactgcgcggtaagttacgggcagaaattgagaatcttcatagaacattcgacccccattttctcagagtgccgtgttggaaaattacactcttcgtgatcgtgcccgtgttgggcccactcgttgcgttgatcatttgctataattggttacatagaagactggctggacagtttttagaggaattgctttttcacctggaagcgttgtcaggttag

SEQ ID NO: 125097 - DNA, 744 bp, Artificial Sequence
  Description of Artificial Sequence: Synthetic coding sequence
atggcttccctaagtcgtccttccctcccttcttgtctgtgcagcttcctcctgcttttactgctccaggtgagtagctcgtatgctggacagttcagagtgataggcccacggcacccaatccgcgccttggttggagacgaagttgaacttccttgccggatcagtccaggcaaaaatgcaacaggcatggaagtgggttggtatcggcctccattctctagggtagttcatctttataggaacgggaaggatcaggatggagatcaggcccccgagtatcgagggcgaacagaattactgaaggacgccatcggcgagggaaaggtgaccttaaggatccgcaatgtgcgcttctcagacgaggggggcttcacctgcttcttccgcgatcattcgtatcaagaggaggctgcaatggaactaaaggtggaggatccattctactgggtgtccccaggggtcctcgtgctcttggctgttttgcctgtactgttgctgcagatcacagtgggactcgtgtttctctgtctccagtaccggctgagggggaaacttagagccgagattgagaatcttcataggacttttgacccccattttctgagggtcccatgttggaaaatcaccttgttcgttattgttccggtgctggggcctctcgtggccctcattatttgttacaattggttgcatcgacggctcgctggtcagtttcttgaggaactccggaatcctttctag

SEQ ID NO: 125098 - DNA, 540 bp, Artificial Sequence
  Description of Artificial Sequence: Synthetic coding sequence
tgacaattcagagtgattggaccaagacaccctattcgcgccctagtgggggacgaagtagagctgccatgtagaatatcaccaggtaagaacgcgacggggatggaggtcggatggtaccgccccccgttttcacgcgttgtccacctttaccgaaatgggaaggatcaggacggcgaccaggctcctgagtatagaggaaggaccgagctcctgaaagacgccatcggtgaaggtaaagtaaccctgcgaatccgcaatgtacgcttctccgatgaaggcggattcacgtgcttcttcagagaccacagctaccaggaggaagctgcgatggaactcaaggtggaagaccccttctattgggtttcacctggcgtactggtgctactggctgtgttacccgtcctgctgctccagataacagtcgggctcgtctttttgtgtcttcagtacagactgcgggggaaactacgtgccgaaatagagaacctgcaccgcaccttcggccagttcctcgaggaactgagaaatccattttag

SEQ ID NO: 125099 - DNA, 540 bp, Artificial Sequence
  Description of Artificial Sequence: Synthetic coding sequence
tgacaatttcgcgtgatcgggcctcgccaccctattagagcacttgtgggcgacgaggtggagctgccatgccgcatatcacccggaaagaatgcgaccgggatggaggtcggttggtacagaccaccattctcccgggtcgtccacttgtatagaaatgggaaggaccaggacggtgatcaggcacctgagtaccgaggtcgcactgagctgctgaaagatgctatcggagaggggaaggtcacccttagaatcaggaacgtgcgcttctcagacgagggggggttcacatgtttctttagggatcacagttaccaggaggaggccgcaatggagctcaaagttgaggatccgttctactgggtgagcccaggagtcctcgttctcctggcagtgcttcctgttctgttgcttcagatcactgtcgggttggtgtttttatgtctacagtaccggttgcgtgggaagttacgcgctgaaatcgagaacctccatcgcaccttcgggcagtttctggaagaactgcgaaatcctttttag

SEQ ID NO: 125100 - DNA, 759 bp, Artificial Sequence
  Description of Artificial Sequence: Synthetic coding sequence
atggcctccctcagtaggccgagccttccgtcctgcctgtgcagtttccttctgctgctgctgctgcaggtttctagttcctatgccgggcagttccgggtcattggaccacggcatccaatccgcgcactggtgggcgacgaggtggagcttccctgccggatctcccccggcaagaatgcaaccggcatggaggtgggctggtataggccaccattctctcgggttgtgcacctctacagaaatgggaaggaccaagacggcgatcaagctcccgaatataggggaaggacggagctgcttaaggatgcgattggtgaaggcaaggttaccctacggattcggaacgtccgcttctctgacgaaggaggcttcacatgctttttccgagaccacagctatcaggaggaagccgcaatggagctgaaagtcgaggatccgttctactgggtgtccccaggagtactggttcttctggcagttcttcccgttttgttgctgcaaatcacagtgggacttgtattcttgtgtctacagtatagacttagggggaaactccgagcggagatcgagaacctgcaccgtacattcgaccctcactttctcagggtgccatgctggaaaatcactttgttcgtaatcgtgcctgtattaggcccgttggtggcccttatcatatgctacaattggctccaccgccgcttggcaggtcagtttctagaggaattgctgtttcacttggaggctctcagcggctag

SEQ ID NO: 125101 - DNA, 690 bp, Artificial Sequence
  Description of Artificial Sequence: Synthetic coding sequence
atggcatcactgagcaggcccagcttgccaagttgcctgtgttctttccttctgcttctgctcctgcaggtcagcagcagttatgctgggcagttccgtgtaatcgggcctagacacccaatccgagccctcgtcggggacgaggtggaacttccctgtagaatctccccaggaaaaaacgccactggtatggaagtggggtggtaccgcccaccttttagccgcgtggtccatctgtataggaacggcaaggaccaggacggcgaccaggctcctgagtacagaggacgcacagaactgctgaaagacgccatcggggaggggaaggtcacattacgtattaggaacgtacggtttagtgatgaaggtggattcacatgttttttcagggaccacagctaccaggaggaggctgcgatggaactgaaagtggaggatcccttctactgggtgtccccaggggtgctggtcctcctcgccgtgctcccagtgcttctgctgcagattacagtggggttggtattcctctgtctgcaatacaggctgcgcggcaagctgagagctgaaatcgagaatttgcacaggacctttgagagcttcggtgtcctaggcccacaggtgaaagagcccaaaaaaactggacagtttctggaagaactcctgttccatctggaagccctctccgggtag

SEQ ID NO: 125102 - DNA, 888 bp, Artificial Sequence
  Description of Artificial Sequence: Synthetic coding sequence
atggcctcactttctagaccttcactgccaagctgtctatgttccttcttgctgctgctgttactccaggtttctagctcatatgctggacaatttagggttattggtccgcgacaccccatccgcgctctagtgggggacgaagtggaactgccttgtaggatatcccccggaaagaacgcaacgggcatggaagtaggctggtatcgaccgcctttttcccgggttgtccacctgtataggaatggtaaggaccaagatggcgatcaggcccctgagtacaggggcaggaccgagctactgaaggacgcgattggcgaaggcaaggtgactctccgaatccgaaacgtccgtttttccgatgaggggggttttacttgcttttttcgcgatcacagctaccaggaggaggccgcaatggagctcaaggtagaggatccattttactgggtgtcacccggagtacttgttctcctggccgtactcccggtgctgctcctgcagatcaccgttgggttagtcttcctttgtctgcagtatcggctgagaggtaagttgagagctgagattgagaacctccaccggactttcgatccacacttcctgagggtcccatgctggaagattacattgtttgtcatcgtgcctgttcttggtccactagtcgccctaatcatatgttacaattggttacaccggcgtctggctggccaattcctggaggaactcagaaaattttcttccctgtgctataagcagagaattaaaagtcaggagcgggagactgaggccactaggggaagaggcggactccttagagatcacatcccacgagggaaagaagaactggagagtctgggcggagggaagacaccccctggccggtag

SEQ ID NO: 125103 - DNA, 642 bp, Artificial Sequence
  Description of Artificial Sequence: Synthetic coding sequence
atggcttctctgagtcggccgagcctgccgagctgcctgtgctccttccttctcctccttctcctgcaagtgtcctcatcatacgcagggcagttccgagtgatcggcccgcggcacccgataagagctctcgtgggcgacgaagtagaattgccctgccgcatcagcccaggaaaaaatgctactggcatggaagtaggctggtatcgcccaccatttagtagagttgtccacctatacaggaatggcaaggaccaggacggagaccaggccccagaataccgcggaaggactgaactgttaaaggatgctattggcgaaggtaaggttactctccgaattaggaacgtaaggttctccgacgaggggggattcacctgttttttccgagaccactcctaccaggaagaggccgccatggaactgaaagtcgaggatccattctattgggtgtctccaggcgtccttgttctgttagccgtgctgcccgtgctgcttctgcaaattacagtggggctggtattcctgtgtctccagtaccgattgcgaggaaagcttagagccgagatcgagaatctccatcgaacctttgggcagttcctggaggaactgctcttccatcttgaggctctctccggctag

SEQ ID NO: 125104 - DNA, 759 bp, Artificial Sequence
  Description of Artificial Sequence: Synthetic coding sequence
atggcttcactgagtcggccctcgctgccctcctgcctgtgtagttttcttttgctcctgctcctgcaagtgagttcaagctacgccggtcagtttcgtgttatcggccccaggcatccaatcagagccctcgtgggagatgaagttgaactcccttgcaggatctcccctggtaagaacgcaacaggcatggaagtgggctggtatcggcccccattttcccgggttgtgcacctgtaccgtaatggaaaggatcaggatggagaccaggccccggaatacaggggtcgtacggagctgcttaaggacgcaataggcgagggcaaggtaacactgcggattaggaacgtgaggttcagcgatgagggagggttcacctgcttctttcgcgaccactcctaccaggaggaagctgccatggaacttaaggtggaagaccctttctactgggtgagcccaggtgtcctcgttctgctcgcagtgctgcctgtcctgctactgcaaattactgttggtttagtgttcctgtgccttcaatatagactccgcggcaaattgagagctgagattgagaaccttcacagaacttttgacccgcacttcctcagagtgccttgctggaaaatcacgctcttcgtgatcgttccggtcctcggtcccttggtggccctaatcatatgctacaactggctgcatcggcgactggctgggcagttcctcgaagaacttctttttcatctggaggcactgagcgggtag

SEQ ID NO: 125105 - DNA, 540 bp, Artificial Sequence
  Description of Artificial Sequence: Synthetic coding sequence
tgacagttccgcgttattggacccaggcatcccattcgggcccttgttggggatgaagtggagttgccctgcagaatcagccctggaaaaaacgccacaggcatggaggttggttggtaccgcccgccattttcaagagtcgtgcatttatatcgcaacgggaaggatcaagacggagatcaagccccagaatatcggggcaggacagagctgctgaaagatgcaataggtgaggggaaggtgaccctgcggattagaaacgtacgttttagcgacgaggggggctttacctgtttctttagagatcacagctaccaggaggaggctgctatggagctcaaggtggaggatcccttttactgggtctccccgggggtgctcgtcttacttgcagtcctgcccgttctccttctgcagattaccgtcggcctcgtctttctatgcctacagtaccggctgcgcggtaagctgcgagccgaaatcgaaaatctgcatagaactttcggtcaattccttgaggagctgcgcaacccattttag

SEQ ID NO: 125106 - DNA, 888 bp, Artificial Sequence
  Description of Artificial Sequence: Synthetic coding sequence
atggcgtccctaagcaggcctagcctgccgtcttgtctttgctcattcttgctattactgctgctgcaggtgtccagctcctatgctggccagtttcgggtaatcgggcctaggcacccaatccgggctctcgttggagacgaggtggaactcccatgtagaatcagcccaggaaaaaacgctacaggcatggaagtggggtggtatcgtccccccttttctcgtgtggtgcacttgtatcgcaatggaaaggatcaggacggggaccaggcgcccgaatatcgcggacggaccgagctactgaaggacgcgatcggagagggaaaagtgaccctgagaatacgaaacgtcagattttctgacgaaggggggtttacctgcttcttccgcgatcattcttaccaggaggaggctgcaatggaattgaaggtggaagaccccttttactgggtgagccccggcgtgctagtacttctggctgtacttcccgtgctgctactacagattactgttggactcgtttttctgtgtctgcagtacaggctccgcggcaaattgcgggcggagattgagaatctgcaccggactttcgaccctcatttccttagggtcccttgttggaaaataaccttatttgtgattgtgcctgtgctagggccgctcgtagcgctgatcatctgctataactggctccaccgccgactggccggtcagttcctggaggaactgcgtaagtttagtagcttgtgttataagcaaaggatcaagtcccaagagagggagactgaggccaccagagggcgcggcggcttgttgagggatcatataccacgcggaaaagaggagctcgaaagccttggtgggggtaaaactccgcctggccgttag

SEQ ID NO: 125107 - DNA, 888 bp, Artificial Sequence
  Description of Artificial Sequence: Synthetic coding sequence
atggccagcctctccaggccatccctcccaagttgtctgtgcagcttcctgctcctcctccttctgcaggtgtcctcaagctacgctggacagttccgagtgattggtccacgtcaccctattagggctctcgtgggggatgaagtcgagctaccatgtagaatcagccccggcaaaaacgccacgggtatggaagtaggctggtataggcctccgttttccagggtcgtgcatctctacaggaatggcaaagaccaagacggcgatcaggctcccgaatatcgcggccggaccgaactcctcaaggatgctattggggagggaaaggtcaccctgcgcatacgtaacgtgaggttcagtgacgagggagggttcacgtgttttttcagggaccactcttatcaggaggaggcagccatggagctgaaagttgaggatcccttctattgggtatcaccaggcgtattggtcctactggccgtactcccagtgctcctgctccaaatcaccgtgggcttagtctttctgtgtctgcaatataggctccgcgggaaactcagagccgaaatcgaaaacctacatcggacatttgatccccactttcttagggtgccgtgttggaaaatcacgttattcgtgattgtccctgtgctggggcctcttgtggctctgatcatctgctataactggctgcataggcgccttgccggtcagtttttggaggagctgcgaaagttctcgtcactctgctataagcagcgcattaagtcacaggagagagagacggaggcaactagaggacgagggggactattacgtgaccacattcccagaggaaaggaggagttagaatccctcggtgggggtaagacccctcctgggcggtag

SEQ ID NO: 125108 - DNA, 396 bp, Artificial Sequence
  Description of Artificial Sequence: Synthetic coding sequence
atggcgtctctgtcacggccctcactgccttcctgtctgtgtagtttcctcctcctgttgttgcttcaagtttccagttcctacgccgaccccttttactgggtgtctcccggggtgctggtactactagccgttttgcctgtactgctgttgcaaatcaccgtggggcttgtcttcctgtgcctccagtaccggttaagagggaagctgcgcgctgaaatagagaacttacatcggacattcgaccctcactttctgagggtgccttgctggaaaatcaccttgtttgtgatagtgcccgtgttggggcccctcgttgctctgatcatttgctacaattggctccaccggaggcttgccgggcaattcctcgaggagctgcggaaccccttctag

SEQ ID NO: 125109 - DNA, 759 bp, Artificial Sequence
  Description of Artificial Sequence: Synthetic coding sequence
atggcgtccttatctcgcccttcactcccctcttgtctctgctcatttttgctgctgctgctcctccaggtgtcttcctcctacgccggacagttcagggtgattggccccaggcaccctatccgagccctcgtgggggatgaggtcgaacttccctgcaggatttccccaggtaaaaacgctacaggcatggaggtgggctggtatcggccaccattttctagagtagtccatctgtatcgcaatggtaaagaccaggacggcgaccaggccccagaatatcgtggtagaactgaactactgaaggacgcgatcggcgaaggtaaggtcactctccgtattagaaatgtgaggttctcagacgagggcggctttacgtgcttcttcagagaccactcctatcaggaggaggctgcaatggagttaaaggtagaggacccattttattgggtgtcaccaggtgtcttggttctactggcggtccttccggtgctgcttttgcagatcacggtcggtctcgtgtttctctgtctgcagtacagattgcgcggcaaattacgagctgagatcgaaaacctgcatagaacctttgacccccatttcctgcgtgtcccatgctggaagattacccttttcgtgatcgtgcccgttcttggaccactagtggccctcattatttgctacaactggctgcatcgtcggctggccggccagtttttggaggaactgctttttcacctcgaggctttgtcaggatag

SEQ ID NO: 125110 - DNA, 744 bp, Artificial Sequence
  Description of Artificial Sequence: Synthetic coding sequence
atggccagtctctcaaggccttcgctgccatcatgtctttgctcatttctcctgctgctgctgctgcaggtgtcaagcagctatgccggacagtttcgtgtgataggcccccggcatccgatcagagctctcgtcggggacgaggtcgagctgccatgtagaatctcaccaggcaaaaacgcgactggaatggaagttggctggtacagaccacctttctcacgcgtggttcacctatacagaaacggcaaagatcaggatggcgaccaggcacctgaatacagggggcgaaccgagctcttaaaagatgccatcggtgaagggaaagtgactctcaggattcgaaacgttcgatttagcgacgagggcggcttcacttgctttttcagagaccacagttaccaggaggaggctgccatggagcttaaggtcgaagatcccttttactgggtttccccaggagtgctggttctcctcgcagtgttgccagttctgttactccagatcaccgtgggactagtgttcctatgcttgcagtaccgcctgcgtgggaaattgagggctgaaattgagaacctacaccggacattcgaccctcattttctgcgtgttccctgttggaaaatcactttatttgtcattgttcccgtactggggcctttggtcgcactgattatctgctacaactggctccacaggcgcctggccggccagttcctggaagagctaagaaatcctttctag

SEQ ID NO: 125111 - DNA, 615 bp, Artificial Sequence
  Description of Artificial Sequence: Synthetic coding sequence
tccctgtccaggccttcgttaccttcatgcctgtgcagtttcctgctgttactgctcctgcaagtctcatcttcgtacgctgggcagtttcgagtgattggcccgagacatcctatccgggctcttgtgggggacgaggtggagctgccgtgccgcatttctccaggaaagaacgccactgggatggaggtgggatggtaccgaccccccttcagtagggttgttcatctctacagaaatggtaaggatcaggatggcgaccaggcacctgaatatcgtggaagaactgaactgctcaaggatgcgatcggcgaaggcaaggttacgcttagaatcaggaacgtacggttctcagacgaaggcggctttacatgcttttttagggatcactcctaccaagaggaggccgcaatggaactcaaggtggaggatccattctactgggtgtcaccaggcgtgcttgtcctacttgctgtgctgcctgtgctcttactacagattactgtcgggttggtgtttctgtgcctgcagtatcgactccgcggcaaactgagagcggagatcgagaacctacataggactttcgtgtttcacttggaagccctgtccgggtag

SEQ ID NO: 125112 - DNA, 888 bp, Artificial Sequence
  Description of Artificial Sequence: Synthetic coding sequence
atggcttctctgtctaggccttcccttccttcgtgcctctgctcttttctgctgctgctcttattgcaggtttcatcctcgtacgcaggccagttcagagtgatcgggcctcgtcacccaatcagggctctcgtgggagacgaagtagagctcccttgccgaataagtcctggcaaaaacgcaacagggatggaggtgggctggtatcgaccccccttctctcgagtcgtgcacttgtacagaaacgggaaggatcaggacggggaccaggcacctgaataccgcggccgtaccgaactcctgaaggatgcaattggagaagggaaggtcacactcaggatccggaacgtccgattcagcgacgaaggtgggttcacatgcttctttagagatcactcctaccaagaggaggccgctatggagctcaaggtcgaggaccctttctattgggttagccccggggtcctggtgctgctggccgtgctccccgtgcttctgctgcagattaccctcggactcgtcttcctgtgcttgcaatatcggctgcgagggaagcttagggccgaaatagaaaatctgcaccgcacatttgatccccattttctacgggttccttgttggaaaatcactctgttcgtgatcgtacccgtcctaggccccctggtggccctgattatttgttacaactggctccaccggcggcttgcaggccagtttctagaggagcttaggaagttttctagtctatgctacaaacagaggataaagagccaagagagggaaaccgaggcaacgcgggggcgaggaggactccttagggatcacatccctcgaggcaaagaagaactggaatctctggggggcgggaaaactcctcccggtcggtag

SEQ ID NO: 125113 - DNA, 690 bp, Artificial Sequence
  Description of Artificial Sequence: Synthetic coding sequence
atggcttctctgagcagaccatccctcccctcgtgcctgtgcagctttctgcttctcctgcttctacaggtctctagtagttacgcggggcaatttagagtaatcggtccccgccacccaatccgcgcactcgttggcgatgaagttgagttgccttgtagaatttcaccgggaaaaaacgccactgggatggaggtgggatggtaccgcccaccattttcacgcgtggttcatctctatcggaacggaaaggaccaagatggggatcaggccccagaatatcgagggcggaccgagctgctcaaggacgccataggtgaggggaaagtaaccctcaggatccgcaatgtgagattcagcgacgagggggggttcacttgtttctttcgcgatcacagctatcaggaagaggccgctatggaactgaaagtggaggaccccttttactgggtgtcacctggcgttctagtgcttctcgccgtcctgcctgtcctgctgctccaaattacagtgggcctggtcttcttatgtctacaatataggctgcgggggaagctgcgcgccgaaatagagaacctacatcgcacgttcgaatcgtttggggtgttgggacctcaagtgaaagagcctaagaaaaccggccagttcctggaggaattacttttccatcttgaggctctctccggttag

SEQ ID NO: 125114 - DNA, 396 bp, Artificial Sequence
  Description of Artificial Sequence: Synthetic coding sequence
atggcttcactctcgaggccctctctcccctcttgcctctgcagtttcttgctgcttcttttgctgcaggtgagctcatcttatgccgatcctttttactgggtgtccccaggtgtcctggttctgctggctgtgctacccgttcttctcctgcagatcacagtagggctggtatttctgtgtcttcaatacagattgagggggaaattgcgggcagagatagagaatttgcacaggacatttgacccgcatttcctgcgagtgccatgttggaaaattacgctctttgtcattgtgccagtacttgggcctttggtcgccctgatcatttgctacaattggctgcatcgtaggcttgcaggacagtttttagaggaactgaggaatccattctag

SEQ ID NO: 125115 - DNA, 540 bp, Artificial Sequence
  Description of Artificial Sequence: Synthetic coding sequence
tgacagttcagagtaattggccctcgccaccctatcagagccctggttggagatgaagtagaactcccatgccggatcagccctggaaagaatgcgaccgggatggaagtggggtggtacagaccccccttctcaagagtggtgcacttgtaccggaacggtaaggaccaggacggtgaccaggcaccagaatacagagggagaaccgaattactgaaggacgcaatcggcgagggcaaagttacactaagaatccgtaacgttcgcttttcagatgagggtggcttcacttgtttttttagggaccatagttatcaagaggaggctgctatggagcttaaggttgaggatcccttctactgggttagccccggtgtcctggtgctcctcgcagtgctcccagtcttactgcttcaaatcactcttggactggtgttcttatgtctccagtatagactgcgagggaagttgagggctgagatcgagaatctccataggacctttggccagtttttggaggaattaaggaaccccttctag

SEQ ID NO: 125116 - DNA, 627 bp, Artificial Sequence
  Description of Artificial Sequence: Synthetic coding sequence
atggcctccctgtcccgcccatctctgccatcatgtctgtgcagtttcctccttctgctgctcttgcaggtaagtagttcatacgctggacagtttagggttatcggacccaggcaccctatacgcgctctggtcggcgatgaggtcgagctgccctgcaggatctctcccgggaagaacgcaaccggcatggaagttggatggtatagaccccctttcagccgggtcgtgcacttgtacaggaacggtaaggaccaggacggagaccaggctcctgaatatcgcgggcgcacagaactgttgaaagatgccatcggggaggggaaggtgaccctgcgcatcagaaatgtgcggttttctgacgaaggcggatttacctgttttttccgggatcacagttatcaagaagaggctgccatggagctgaaagtggaggatcccttttactgggtgagccccggagtgttagtgttgctggctgtattacctgttttgcttcttcagatcaccgtcggactgatctttctgtgcctacagtaccggcttagaggcaagctccgtgcagaaatagagaacctccaccggacattcggacagttcctggaggagttgaggaatccattttag

SEQ ID NO: 125117 - DNA, 744 bp, Artificial Sequence
  Description of Artificial Sequence: Synthetic coding sequence
atggctagcctgtcaaggccaagtctgccatcatgcctgtgctcctttcttttgctgctgctgttgcaggtgagcagctcctacgccggccagtttagggtgatcggcccccgtcatcctattcgagcgctggttggcgacgaggtcgaactaccttgtagaatatccccaggcaagaacgcaactggcatggaggtcggctggtatagaccccccttttctcgggtagtgcacctctacaggaatggcaaggaccaggatggggatcaggcccccgagtacagggggcggacagagctcctgaaagacgccatcggagaagggaaggtcaccctccgcataaggaatgtgcggttctctgatgaaggcggttttacctgttttttcagggatcactcatatcaggaggaagcagcaatggaactcaaggtcgaagatccattctactgggtgagcccgggcgtactggtgttgctggctgtgttgcctgtgctactgctccagatcacggtaggattagtgttcttgtgcctgcaataccggttaagaggaaaactgagagccgagatcgagaacctccaccgcacttttgacccccatttcctcagggtgccgtgttggaagataaccttgttcgtaatcgtccccgtgctaggaccactcgttgctctgataatctgttacaattggctacatcgacggctggctggtcagttcctagaggaactgagaaaccccttttag

SEQ ID NO: 125118 - DNA, 396 bp, Artificial Sequence
  Description of Artificial Sequence: Synthetic coding sequence
atggcaagcttgagtagaccctcacttccctcctgtctgtgctctttcctgcttctactactccttcaggtgtcatcgagctacgccgacccattttactgggtgagcccaggcgttttggtactgctcgcagtcttacccgtgttgctgctgcagatcactgtgggattggtgtttctgtgcttacagtacagactgcgcggcaaactccgggcggaaatcgaaaacttacaccgtacattcgatcctcacttcctgagggtcccctgctggaagatcacgctgtttgttatcgtgcctgtcttggggccacttgtggcactcatcatctgttataactggctacaccgcaggctcgccggacagttcttggaggagttgaggaaccctttctag

SEQ ID NO: 125119 - DNA, 642 bp, Artificial Sequence
  Description of Artificial Sequence: Synthetic coding sequence
atggcaagcttgtcacgaccttccctgccgtcgtgcctttgcagttttctgctgctgctgctgctgcaagtcagctcatcttatgcaggccagtttagagtgatcggccctcgccaccccatccgggcccttgtgggcgatgaagtcgagcttccctgccgtatatctccaggaaagaacgcgacagggatggaagttggatggtaccgaccacctttctcccgggtggtccacctctacaggaatggtaaagaccaagatggagaccaggctcccgagtaccggggacgcaccgaactactgaaggacgccatcggggaaggaaaggttacacttaggattcggaacgtacgcttcagcgacgagggaggttttacatgttttttccgggaccacagctatcaggaagaagccgctatggaactcaaggtagaggatccattttattgggtctctcctggtgtacttgtgttgcttgccgtactgccagtgctcctccttcagataaccgtcggattagtttttctgtgcctacagtatcggctgcgcggaaaactgagagcagaaattgagaatctgcaccggacttttggccaattcttggaggaactcttgtttcaccttgaggcactgagtggatag

SEQ ID NO: 125120 - DNA, 615 bp, Artificial Sequence
  Description of Artificial Sequence: Synthetic coding sequence
tctctgtcccggccctctctgccatcctgtctctgttcctttctacttctgctgctcctgcaggtgtcgagtagctacgccgggcagtttagggtgatcggtccaaggcaccctatccgtgccctggtcggggacgaagtggagctcccctgcagaattagccccggaaaaaatgctacagggatggaagtaggttggtataggcctccattctccagagtagtacatctgtatcggaatggaaaagaccaggacggcgatcaagctccggaataccggggaaggacagagcttctgaaggatgcgatcggcgaaggcaaggttacactgcggatccgaaacgtgagattttccgatgagggaggcttcacctgcttcttcagagatcattcttatcaggaggaagcggccatggagctgaaggttgaagacccattttactgggtgagcccgggggttctggtactcctggctgtcttgccagtgctgctgctccagattacactgggtctggtttttctctgccttcagtatcgtctcagggggaaactgcgcgcagagatcgaaaatctgcacagaaccttcgtcttccatctggaggctctctctggctag

SEQ ID NO: 125121 - DNA, 675 bp, Artificial Sequence
  Description of Artificial Sequence: Synthetic coding sequence
atggctagcctttccagaccttctttgcctagttgcctgtgcagctttcttctgctgcttctgttgcaggtttcatctagctacgcaggccagttcagagtcatcggcccgcggcaccctattcgcgcactggtgggggacgaggtcgaactgccatgcagaatctctcccggaaaaaatgccactggcatggaggtgggatggtataggcctccattcagccgcgtggtccatctttaccgcaatggcaaggaccaagatggagatcaggcacctgaatatagagggaggacagaactgctgaaagacgccatcggtgaaggtaaggtgacacttcgaatcagaaatgttcgattttccgacgagggcggctttacatgcttcttccgggatcacagttaccaggaggaagccgccatggaacttaaggtggaggatccgttctactgggtgagcccgggagtgctggtccttcttgcggtgctccccgtacttctgctacagatcaccgtggggttggtcttcttgtgcctccagtacaggctgagaggcaaactgcgagccgagatcgaaaatctgcaccggacttttgagtctttcggcgtgctgggcccccaggtaaaggagcctaagaaaactgggcagttcttggaagagctccggaaccctttctag

SEQ ID NO: 125122 - DNA, 690 bp, Artificial Sequence
  Description of Artificial Sequence: Synthetic coding sequence
atggccagcctgtccagaccttcactaccctcatgcctttgcagctttctattgcttttgctactgcaggtctcttctagttatgccggtcagtttcgggtgatcggtcctcggcacccaattagagccctcgtaggggatgaggttgaattaccgtgccgtatctctccaggtaagaatgcaactggaatggaggtgggatggtataggccaccattcagccgtgtggtacatctttatagaaatggcaaagaccaggatggagatcaagctccagagtatcgggggaggaccgaactgctcaaagatgccattggcgagggaaaggttacccttcggattaggaatgtgaggttttcagacgagggaggctttacatgtttctttagagaccacagttaccaagaggaggccgctatggaactaaaggttgaggatcccttctactgggttagccccggagtgttagtacttttagctgtgctgcccgttctgcttctgcagattaccgtagggctggtgtttctgtgtttacaatatcgcttgcgggggaagctacgggccgaaatcgaaaacctccatcgaacattcgagtctttcggcgtgctcggcccccaggttaaggagcctaaaaaaaccggccagtttctggaagaactcttatttcatctcgaagctctctctggctag

SEQ ID NO: 125123 - DNA, 888 bp, Artificial Sequence
  Description of Artificial Sequence: Synthetic coding sequence
atggcaagtctgtctagacccagcctgccttcatgtctgtgttcattcctgttactacttttactgcaggtcagtagcagctatgcaggccagttccgcgtcatcgggcccaggcatcctattcgggcacttgtgggcgacgaagttgagctcccatgccgaataagtcctgggaagaacgctaccggaatggaagtcggatggtatcgcccacccttctctcgcgtggttcacctttatagaaacggtaaggatcaagacggggatcaggcgccagagtatagggggaggaccgagctgcttaaggacgcaattggtgagggcaaagtgactttaagaatccgcaacgtgcgattcagtgatgagggaggattcacctgttttttcagggaccatagttaccaggaagaggcggcaatggagctgaaggttgaggatcctttctattgggtttccccgggagtgctggtgttactcgcggtgctgccggtgcttctgctgcaaatcaccgtggggttggtgttcctctgtctgcagtacaggctaagaggcaaactgagagccgaaatcgagaacctgcataggacttttgatccacacttcctacgggttccatgttggaagataactttgtttgtcatagtccccgtgctcgggccactggtggccctaatcatctgctacaactggttacacagacgattggccggacagtttctcgaggagttgaggaaatttagctcactgtgctacaagcaacgaataaaaagccaggagagggagacggaagcgacaagaggccggggcggccttcttcgggaccacatcccgcggggcaaagaagagctggaatctctggggggcggcaaaacaccaccaggcagatag

SEQ ID NO: 125124 - DNA, 540 bp, Artificial Sequence
  Description of Artificial Sequence: Synthetic coding sequence
tgacaattccgggtgattgggcctaggcaccccatcagggccctcgtgggggatgaagtggagctgccctgtcgcatctctccaggcaagaatgcgacgggcatggaagttggctggtatcggccacctttctcccgtgtcgtgcatttgtacagaaacggaaaggaccaggatggtgaccaggccccagaataccgaggcaggacagaacttttgaaagacgccattggcgaggggaaggtaactctgcggataagaaatgtgcggtttagcgacgagggagggtttacctgttttttccgggaccacagctatcaggaggaggccgctatggagctgaaggtggaagaccctttctactgggtgtcccccggagtcctggtattgctcgcagtactgcctgttttactcctacagattactgtgggacttgtgtttctctgtcttcaatatcggctcagaggcaaactgcgagcagaaatagaaaacctacaccgaaccttcggccagttcctagaggagcttagaaatcccttttag

SEQ ID NO: 125125 - DNA, 642 bp, Artificial Sequence
  Description of Artificial Sequence: Synthetic coding sequence
atggctagcctgtcccgaccaagccttccgtcttgtctgtgctcgtttcttttgctgttgttactacaggtgagttccagctacgcaggacagtttcgggtcatcggaccgagacacccgatccgggccctcgtcggagatgaagtggaactgccatgccgaatttccccaggtaaaaatgcgaccggaatggaagtgggatggtacaggccgccctttagccgagttgtccatctgtacaggaatgggaaggaccaggatggagatcaggcgccggagtatcggggacgcacggaacttctgaaggatgccattggagagggaaaagtgactctccgtatcaggaatgttaggttctctgatgaaggcggattcacctgtttttttcgcgaccactcctatcaggaagaggctgccatggagctgaaagtggaagatccattctattgggtctcccccggagtcctcgtgctactagcagttctacccgtactcctgcttcagatcacagtcggtctagtcttcctgtgtcttcagtatcggttgagaggcaaactgagagccgagatcgagaacctgcatcgaacctttggccaattcctcgaagagctgcttttccatctggaggcactgtctggatag

SEQ ID NO: 125126 - DNA, 759 bp, Artificial Sequence
  Description of Artificial Sequence: Synthetic coding sequence
atggcttccctgtcgaggcccagcctgcccagttgtttgtgcagcttccttctcttacttctgctacaggtgagcagcagttatgccggtcagtttagagtaatcggcccccggcaccccatccgggctctggtgggagatgaggtggagttaccctgtcgaatttctcctggcaaaaatgccaccgggatggaagtaggctggtacagaccaccctttagtcgggtggtacatctgtacagaaacggtaaggaccaagatggcgaccaggcacccgagtaccgcggccgcacggagttactgaaggatgctatcggcgaggggaaggtgacacttaggattagaaatgtgaggttctccgatgaagggggatttacatgcttcttccgagaccactcttaccaggaggaggctgctatggaattgaaggtggaagaccccttttactgggtgtcacccggtgtgctcgtgcttttagcagtactgcctgtgctgctccttcaaattacagtgggattggtgtttttatgcctgcaatacagactgagaggcaaactgagagcagagatcgaaaacctccaccgaactttcgatccccacttcttgcgagttccttgttggaagatcaccctttttgtgatagtccccgtcctcgggcccctcgtagccctgatcatatgctacaactggttgcaccgtagattggctgggcagttcctggaggagctcctgtttcatctggaagcactgtcagggtag

SEQ ID NO: 125127 - DNA, 642 bp, Artificial Sequence
  Description of Artificial Sequence: Synthetic coding sequence
atggcaagtttaagccgccctagtctcccgagctgcctgtgcagctttttgctgttactgctcctccaggtgtctagcagttacgccgggcagtttcgcgtcatcggccctcgacaccccattcgcgcactggtgggggacgaagtagagctgccctgcaggatctcccctggaaagaacgccaccggtatggaagtcggttggtataggcctcccttttcaagggtggtgcacctgtaccggaacggaaaggatcaggacggtgatcaggcacccgagtaccgcggtcgaaccgaattattgaaggacgcaataggagaaggcaaggtgacgctacggattcgcaacgtgagattttctgacgagggaggcttcacatgcttctttagggatcacagttaccaggaggaggctgcgatggagctgaaagtagaagaccccttctactgggtttcaccgggcgtgcttgttcttctcgccgtcctgcccgtgcttttgctccaaatcacggtgggactcgtgtttttatgtctccagtaccgcttgagagggaagctcagagcagaaatcgaaaacttacatcggacattcggccaattcctagaggagcttctgttccatctggaagcactgtcaggttag

SEQ ID NO: 125128 - DNA, 675 bp, Artificial Sequence
  Description of Artificial Sequence: Synthetic coding sequence
atggcctccctgtcaaggcccagcctgcccagttgtctgtgcagttttttgctgctgctgctgctgcaggtctcttcgtcatatgcagggcagttccgagtcattggtcctcggcaccccatcagggctctggtgggtgatgaggtagagcttccatgtagaattagtcccggcaagaatgcaactgggatggaggtggggtggtatcgtccgcccttctcaagggtggttcatctctatcgcaacggaaaagaccaggatggcgatcaggctccggagtataggggccgcacagaactgctcaaggacgctatcggggagggtaaggttacactgcgcatcagaaacgttcggttcagtgatgaaggtgggtttacatgcttttttagagaccatagttatcaagaggaggcagccatggagctgaaggttgaggaccccttttattgggtgtccccaggagtccttgtcctcctcgccgtactgccagtgctactactccagattaccgtcggattggtatttctgtgtctacagtatcgccttaggggaaagctgcgagctgaaatagaaaaccttcaccgtaccttcgagtccttcggtgtgctgggcccccaagtgaaggagccgaaaaagaccggccagttcctggaggaattgagaaacccattttag

SEQ ID NO: 125129 - DNA, 615 bp, Artificial Sequence
  Description of Artificial Sequence: Synthetic coding sequence
agtttgtcgcgtccatcactgccctcctgtctctgcagctttctgctactgctgctgcttcaagtgtcttcctcctacgctgggcaatttcgcgtcattggcccacgacatccaatcagagctctcgtgggggatgaggtagaactgccctgccgcatatcacctgggaaaaatgctactgggatggaggtcggttggtaccgccctccctttagtagggtcgtccatctgtacagaaatggtaaggaccaggatggagatcaggcacccgagtaccgtggcagaactgaacttctgaaagacgccatcggggagggaaaggtgacactgcgcattagaaacgtgcgcttctccgatgaagggggattcacctgtttcttccgggaccactcttaccaagaggaggcagccatggaactgaaagtggaggaccctttctactgggtttccccaggagtgttggtcctgctggcagtcttaccagtcctgctgcttcaaataacggttggactcgtgttcctgtgcctccaataccgcctgcgcggaaaattgagagcggagatagagaacctccaccgtacatttgttttccaccttgaggctctgtctggctag

SEQ ID NO: 125130 - DNA, 675 bp, Artificial Sequence
  Description of Artificial Sequence: Synthetic coding sequence
atggcaagtttatccagaccatccctgccatcttgcctatgcagtttcttactactgctcctgctgcaggtaagttcttcctacgcgggtcaattcagagtgatagggcctcgccatccaatccgggccctggtcggagacgaagtggagctcccgtgccgcattagcccagggaagaatgcaaccgggatggaagtgggctggtaccgaccccccttctccagggtagtgcacctttaccgcaatggaaaagatcaggacggtgatcaggccccagagtatagggggcgcaccgagctactgaaggatgctattggggagggaaaggtgactctgaggatcagaaacgttagattctcggatgagggaggctttacatgcttcttcagagaccacagttaccaggaggaagctgctatggagctaaaagtggaagatccgttttattgggtttccccaggagtgctcgtgctgttagctgtgctgcctgtccttctactgcagattaccgtcggtctcgtgttcctgtgcttacagtaccgcctacgcggcaagcttagggcggagatagagaacctgcacagaacgttcgaaagcttcggtgtgttaggtccgcaagtgaaggagcctaagaagacaggacagttcctcgaagagctgcggaaccccttttag

SEQ ID NO: 125131 - DNA, 759 bp, Artificial Sequence
  Description of Artificial Sequence: Synthetic coding sequence
atggcaagcctatccaggcctagtctgcccagctgcctctgcagcttccttctgttactcctgcttcaggtttcttcgagctatgccggacagtttagggtgatcggtcctaggcaccctatcagagctctggttggcgatgaagtagaactaccatgcaggatctcaccgggaaagaacgcaacaggtatggaagtggggtggtacaggccaccgttctccagagtggtacacctgtatcgaaacgggaaggaccaggacggggaccaggcccccgaataccgtggtcggactgaactcttaaaagacgcgatcggtgaaggaaaggtgacactgcgaataaggaacgtgaggttttccgacgaaggaggcttcacatgtttttttagagaccactcataccaggaagaggcagccatggagttaaaggttgaagatccattctactgggtctctcctggtgtgctggtgctgctcgcggttctgcccgttctgctcctccagatcacagtggggctggtgttcttatgccttcagtacagacttcggggcaaactgagagcagagattgaaaacctacaccgaacgttcgaccctcacttcctacgggttccctgttggaaaattaccttgtttgtaatcgttccagttctggggccccttgtggccctgatcatctgttacaactggctgcacaggcgccttgccggccagtttcttgaggaacttctcttccatctggaggccctgagtggctag

SEQ ID NO: 125132 - DNA, 744 bp, Artificial Sequence
  Description of Artificial Sequence: Synthetic coding sequence
atggccagcctctcccgcccatcgctcccttcttgcttgtgtagttttctcctgctgttattactccaggtgagctcaagttacgccgggcaattcagagtgattggaccccgacaccctatcagggcactcgtgggtgacgaggtcgaactaccttgcagaatttctcctgggaaaaacgcaacagggatggaagtcgggtggtatcgtcccccattctctcgagtggtccatctataccgcaatggaaaagaccaggatggcgatcaggcgcctgaataccgtgggaggacagaactactgaaggatgccatcggcgagggcaaagtcaccctcaggatccggaatgtgaggttcagcgatgaggggggctttacgtgtttcttccgcgaccattcctaccaggaggaagccgcgatggaactgaaggtggaggacccattttactgggtgagccctggggttctggtgctccttgcggtactgcctgttctcctcttgcaaattacagtgggcttagtgtttctgtgtttgcagtatcgcctccgtgggaagctgcgagcagaaatcgagaatttgcataggacatttgatccacacttcttgcgagtgccatgctggaagatcaccctattcgtcatcgtgcctgtgctcggcccactggtggcactgatcatatgttataactggctgcaccggaggctggccggtcagttcttggaggagctgcgcaatcccttttag

SEQ ID NO: 125133 - DNA, 615 bp, Artificial Sequence
  Description of Artificial Sequence: Synthetic coding sequence
agcctaagcaggccatctcttccaagttgcctgtgctcattcctgctcctgcttctgctgcaggtatctagttcctacgccggtcagttccgcgtgatcggccctcgacaccccatcagggctctcgtcggggatgaagtggagcttccctgtaggatcagtcctggaaaaaatgccaccggaatggaggttggctggtatcggcctcctttcagtagggtggtgcacctgtaccgcaacggaaaagaccaggacggggatcaggctcctgagtaccgcggccgaacagaactccttaaagatgctatcggagagggcaaagtaaccctgcgaatacgcaacgttaggttcagtgatgagggcggcttcacctgcttttttagagaccattcttaccaggaagaggccgctatggagctgaaggtggaggaccctttttattgggttagccctggggtccttgtacttcttgctgtcctgccagtgctgctcctgcagatcacagtaggtctggtcttcctgtgccttcaataccgtctccgaggaaagctacgggctgaaattgagaatttacatcgaaccttcgtctttcacctggaagctctgagcggatag

SEQ ID NO: 125134 - DNA, 888 bp, Artificial Sequence
  Description of Artificial Sequence: Synthetic coding sequence
atggccagcctcagtcgtcccagcttaccctcctgcttatgctccttcttgttgctgttgttgttgcaggtgagttcctcttacgccggtcagttccgcgtcattggaccaagacacccaatcagggcgcttgtgggcgacgaggttgagctgccttgtaggatttcccccggcaagaatgctacgggtatggaggttggctggtatcgtcctcctttttcccgcgtcgtgcacctctatcgaaacggcaaggatcaggatggggatcaggccccagaatatcgcggtcggacagagctccttaaagatgccattggcgaggggaaagtaactcttcgtataagaaacgtgaggtttagcgatgaaggcggctttacatgttttttccgcgaccacagttatcaggaggaagcagcgatggagttaaaggtggaggatccattttactgggtgtccccaggtgtgctggtcctcttggcagtgctgcccgtgctgcttcttcagataacagtgggccttgtgtttctttgtctccagtacagactgcgcgggaaactccgggctgaaatcgaaaacctgcataggacttttgatccccactttttaagggtgccctgctggaagataacactcttcgtcattgtacctgtgttggggcccctagtcgccctcatcatttgctataattggctgcatcgcagattagccggccagtttctggaggagctcagaaagttctcaagcttgtgctataaacaacgcatcaaatcgcaggaacgcgagacggaagctacacgcggccggggaggtctacttagggaccacatcccacgtggtaaggaggagctggaaagtctcggaggagggaagactccgcccgggcgctag

SEQ ID NO: 125135 - DNA, 759 bp, Artificial Sequence
  Description of Artificial Sequence: Synthetic coding sequence
atggcctctctgtccaggccatcgttgccatcatgcctctgctccttcctcctgctactgctcctgcaggtctcctcgagctatgctgggcagttccgggttataggacctaggcatcccatcagagctcttgtcggcgacgaagtcgagcttccatgcagaatttcgcccggaaaaaacgccaccgggatggaagtgggttggtatcgcccgcccttctctcgggtggtgcacctgtaccggaatgggaaagatcaggacggcgaccaggctcccgagtatcgtgggcggacggaactgctcaaggatgccataggcgaaggaaaggtaactctgagaatccgcaatgttaggttcagtgacgagggggggttcacttgctttttccgcgaccattcataccaggaggaagccgcaatggagttgaaagtagaggaccctttttattgggtgagcccgggagtgctggtgctgttagccgtgctccctgtgcttctgctccagatcactttgggactcgtattcctttgtctgcagtaccggctgcgtggaaaactgcgagcagagattgaaaacctccatagaactttcgatccgcatttccttcgtgtcccttgttggaaaattaccttattcgtgatcgttccggtacttggccctctggtagctttaatcatctgttataattggttgcatcgccgcctggccgggcagttcctggaagaactgttgttccacctggaagctctttcaggctag

SEQ ID NO: 125136 - DNA, 540 bp, Artificial Sequence
  Description of Artificial Sequence: Synthetic coding sequence
tgacagttccgcgttatcgggccccgccatccaattcgtgccctggtcggggatgaagtcgagcttccctgcaggatcagtccaggaaagaatgcaacagggatggaagtgggttggtacaggccccccttctcacgggtggtccacctgtaccgtaatggtaaagaccaggacggcgatcaggcccccgaatacaggggccgcacagaactgcttaaagacgctatcggagagggaaaagtgacattaaggataagaaatgtgcggtttagcgacgagggcggcttcacatgtttctttcgagaccatagttatcaagaggaggcagcaatggagctgaaggtggaggatcccttttattgggtgtcccccggggttcttgtgttgttggccgtcttgccagtgctgcttttgcagattactgtaggactggtttttctgtgcctgcagtacagactccgaggtaagctccgcgccgagatcgaaaacctacatcgcacttttggtcaattcctggaagagctgagaaacccgttctag

SEQ ID NO: 125137 - DNA, 396 bp, Artificial Sequence
  Description of Artificial Sequence: Synthetic coding sequence
atggccagcctgagccgaccaagtttgccatcctgtttgtgttcattcctgctgctcctgctcttgcaggtctcgagttcatacgccgatcccttttattgggtctcccccggagtgctggttctgcttgcagtgctgccagtcctgcttttgcagatcaccgtaggccttgtatttctatgcctgcagtacaggctgcgcggtaagcttcgcgcagagatcgagaacctgcaccgcacttttgatccccatttcctgagagtgccctgttggaagatcacactgtttgtaatagtccccgtgctcggcccactcgttgcccttattatctgctataattggctgcacagacgcctggcaggtcagttcttggaagagttacgcaatcccttttag

SEQ ID NO: 125138 - DNA, 744 bp, Artificial Sequence
  Description of Artificial Sequence: Synthetic coding sequence
atggcaagcctgtcacgccctagcctcccttcgtgtctgtgctctttcctgcttctgctgctgttgcaggtcagctcgtcttatgccggccaattccgggttattggaccccgtcatccaatcagggccctcgtaggcgatgaggtggaactcccctgcagaatttcacctggcaaaaacgctaccgggatggaggtggggtggtataggccccctttctcaagggtcgttcacctctatagaaatggcaaggaccaggacggtgatcaggcaccagagtatagaggccggaccgagttactgaaggacgccattggcgagggaaaagttaccttgcggattcggaacgttcgcttctcagacgaggggggtttcacatgcttcttccgtgaccactcttatcaggaggaagctgctatggaactgaaggtcgaggatccgttttactgggtaagtccgggcgtgctggtgttgctggcggtcctgcccgtgctgctactgcagattacccttggtctggtgttcttatgtcttcagtaccgcctgcgtgggaagctacgcgctgagatcgagaacctgcatcgaacttttgaccctcattttctcagagtgccatgctggaagataacattattcgttatcgtacctgtgctgggcccattagtagccctgataatttgttataattggctccacagaagattagccggtcaattcctggaagagctgcgaaacccgttctag

SEQ ID NO: 125139 - DNA, 642 bp, Artificial Sequence
  Description of Artificial Sequence: Synthetic coding sequence
atggcatccctgtcacgtccaagtttgccctcttgcctgtgttccttcctgcttttactgctactccaggtgtcttccagctatgccggacagtttcgggtaatagggcctcgtcatcccatccgcgccctcgtgggtgacgaagtagagctgccgtgccgtatttcgcccggaaagaacgctaccggcatggaggtggggtggtaccgccctccattcagccgggtggtacatttatatcgaaacggcaaagatcaggacggagaccaagctccagagtaccgagggcggactgagctacttaaggatgccatcggggagggaaaagtgacactccggatccggaacgtgcgtttttccgacgaggggggattcacatgcttctttcgggatcatagctatcaggaagaggcagcgatggagctgaaagtggaagaccctttctattgggtgtctcccggagtcttagtcttgctggcagtgctgcctgtgctgctcctgcagatcaccctcggactggtgttcttgtgtctgcagtatcgtctgcgcggcaaactcagggcagaaattgaaaatctccaccggacatttgggcagtttttggaagagctgctgttccatttggaagcactgtcaggctag

SEQ ID NO: 125140 - DNA, 615 bp, Artificial Sequence
  Description of Artificial Sequence: Synthetic coding sequence
tcactgtctaggccatctcttcccagctgtctttgtagcttcctgctgctacttcttctgcaagtgtcttcaagttatgccggccagtttcgtgttataggccctcgccacccaatacgagcgttggtaggggatgaggtcgaactcccatgcagaatttcccccggaaaaaacgcaacggggatggaagtcggctggtaccgaccgcctttttcaagagtggtgcacctgtaccggaacggcaaagatcaggacggcgatcaggctcctgagtatagggggcggaccgagctgctgaaagatgctatcggtgaggggaaggtgacacttcgcatcaggaatgttagattctcggacgagggcggatttacctgcttcttccgggatcatagctaccaggaggaggccgccatggagctcaaggtggaagacccattctactgggtgagcccaggagtgctggtgctccttgccgtgcttccagtgctcctgctccaaattacagtggggttggtttttctttgtctgcagtatcgattgcgtggtaagctgcgggcagagatcgaaaaccttcaccggactttcgtgtttcatctggaggccttaagcggttag

SEQ ID NO: 125141 - DNA, 690 bp, Artificial Sequence
  Description of Artificial Sequence: Synthetic coding sequence
atggcgtctctgagccggccatcacttccctcgtgcctgtgctctttcctgctgctgctgctgctccaggtgtcgtcatcctacgccgggcaattcagagttatcggaccccgacatccaatcagggcacttgtgggggatgaagtggaactcccttgcagaatttcgcccggcaagaacgctacaggcatggaggtagggtggtaccgtccacccttttctcgggtagtgcacctctatcgcaatggtaaggaccaggacggagaccaggcccccgagtaccgggggagaacagagcttcttaaggacgccataggggaggggaaggttaccctgcggattcgcaacgtacgattctccgacgagggcggttttacttgcttcttccgcgaccactcttaccaagaggaagccgctatggaacttaaagtggaggatccattctattgggtctcgcctggtgtgctagtgctcctggcagtcctgcccgttctcctacttcagataaccgtgggcctagttttcctgtgcctgcagtacaggctccggggcaagttacgcgccgaaatcgagaacttgcacagaacattcgagtcctttggggtgctcgggccccaggtgaaggagcctaagaagacaggccaatttctcgaggagctgttattccacctggaggctctgagtgggtag

SEQ ID NO: 125142 - DNA, 615 bp, Artificial Sequence
  Description of Artificial Sequence: Synthetic coding sequence
tctctgtctaggccttccctcccttcctgtctctgctcatttctgctgctcctcctcctgcaggtctcatccagctacgccggccagttcagggtgatcggaccaagacatcctattcgcgcacttgttggagatgaggttgaactcccctgcaggattagtccgggaaaaaatgcaaccggaatggaggtggggtggtatcgcccacctttttctagagtggtgcacctgtatagaaatggaaaggaccaggatggggaccaggcccctgagtacagaggaagaactgagctgctgaaggacgcaatcggagaagggaaggtgaccttgaggatacgaaatgtgagattctcagacgaaggtggcttcacttgttttttccgggaccactcttaccaggaagaggcagctatggaactgaaagtcgaagacccattttattgggtttcccccggggttcttgtgcttctggccgttctccccgtcctccttctccagattaccgtgggccttgtgtttctgtgtcttcagtaccgtctccggggcaagttaagagccgaaatcgagaacctccatcggacttttgttttccatctcgaggccctttcaggatag

SEQ ID NO: 125143 - DNA, 690 bp, Artificial Sequence
  Description of Artificial Sequence: Synthetic coding sequence
atggcgtcactctctcgcccatctctcccctcgtgtctgtgctcctttctcctgctgcttcttctacaggttagctcctcctatgcgggtcaattccgggtcattggaccaaggcatccaattcgtgctttggtgggagacgaggtggagctgccctgtaggatctctcccggcaaaaacgcaactggcatggaggttggctggtatcgtccacctttttcgcgagtcgtgcatttgtatcggaatggcaaggaccaggatggagaccaggccccagagtaccgcgggcggactgaactgctgaaggacgcaataggggaggggaaggtgactctgcgcatacgtaacgtgcggttctcagacgaaggcggattcacgtgtttcttccgtgaccattcttatcaagaggaagcagctatggagttaaaagtcgaagacccattctactgggtttctccaggcgtgcttgtactgctagccgtgctacccgtgctgcttctgcagataactctaggtctagtgtttctgtgtctccagtaccgcctgcgagggaagctccgagcagaaattgagaaccttcacaggaccttcgaatcatttggtgttctcggtcctcaggtgaaggaaccgaagaagactggacagttcctcgaagaactgctatttcacttggaagctctctccgggtag

SEQ ID NO: 125144 - DNA, 690 bp, Artificial Sequence
  Description of Artificial Sequence: Synthetic coding sequence
atggcttccttgagccgaccctcactgccatcttgcctgtgctctttcctcctgctgctgctcctgcaggtgagcagctcctatgcggggcaatttcgggtgatcggtccacgtcacccaattagggcattagtgggggacgaggtagaactcccctgtagaatctcgcctgggaagaacgcaacaggcatggaggtgggatggtaccggccccctttcagccgcgtggtccatctgtataggaatggcaaagaccaagatggagatcaagctccggagtacaggggccggaccgagctcctcaaggatgcaatcggcgaggggaaagttaccctgcgtatacgcaacgttagatttagtgatgagggggggttcacctgttttttccgggatcactcttaccaagaggaagcagccatggaattaaaagtggaggaccccttttattgggtgtcacccggcgtcttggtgttgttggcagtgctgcccgtcttactgctgcagatcacagtcggactgatcttcctttgccttcagtaccgcctgagaggtaagctgagagccgaaatcgaaaacctgcatagaaccttcgagtcttttggtgtcctgggtccacaggtcaaggagccaaaaaagacaggccagtttttggaagaattgctctttcacttggaggcactcagcgggtag

SEQ ID NO: 125145 - DNA, 516 bp, Artificial Sequence
  Description of Artificial Sequence: Synthetic coding sequence
atggcttcactcagcaggccttcactgccctcatgtctttgcagcttcctgctgttgctgctgctacaggtgtcatcgagctacgctggtcagttccgcgtcatcggaccccgccaccctatccgcgccctcgtcggtgacgaggtcgagctgccttgccgcatttctcctggaaaaaacgccacgggcatggaggttgggtggtacaggcccccgttttcaagagtggtgcatctttaccgtaacggtaaagaccaggacggtgatcaggcacccgagtacaggggtcgcacggagcttcttaaggacgcaatcggagaagggaaggtcactctgcggattaggaatgtaaggttcagcgatgagggcggctttacttgtttcttccgcgaccactcatatcaggaagaagcggctatggaactcaaagtggaagtctcccatagtgtaacccaggattggcttcagtggcacgatcacggatctctgcaacctcctcctccacgcctcaagtag

SEQ ID NO: 125146 - DNA, 534 bp, Artificial Sequence
  Description of Artificial Sequence: Synthetic coding sequence
atgtctcatatctcctgggaagagaggtatagaaacggcaaagaccaggatggcgatcaagcaccggagtaccgtggacgaacagagctccttaaggacgccatcggcgagggtaaagtgacacttcggattcgcaacgttagattctccgacgaaggcggttttacctgtttttttcgcgaccactcttatcaggaagaggccgccatggagttaaaggtggaggacccattttattgggtgtcacctggagtcctggtacttctggccgtgttaccggtgttactcctgcagataacagtcggcctggtctttctctgcctccagtatagactaagaggtaagctccgtgctgagatagaaaatttacaccgcacattcgatccccacttcctgagggtaccttgctggaaaatcactctgtttgttattgtacccgttctcggcccgctggtggcattgattatctgttacaattggctgcaccggagactggccggccagtttttagaggaattacgtaaccctttttag

SEQ ID NO: 125147 - DNA, 174 bp, Artificial Sequence
  Description of Artificial Sequence: Synthetic coding sequence
atggcgtccttaagccggccaagtctgcctagctgcctatgtagcttcctactgctgctcctgctgcaggtgagctcctcatacgcgggcctggtggcagtggcgagatcctggctcattgccgcatccacatcacaagctcaggtcatactcctcacgcagcctttggagtag

SEQ ID NO: 125148 - DNA, 627 bp, Artificial Sequence
  Description of Artificial Sequence: Synthetic coding sequence
atggcctctctgagcagaccatcgctgccttcctgtctgtgcagcttcctgctgctattactgttgcaagtctccagtagttacgctggccagttcagagtgattggcccccggcacccaatccgcgctcttgtaggggacgaggtggaattaccatgccgaatctccccagggaaaaatgctaccggcatggaggtcgggtggtaccgacctccctttagtagagtggtccatctttaccggaacggtaaggaccaggatggtgatcaggcacctgaatatagaggcagaaccgagctgctgaaggatgcgatcggagaagggaaggtcacgttaagaataaggaatgtgaggttttcagacgagggagggttcacctgcttcttccgcgaccatagctatcaggaggaggctgccatggaattgaaggtagaggacccgttttactgggtctcccccggcgtccttgtactgctggctgtgcttcctgtgctcttgctgcaaattacagtggggctcgtgtttttatgccttcagtacagactgcgtggaaaactgagagccgaaatcgagaacctccaccgcactttcggacagtttctcgaggaactgcggaatccattctag

SEQ ID NO: 125149 - DNA, 516 bp, Artificial Sequence
  Description of Artificial Sequence: Synthetic coding sequence
atggcatcactgtcgaggccgtccttgccgagctgtctgtgctcattcctcctcctgttgctgctgcaggtgagtagtagttacgctggccaattcagggtgatcggtccccggcatcccattagggctttggtgggcgacgaagtggaactgccctgtcgcatcagtccgggaaagaatgccacagggatggaagtgggttggtatcggccaccatttagtcgggtggtccacctttaccgcaatggaaaagaccaagacggcgatcaggccccagagtatagaggcaggacagaactcctgaaggacgcgattggagagggcaaggtgaccctacgcatcaggaatgtgcggtttagtgatgaaggcggcttcacctgcttcttcagagaccactcctatcaggaggaggcggctatggagctgaaggtggaggtatctcacagcgtgacccaggattggctgcagtggcacgatcacggctcgttgcagccgccccccccccggctgaaatag

SEQ ID NO: 125150 - DNA, 516 bp, Artificial Sequence
  Description of Artificial Sequence: Synthetic coding sequence
atggctagcctatcccgcccaagtctgccgagttgtctctgcagtttcctcttactgctgctgctccaggtaagctcctcttatgccgggcagtttagagttattgggccacgccaccccattcgggccctagtgggggacgaggtggaactgccgtgtcggatatctcccggaaagaatgcaacaggcatggaagtagggtggtaccgccctccgttcagcagggtcgtccacttataccggaatggcaaagatcaagatggggaccaggctccagagtacagagggcgcaccgagctgctcaaggatgcaattggtgaaggcaaggtgacccttaggatccgcaatgttcgattttctgacgaaggaggtttcacttgctttttcagagatcattcctatcaggaagaggctgctatggagctgaaagttgaggtgagccatagtgtcactcaggactggctccagtggcacgaccatggttcactgcagcctccacccccacgcctgaaatag

SEQ ID NO: 125151 - DNA, 621 bp, Artificial Sequence
  Description of Artificial Sequence: Synthetic coding sequence
atggcctcactgtctaggcccagcttgccatcatgcctttgctcttttctgctgttattgctgttgcaagtgtcctcgagttatgcaggccaatttagagtcatagggccacggcatcccatcagagccctggtgggcgacgaagtagagctaccatgccgtattagtcccggaaaaaatgccaccggcatggaagtgggctggtaccgaccccccttctcacgagtggtccatctttacagaaacggcaaggaccaggatggggatcaagctccagagtaccgggggaggacagagctgctcaaggatgctatcggcgaagggaaggtgaccttaaggataaggaacgtccgtttttccgatgagggcggctttacctgcttctttcgtgatcacagttatcaggaggaagctgctatggaattgaaggtcgaggatcccttctattgggtgtcacctggagtgctcgtgctactggccgtcttgccagtgcttctcttacagattaccgttggtcttgttttcctgtgtctgcagtatcgactgagggggaagctgagggcagagatcgagaatctacacagaacctttgtgtttcacctcgaggccctatctggctag

SEQ ID NO: 125152 - DNA, 627 bp, Artificial Sequence
  Description of Artificial Sequence: Synthetic coding sequence
atggcttcactcagcaggccctcacttccaagttgcttgtgctctttccttctgctgctactcttgcaggtgtcgtcatcctacgcaggacagtttcgtgtaatcggccccaggcacccgatcagggccctggtaggagatgaggttgagctcccatgcaggatttcacctggtaaaaacgctacgggcatggaggtcggttggtatcggccacccttctcaagggtggtgcatctgtaccgaaacgggaaggaccaggacggcgaccaagcacccgaataccgcgggcgtactgagctactcaaagacgccattggggaaggcaaagtcacgctacgcattcgtaacgtgaggtttagtgatgagggcgggttcacctgtttcttcagggatcatagttaccaggaagaagccgccatggaactgaaggtcgaagatccattctactgggtaagtcctggcgtactggtgctgttggccgtactgccagtgttgctgctccaaatcaccgttggactggtgttcctctgccttcagtataggctgcgtggcaagctgagagccgagatcgagaatctgcaccggacattcggacaattcctcgaggagctgagaaatcctttttag

SEQ ID NO: 125153 - DNA, 621 bp, Artificial Sequence
  Description of Artificial Sequence: Synthetic coding sequence
atggcatctctctcccgcccctcgctaccctcctgcctctgctcatttctgttgctgctattactccaagtatcaagttcctatgccggacagtttcgtgtgatcggcccaagacatcctatacgcgcgcttgtcggggacgaagtagaactgccatgtcgtatatcacccgggaagaatgccaccggcatggaggtgggctggtatcgcccaccattttcaagagtggtgcatttatatcgaaacggcaaggaccaggatggcgatcaggctcccgaatatcgcggtagaacagagctgcttaaggacgctatcggggaagggaaagtgaccctccggatcaggaacgtgaggtttagcgacgagggtggcttcacttgttttttccgagatcacagctaccaagaggaagccgccatggagttgaaggtcgaggaccctttttattgggtttctcctggggtgctggttctgctggctgtgcttcccgtccttctccttcagatcacagtaggcctcgtttttttgtgccttcagtacagattacggggtaagctccgggcagaaatagagaacctccaccgtacctttgtgtttcatctagaagccctttccggatag

SEQ ID NO: 125154 - DNA, 534 bp, Artificial Sequence
  Description of Artificial Sequence: Synthetic coding sequence
atgagccatatttcttgggaagagaggtaccgaaatggtaaagatcaggatggtgaccaggcacctgagtacaggggacgaacagagctgcttaaggacgcaatcggcgaggggaaggtgaccttgaggataaggaacgtgcgattctcagatgaaggaggctttacatgtttctttcgcgaccactcataccaagaggaagccgccatggagctgaaagtcgaggacccgttttattgggtgtcacccggcgtgctcgtcctgcttgccgtgctgcctgtgcttcttctgcaaattacagtgggactagtcttcctgtgcctgcagtacagacttagggggaagctacgagctgagatcgaaaatttgcatcgcacctttgaccctcacttcttgcgcgtcccctgttggaagattaccctgttcgtgatcgtaccggtgttaggcccacttgtagccttaataatttgctacaattggttgcataggaggctcgcgggacagttcctcgaggaactaaggaacccattctag

SEQ ID NO: 125155 - DNA, 621 bp, Artificial Sequence
  Description of Artificial Sequence: Synthetic coding sequence
atggcttccctgtctcgcccaagcctcccgagttgtctctgtagcttcctgctgctgctgttgctgcaggtgtcgagtagctatgctggtcagttcagagtgataggcccccgccatcccatcagagcattagtcggcgacgaggtagagcttccttgtagaatcagccctggaaaaaacgcaactggtatggaggttggctggtaccgcccccccttctcccgggttgtacatctgtaccgtaacggcaaggaccaggatggagatcaggctcctgagtatcgaggaagaacagagcttttgaaggacgccatcggagaggggaaagtcaccttgcgtattcgcaacgtccgcttctcagatgaaggtggttttacctgttttttccgggaccattcttatcaggaagaggccgccatggagctaaaggtcgaggacccattttactgggtctcccctggagttctggttctgctagctgtgcttccggtgcttcttctccagatcactgtggggcttgtatttctgtgtctccaataccgcctgcgggggaaattacgtgctgagattgaaaaccttcatcgcacctttgtgttccatttagaggccctgtccggatag

SEQ ID NO: 125156 - DNA, 621 bp, Artificial Sequence
  Description of Artificial Sequence: Synthetic coding sequence
atggcctcgctcagtcggccctcactccccagttgcctgtgctctttcctgttgctactgcttctccaggtaagctcaagctacgcagggcaatttcgggtcataggtcctagacaccctatccgagccctcgtcggtgacgaggtggagttgccttgccgcatcagccccggcaaaaacgctaccggaatggaagtagggtggtatcggccaccgttttcccgagtggtccatctctatagaaatggaaaagaccaggatggtgaccaagctccagagtacagagggcggaccgaactgctcaaggacgcgattggcgaaggtaaggtgaccctgaggatacggaacgttaggttcagcgacgaaggcggcttcacatgcttcttccgagaccacagctatcaagaagaagcagcaatggagttgaaggtagaggatccgttttactgggtgtctcctggcgtgctcgtgcttctggcagttctgcccgtgctcctgcttcaaatcacggtgggactggtatttctgtgcctgcagtatcgcctgcggggcaaactgagagccgagattgagaacttgcacagaacattcgtatttcacctggaagcactgagcggttag

SEQ ID NO: 125157 - DNA, 534 bp, Artificial Sequence
  Description of Artificial Sequence: Synthetic coding sequence
atgagtcacataagctgggaagaaagatataggaatggcaaggatcaggacggtgaccaggctcctgagtacaggggtaggacagaactgctaaaagacgccattggcgaaggaaaggtcaccttacgtatccgcaacgtgaggttcagtgatgaaggagggttcacctgtttcttcagagaccattcctatcaggaagaggctgccatggagttaaaagtggaggatccattttactgggtctctcccggagtgctcgtcctgctagcagtgcttcccgtgcttcttctgcagattaccgttggccttgtcttcttgtgcctgcagtacagactgcgtgggaaacttcgagctgaaatcgagaatctgcaccgaaccttcgacccacactttctgcgagtgccttgttggaagatcactttatttgtcatagtccccgtactgggacccctggtcgctctgatcatttgctataactggctgcacagaagattagctggacagttcctcgaggaactgaggaacccattttag

SEQ ID NO: 125158 - DNA, 621 bp, Artificial Sequence
  Description of Artificial Sequence: Synthetic coding sequence
atggcttctttatccaggccatccttgcctagttgtctgtgttccttcctcttactcctgctcctgcaagtaagttctagctatgccgggcaatttagggtgataggccctcgtcacccgatccgcgccctggtcggtgatgaagtcgagttgccttgcagaatatctcctggcaaaaatgcaactggaatggaagtcggatggtaccgccccccattttcaagggtggtacacctgtaccgcaatggcaaggaccaggatggcgaccaggccccggaataccgtggtagaacagaattgctaaaggacgccataggggaaggcaaggtaacactgcggatacggaatgtgagattttctgatgaggggggtttcacgtgctttttccgtgaccactcttatcaagaagaagctgctatggaactgaaggtcgaagatcccttctactgggtgtcacctggcgttctggtgctactggcagtgttgcccgtgcttctgctgcagatcacagtcggcctcgtgtttctttgtcttcagtacagactgcggggaaagctgcgggctgaaattgaaaatttgcacagaacattcgtgtttcacctggaggcactcagcggctag

SEQ ID NO: 125159 - DNA, 174 bp, Artificial Sequence
  Description of Artificial Sequence: Synthetic coding sequence
atggcctcgctatcgaggcctagcctgccaagctgtctctgctctttcttgcttttgctgttactacaggtctcttccagttacgccgggctggttgctgtggcccgttcttggttgatcgctgccagtacctctcaggctcaggtgatccttctgacacaaccactcgaatag

SEQ ID NO: 125160 - DNA, 621 bp, Artificial Sequence
  Description of Artificial Sequence: Synthetic coding sequence
atggcttccctgagcaggccttcccttccatcttgtctgtgctcattcctccttctgctgttgctgcaggtgtccagcagttatgcaggccaattcagagtaattggcccgagacatcctatccgggccctggtaggcgatgaggtagagctgccctgtaggatcagcccaggcaagaacgccactggaatggaagtcggatggtaccgtcccccgttttcaagggttgtgcacctgtatcgaaatggaaaggatcaggacggagaccaggctccagaatatagaggcaggaccgagctcctgaaagacgccataggcgaaggaaaagtcacattgaggatcagaaacgtgaggttttctgacgagggcggatttacttgctttttcagagatcacagttaccaggaggaagccgctatggagctgaaagtcgaagaccccttttactgggtgagtccgggcgtcctggtgctgctcgcagttcttccagttttactgctgcagatcactgttggattagtgtttctgtgcctccaatatagactgagagggaagctgcgagctgagatcgaaaacctgcataggaccttcgtgttccatctggaagcattgtccggatag

SEQ ID NO: 125161 - DNA, 516 bp, Artificial Sequence
  Description of Artificial Sequence: Synthetic coding sequence
atggctagcttgtcccggccgtccctcccgtcctgcctgtgcagctttcttcttttactactgctgcaggtttccagttcgtacgctggccagttccgcgttattggcccgcggcacccaatccgagcactggtgggcgacgaggtagagctcccatgtaggatcagtcccggcaaaaacgccactgggatggaagtcggctggtatcggccacccttttcacgggtggtgcatttatataggaatggcaaagaccaggacggtgatcaggctcccgagtacaggggccggacagagcttcttaaggacgcaattggagagggcaaagttacactgaggataagaaacgtgcgcttttccgatgagggcgggtttacctgtttttttagagaccactcctaccaggaggaagcagctatggagctcaaggtggaggtgtcacactccgtcacacaagactggctgcagtggcacgatcacgggtctctgcagccaccccctcctcgtctgaaatag

SEQ ID NO: 125162 - DNA, 621 bp, Artificial Sequence
  Description of Artificial Sequence: Synthetic coding sequence
atggcttctcttagtagacccagtctgccatcatgcttgtgtagcttcctattactgttgttgttgcaggtatccagcagctacgccggacaattccgggtgattggacctaggcacccaataagggcccttgtaggagatgaggtcgaacttccctgccggatctctcccgggaagaacgccaccggcatggaggttggctggtataggccaccattcagtcgcgttgtgcatctgtatcgaaacggcaaagatcaggatggcgaccaagccccggagtatcgaggccggacagaacttctgaaggatgcaataggcgagggtaaggtcaccctgcgcattagaaacgtgcggttttctgacgaaggcggattcacctgcttttttcgcgatcattcataccaggaggaggccgctatggaacttaaagtcgaggacccgttctactgggtgagccccggcgtgctagttctgcttgcagtcctgccagtcctcctgctccagattacccttggactcgtcttcttgtgccttcagtatcgtctcaggggcaagctgcgtgccgagatcgagaacctacacagaacatttgtatttcatttagaggccctgagcggatag

SEQ ID NO: 125163 - DNA, 516 bp, Artificial Sequence
  Description of Artificial Sequence: Synthetic coding sequence
atggcttccctttcccggccttcattaccctcttgcctgtgttcctttttgctcctacttctactgcaggtgagctcctcctatgccggccagttccgcgttatcgggcctcgacacccaattagagccctagttggcgacgaggtggaactgccgtgtcggattagtccaggcaaaaatgccacgggaatggaggtgggctggtacaggccgcccttttctcgggtggtgcatctgtaccgcaacggtaaggaccaggacggggaccaggccccagaatacagaggtcggaccgagctgttgaaagatgcaatcggtgagggaaaggtgacactgcgaatcagaaatgtccgcttctctgatgagggcggatttacttgtttttttcgagatcattcgtaccaggaagaggcggcaatggagcttaaagtggaggtgagtcacagtgtgactcaggattggttgcagtggcacgaccacggatccctgcaaccacctccgccacgccttaaatag

SEQ ID NO: 125164 - DNA, 516 bp, Artificial Sequence
  Description of Artificial Sequence: Synthetic coding sequence
atggccagccttagtaggccttcccttcctagttgcctgtgttccttcctgctgctactgctgctgcaggtcagtagctcatatgcgggccagtttcgtgtgataggcccaagacaccccatccgggcgctcgtgggagatgaagtggagctgccctgtagaatttcacccggcaaaaatgccacgggaatggaggtgggctggtaccggcccccattcagccgtgtggtgcacttgtataggaatgggaaggatcaggatggggatcaggcccccgagtatcgcgggagaacagagcttctcaaggacgcgattggtgagggtaaagtgactctcagaatacgtaacgtcagattctctgatgagggcggcttcacatgtttctttagggaccactcttaccaagaggaggccgcgatggagcttaaggtagaggtttctcatagcgtgacccaggattggctccagtggcacgatcacggtagcctgcagcctccaccaccgcgtctgaagtag

SEQ ID NO: 125165 - DNA, 627 bp, Artificial Sequence
  Description of Artificial Sequence: Synthetic coding sequence
atggccagtctgtctcgcccatctttgccttcctgcctctgttcctttctcctgcttttattacttcaagtgtcatcaagttatgcaggccagttccgcgtgatcggccccagacatcccattagggccctggtcggcgatgaagtagagctgccgtgccgcatttctcccgggaaaaacgccactggcatggaggtggggtggtatcgtccgccgttcagccgtgtcgtgcacctgtaccgcaacgggaaagaccaggatggcgatcaggcacccgagtacagggggcggacagagctgctcaaagacgctatcggtgaagggaaggtgactcttcggatacgcaatgtgaggttcagcgacgaggggggctttacctgtttctttcgagaccactcttaccaggaagaggccgctatggaattaaaggtggaagacccattttattgggttagccctggcgttctggtgttgttggctgttcttcctgtcttgctgctgcagatcactgttgggctggtttttctttgcctccagtatagactgagggggaagcttagagccgaaattgagaatttgcatagaacttttgggcagttcctggaagagcttcggaaccctttctag

SEQ ID NO: 125166 - DNA, 174 bp, Artificial Sequence
  Description of Artificial Sequence: Synthetic coding sequence
atggcctcactgtcacgcccatctcttccctcctgcctctgttcttttcttctgttactgctgcttcaggtatctagctcctatgcgggccttgtggccgtggcgaggagttggctgattgctgcctctactagccaggctcaggtgattctactcacacagccactcgaatag

SEQ ID NO: 125167 - DNA, 627 bp, Artificial Sequence
  Description of Artificial Sequence: Synthetic coding sequence
atggcttccttatcacggccgtccctgcctagctgcttgtgtagcttcctacttcttctgcttctgcaggtcagctcctcctatgctgggcagtttcgggtaatcggaccaagacatccaatccgagctctagtgggtgacgaggttgagttaccctgccgcatttctcccggcaagaacgctactggcatggaagtgggctggtatcggccccccttttcaagagttgtgcacctgtatcgaaacggaaaggatcaagacggagaccaggcgcctgagtatcgaggccggactgagcttcttaaagatgctatcggtgagggcaaggttacactcagaattaggaacgttcggttttccgatgaagggggatttacctgcttttttagagaccatagttatcaggaggaagcagctatggagttgaaagtcgaagatcccttctactgggtgtcacctggagtactggtcttactcgctgttctccccgtgctgctgctgcagatcactgttggtctggttttcctgtgtctgcaataccggttgaggggaaagctgcgggccgaaatcgagaacctgcaccgcacatttggacaattcctcgaggaacttaggaatcctttctag

SEQ ID NO: 125168 - DNA, 174 bp, Artificial Sequence
  Description of Artificial Sequence: Synthetic coding sequence
atggcttctctgagtcgaccatcactgccctcttgcctttgtagcttcctgctgcttctgctccttcaggtgtcatccagctacgctggactcgtcgcagtggccagatcatggctgatagcggcaagcacctcccaggcccaagtaattctattgacccagcctctggaatag

SEQ ID NO: 125169 - DNA, 534 bp, Artificial Sequence
  Description of Artificial Sequence: Synthetic coding sequence
atgtctcacattagttgggaagagaggtatcgcaacggcaaagaccaggacggcgatcaggcaccagagtacagggggcgcaccgagcttctgaaggatgccataggagagggcaaggtgacgctgagaattaggaacgtgcgcttttccgacgaaggtggcttcacttgcttctttcgggaccacagctatcaggaggaagccgccatggaacttaaggtggaggaccccttttactgggtatccccaggcgtgcttgtcctcctcgcggtgctgcccgtgctgcttttgcagattacagtcggcttagtgtttctttgccttcagtatagacttcggggaaagttgcgggcggagattgagaacttacatcggacttttgatccgcactttctaagggtgccgtgctggaagattaccctgttcgtgatcgtgccagtactcgggcccctggttgcactcataatctgctacaactggcttcacagacgtttagcgggccaattcctagaagagctgcgaaatcccttttag

SEQ ID NO: 125170 - DNA, 516 bp, Artificial Sequence
  Description of Artificial Sequence: Synthetic coding sequence
atggcaagtctctcacgcccatccctgcctagctgcttatgtagttttctgttactgctgcttcttcaggtctcgtccagttatgctggacagtttagagtgatcggcccaaggcatcccatccgcgccctggtgggcgacgaggtggagctgccctgccgtatttctccaggcaagaatgcgacaggcatggaggtgggatggtatcgaccgcccttttccagagtggttcacttatacagaaatggtaaggatcaggacggagatcaggcacccgagtaccgaggccggactgaactgttgaaggacgccatcggtgaggggaaggtcaccttgaggattcggaatgtccggttcagtgatgaggggggtttcacgtgtttctttagggaccacagctatcaggaagaagccgccatggagctcaaagtcgaggtcagtcattctgtgacccaggattggttgcagtggcatgatcatggctctctccaaccgccgccccccagactcaagtag

SEQ ID NO: 125171 - DNA, 534 bp, Artificial Sequence
  Description of Artificial Sequence: Synthetic coding sequence
atgagtcatatctcttgggaagaacgttaccggaatggtaaggaccaggatggcgatcaggcaccagagtataggggtaggacggagcttttgaaagacgcgatcggagaaggcaaggtcactctcagaattcggaatgtgcggttcagtgacgaaggaggattcacctgctttttccgcgatcattcataccaggaggaagccgccatggagctgaaagtcgaagacccattctattgggtgtccccgggcgtgctggtgcttctggccgtcctacccgttctgctgcttcagatcacactcggattagtgttcctttgcttgcagtatcggctgcgaggcaaactcagggccgagattgaaaatctgcatcgaactttcgacccccactttctccgcgtgccatgttggaaaattactcttttcgtcattgtccccgtgctcggacccctggtcgccttgatcatatgttataattggctacataggaggctagctggccaattcctggaggagcttaggaatcctttctag

SEQ ID NO: 125172 - DNA, 627 bp, Artificial Sequence
  Description of Artificial Sequence: Synthetic coding sequence
atggcctccttgtcgcgcccatctctgccgtcatgtctctgttccttcctcctgcttcttctgctccaggtgtcctcgtcgtacgctggacagttccgtgtcatcggaccacggcaccctatcagggctctggtgggcgatgaagtggagctcccatgtaggataagtcctggcaagaacgcaactggaatggaggttggctggtataggcccccatttagccgtgtcgtgcatctctacagaaacggtaaagatcaagatggcgatcaggctccagagtaccgggggagaactgaacttttgaaagatgccatcggagaaggaaaggtgacgctgcggattcgtaacgtgcgattctcagacgagggtggcttcacctgttttttccgggaccatagttatcaggaagaagctgccatggagctcaaggttgaagacccattttattgggttagccctggcgttctggtgttgctggctgtgctgcctgtcctgcttctgcagatcaccgtgggactcgtatttctgtgtttacagtaccggctcagaggtaaactacgagctgagatagagaatctccatcgtacattcggtcaatttctcgaagagcttaggaaccctttttag

SEQ ID NO: 125173 - DNA, 174 bp, Artificial Sequence
  Description of Artificial Sequence: Synthetic coding sequence
atggctagcctgtccaggccttccttaccaagttgcctgtgcagcttcttgcttttgctattgctgcaggtctccagcagctatgccggcctggtcgccgtagctcggagctggctgatagctgcaagcaccagtcaggcccaggtgatcctcttaactcagcccttagagtag

SEQ ID NO: 125174 - DNA, 174 bp, Artificial Sequence
  Description of Artificial Sequence: Synthetic coding sequence
atggcctctctcagccggccctcgctgccttcctgcttgtgtagctttctacttctgttactgctgcaggtgagctcctcctacgccggcctcgtagccgtagcccgcagttggctcatcgccgcctctacaagccaggcgcaggtcatcttactgacacaacccctggagtag

SEQ ID NO: 125175 - DNA, 534 bp, Artificial Sequence
  Description of Artificial Sequence: Synthetic coding sequence
atgtctcacatctcctgggaagagcggtatcgcaacggcaaagatcaagatggggaccaagcacccgaataccggggtcgcacagagctcctaaaagatgcaatcggtgaaggtaaagtgactctgcgcatccgcaatgtgcggttctcggatgagggtgggtttacctgcttcttccgcgaccactcatatcaagaggaagcagctatggagctgaaggtcgaagaccccttctactgggttagtcctggcgttttagtgctgcttgcagttttgcccgtgctgctgctgcaaataaccgtcggtctggttttcttatgtctccagtacagactgcggggcaaactcagagcggaaattgagaaccttcatcggaccttcgacccccattttctacgcgtcccttgttggaagattacattgtttgtaatcgttcccgttctggggccactggtggctcttataatctgttacaattggctacataggcgcctggccggtcagttcctggaagagctgcgaaacccattttag

SEQ ID NO: 125176 - DNA, 516 bp, Artificial Sequence
  Description of Artificial Sequence: Synthetic coding sequence
atggcaagcctgagccgcccgagtctgccgtcttgcctttgctccttcctactactgctgcttctgcaggtgtctagctcttatgccggtcagttcagagtgattggacctaggcaccccattcgtgccctggtgggggatgaggttgagctgccctgtcgcatttctcccgggaagaacgccacaggaatggaggtgggttggtacagaccccctttctctagagttgtgcacctgtaccggaatggcaaggaccaagacggcgaccaggcccctgagtacagaggcaggacggagctgctcaaagacgctatcggcgagggaaaagtgacactgcggatccgaaacgtccggttttccgatgagggcggctttacctgtttctttagggaccacagctatcaagaagaggcagcgatggaactaaaagtcgaggtgagccacagtgttacacaagattggctgcagtggcacgatcacggatcccttcaaccgccgcctcccaggttgaagtag

SEQ ID NO: 125177 - DNA, 534 bp, Artificial Sequence
  Description of Artificial Sequence: Synthetic coding sequence
atgagccacatctcatgggaggagcgctatcgcaacggcaaggatcaggatggcgaccaggcccccgagtacaggggaagaactgaactgctgaaagatgcaattggagaaggcaaggtcaccctgcgcatccggaacgtgcggttcagcgacgaggggggtttcacatgcttctttcgcgaccactcataccaggaagaggccgcaatggagctgaaagtggaggaccccttctattgggtctcccccggggtcttggttcttcttgccgtcctccctgtgctgttgcttcagattactgtcgggctagtgtttttatgtctgcagtacagattgcggggcaaactgcgagctgagatagagaacctacataggacatttgacccccattttctgcgagtgccctgttggaagataacgctgtttgttatagttcccgtcctaggccccctcgtggcattgatcatctgctacaactggctccacaggcgattagccgggcagttcttggaggagctaagaaatccgttttag

SEQ ID NO: 125178 - DNA, 174 bp, Artificial Sequence
  Description of Artificial Sequence: Synthetic coding sequence
atggcctctctgagcaggccaagcctccctagctgcctgtgttcttttctgctgctgctgctgctccaggttagctccagttatgccggtcttgtggccgttgctaggtcttggctgatagctgcaagcacatctcaggctcaggtcatcttgctgacccaaccactagagtag

SEQ ID NO: 125179 - DNA, 627 bp, Artificial Sequence
  Description of Artificial Sequence: Synthetic coding sequence
atggcctccctgtcaagaccttctttgcccagctgcctgtgctcattccttcttctattacttcttcaggtgtcaagcagctatgctgggcaatttagagtgataggaccacgacaccccattcgggcccttgttggtgacgaagtcgagctgccttgcagaatctcacccggtaagaatgcaacgggaatggaggtgggctggtacagacccccgttctctcgcgtggtacacctgtatcgcaatggcaaggaccaggatggcgaccaagctccggagtatagaggaagaacagagctgcttaaggatgcaattggcgaaggaaaggtaacattgcgtatacggaatgtgcgcttctccgatgagggtggattcacctgttttttcagagaccactcttatcaggaggaggctgccatggagctgaaggtcgaagatcccttctactgggtttcgccaggagtgctagtacttctcgcagttctgccggttctgcttctgcagatcacagtgggcctggtctttttgtgcttacagtaccggcttcgtgggaagctgcgagctgaaattgaaaatctccatcgcacctttgggcaattcctagaggaactacgcaaccctttttag

SEQ ID NO: 125180 - DNA, 327 bp, Artificial Sequence
  Description of Artificial Sequence: Synthetic coding sequence
atggcttctctatcccggcctagcctaccgtcctgcctctgctcatttctgttactgttgctgttgcaggtgagtagtagctacgcggatcccttctactgggtctctccaggggtactggtcctgcttgccgtgcttccggttctattgttacagattacggttggtttgatttttctgtgtctgcagtacaggctccgaggcaagctcagggcagagatcgaaaaccttcaccgcacctttgaatcatttggtgtcctcgggccccaggtgaaggaaccgaagaagactggccagtttctggaagagctcaggaatcctttctag

SEQ ID NO: 125181 - DNA, 753 bp, Artificial Sequence
  Description of Artificial Sequence: Synthetic coding sequence
atggctcccggcgcaccctcatcctcacccagcccgatactggccgtgctactgttctcctccttggtcctgagccccgcccaggccatagtggtgtacactgaccgggaagtccacggcgcagttgggagcagagtcactctgcattgtagcttctggtcttctgaatgggtttcagacgacatttcatttacttggagataccagcctgagggagggcgcgacgctatcagcattttccattacgccaagggacaaccctatattgatgaagtgggcacatttaaagagcgcatacaatgggtgggagatccacggtggaaggatgggtctatagttattcacaatcttgattactccgacaatggcacctttacttgtgacgtgaagaacccacctgatatagttggaaagacaagccaggtgacattatatgttttcgaaaaggtcccgactagatacggagtcgtcctgggggcagtgattggtggcgtgttgggtgtcgtgttgctgcttctgctgctcttttacgttgtgcggtattgctggctgagaagacaagcagcccttcaacgaagacttagcgcaatggagaagggtaaactccataaaccaggtaaagatgcgagcaagcgaggccgccaaacaccagtcctgtaccaatgctggactacagccgaggcccccaagttgagtgtgagacggcgccctcggggctggggttctctggctcgcatccgcaattccggttag

SEQ ID NO: 125182 - DNA, 777 bp, Artificial Sequence
  Description of Artificial Sequence: Synthetic coding sequence
atgcttagggctcccgccccagcccctgctatggcacccggggcaccttccagcagcccgtccccgattctcgccgtgctcctgttcagctctctggttctgtctcccgcccaagcgattgtcgtgtataccgacagggaggtacacggggctgtgggttccagagttacactacactgttcattttggtcatctgagtgggtgagtgacgatatctctttcacatggcgataccagcccgagggagggagggatgcaatatccatcttccactatgcgaaggggcagccctacattgatgaggtgggcacattcaaagaaaggattcagtgggtaggggatccccggtggaaagacggatcaattgtcatccacaacctcgactattccgacaatgggactttcacctgcgacgtcaaaaatccccccgacatcgtcggaaaaacttcgcaagtgacattatatgttttcgagaaagtcccgactaggtacggagtggtgctgggagcagtgataggaggtgtacttggagtggtgctgcttctcctgctgctgttttatgtggtcagatattgctggctgcggcggcaggccgccctacagcgccggctgagcgctatggaaaagggtaaactccacaagcccggcaaagacgcctcaaaaaggggccgtcaaacaccagtgctgtatgccatgcttgatcactctagatctacaaaagctgtatcagagaagaaagcgaaggggttgggggagtcccgcaaggataaaaagtag

SEQ ID NO: 125183 - DNA, 747 bp, Artificial Sequence
  Description of Artificial Sequence: Synthetic coding sequence
atggcccctggcgcaccctcttctagccctagtcccattctagcggtcctgctgtttagctcactcgtgctcagccccgctcaagcaattgtggtctatacagatcgcgaagtccatggcgcggtgggttccagggtgactctccattgctcgttctggagtagcgagtgggtgagcgacgacatctccttcacgtggcggtaccaacccgagggaggtcgtgacgctattagcatatttcactatgccaagggacagccttacattgatgaagtgggtacctttaaggagcggattcagtgggttggagacccaagatggaaagatggaagcatagtgattcacaacttggattatagtgataatggtacctttacatgcgatgtcaagaatccccctgacatcgtgggcaaaacctcacaggtgacactttacgtgtttgagaaggtccctacccggtacggagttgtgctgggtgccgtcattggtggcgtattgggagtggtgcttcttcttctcctgctgttttacgttgtacgttactgttggctgagacggcaggcagcactccaaaggaggctgtccgctatggagaagggcaagctacataagcccgggaaagacgcaagcaagcggggaaggcaaactccggtgctgtacgccatgctggatcactcaagaagtactaaagcagttagcgagaaaaaggcgaaggggcttggcgagtccagaaaagataaaaagtag

SEQ ID NO: 125184 - DNA, 747 bp, Artificial Sequence
  Description of Artificial Sequence: Synthetic coding sequence
atggcaccgggggccccttcttcttccccctctcccatacttgctgtcctgctcttctcaagcctggtcctgagcccagcacaggcgatcgtcgtttataccgaccgcgaggtacacggtgccgtcggctccagagtcactctgcactgttcgttctggtcctcagaatgggttagcgatgacatcagtttcacctggcgctaccagcccgagggtggcagagacgccatcagcatattccactacgccaaaggtcagccttatattgacgaggtcggtacttttaaggagagaatccagtgggtcggcgatcccagatggaaggacggttccatagttattcataatctggattactcagacaacggcacattcacttgcgatgttaaaaatccgcccgatatcgtcggaaagaccagccaggtgaccctgtatgtcttcgagaaagtgccaacgagatacggggtggtcctgggggctgttattggcggcgtgctcggcgtcgttctccttttgctgctgctgttctatgttgtgaggtactgctggctgcggcgccaggcagccctgcagcgccgcctttccgcaatggagaaaggtaagttacacaaaccgggcaaagatgctagtaagaggggacggcagacaccggtcctctatgctatgctcgaccattcgcggagcacaaaggctgtgagcgagaagaaggcgaagggccttggtgagtcccggaaagacaagaagtag

SEQ ID NO: 125185 - DNA, 648 bp, Artificial Sequence
  Description of Artificial Sequence: Synthetic coding sequence
atgtatgggaagtcctcaaccagagcagttctgctcctcctcggcatccagctgaccgcactatggccaatagcagccgtggagatttatactagtcgggtgctggaggcggttaatgggaccgatgcccgattgaagtgcacgttttcttcgttcgcaccagttggtgacgccctgactgtgacctggaattttcggcccctggatggtggacccgaacagtttgtgttttattaccacatcgatcctttccagcctatgagtggccgattcaaggatagggtatcttgggacggtaatccagagagatacgacgccagcatattactgtggaagctccagtttgacgacaacgggacctacacgtgccaggttaagaaccctccagatgtcgacggcgtgattggggaaataaggttgtctgtggtccatacagtgcgcttctcggagatccattttctagctctagcaattgggtccgcttgtgctctgatgattatcattgtcatagtggtcgttctcttccagcactacaggaaaaagcggtgggccgagcgcgcccataaggtcgtcgagattaagagcaaggaggaggagagattgaaccaagaaaaaaaagtaagtgtatatctggaagacactgactag

SEQ ID NO: 125186 - DNA, 648 bp, Artificial Sequence
  Description of Artificial Sequence: Synthetic coding sequence
atgtatgggaagtcatccactcgggcagtgctcctgctgctgggaattcagttgaccgccctgtggcctattgccgccgttgagatttataccagcagagtgctagaggctgtgaacggcaccgatgcaaggttgaagtgtaccttttcatcatttgcccctgtcggggatgctttgacagtcacctggaacttcaggccgttggacggcgggcctgagcagtttgtcttctattatcatatagatccgtttcagccaatgtctggtcggttcaaggatagagtgagttgggatggcaatccagagcggtatgatgcatccattttactgtggaaactgcagttcgacgacaatggcacctacacctgtcaggtgaagaatccgcctgatgtggatggcgtgattggagagataagattgtccgtcgtgcacaccgtgcgcttctctgaaatacactttctggctctggcgataggctcggcatgtgcactaatgataatcatcgtgattgtcgtggtgctgttccagcactaccgcaagaaacgctgggctgagagagctcacaaggtggtggagattaaatccaaagaagaagagcgcctgaaccaagaaaagaaggtttctgtctacctagaggacacagattag

SEQ ID NO: 125187 - DNA, 708 bp, Artificial Sequence
  Description of Artificial Sequence: Synthetic coding sequence
atgcagcaacgtggtgctgccgggagcagaggttgcgcgctgttccccctgttaggcgtgctttttttccagggcgtctatatagtgttctctctggaaatcagggctgacgcccatgtgcgaggctacgtcggggagaagatcaaattaaaatgtacgttcaaatccacttcagatgtgactgataagctgactatagactggacataccgccctccttcctcgtctcatacagtaagcatttttcactaccagtcttttcagtatccgacgactgcagggacattccgtgaccgcatctcttgggttggcaacgtctataaaggagatgcctctattagtatctctaatcctactattaaggataacgggactttttcatgcgcggtgaaaaatccaccagacgtacatcataacatacctatgacagagttaaccgttacagaacggggtttcggtacaatgctgtcttccgtggcccttttgagtattctagtttttgtgccctcagctgtcgttgtcgccctgctcctggtccgcatgggcaggaaagccgccggactgaagaaacggtcccggtccggctacaagaagtcctcgatagaggtttctgacgataccgaccaagaggaagaggaggcctgtatggcgaggttgtgcgtcagatgtgctgagtgcctggactctgactacgaggagacctactag

SEQ ID NO: 125188 - DNA, 672 bp, Artificial Sequence
  Description of Artificial Sequence: Synthetic coding sequence
atgcagcagaggggagcggcgggaagccgcggctgcgccctgttcccactcttaggagtattgtttttccaggacgcccacgttcgaggatacgtgggtgagaaaattaaactcaaatgcacattcaagtcaacgagcgatgtgaccgacaagctgacaattgattggacatacagaccacccagtagcagccacactgtttccatcttccattaccagagtttccagtaccctacgacggccggcacatttcgggatcgcatctcatgggtgggtaatgtttacaagggggatgccagcatttccatcagcaatccaactataaaagacaacggaactttcagctgtgccgtgaaaaaccccccagacgtacaccacaatatccccatgactgaactgaccgtcactgagcgggggtttggtaccatgttgagcagcgtggctctccttagtattctggtcttcgtgccgtccgctgtggttgtggccttgttactggtcaggatggggcggaaagcagctggtctaaagaagcgctcccgcagtggatacaaaaaatctagcattgaagtttccgacgatactgaccaggaggaagaagaagcttgcatggcccgcttatgtgtgagatgtgctgagtgtctggacagtgattacgaggaaacctattag

SEQ ID NO: 125189 - DNA, 3366 bp, Artificial Sequence
  Description of Artificial Sequence: Synthetic coding sequence
atgtcgctggagaacgaagacaagcgcgcaaggacccgtagcaaagccttgagaggaccgcccgagaccaccgccgcagacctaagctgtccaactcccgggtgtactggcagtggccacgttagaggtaaatactccagacatcgtagcctacagagctgcccgctagctaaaaagcgcaagttggaaggagctgaggccgagcacctggtttcgaagagaaagtctcaccctctaaaactggcgcttgacgagggatatggtgttgattccgacgggagtgaagacaccgaggtaaaggacgcttctgtgagtgacgagtccgagggcaccctcgagggtgcggaggccgagacatcaggtcaggacgagatacacaggccagagactgcggagggccgcagcccagtgaaatcacacttcggctcaaacccaatcggaagcgcaactgcctcatctaaggggagctattctagttatcaggggatcatagccacatccctgctgaacctcgggcagatcgcggaggaaaccctcgtggaggaggacctcgggcaggctgcaaagcccggacctggcattgttcacctgttgcaggaggccgctgaaggcgctgcctctgaagagggtgagaagggtctgttcattcagccggaggatgccgaggaagtggtcgaggttactacagagcggtctcaggatctgtgtccacagtccctcgaggacgcagcttcagaagagtccagcaaacaaaagggaattctaagccatgaggaggaggatgaggaggaggaggaagaggaagaggaggaagaagaggacgaggaggaggaggaagaagaagaggaagaggaggaagaggaggaggaggaagaagaagaagaagaagaggaggaggaagaagaggaagaggaggaggccgcgcccgatgtgatctttcaggaggacacctcacacacgagcgcccagaaggcccctgaattgaggggtccagagtcccccagtccaaagccagaatatagtgtgatagtagaagtaagatccgacgacgacaaggatgaggatacccatagtaggaagtccactgtgacagatgagtctgagatgcaggatatgatgaccagggggaatttggggctgctcgagcaggcaatcgctctcaaagctgagcaggtccgcaccgtgtgcgagcccggctgcccacctgctgaacagtcacagctgggccttggcgagcccggaaaagctgctaagccgctggatactgtgcggaaatcctattactcaaaagacccatcaagggccgagaaacgagaaataaaatgtccaacccccggatgtgacggaacaggtcacgtcaccggactatacccgcaccatagatcattatccggctgtccccataaggacagaattcccccggagatattagctatgcatgagaatgtgctcaaatgtcccacaccaggctgcacaggacagggacacgttaacagcaaccgaaatactcacagatctctgtctgggtgtcccatcgctgccgctgaaaagttagctaagtcccacgagaaacagcagccccaaaccggggaccctagtaagtcatcctctaattcagacaggatcttaagacccatgtgctttgtcaaacagctcgaagtcccaccgtacggatcgtaccgcccgaacgttgcccctgccaccccacgggccaatctggccaaagagcttgagaagttttctaaggtgacatttgattatgcctcattcgacgctcaagtgttcggaaagaggatgctggcacctaaaatccagacatctgaaacatcacctaaagcctttcagtgtttcgactattctcaagacgcggaagctgctcatatggctgcaaccgcaatcctgaacctgagcactcgctgctgggagatgccggagaacctctccactaagccccaagatctccctagcaagtccgtggacattgaagtggacgagaacggaacgttggatctgtcgatgcacaaacaccgcaagagagagaacgcatttccttcttctagtagttgctcttcaagcccgggcgtgaaatcccctgacgcctcacaacgacattcatcaacatcagcaccctctagtagcatgacttcaccacagagttctcaggcatcacggcaggatgaatgggatcgtcctctggattacaccaagccttctcggctgagggaagaggaaccggaagagtcggaacccgcggcccactccttcgccagcagcgaggcagatgaccaggaagtttccgaggaaaacttcgaggaacggaaataccccggtgaggtcactctcactaatttcaaactgaagttcctctccaaagacattaagaaagagctgctgacttgccctacgcctggctgcgacggctccggccatatcacaggcaactatgcctcccacaggagtctctctgggtgcccactggctgacaagtccctgaggaacctgatggccgcacactccgccgacctcaaatgccctacaccaggatgcgacggtagcggacacataacaggcaactacgcgtctcataggagcctgtcaggatgtccaagagccaaaaagagcggtgtgaaggtggcccctaccaaagacgacaaagaagatcctgagctgatgaagtgccccgttccaggttgtgtcggcctggggcacatttctgggaaatatgccagtcatagaagtgcttctggttgtccacttgcggcccgcaggcaaaaggaggggagtctgaacggcagcagcttctcctggaaaagccttaaaaacgaagggccaacttgtcccacacccggctgcgatggttctggccacgcaaacggcagttttttgacgcaccggagtctgagtggatgtcccagggccacgttcgccggtaagaagggcaaactgagcggggacgaagtgctatccccaaaatttaagacatcagacgtgctggaaaacgacgaggagattaagcagctgaatcaggaaattcgcgatttgaatgaatccaacagtgagatggaagcagccatggtgcagctccaatcacaaatctcatcaatggagaagaatttgaagaatatagaagaagagaataagctcattgaggagcagaacgaggccttatttttggagctgagtggtttgagtcaggccctgatccaatcgctggcaaatattagactaccacatatggagcccatttgtgagcagaatttcgatgcttacgtttccactctaactgacatgtacagcaaccaagaccctgagaataaggatctactggaaagcattaagcaagctgtgcgcgggattcaggtttag

SEQ ID NO: 125190 - DNA, 1776 bp, Artificial Sequence
  Description of Artificial Sequence: Synthetic coding sequence
atgagtctggagaacgaagataagagggctcgcaccaggtccaaagcgctgcggggccctccagaaaccaccgccgccgatctctcctgccccacacctggttgtaccggttcaggccacgttagagggaaatactctagacatcgatcacttcagtcatgtcccctggcgaaaaaacgtaagctggagggcgcagaggcagagcacctggtgtctaagagaaaatcacaccccctgaagcttgcactggatgaggggtatggtgtggatagcgacggctctgaggacactgaggtcaaggatgcttccgtgtctgacgagtcagagggaactctggagggagccgaggctgaaaccagcgggcaggatgagatccacaggcccgaaaccgccgaggacccttccagggctgaaaagcgagagatcaaatgccctacccctgggtgtgatggcacgggacacgtcacaggattgtatccccatcacaggagtttgagtggttgcccccataaggacaggatcccacccgagatacttgccatgcacgaaaatgtgttgaagtgccccactcctggatgtaccggccagggtcatgttaatagtaaccggaatactcatcgctccctgtcaggatgcccaatcgccgccgccgaaaagctagcaaagtcacacgaaaaacagcagccacaaacaggggacccctcaaaaagctcatccaattcagacaggattctgaggcccatgtgcttcgtcaaacagctggaagttcccccctatggctcgtacaggccgaatgtggcccccgccacaccacgagccaacctcgctaaggagctggaaaagtttagcaaagttacctttgactacgcctcctttgacgcccaggtctttggaaagcgtatgctcgctcctaaaatccagaccagtgaaaccagtccaaaggcattccagtgctttgattattcccaggacgccgaagcggctcacatggccgccaccgcaatccttaatctcagcacaaggtgctgggagatgcccgaaaaccttagcacaaagccccaagacctgccgagcaagtcagtggacatcgaggtggatgaaaatggaacactggacctgagtatgcacaaacacaggaagcgtgaaaacgcttttccgtcttcatcatcttgcagttctagtcctggtgtcaagagccctgacgccagtcagcggcactcatccaccagcgcccccagcagctccatgacctcaccccagagttcccaagcttccagacaggatgagtgggatcggccgctggactataccaagccatcgagattgagggaagaggagcccgaagaatctgagcccgcggctcactccttcgcgtctagcgaagctgacgaccaagaagtgtcagaggagaatttcgaggagcgcaagtatcccggggaagtgactttaactaattttaagttgaagttcctgtccaaggacatcaagaaagaactgctcacgtgtccgacacctgggtgtgacggtagtggtcatataacagggaattacgcctcccatcgacggtgccccacccctggctgcgatgggagcggccatataacaggcaactacgcatcacatcgttcactgtctgggtgtccgcgggcgaaaaaatctggagtgaaggtcgcacctacgaaagacgacaaagaggaccctgagctaatgaagtatgttgggccttgttggttgttccattgcatcgccgaactcagattctcctgcgtgctgtag

SEQ ID NO: 125191 - DNA, 3447 bp, Artificial Sequence
  Description of Artificial Sequence: Synthetic coding sequence
atgtccctggaaaatgaggacaagcgggctcgcacaagatccaaagctttgagagggccacctgagactacagcagcagacctgtcatgtcccactcctgggtgtactggaagcggccacgtgcggggcaagtactcacgtcatcgctccctgcaatcgtgtccgctggccaaaaaacgcaagctggagggagctgaagccgaacatctggtgagtaagcgaaaatcccaccctctgaaactagccctggatgagggctacggtgttgattcagatggctctgaggacaccgaggtgaaagacgcaagcgtttcagacgagagcgagggcacactcgagggcgccgaagccgagacatccggccaggacgagattcatagaccagaaactgctgaaggtaggtctccagtgaaatcacactttggcagcaatccaatcggcagcgccacggcatcttctaaggggtcttattcctcataccaaggtataatagccacttctctcctgaacttagggcagatcgccgaggaaaccctcgtggaagaggacctcggccaggccgcaaagccaggacctggtattgtccatctgttgcaggaggccgcggaaggagcggcgagcgaggagggagagaaggggctattcattcagccagaagatgccgaggaggtggtcgaggtaaccacagaaaggagccaggacctctgcccccagtcgctggaggatgctgcaagtgaggaatctagcaaacagaagggtatcctgagccacgaagaagaagatgaagaggaagaggaggaagaagaggaggaggaggaggacgaggaggaagaagaagaggaggaagaggaggaggaggaagaggaagaagaagaggaagaggaagaagaggaggaagaggaggaggaggaggaagaggcggccccagatgtgattttccaggaagatacatctcacacctcggcccagaaggcccctgagctgaggggacctgaatcaccttctcccaaaccggaatacagcgtgattgtggaggtacggtctgatgatgacaaggatgaagacacacattctagaaagtccacagttacagatgaaagcgagatgcaggatatgatgaccaggggcaacctgggtctgctggagcaagctatagccttaaaggccgaacaggtgcgcaccgtgtgcgaaccaggctgtcctcctgctgagcaaagtcagctaggtctgggtgagcctggaaaggccgctaagccactcgatacagtcagaaagagttattactcgaaggatccctccagggccgaaaaacgggagattaagtgtccaactcccggttgtgatgggaccggccacgtgaccggactgtatccccatcatcggtctttatctggctgtccccataaggatcgaattcctccagagattttggccatgcatgaaaacgttctgaaatgtccaacccccggatgtacaggtcagggacacgtaaactctaaccggaatactcacaggtccctctctgggtgcccaattgccgcggctgaaaaactcgccaagagtcatgaaaaacagcagccgcagacaggtgatcccagcaaatcctcctcaaattctgataggatcctgaggcccatgtgtttcgtaaaacaattggaggtgcccccctacggcagttatcgccccaatgtcgctcccgcgacaccccgcgccaatctggcaaaggaattggagaaattctccaaggtgacctttgattacgcaagctttgacgcccaagttttcggcaagaggatgctcgcgcccaagatacagacatcagaaactagccccaaagctttccagagcaaacctttcccaaaggcctcatccccgcggcacagcccaagcagctcttacgtgaggtccactagttctagctcggctgggtttgattactcacaagatgcggaagctgcacatatggcagccactgctatcctaaacctttctacccggtgttgggagatgccggaaaacctgtctaccaagcctcaggatctgccgagtaaatctgtggatattgaagtggatgaaaacggcactctggatctatccatgcacaagcacagaaagcgggagaatgcctttccttccagctctagctgttcttcctctccgggcgtgaagtctcccgacgcctcacagcgacacagctctacttccgcgccttctagcagcatgaccagtcctcagtcttcccaagcttcccggcaggatgaatgggatcgcccgcttgattatacgaagccaagtcggctgcgagaggaggaacccgaggagagcgagcccgctgcgcatagctttgcttcctctgaggctgacgaccaggaggtgtcagaggaaaacttcgaggaacgcaagtaccctggcgaagtaaccttgaccaattttaaactgaaattcttatcaaaggacatcaaaaaggagctcctgacctgtcctacacccgggtgtgacgggagcgggcacatcacgggcaattatgccagtcaccggtctttgtcagggtgccccctggccgacaaatctctgaggaaccttatggctgcacactccgcggacctcaaatgccctaccccagggtgtgatggaagcggccatattacaggtaactacgcctcccatcgcagtctgagcgggtgcccaagagcgaagaaatcaggcgttaaggtcgctcccactaaggacgataaagaagatccagaactgatgaagtgcccagtgcctggatgtgtcggcctgggtcacatcagtgggaaatatgctagtcatcggtccgcgtcgggctgtcctttggcggcgcgccgacaaaaggagggctccctgaacggctcatccttcagttggaagtctcttaaaaatgaagggccaacatgccccaccccaggctgtgatgggtccggtcacgctaatggaagcttcctcacccacagatctctgtctggatgcccacgggctacgttcgccgggaaaaagggcaaactctctggcgatgaagtgctgtctccaaaatttaagacctcggatgtgcttgagaatgatgaagaaataaagcagttgaaccaggagattagggatctgaacgagtccaactcggagatggaagctgccatggtgcagctgcagtcgcagatctcaagcatggagaagaatcttaaaaatatcgaggaagaaaataagttgatcgaagagcagaacgaagcactgtttcttgagctgagcggactgtcccaggctttgattcagtctctcgccaacattcggctaccacatatggagcccatttgcgaacagaactttgatgcatatgtctctactctgacggacatgtactcaaatcaggatccagagaacaaagatctcctcgagtccataaaacaggcagttcgggggatccaagtgtag

SEQ ID NO: 125192 - DNA, 3399 bp, Artificial Sequence
  Description of Artificial Sequence: Synthetic coding sequence
atggaggtggataccgaagagaagaggcacagaaccagaagcaagggggttcgggttcccgtggagcccgcaatccaggaactgttttcttgtcccaccccaggctgtgacggctcaggccacgtgagcggcaagtacgcacggcatcgttccgtgtacggctgtcccctggcaaaaaaacgaaagactcaagataaacaacctcaggaacctgcaccgaagcggaagcccttcgctgtgaaggccgatagctccagcgtcgacgagtgtgatgactcggatggcacagaggatatggacgaaaaagaggaggacgaggaagaggaagaagaggaagaagaggaaaatgaggaccaccaaatgaattgtcataatactcgaatcatgcaggacactgagaaagatgataataacaacgatgagtacgataattacgacgagctggttgcgaagtcactcctgaatttgggaaagattgccgaggatgccgcctaccgtgcccgcactgaatcagagatgaactcaaatacctctaactccctcgaggacgattctgataagaacgagaacctgggacgaaaatccgaactatcacttgacctggatagcgacgtcgtgcgtgagacagtggattcacttaaacttcttgctcagggccatggtgtggtgttatctgaaaatatgaacgatcgtaattacgccgactcaatgtcccaacaggatagtaggaatatgaattatgtgatgctgggtaagcccatgaataatggtctgatggaaaaaatggtcgaggagagtgatgaggaggtctgcctcagctcactcgaatgcctgcgcaatcagtgttttgatctcgctaggaagttgtccgaaaccaatccccaggaacggaaccctcagcagaacatgaatattcgccagcatgtgcgacccgaagaggatttcccagggcggaccccagataggaactactccgacatgttgaacctgatgcgactcgaggagcagctgagccctcggagccgggtattcgccagctgtgcgaaagaagacggctgtcatgagagagacgatgatactacctcagtgaactcagatagatccgaggaagtctttgacatgaccaagggaaacctaacattgttagaaaaggccatagctctggagacagagagagctaaggctatgcgtgaaaagatggctatggaagcaggcagacgcgataatatgcgctcctacgaggaccaatctccccggcagctgcctggcgaggaccggaagcccaagtcgtccgactctcatgtgaaaaaaccctactacgacccatcaaggactgagaaaaaggagtccaaatgtccgacccctgggtgcgatgggactgggcatgtcactgggctgtatccccatcacaggtctctgtcaggctgtccacataaggatagggtgccccctgaaatcctggcaatgcatgaaagcgtgttaaaatgcccaactcccggttgtaccggacgcggtcatgtgaatagcaaccgaaattctcaccgatcactctccggttgccccattgcggccgctgagaagcttgcaaaagcccaggagaagcaccaatcctgtgacgtaagcaaatcctctcaggcctctgatcgcgtcctgcggcccatgtgcttcgtgaagcagcttgagattccccaatacggctatcgaaacaacgttccgacgactacgcccagatcaaacctcgccaaggaactggagaaatactcgaaaacgagctttgagtacaactcttatgacaatcacacatacggcaaaagggccatagcccctaaagttcagacacgagatatcagcccaaagggctacgacgacgcaaagcgctattgcaaagatccctcaccatcttcctcttcaacttctagttacgcacctagtagttcctccaatctgtcttgtggggggggatccagcgcaagctccacctgcagcaagtcctctttcgactatacgcacgatatggaggccgctcatatggccgcaacagccatcctcaacttatctacacgttgccgagagatgcctcaaaacctgagcaccaagccacaggacctctgtgctacccggaaccctgatatggaagtggacgagaatgggacgctggacttgtcaatgaacaaacagagacctagggactcttgctgccctatactgactccactagagccaatgtctccccagcagcaggccgttatgaataaccggtgtttccagctgggagaaggcgactgttgggatctcccagtcgactacaccaagatgaaacccagaagaatcgacgaggatgagtctaaagacatcacacccgaagatctcgacccatttcaggaagccttggaagaacgccggtatcccggggaggtgactatcccatccccaaagcccaaatatccccagtgcaaggagtcgaagaaagacctgataactctgtcaggatgccctttggcagacaagtcgattcggtcgatgctggcaaccagttcccaagagctgaaatgccccacgcccggctgtgatggaagtggccatatcacaggaaactatgcatctcaccgatccttgagtgggtgccctagggccaaaaaatcggggattcgcatagcgcaatcgaaggaggacaaggaggaccaggaacccataaggtgccccgtgcctggttgcgacgggcagggccacataaccgggaaatatgcaagtcatcgctctgcttcaggttgccctctggccgctaaacgtcagaaggacggctacctgaacgggtctcagtttagctggaagtcagtgaagacggaggggatgtcgtgcccgaccccagggtgtgacgggtcaggccacgtatcaggaagctttctgacccatcgaagcctcagcggctgccctagggctacgtcagccatgaaaaaagcaaaattgtccggcgagcagatgctcacaatcaaacagcgggcttccaatggcatagaaaacgatgaggagattaaacagctggatgaagaaataaaagagctgaatgagtctaactcccagatggaagcagacatgatcaaactgaggacccagatcaccaccatggagtctaacctcaagacaatcgaggaagagaacaaagtgattgaacaacagaatgagtcccttttgcacgagctcgcaaatctgtcccagagcctcatccactccctcgccaacattcagcttccccacatggaccctataaatgagcaaaatttcgatgcatatgtaactactctgaccgagatgtacactaatcaggaccggtatcaatcgccagagaataaggccctactggaaaacattaagcaggctgtaaggggcatacaggtctag

SEQ ID NO: 125193 - DNA, 3561 bp, Artificial Sequence
  Description of Artificial Sequence: Synthetic coding sequence
atggaggtggacacggaagagaaacggcatcgcacccggtcaaaaggggttagggtgccggtagaacctgccatacaggaactgttttcatgtcctacacctggatgtgatggctctggccacgtctctggcaagtacgcccggcacaggtccgtgtatggatgtccactggccaaaaagaggaaaactcaggacaagcagccgcaagagccggccccaaaaaggaagccttttgccgtgaaggctgactcgagctccgttgacgaatgcgatgactccgatggtaccgaggacatggatgagaaggaagaagatgagggcgaggagtactccgaggacaatgacgaaccaggggatgaggatgaggaagacgaggaaggagatcgagaggaagaggaggaaatagaagaggaagatgaggacgatgatgaggacggcgaagacgtggaggatgaggaggaagaggaagaagaggaagaagaggaggaagaggaggaggagaatgaagaccaccagatgaactgccacaatactagaataatgcaggacacggagaaggatgataacaataatgatgaatatgacaattacgacgagctcgtcgcgaaatccctgctcaatctgggcaagattgccgaggacgccgcctacagggcgcggactgagtctgaaatgaactctaacacaagcaattccctcgaggacgattccgacaaaaatgagaacttgggaaggaagagcgagctgtctctcgacctggacagcgacgtggtgcgggagaccgtggattctctgaaactgctggcacagggacatggggttgttctcagcgagaacatgaatgacaggaactacgccgactccatgagccaacaagattcccgaaatatgaattatgtaatgctgggaaaacccatgaataatgggttgatggaaaagatggtagaggaaagcgatgaagaggtgtgcctcagtagtctcgagtgcctgcgcaatcagtgtttcgaccttgcccgcaaactgtcggaaacaaatccccaagaaaggaacccgcaacagaacatgaatatccgtcagcatgtgcggcccgaagaagacttccccggacgcacaccggataggaactactctgatatgcttaaccttatgagactggaggagcagctgtcgcctcgctctcgagtctttgccagctgtgcaaaggaagatggctgtcatgaaagggacgacgataccaccagcgtgaattccgacaggtccgaggaggtattcgatatgaccaaaggaaatcttaccttgcttgagaaagctatcgctctggaaactgaacgggctaaggccatgcgcgagaagatggccatggaggccggacgccgggataatatgcgttcttacgaggaccagtcacctagacagctcccaggagaagatagaaaacctaagtccagcgattcccacgttaaaaagccgtattatggtaaagacccttccagaacagaaaaaaaagaatctaagtgtcctacgcccgggtgtgacggcaccggccacgtgactggcctgtacccgcaccatcgctccctctctggctgtccgcacaaggatcgtgtcccacctgaaattctcgctatgcatgagtccgtgctgaagtgtcctaccccaggatgtactgggaggggccacgtgaattccaaccgcaatagtcatcgtagtctcagtggttgtccaatcgccgcagccgagaaactggccaaggctcaagagaagcatcagtcgtgtgatgtttcaaaaagctctcaggcttcagatcgcgtactgaggcccatgtgctttgtcaaacaactggaaattccgcaatatggatatagaaacaatgtgcctaccacaactcccagaagcaacttagcaaaggagctcgagaagtactctaagacatcattcgagtacaattcgtacgataatcacacatatggcaaaagggccatcgcaccaaaggttcaaacccgagacatcagccctaagggctatgatgatgcgaaaaggtactgcaaagatcctagcccttcatcctccagtacatccagctatgccccctcttccagctcaaacctgagctgtgggggcggaagctctgcttcctctacgtgttcgaaatccagttttgattatactcacgatatggaggccgctcacatggccgctacagcgatattgaacttgagcaccagatgcagagaaatgcctcaaaatctgtctacaaagccgcaagacctttgcgctacccgaaatcccgacatggaggtggacgaaaacggcaccctggacctgagtatgaacaagcagagaccccgggattcatgctgccccattctcaccccacttgagccaatgagcccccaacagcaggcagtcatgaacaaccgatgttttcagctgggggagggcgattgctgggatctgcctgtcgactacactaagatgaaacccaggaggatcgacgaggacgagagtaaagacattactcctgaggatttggaccccttccaggaagctctcgaagagcggcggtaccccggcgaagtcaccatcccgagccccaaacctaagtatccacaatgtaaggagtcgaagaaggatttaatcacactcagtggatgtcctcttgcagataaatcaattcggtcaatgctcgctacctcgtcccaggaattgaagtgtcctacaccgggatgtgatggatctggccatatcactggcaactacgcctcacacaggtccctcagcggttgtccccgcgccaaaaagagcggaattagaatcgcacagtccaaggaggataaggaggatcaggaacccatccggtgccctgtccccggctgtgatggtcaggggcacatcaccggcaagtacgcatcacacaggtcagcctcgggatgcccattggcagccaaacgtcagaaagacgggtaccttaacggttcccagttcagctggaagtccgtgaagaccgaagggatgtcatgtcccacccccggctgtgatggttctggccatgtgtctggtagctttctgacgcacaggtccctatcaggctgcccaagagcaacgagcgcaatgaagaaagctaagctaagcggcgagcagatgttgactattaagcagcgggcctccaacgggatcgaaaacgatgaagagattaagcagcttgacgaggaaattaaggagctgaacgagtcgaattcacagatggaggctgacatgatcaagctgagaacccagattaccacgatggaatccaatctgaagaccatagaggaagaaaataaagtgatagaacagcaaaacgaatccctgctccacgaactggccaatctttcccaatccctgatacactctctggccaacattcagcttcctcatatggatcccatcaacgagcagaacttcgatgcctatgtgactactctgacagagatgtacaccaaccaggaccggtaccaaagccccgagaacaaggcgttactggaaaatataaaacaggcagtgcgcggaattcaggtttag

SEQ ID NO: 125194 - DNA, 555 bp, Artificial Sequence
  Description of Artificial Sequence: Synthetic coding sequence
atgtcatgtccaacccccgggtgcgatggctccggtcacgtaagcggctctttccttacccaccgttccctaagcggatgtcccagagccacctcagccatgaaaaaggctaagttaagcggggagcagatgcttactataaagcagagggcttcgaacggtatcgaaaatgatgaagaaatcaaacagctggacgaggaaattaaggaactgaacgagtctaactctcagatggaagctgatatgataaagctgagaacacaagtcacaataaccacgatggagagcaatcttaagacaatcgaggaagagaataaggtgatcgaacaacagaatgagagcctgttgcacgagttggcgaatctgagtcaatcacttatacacagcctggcaaatattcagttgccacatatggaccctattaatgagcagaactttgacgcctatgttactacactgacggaaatgtacacaaaccaggatcgatatcagagcccagagaacaaggccctcctcgagaacattaaacaagctgtgaggggcatccaagtgtag

SEQ ID NO: 125195 - DNA, 3555 bp, Artificial Sequence
  Description of Artificial Sequence: Synthetic coding sequence
atggaggttgatacagaagagaagcgtcacaggacaagatctaaaggtgtcagggttccagtggagcctgcgattcaggaactgttctcctgccccactccggggtgtgatgggtctggtcatgtttcggggaagtacgctcgacaccggtctgtatacgggtgcccactggcgaagaaacgtaaaacacaggataagcaacctcaggagccggccccaaagcgaaaacccttcgcggttaaggccgactcgtcctctgtggatgagtgtgacgacagcgatggcaccgaggatatggacgagaaggaagaggatgaaggtgaggaatattccgaagataacgatgagcccggcgacgaagatgaggaggacgaggagggagatagggaagaggaagaggagatagaagaagaagatgaagacgacgatgaggacggcgaggacgtagaagatgaagaggaagaagaggaggaggaggaggaagaagaggaggaagaagaaaacgaagaccatcagatgaactgccacaacacccggatcatgcaagacacagagaaagatgataataataacgacgaatacgacaactacgatgagctggttgccaagagcctacttaacctcggcaaaatcgcggaggatgcagcataccgcgctcgtactgagtccgagatgaacagcaacaccagtaatagcttggaagacgattccgacaagaacgaaaatctggggagaaaaagcgagttatcactggatctggactccgacgttgtacgagaaacagttgattcactgaaacttcttgctcaaggccacggcgtggtgctctctgaaaacatgaacgatcgcaactacgctgattccatgagtcaacaggattctcgaaatatgaactacgtgatgctgggaaaaccgatgaacaacggcctgatggagaagatggtcgaggaatccgacgaggaagtgtgtcttagcagccttgagtgtttacggaaccagtgctttgatctggccaggaagctgtctgaaacgaacccccaggaacgcaacccacagcaaaatatgaacattcggcagcatgtcaggccagaggaggactttcctgggcggactcccgatcggaactactccgatatgctgaaccttatgagacttgaggagcagctatctcctaggtctcgagtatttgccagctgcgcaaaagaggacggctgtcatgagcgcgacgatgacacaacaagcgtgaattccgacaggagcgaggaggtttttgatatgaccaagggcaacctgaccctgctggaaaaagccatcgccttggaaacagagagggccaaggccatgcgagaaaaaatggccatggaggccggtcgccgggataatatgagaagttacgaagaccaatcaccgcgacagcttccaggggaggataggaaacctaagtcctccgatagccacgtgaagaaaccttactatgacccttctaggaccgagaagaaggaatccaaatgtccaacgcctgggtgtgacggtaccgggcatgtgaccggcctgtacccacatcaccggtctctcagcggctgtccacataaggatcgcgtgcctcctgagatcttggcaatgcatgaaagtgtgctaaagtgccccaccccaggctgtacgggtcgagggcacgttaacagtaatagaaactcccacaggtccctttcaggttgtcccatcgccgctgcagaaaagttggccaaggctcaggagaagcaccagagttgcgatgtgagcaaatctagccaggccagcgacagggtgttgagaccaatgtgcttcgtgaagcaactggagattccccagtacggatatagaaataacgtgcccactacaactccgcgatctaatctagccaaagagctggagaagtattccaagacgagcttcgagtacaacagctacgataaccatacatacggcaagagagccattgcgcctaaggtccaaacaagggacatctcccccaagggatacgacgacgccaaaagatattgcaaagacccctccccctcttccagtagcacatccagctatgcgcctagttcctcaagcaatttgtcttgtgggggaggctcgagtgcctcgtctacttgtagcaagtcgtccttcgattatacccatgacatggaagcagcccatatggccgccactgctattttgaatttgtccacacgctgtcgcgaaatgccccagaatctgtcgactaaaccacaggacttgtgtgctacccgtaatcccgacatggaggtggatgaaaatggaacccttgacctgtcaatgaataaacagcggccacgggactcttgctgtcctatcttgactcccctggagcccatgtctccgcagcagcaagccgttatgaacaacagatgctttcaactcggagaaggcgattgttgggatctgcccgtagattatactaagatgaagcctcgcaggattgacgaagacgaaagcaaggatattacaccagaagacctggaccctttccaagaagctttagaagagcgccgatatcctggagaggtaaccatcccgtctccaaagcccaaataccctcagtgcaaggaatcaaagaaagatctgattaccctttcggggtgcccactcgcggataaaagcattaggtccatgcttgccaccagcagtcaggagctcaagtgtcccacaccaggatgcgacgggagtgggcatattacaggtaactacgctagtcaccgatccctgtctggctgtcctcgcgcgaaaaagagcggaatcaggatcgcacaatcaaaggaggataaggaagatcaagaacctatacgttgccccgtgcccggctgcgacggacaagggcacatcacaggcaagtacgctagccacagaagcgctagtggttgtcctctggcagccaaacggcagaaggatggctatctgaatggatctcagttctcctggaaatctgtcaagactgagggcatgtcttgtcccactcccggctgcgatggcagcgggcacgtatcgggatcctttctaacccatagaagtctgagcgggtgcccccgcgccacgtcagcaatgaagaaagctaaactctctggcgaacagatgctcaccatcaagcagcgggcctctaacggcatcgagaatgatgaggaaattaagcaactggacgaagaaatcaaggagctcaacgaatctaatagccagatggaggccgacatgattaaacttcgtactcagattacaaccatggagagtaatcttaagactatcgaagaagagaataaagtaattgagcagcagaatgagtcccttctgcacgagctcgctaatctctcacagagcctcatccactcactggctaacatccagttgccccatatggatccaatcaacgaacagaactttgacgcatatgtgaccaccctgaccgaaatgtatacaaatcaggacagataccagtcaccagaaaataaagcacttctggagaatattaagcaagcagtgcgcggtatccaagtgtag

SEQ ID NO: 125196 - DNA, 552 bp, Artificial Sequence
  Description of Artificial Sequence: Synthetic coding sequence
atgtcccagaagccggccaaggaggggcccaggctcagcaagaaccagaagtactcagagcatttttcaattcactgttgccctcccttcacgtttttaaactctaagaaagaaattgtcgacaggaaatattctatctgtaaaagcgggtgcttttaccagaaaaaggaagaagattggatctgttgcgcatgtcaaaagacacggactagccgacgggctaaatccccacagcgacctaagcaacagcccgccgcgccgcccgccgtggtcagggctcccgccaagcctcgatcaccaccccggagcgaacggcaaccccgatctcctccacggagcgagcgtcagcctaggagtccaccaaggtccgagcggcagcctcgtagccctcctagaagcgagcgtcaacctcgccctcggcctgaagttcgtccaccgccggccaagcaaaggccaccacagaagtccaagcagcaaccaaggagctccccacttcgaggccctggcgcttctcgcgggggtagtccagtcaaggctagtcggttctggtag

SEQ ID NO: 125197 - DNA, 246 bp, Artificial Sequence
  Description of Artificial Sequence: Synthetic coding sequence
atgtctcagaaacctgccaaagaaggtccgcggctgagtaaaaatcagaaatattcagagcattttagtattcactgttgtcctccgtttacttttctgaactctaagaaagaaatcgtggaccggaaatatagcatctgcaaaagtggctgcttttatcaaaagaaagaggaggattggatttgttgcgcctgtcagaaaactcggctgaaacgcaagatccgccccacacccaagaaaaagtag

SEQ ID NO: 125198 - DNA, 246 bp, Artificial Sequence
  Description of Artificial Sequence: Synthetic coding sequence
atgagccagaagccagcaaaagagggcccccggctgtcaaagaatcagaagtattctgagcactttagcattcactgctgcccccctttcactttcctaaactctaagaaagagattgtcgatcggaaatacagcatctgtaagtctggttgtttttaccaaaaaaaagaggaagactggatctgttgtgcctgccagaagacacggctgaaaaggaagataagaccaacgccgaagaaaaaatag

SEQ ID NO: 125199 - DNA, 246 bp, Artificial Sequence
  Description of Artificial Sequence: Synthetic coding sequence
atgagccagaagcccgccaaagagggccctcgcctgtcaaagaatcagaagtactctgagcacttttcaatccactgctgtcccccttttacatttctgaactcaaaaaaggagattgtggaccgtaagtactcaatctgcaaatcggggtgtttttatcaaaaaaaagaagaagattggatctgttgcgcttgccagaagacaaggctcaaacggaagatacgccctacccccaagaagaaatag

SEQ ID NO: 125200 - DNA, 552 bp, Artificial Sequence
  Description of Artificial Sequence: Synthetic coding sequence
atgtcacagaagccggctaaagagggccccagactctcaaagaatcaaaagtattcagaacacttcagcattcactgctgtccaccatttacgttcctgaactctaagaaagagattgtagatcgtaaatactcaatctgtaaatcaggttgcttctaccagaaaaaagaagaagactggatctgttgcgcttgccagaagacacgcacttccaggcgggccaaatccccacagcggcccaagcagcagccagccgcccctcccgccgtcgtcagagctcctgcaaagcctagatctccaccgaggtcagagcgacagccccgctctcctccccggtcggaacgacagccaagaagccccccccggtcagaaaggcaaccccgcagccctcccaggtccgagcggcagcctcgccctcgccccgaagtgcgacctcctccagctaagcagaggccaccgcagaaatcaaaacagcagcctaggtcatccccgttacggggccctggggccagtcgcggcgggagtccagtaaaggcgagcaggttttggtag

SEQ ID NO: 125201 - DNA, 552 bp, Artificial Sequence
  Description of Artificial Sequence: Synthetic coding sequence
atgagccaaaaacccgcaaaggaggggcctagattatctaagaatcagaagtactccgaacacttttcgatccactgttgcccaccgttcacttttttgaactccaagaaagaaattgtggaccgcaaatattccatctgtaagagcgggtgtttctaccagaaaaaggaggaagattggatttgttgcgcttgccaaaaaacccgcacctccaggcgagccaagtcccctcagcgacctaaacagcagcccgccgccccccccgctgtagtcagagcccctgctaaacctcggtcccctcctagatcagagaggcagccccgatccccaccccgctctgaacggcagcctcgatccccaccgagaagtgagagacagcctcgttcgccgccccgcagtgagcggcagcccagacccaggcctgaagtacgccctccccctgctaaacagcgccccccccagaagagtaagcagcagccacgaagctccccactgagaggcccaggcgctagccgagggggctcacctgttaaagcctcaagattctggtag

SEQ ID NO: 125202 - DNA, 246 bp, Artificial Sequence
  Description of Artificial Sequence: Synthetic coding sequence
atgagccagaagccagccaaagaaggccccaggctgtctaaaaatcagaagtattcggagcatttctccatacattgttgtcctccgtttacgtttctgaacagtaagaaggagatcgtggatagaaaatatagtatttgtaagtcaggatgcttttaccagaagaaggaggaagactggatctgctgcgcgtgccaaaagacacgcttgaagcgtaagattcggcctacacctaagaagaaatag

SEQ ID NO: 125203 - DNA, 552 bp, Artificial Sequence
  Description of Artificial Sequence: Synthetic coding sequence
atgagtcagaagcccgcgaaggaagggccacggctctctaaaaaccagaagtattcagaacatttttcaattcattgttgccccccattcacctttctaaactcaaagaaggaaatcgtagatagaaagtacagcatctgcaaatctggctgcttctaccagaagaaggaagaagactggatttgctgtgcttgtcagaaaactagaacctcacggcgggcaaaatctcctcaacgcccaaagcagcagcctgctgcgccacctgctgtggtgagggcacccgcgaaaccgagaagccccccacgcagcgagcggcagccacgctctccccctcgatccgaaaggcagcccaggtcccctcctagaagcgagagacagcctaggagcccccctcggtccgagagacaaccacggccccgtcctgaggttcgtcctcctccagcgaagcagcgcccgccccagaaatcaaagcagcagccccgctcatcccctttacgcggtccaggagcctccagaggtggctcaccagttaaggctagtcggttttggtag

SEQ ID NO: 125204 - DNA, 246 bp, Artificial Sequence
  Description of Artificial Sequence: Synthetic coding sequence
atgagccaaaaacccgccaaagaggggcccagactcagcaagaatcaaaagtactccgagcacttcagtatacactgctgtcccccgtttacctttcttaacagtaagaaggagattgtcgaccgcaagtactccatttgcaagagcggatgcttttaccagaaaaaagaagaggactggatctgctgcgcatgccaaaaaactcgcctcaaacggaagattcgcccaaccccgaagaaaaaatag

SEQ ID NO: 125205 - DNA, 177 bp, Artificial Sequence
  Description of Artificial Sequence: Synthetic coding sequence
atgtcacaaaagcctgccaaggaaggacctaggctatcaaagaatcagaaatattctgagcacttcagcattcattgttgccctcctttcaccttcttgaattccaaaaaggagattgtcgacagaaaatattcaatctgtaaaagcgggtgcttctaccagaaaaaggaggagtag

SEQ ID NO: 125206 - DNA, 423 bp, Artificial Sequence
  Description of Artificial Sequence: Synthetic coding sequence
atgcttcaggcagccgacttcattgagcgaaccgagacagcgggagaattaagccgaggcctgatcggggtgctctcttcgcagatctcctggtgtctgttgaacgtcaatctgtccaagctccctacaagactgcaaaggctttcatgtagcgtcttaaactccagcccagccatgcgcgggggcgcccgggggaggcctcagctgaccctcgagagacccctcagacccggctgtcgacttcacagctgtagcgaggcggagaaagggggatttgtccggagaaaagaaattatcttatttccaccctgcgaggacccggcacgggggtggctcagcgctaatcccggccgcgagccatcccctggcatttgttggcacctgaacctcgggctgccatctctgcacaattgtgaagaatag

SEQ ID NO: 125207 - DNA, 816 bp, Artificial Sequence
  Description of Artificial Sequence: Synthetic coding sequence
atgttcggcctgaaaagaaacgccgtgattggactcaacctgtattgtggcggtgctgggttaggtgctggttcaggtggtgccacccggcctggcggaaggttgttagccacagagaaggaggcttccgctaggcgcgaaattggcggcggggaggcgggagcagtgatcggtgggtcggctggagcatcaccaccatccaccctgactcccgactctaggcgtgttgccaggccgccgcccatcggcgcggaggtgccggatgtaactgcaactcctgctcggttgctgttcttcgcccccactagaagagcagcccctctcgaagaaatggaggccccagcggctgacgccatcatgagcccggaggaggaactggatggttacgagccggagccccttgggaagcgaccagccgtgctccccttgctagagctcgttggagagagcggcaacaatactagtacggatggttcattacctagcacacctccaccagccgaagaggaagaggatgagctctaccgacagtccctggaaatcatctcgaggtacctgcgagagcaagcaacaggggccaaagacactaagcctatgggccgttcaggggccacctccaggaaagctctcgagaccttgcgtagggtgggggacggagtacagcgaaatcacgagactgccttccaagggtgggtgtgcggcgtcctgccttgccgcggacccagaaggtggcatcaagagtgtgccgctggcttttgtcggtgctgctggagccggagctggttcggaatttctaacaagattgccctgctgtag

SEQ ID NO: 125208 - DNA, 1053 bp, Artificial Sequence
  Description of Artificial Sequence: Synthetic coding sequence
atgtttggcctgaaacggaatgccgtcataggccttaacctatactgtgggggggccggcctcggcgcaggaagcggcggggccacaagacccggagggcgcctgctggctaccgagaaggaagcaagtgcccgtcgagagattggaggcggcgaagccggtgcagttattgggggcagcgccggcgcctcaccccctagtactctaacgcccgactcccggagagtggctagaccaccaccgattggtgccgaagttccggatgtaactgccacccctgccaggctgctgttctttgcccctactcgtcgggctgcgcctctcgaagagatggaagcccccgctgctgacgctattatgagtccggaagaagaactggacgggtacgagccagagccacttggcaaacgtccggcagtgctgccattactggaattggtaggcgaaagtggaaacaacaccagcacagatggcagcctgccctcaacgccgcctcctgcagaggaggaggaggatgagctctatcgccagtcgctggagatcatctcacggtatctgcgcgaacaagcgacgggggccaaggacacaaaacccatgggccgctccggagcaaccagcaggaaggctctcgagactctccgcagagttggcgacggcgtgcaaagaaaccatgaaacagcctttcaggggatgctgcgcaagttagacataaaaaacgaggacgacgttaaatctctgtctcgtgtgatgatccatgtgttctctgatggggtaacaaactggggtcgtatcgttactcttatttccttcggcgcatttgttgctaagcacctgaaaaccattaatcaagagagttgtatcgagccactggccgaaagcatcactgatgtgctagtgcgaaccaagcgagattggcttgttaagcagcgcggctgggacggtttcgtcgagtttttccacgtggaggatcttgagggcgggattagaaacgtcctgctagcatttgcaggtgtggccggggtgggcgctggattagcctatctgatacgttag

SEQ ID NO: 125209 - DNA, 840 bp, Artificial Sequence
  Description of Artificial Sequence: Synthetic coding sequence
atgtttgggcttaaacgcaatgccgtcatcgggctgaacttatattgtggaggtgccggcctaggagcaggcagcggcggggccacgcgtccaggtggccgcctattagcaacggagatggaggcacccgcagcggatgctataatgtcgcctgaggaggagctggatggctacgaaccagaaccattaggcaagcgacccgcagtgctcccccttctcgagcttgtgggggaaagcggaaacaacacctcaaccgatggaagcttgcccagcacacctcctccagcagaggaggaggaagatgagctttacagacagtccttagagataatttcccgctacttgcgagagcaggcgaccggggcaaaggatacaaagcctatgggaagatctggagctacctccaggaaggccctcgaaaccttaagacgcgtgggagatggcgtgcagaggaaccacgagactgcgtttcaggggatgctgcgaaagctcgatataaagaatgaggatgatgttaagagtctgagtcgcgtcatgatccatgtctttagcgacggtgtaacaaactggggacggatcgttactttaatcagctttggagccttcgtcgccaaacacctcaaaactatcaatcaagaaagctgcattgaacccttagccgagagtataactgatgtgctggtacgcacaaaacgggactggctggtgaaacagagaggctgggatggttttgtagagttctttcacgtggaggacctcgaagggggaatccgaaacgtcttgctggcatttgcaggggtggccggtgtaggggctggtctggcctacttaattaggtag

SEQ ID NO: 125210 - DNA, 1224 bp, Artificial Sequence
  Description of Artificial Sequence: Synthetic coding sequence
atggtaaatgagtataagaagatactgcttctgaaggggtttgagcttatggatgattatcactttacatctatcaagtccctgctggcttacgacctcggcctgaccacaaagatgcaagaggagtacaatagaatcaagattaccgatcttatggagaaaaagtttcagggggttgcttgtctcgataaattgattgagctggccaaggacatgcctagcctgaaaaacttggtgaataatctgcgaaaagagaaatcgaaagtggcaaaaaaaataaagactcaagagaaggcccctgtgaaaaagattaatcaggaggaggtggggctcgcggcccccgctcccacggcccggaacaagctcacatcggaggcgcgtggccgtattcctgtggcgcagaaacggaagacacctaacaaggagaaaaccgaggcaaaaaggaataaggtgtctcaggagcagtcaaagcccccggggccctccggcgctagcacaagtgccgccgttgatcaccctcccctgccacaaacttcatccagcacacctagcaacacctcctttacacctaatcaggaaactcaggcacagaggcaagtggatgctagaaggaatgttcctcaaaacgatcccgtgaccgtagttgtcctaaaagccacggcacccttcaagtatgagagccccgagaatgggaagtccaccatgttccacgctaccgtggcttctaagacacaatacttccacgtcaaggtttttgatatcaatttgaaagaaaaattcgtacgcaagaaggtaatcaccatttccgactattctgagtgcaagggcgtcatggaaattaaagaggcttcttccgtgtccgactttaaccagaacttcgaggttcctaaccggatcatcgagattgctaataagaccccgaaaattagtcaactgtacaagcaggcttctgggaccatggtatacgggctctttatgctccagaaaaaatctgtgcacaaaaagaacacaatttacgagattcaagacaataccgggtcaatggacgtggtcggatccggaaaatggcacaatatcaagtgtgagaagggagacaagctgcggcttttctgcctccagctacgcaccgttgatcgaaagctcaaactggtgtgcggcagccactccttcatcaaggtaattaaagccaaaaaaaataaggagggaccgatgaacgtgaattag

SEQ ID NO: 125211 - DNA, 315 bp, Artificial Sequence
  Description of Artificial Sequence: Synthetic coding sequence
tgaccaaataggatcattgaaatcgccaacaaaacacccaagatttcccaactgtacaaacaagcttctgggaccatggtgtacggactgttcatgctacagaagaagagtgtgcacaaaaagaacaccatttacgagatacaggataacaccggatcaatggatgtagtggggtcgggcaaatggcacaatattaagtgtgagaagggagacaagctgcggctattctgcctgcagcttagaacagtggaccgcaagttgaagctggtcatcaaagcaaaaaagaacaaggaaggacccatgaacgttaactag

SEQ ID NO: 125212 - DNA, 795 bp, Artificial Sequence
  Description of Artificial Sequence: Synthetic coding sequence
atgagacctgatagagcagaagctcctggccctcctgctatggctgctggtggacctggtgcgggttctgcagcccctgtgtccagcaccagcagccttccattggctgccttgaacatgcgggtaagacgtcgcctctctctatttctgaatgtgcgcacacaagtcgcagccgattggactgccctcgctgaggagatggattttgagtacctcgagatccgccaactcgagactcaggccgacccaactggaagactcctagatgcatggcagggccggccgggagccagtgtgggccgcctactcgaactcctaactaagcttggacgcgatgatgtccttttggagctcggcccatcaattggccacatgcccgaacgctttgatgcgttcatttgctactgtccctccgacatccagtttgtccaggaaatgattcgccaactggagcagacaaattatcgtctcaaactgtgcgttagcgaccgggacgttttacctgggacctgtgtgtggagcatcgcttccgagctgattgaaaaaagatgcagaaggatggtagtcgttgtgagcgatgactatctgcagtcaaaagagtgtgactttcagactaagtttgccctctcactttctccaggtgctcatcagaagaggctgatcccaattaaatataaggccatgaagaaggagttcccctctattctgcggtttatcacagtctgtgattacaccaacccttgcactaagagttggttctggacacggctggccaaagccctaagcctcccatag

SEQ ID NO: 125213 - DNA, 615 bp, Artificial Sequence
  Description of Artificial Sequence: Synthetic coding sequence
atgcgccccgatagagctgaggcgccgggcccccctgccatggcagcaggcggccccggtgccggttcggccgcgcccgtcagttccacctcctccttgccactggccgcactcaacatgcgcgttagaaggagactaagcctcttcctgaacgtaagaacacaggtcgccgcagattggactgctctggcagaagagatggacttcgagtatctggagattcgacagctggagacacaagccgacccgacgggacgacttttggatgcctggcagggccgacctggcgcctccgtaggcaggctgctggaactgctcaccaaacttggccgggatgacgtcctactcgagttaggaccgtctatcgaagaggactgccagaagtatatacttaaacagcaacaagaggaggccgagaagccgctgcaggttgccgctgtggatagctctgtgccccgcactgccgagctggcgggaatcactacactggatgaccctctaggcgctgcagggtggtggtggctctctttgatgattacctgtcgcgcacgaaatgtgaccagtagacccaacttgcactctgctagtctacaagtgccaatccggagcgactag

SEQ ID NO: 125214 - DNA, 480 bp, Artificial Sequence
  Description of Artificial Sequence: Synthetic coding sequence
atgagaccagatcgcgctgaagccccaggtccgccagcaatggcagctgggggccccggagcgggctcagctgcgcctgtctccagtacctcatcgcttccattagctgcacttaacatgcgggtcagaaggcggctgtccctgtttctgaatgtgagaacccaagttgctgccgattggactgcactggctgaggagatggacttcgaatacctcgagatacggcagttggaaacacaggccgatcccacaggacgcctcctggatgcctggcaagggcggcccggcgctagcgttggaaggctgttagagctgctaacaaaactgggccgggacgacgtcctgctggagttaggtcctagcattggggctgccggctggtggtggctgtcactgatgattacatgccgggccagaaacgtgacctcccggcctaacctccattccgctagcttacaagtacccatcagatccgactag

SEQ ID NO: 125215 - DNA, 807 bp, Artificial Sequence
  Description of Artificial Sequence: Synthetic coding sequence
atgttccggatgctcaattccagctttgaagacgatccctttttttctgaaagtatacttgcacatagagagaatatgcgtcagatgataagaagtttcagtgagcccttcggacgcgacctgctgtccatcagtgatgggaggggccgcgcacacaatcggagaggccataacgacggggaggacagtctgacccataccgatgtttcctcatttcaaacaatggaccagatggtctccaacatgaggaattatatgcaaaagctcgaaaggaacttcggccagttaagtgtcgaccccaatggccattctttttgttcatcttccgtcatgacttactctaagatcggtgatgagccacctaaggtgtttcaggctagcacgcagaccaggagggctcccggggggattaaagagacaagaaaagcaatgcgcgatagtgatagcggtttggaaaagatggccattggacaccacatccacgatcgggcccatgttatcaagaagtccaagaacaagaagaccggggacgaggaagttaaccaggaatttattaacatgaacgagagcgacgcgcacgcgttcgatgaggagtggcaatcagaggtcctgaaatataaacccgggagacataacttgggaaacaccaggatgaggagcgtgggacatgagaacccggggtcacgggagctcaagagacgggaaaagccacagcagtcccctgctatcgaacacggcaggagatccaacgtgctgggggataaacttcacataaagggctccagcgttaaatccaataaaaaatag

SEQ ID NO: 125216 - DNA, 732 bp, Artificial Sequence
  Description of Artificial Sequence: Synthetic coding sequence
atgcgtcaaatgatccgtagcttttcagagccgttcggtcgtgatctgttgagcatcagtgatggaaggggccgggcccacaatagacgagggcataacgacggtgaggactccttaacacataccgatgtgtcgagtttccaaactatggatcaaatggtttctaatatgaggaactatatgcagaagttagagcggaatttcggccaactctccgtggatcccaacggacactctttttgttcctctagtgttatgacttactccaaaattggtgacgaaccgcccaaagtgttccaagcctctactcaaacaagacgcgcacctggaggtattaaagagactagaaaggcaatgcgggattcagatagtggcctggaaaaaatggcaatcggtcaccacatacacgaccgggcccacgtcataaaaaagagcaaaaataagaaaaccggcgatgaagaagtgaaccaggagttcatcaatatgaatgaatctgacgcgcatgccttcgacgaagagtggcaatcagaagtcctcaagtataagccaggccggcataacctgggaaacactaggatgagaagcgtgggtcacgagaaccccggctcacgggagctgaagcgcagggaaaaaccccagcaaagtccagcgatcgagcatggccggcgctcaaacgtactaggcgacaaactccatatcaagggatcatccgtgaagagcaacaaaaagtag

SEQ ID NO: 125217 - DNA, 900 bp, Artificial Sequence
  Description of Artificial Sequence: Synthetic coding sequence
atgttaaaggaagtgctgcagcgcgaggggaagagttacaagtcagagaccctgatgtacatcaaaaaggccagagccagcgaaaataagttgagcgagagcattttagcgcaccgcgaaaacatgcgacagatgatccggtcattcagcgagccattcggtcgggatttactcagtatcagtgatggacgcggaagggctcataacaggaggggacacaacgacggcgaggacagccttacagctaccagttgttctctagttccctttggtgacttcggcggcatgcatacagacgtgagctcgtttcagaccatggaccagatggtcagtaacatgcgcaactacatgcaaaagctcgagcggaacttcgggcagctgtctgtagatccaaatggacattctttctgcagcagctctgtgatgacctacagcaagataggtgatgaaccccccaaggtgtttcaggcctctacacagacacgaagggcaccaggcggcataaaagagactaggaaggccatgcgagactctgattcaggactggagaagatggccatcggacatcatatccacgaccgagcacatgtgataaagaagtcaaagaacaagaagacaggcgacgaggaggtcaatcaggagtttatcaatatgaatgagtccgatgcccacgcctttgacgaagagtggcagtcagaggttcttaaatacaaaccgggccgtcacaatcttggcaatacccgaatgagatctgtcggccatgagaacccgggctcgcgggagctgaaaagaagagaaaaacctcaacaaagccccgccatcgaacatgggcggagatcgaacgtgctgggtgacaagttgcatattaaaggttcctctgttaagtccaacaagaagtag

SEQ ID NO: 125218 - DNA, 777 bp, Artificial Sequence
  Description of Artificial Sequence: Synthetic coding sequence
atgagacaaatgatcaggtctttctccgaacccttcgggagagatctgctgagtattagtgatgggcgtggccgagctcataacaggagagggcacaatgatggagaggactctttgactgcaacaagctgttcactggtcccattcggcgacttcggtggcatgcataccgacgtctcctctttccagactatggaccagatggtatcaaacatgcgcaactacatgcagaagctggagcgcaactttgggcagctcagcgttgatcccaatgggcattccttttgttcctcatccgtcatgacttactcaaagatcggcgatgaaccacctaaggttttccaagcgagtactcagacccggcgagcccccggcggtattaaggaaacccggaaggcaatgagagattctgatagcggtcttgaaaaaatggcgattggtcatcatattcatgacagggcccacgtgataaaaaaatccaagaataagaagacaggagatgaggaggtgaatcaggaattcataaatatgaacgagagtgatgctcacgctttcgatgaggagtggcaaagcgaggtattgaaatacaagccaggacgccataacctgggaaacactagaatgcgcagcgtgggacacgagaatccaggtagtcgcgaacttaaaagaagagaaaagccacagcagtctcccgcaatcgagcacgggcgcaggtctaatgtcttgggagataagctgcatatcaaaggcagctctgtgaaatctaataagaaatag

SEQ ID NO: 125219 - DNA, 777 bp, Artificial Sequence
  Description of Artificial Sequence: Synthetic coding sequence
atgcgacagatgatccgcagtttcagtgaaccttttggcagagaccttctctcaatctctgatggccgcggcagagcccacaataggagaggacacaatgatggcgaggatagccttaccgctacttcgtgtagtttggtccccttcggcgactttggaggaatgcatacagacgtctcctcctttcagactatggaccagatggtatccaatatgcggaattatatgcagaaactggaacgcaacttcggccaattatccgtcgatcctaatggccactcattttgctcatctagcgtgatgacctatagcaagatcggggatgaaccgcccaaagtctttcaagcttcgactcagacccgcagagcacctggtggaataaaggagacccggaaggctatgagggactctgacagtggactagagaagatggctataggtcaccacatccacgatcgcgctcacgttataaaaaaatccaagaacaaaaagacgggcgacgaggaagttaaccaggagttcattaacatgaatgagtccgacgcgcatgccttcgacgaagagtggcagtccgaagttctgaaatacaaaccaggtcgccataatttaggcaacactcgcatgagatctgttggccacgagaatccgggaagccgggaactaaagcgacgagagaagcctcagcagagtcctgcaattgagcacggaagacgcagtaatgtgctcggtgataaactccatattaagggatcctcagtgaagtctaacaagaaatag

SEQ ID NO: 125220 - DNA, 732 bp, Artificial Sequence
  Description of Artificial Sequence: Synthetic coding sequence
atgcgccagatgatccgttctttcagcgagccatttggtagagatctgctgtccatttcggacggaagaggtcgtgcacataaccggagaggtcacaatgatggcgaggacagtttgacccacactgatgtttccagttttcaaacaatggaccaaatggtgtccaacatgaggaattatatgcagaagctggagagaaacttcggccagctatcggtggatcccaacggacacagcttttgttcctcttctgtaatgacctatagcaagataggcgatgaacctccaaaagtctttcaggcgtccactcaaacccgcagggcacctggggggataaaagagactcgcaaggccatgcgggacagtgacagtggacttgagaagatggctattggccaccatattcatgacagggctcacgtaatcaagaagtcaaagaacaagaaaaccggtgatgaagaagttaaccaggaatttataaacatgaatgagtccgacgcgcacgcctttgacgaggagtggcaaagtgaggtgctcaaatataaacctggcagacataatcttgggaataccaggatgagaagtgtggggcatgaaaacccagggagcagggagctcaagcgtcgcgagaaacctcagcagtcacccgcgatcgagcatggcagacgaagtaatgtcttaggcgacaagctccacattaaagggtcttcagttaaatccaataagaagtag

SEQ ID NO: 125221 - DNA, 732 bp, Artificial Sequence
  Description of Artificial Sequence: Synthetic coding sequence
atgcgccagatgataagatcattcagtgaacctttcggaagagacctattgtctatctccgacggccgggggcgagcccacaacagaagaggtcataacgacggagaagattccctgacgcataccgatgtgagtagtttccaaacaatggaccagatggtctccaatatgcgcaactacatgcaaaagttagagagaaattttggccagcttagcgtcgaccccaacgggcattcgttctgttctagcagcgtgatgacatatagtaaaatcggcgacgagcctcctaaggtcttccaggcctccacacaaacgagaagggccccagggggaattaaagagactcgaaaggcgatgcgcgactctgattcagggctggagaagatggcaatcggccaccacatccacgatagggcccatgtgatcaaaaagagcaagaacaagaaaaccggcgacgaggaggttaaccaggaatttatcaatatgaatgagagtgacgctcatgcattcgacgaagagtggcaaagcgaggtgctaaaatacaaaccgggccgccataatctgggaaatactagaatgcgcagtgttggccatgagaatccagggtctcgagagctgaagaggcgtgaaaaaccccagcagagccctgccatcgaacatggccggagaagtaacgtgcttggagataagctgcacattaaggggagtagcgttaagtccaataagaaatag

SEQ ID NO: 125222 - DNA, 603 bp, Artificial Sequence
  Description of Artificial Sequence: Synthetic coding sequence
atgcgacagatgatacgctccttcagcgaaccgtttggcagggacctgctgtctatctcagatggcaggggccgggcccacaacaggagaggccacaatgacggggaggattctctcacacacactgatgtcagctcgtttcagactatggaccagatggtgtcaaatatgcgaaattacatgcagaagttagaaagaaactttataaaagaaaccaggaaggccatgagagattccgactcggggcttgaaaaaatggcaataggccaccacattcatgatcgtgctcacgtgattaaaaagagcaagaataaaaagaccggcgacgaggaggttaaccaagaattcataaacatgaatgaaagtgacgcacatgcatttgacgaggagtggcagtctgaggtccttaagtacaagcccggcaggcacaacctgggtaacactaggatgcgctcggtaggacatgagaatcctggcagtagagagttgaagagacgggagaaacctcagcagtcccctgcaattgagcacggcaggaggagcaatgtgttaggagacaagctccatatcaagggatcctcggtgaagagcaataagaagtag

SEQ ID NO: 125223 - DNA, 747 bp, Artificial Sequence
  Description of Artificial Sequence: Synthetic coding sequence
atgttccggttcatgcgcgatgtcgagcccgaagatccaatgtttttgatggatccctttgcaattcatcggcagcatatgtcacggatgttgagcgggggatttgggtactccccattcctgagcatcacagacgggaacatgcctgggacacgccctgcgtcaaggcggatgcaacaggccggggccgtgagcccattcggcatgctaggaatgtcagggggctttatggatatgtttggaatgatgaatgatatgatcggaaacatggagcatatgaccgccggtggaaactgccagactttttcctcctctacagtcatttcttacagtaataccggggatggagctccgaaggtctatcaagagacgtcagaaatgcggtccgcaccaggcggaattcgcgaaacaaggaggacagttcgggatagcgactcgggactagagcagatgtctatcggacaccacatccgggatagggcacatattctccagaggagccgcaaccatcgaactggtgaccaggaggagagacaggactacatcaaccttgatgagtctgaggccgccgccttcgacgacgaatggcgtagggagacatcacgcttcagacagcagaggcctcttgaatttcgccggctagaaagcagcggggccggagggaggcgtgcagagggtccccccagacttgctatccagggaccagaggacagcccctctcggcagtccaggagatatgattggtag

SEQ ID NO: 125224 - DNA, 747 bp, Artificial Sequence
  Description of Artificial Sequence: Synthetic coding sequence
atgttccggtttatgagagacgttgaacccgaagaccctatgttcttaatggatcctttcgccatacatagacagcacatgtccagaatgctgagcggcggattcgggtatagcccctttctttcaatcacagatggtaatatgcctggtactcgccccgcgagccgcaggatgcagcaggctggcgccgtgtcgccattcggtatgctggggatgtctggcggatttatggatatgtttggaatgatgaatgatatgatcggcaacatggagcacatgacggccggaggcaactgtcaaactttctcgtcgagtactgtgatcagttactccaacactggcgacggggcacctaaagtataccaggaaacttctgagatgagatctgcacccggggggattcgagagactcggcgcaccgtgcgggacagcgattcagggctggaacagatgtcgattggacaccacattcgagatcgagcccacattctgcagcgttctagaaatcacagaacaggggaccaggaggagcgccaggattatattaatctggacgagagtgaagccgcagccttcgatgacgaatggaggcgagaaacaagcagattcagacagcagaggccgctggagtttagaagactagaatcatctggcgcgggaggtaggcgggcagagggccccccccggctggccatacagggtcctgaggattcaccgtcaagacaatcgcgacggtatgactggtag

SEQ ID NO: 125225 - DNA, 747 bp, Artificial Sequence
  Description of Artificial Sequence: Synthetic coding sequence
atgtttaggtttatgcgagatgttgagccagaagatccgatgtttctaatggatccgttcgctattcacagacagcatatgtccaggatgctgagcggaggattcgggtactctcccttcctgtcaatcacagatggcaatatgcccggtacccgacccgcgagtagacgcatgcaacaagctggggctgtgtccccattcggcatgcttggcatgtccggcggttttatggatatgtttggaatgatgaatgacatgattggtaacatggagcatatgactgcagggggtaattgccagacgttctccagctctactgtgatttcctacagcaacactggggatggagcccctaaggtgtaccaggaaacgtcagagatgcggagcgccccaggggggatccgcgaaacacgacgcacagtgcgggattccgatagcggtctggaacaaatgtcaatcggccatcatattagagacagggcccacattctacagagatcccggaaccacagaactggcgaccaagaggagcggcaggattacatcaatttagacgaaagcgaagcggccgcgttcgatgacgagtggagacgtgaaacttcccgcttcagacagcagcgcccactcgagtttcgccgcttagagagttcgggcgctggagggcgccgtgcagaaggtccaccaaggctggcaatccaggggcccgaggacagcccgagcagacaaagccgccggtatgactggtag

SEQ ID NO: 125226 - DNA, 747 bp, Artificial Sequence
  Description of Artificial Sequence: Synthetic coding sequence
atgtttcggttcatgagagatgtggaacctgaagatcccatgtttctgatggatccattcgctattcaccggcaacacatgagtagaatgttgagcggcggatttgggtactctccattccttagcatcaccgacggcaatatgcccgggacccggccggcttctcgcagaatgcagcaggctggcgcggtgagcccatttggcatgcttggaatgagtggtgggtttatggacatgttcgggatgatgaatgacatgatcggaaacatggaacacatgactgccggcggcaattgccagactttcagctcatctaccgtgatcagttatagcaatactggtgatggagctccaaaagtgtaccaggaaaccagcgagatgagaagcgccccgggggggatccgggagacacgccgaactgtccgcgatagcgactctggactggaacagatgagtatagggcaccacatccgcgatagggcacatattctacaaagatcgcgcaaccatcggaccggtgaccaggaagaaagacaggactacataaacctggatgaatcagaagctgctgcctttgacgatgaatggcgtagagaaacctcgagatttcgtcaacaaagacccctcgaattccggcgcttagagtctagtggcgccggcgggagacgggcggaagggccccctcgtctggctattcaaggccctgaggattctccatccaggcagtcgcggagatacgattggtag

SEQ ID NO: 125227 - DNA, 684 bp, Artificial Sequence
  Description of Artificial Sequence: Synthetic coding sequence
atgatggcagcgggggcagcacttgcactggcgttatggctgttaatgcccccagttgaagtggggggtgctggtccaccaccaatccaagatggggagtttacatttctgctccccgccggccgtaagcagtgcttttatcagagtgcacctgccaatgcttcactcgagactgagtatcaggtgattggcggtgcgggcttggacgttgatttcacactggagtccccacagggcgtactccttgttagcgaaagccgaaaagctgacggtgtccacacagttgagcctaccgaggcaggagattacaagctgtgttttgataactcttttagtacgatctcagagaaactcgtgttcttcgagctgatctttgacagtctgcaagacgatgaggaggtcgagggatgggccgaggccgtcgaacccgaagagatgctggacgttaagatggaggacatcaaagaatctatcgaaaccatgcgtacgcgccttgagcgcagcattcagatgttaacacttctaagagccttcgaagccagggaccgtaacttgcaagagggtaatctcgaaagggtaaatttctggtcggccgtgaacgtggcagtcctcctgctcgtggccgttctgcaggtctgcaccctgaagcggttttttcaggacaaacggccggttcctacttag

SEQ ID NO: 125228 - DNA, 873 bp, Artificial Sequence
  Description of Artificial Sequence: Synthetic coding sequence
atgcgcccagccgttcttggctcgcctgatagggcccctccagaagatgaaggacccgtcatggtgaaactcgaggactcagaggaggaaggcgaggctgctctttgggaccccggacctgaggccgccagactgcggttcagatgtttccgatatgaggaggctacaggccctcaagaggccctggcccagcttcgagagctctgtcgacaatggctcaggcccgaagtgcgtagcaaggaacagatgctggagctgctcgttctggagcagttcttgggtgccctgcccccggaaattcaggccagagtacagggtcagcgacccgggtcccccgaggaggccgccgcactggttgacggattgcgcagggaaccaggtggtccccgtagatgggtgacagtgcaggtccagggccaggaggttctgtccgagaagatggaacctagttcctttcagccactgcctgagaccgagccacctacccctgagcccgggcctaagactccgccacgtactatgcaggaatcccctttaggactgcaggtaaaggaggaatcagaggtgaccgaggatagcgacttcctggaaagtggtcctcttgcggctacccaggaatcagtccccacactcctgccagaggaagcccagagatgcggcacagtccttgaccagatatttccgcactccaaaactgggcccgaggggcccagctggagggaacacccaagagctttatggcatgaggaggccggcggaatattcagtccaggcgctggggcgggggccgctcccgctcttggagccggttggcttggcgcagccgtcgcaatgtatgtggccagatgctccgccaatgctgctacatgttag

SEQ ID NO: 125229 - DNA, 2205 bp, Artificial Sequence
  Description of Artificial Sequence: Synthetic coding sequence
atgaggccggccgtgctgggctcccctgacagggcaccacctgaggatgagggtcctgtgatggtgaagctggaggatagcgaggaggagggcgaggccgctttatgggacccgggtccagaggctgctcggcttcgttttagatgctttagatacgaggaagccaccgggccccaagaggcactcgcccagctccgggaattgtgccgacaatggcttcgccccgaggtccggtcgaaagagcagatgttggagctcttggtgctagagcaattccttggcgctctgcctccagagatccaggctagggtgcagggacagcgtcccggctctcccgaggaggcagccgccttggtcgatggtctgcggcgggagccagggggccctcgtaggtgggttacagtgcaggtccagggacaggaggtgttgagcgaaaagatggaaccctcaagcttccagcctttgcccgaaaccgaacctccaacgcccgagcccggcccaaagactcctccacgcactatgcaagagtctcctctcgggctgcaggtcaaagaagagagcgaggtcactgaggatagtgattttctggaatccggccctttagccgctacccaggagtcagtccctactttgctgcctgaagaagcccagcggtgcggcacagtccttgatcagatttttccccacagcaaaaccggacctgagggccctagttggagggaacatcctcgggccttgtggcacgaggaagctggaggaatcttttcacctggattcgccctgcagctggggagcatttcagcaggtcccggctctgtatcaccgcacctgcacgtgccatgggacctgggcatggccggactgagtggacagatccagtctccaagccgcgagggtggttttgcacacgcactccttttaccatctgatctccgctcagagcaagatcccactgacgaggatccctgccggggggtggggccagccttgatcaccactcgctggcgaagcccacggggtcggtccaggggcaggcccagtaccggcggcggagtggttcgtgggggacggtgtgacgtgtgcgggaaggtgttttcccaacggtcgaatctcctgcgccaccagaagatccacaccggcgagagacctttcgtgtgcagcgagtgcggacggagcttttcccggtcctcccacctgctacggcatcaattgactcacacggaggagagaccatttgtgtgcggagactgtgggcagggatttgtgagatccgcacgacttgaggaacacaggagggttcataccggcgagcaaccttttcggtgcgctgagtgtggacagtctttccggcagcgatctaatcttttacaacaccaaaggatacatggcgatcctcccgggccgggcgctaagccacccgcgcctcccggagcacctgaaccacctggacccttcccctgtagtgagtgccgagaaagttttgcacgaagagccgtacttttggaacaccaagccgtgcatacaggcgataagagctttggctgtgtcgagtgcggcgaacgatttggtaggcgctctgtgctattgcagcatcggagggtacattccggagagaggccattcgcttgcgcagaatgtggacagtcctttagacagaggagtaaccttacacagcaccggcgtatccatacaggcgaaaggccattcgcttgtgctgagtgcggcaaagcctttcgccagaggcctacattgacccaacacttgagagtgcacacaggagagaaaccttttgcttgccccgagtgtggtcaaaggttcagtcagagacttaaactgacccgccatcagcgcactcacaccggagagaaaccatatcactgcggcgagtgcggtctcggcttcacccaggtgtctagactgactgaacaccagaggattcacaccggtgaaagaccctttgcttgcccggagtgtgggcagagcttcaggcagcacgccaatttaacgcagcacagaaggatacacaccggggagcggccttatgcctgccccgaatgtggcaaagcctttcgacagcgacccactctgacacagcacttgcggacccacaggagggagaaaccgtttgcttgtcaggactgtgggaggagatttcaccagtccactaagctcatccagcaccaacgtgtgcactccgccgagtag

SEQ ID NO: 125230 - DNA, 1539 bp, Artificial Sequence
  Description of Artificial Sequence: Synthetic coding sequence
atggctcatagttgtagatggagattccccgctcgtccaggcacgaccggcggtggcggtggcggtggacgccggggactgggcggggccccaagacagcgagtacctgccttgctcctacctccaggtccccctgtgggaggaggcggaccgggagctccaccctctccgccagccgttgccgctgcggctgcagccgccgggtccagtggagctggggtaccgggcggcgccgctgccgctagcgccgcttcttcatcaagcgcaagctcatccagttccagctccagcagtgcctcaagcggaccagcacttctacgcgtgggtccgggattcgacgcagcacttcaggtatcagctgctattgggacaaacttaaggagattccgtgcggtatttggagagtcaggcggcggcggtggttctggggaacttacaacacagatcccttgttcttggcgaactaagggccacattcatgataagaaaacagagcctttcaggctcctcgcttggtcctggtgcctaaatgacgagcagttcttgggttttgggtccgatgaagaggtgcgggtccggtcacctactcgcagtccctctgtcaaaacaagtcccagaaaaccacgaggtagaccacgcagtggatcggacagaaacagtgccattctgtcagatccatctgtcttcagcccactgaataaaagtgaaactaagtccggggacaagattaaaaagaaagatagcaagagcatcgagaaaaaacgcggacgccctcctactttccctggcgtgaagatcaaaattactcatggcaaggacatttcagagctccccaaaggcaacaaggaggacagccttaaaaagatcaaacgcaccccctcagcgacgttccagcaggccactaaaatcaaaaagctgcgcgctgggaagctctctcctctgaagagcaagtttaagacagggaaattacagatagggagaaagggcgtgcaaatcgttcgcagacgcggaaggccgccatccacagagcggataaaaacgccgtcggggctgctgattaacagtgagctggaaaagccccagaaggtcaggaaagataaagaaggcaccccccctctgacaaaagaggacaagaccgtcgtacgtcagagtccacgtcgcatcaaaccagtacggatcatcccatcctccaaacgtaccgatgctactattgccaaacagctgttgcagagagctaaaaagggtgctcagaagaagattgaaaaggaagcagcccagcttcaagggcgaaaggtgaagacacaagtgaaaaatatcaggcagttcataatgcccgtggtaagcgccatatcgagcaggattataaaaacacctagaaggtttatcgaagacgaagattacgatccaccaatcaagattgcccggctggaaagcacaccaaattctagattttcggcaccatcctgcgggtcttcggaaaagtccagcgctgcttcccagcacagctcccagatgagctccgattccagccgctcatag

SEQ ID NO: 125231 - DNA, 11796 bp, Artificial Sequence
  Description of Artificial Sequence: Synthetic coding sequence
atggcacactcctgtcgttggcgctttcccgcccgccccggtactacaggcggtggggggggcggtgggcgcagagggctaggaggggcccccagacagcgcgttccagctttacttctccctccaggaccgcctgttggtggcgggggtcctggagcgcctcccagcccccccgccgttgcggcagccgcagccgccgccggtagctcaggcgcaggtgtccccggaggggccgcggccgccagcgccgcatcttcaagcagcgcaagctcttcgtcgtcctcctcgtcctctgcttctagcggacccgccttgctgcgggtgggccctggattcgacgccgccctccaggtgtcggccgccattggcacaaacttgcggcggttcagagccgtgttcggggaatctggcggcggcggaggatccggggaagacgagcagttcctggggttcggcagcgatgaagaggtaagggtgagaagcccaacaaggtctcctagcgtgaaaacaagcccacggaagccacgaggtagacccagatctgggtcagaccgcaattcggccatccttagtgacccgagtgtgttttctcctctgaataagagcgagactaaatctggcgacaaaatcaaaaaaaaggacagtaagagtatcgagaaaaaaaggggcagaccgcctacctttcctggggtgaagattaaaatcacccatgggaaggacatatcagaattacctaaaggcaataaggaagactcgctcaagaagatcaagcgcaccccgtcagctacctttcagcaagccaccaagattaagaagctgcgcgctgggaaactgtcgccgctaaagtcaaagttcaagacaggaaagcttcagattgggagaaagggcgtgcagatcgtcaggcggcggggccgccccccgtctacggagaggatcaagacccccagcggactcctgatcaacagcgaactggagaagccacagaaagtgcggaaagacaaggagggtacacctcccctcacaaaggaagataaaaccgtagtgcggcagtctcctcgtcggatcaaacccgtccgtataatcccatcgagtaaacgcacagatgctactatagccaaacagttgctccaaagagcaaaaaaaggtgcgcagaagaagatcgagaaggaggcggcacagctgcagggcaggaaagttaagacacaggtgaaaaacataagacagtttatcatgcctgtagtttcagcaatttcttcacggattatcaaaacgcctaggcggtttattgaagacgaggattatgacccacctattaagattgcacgcttggaatcaactccaaatagtcgattttcggctcccagctgcggctcctcggaaaaatctagtgccgcatcacagcatagttcccagatgtcttccgattcaagcagatccagttcaccctcggtggacacatcaaccgattctcaggcaagcgaagagatccaggtgttgcccgaagagcggtcggacacacctgaggtgcatccccctctgccaatatcccagtcccctgaaaatgagtctaatgacaggaggtccaggaggtatagtgtgagtgaacgcagcttcggatcacggactacaaagaagttgtccacattgcagtcggccccacagcagcagacctcgtcttcccctccccctcccttactaacccctcctcccccacttcagccagcgagtagtataagtgaccacactccctggctgatgccgccaacaatcccactcgccagcccatttcttcccgcttccaccgcccccatgcagggtaaaaggaagtccattctacgtgagccaacgttcagatggacaagtctgaaacattctcggtccgagcctcagtacttttcttccgctaagtatgcaaaagagggactcatccgaaaacccatttttgacaatttcagaccaccacctctgaccccggaggacgtggggtttgcctctggcttcagcgctagtggcacggcagctagcgcacgcctcttctctcccctccatagcggtacaaggttcgacatgcacaagaggtctccgctccttcgggccccacggtttactcctagtgaagcccatagtagaatctttgagtcagtcaccttgcccagtaatagaacatctgcaggcacgtcgtcaagtggggtatccaacagaaagagaaagcgaaaagtctttagccctattcgctccgaaccgaggagcccttcacacagtatgcgaacccgctccggacgcctttctagtagcgaactgagccctctgacaccccccagctccgtcagttcgagcctttcaatatcggtttcccccctagctacctcagcattaaaccctacattcacctttccatcccactcactcactcagagtggggagtccgccgagaaaaaccaacgccctcggaagcaaacctctgctccggctgagcccttcagtagctcctctcccacaccgctattcccctggtttacgcctgggtcccagaccgaaaggggccgaaacaaggataaagcacctgaagagctcagcaaagatcgtgacgcagataagagcgtagaaaaagataaaagccgggagcgcgatagggagcgggagaaggagaacaagagagaaagtcgtaaggagaaacgcaaaaagggaagcgagattcagtcttcaagtgccttgtatcctgtgggccgcgtgtccaaagaaaaggtcgtgggcgaggacgtcgcgaccagttcctctgctaaaaaggcaacgggtcgcaaaaagagcagcagccatgactccgggactgatatcacttcagttacattgggagatacaacagccgtcaaaacaaaaattttaattaagaagggtcggggtaacctagagaagactaatctggatctgggtccaactgctccgagtctggaaaaggagaaaacactttgcctgtctacaccatcttcatccacagttaaacatagcacctcaagcattggctcaatgctcgcacaggcggataaacttcctatgaccgataaaagagtcgcctctctgctgaaaaaagccaaagcccagctttgtaaaattgagaagtcaaaatccctgaagcagaccgaccagcccaaggcacaagggcaggaatcagacagtagtgaaacgtcagtgcggggtccccggattaaacatgtttgcaggagagctgcggtggccctggggcgcaaacgtgccgtgttcccagatgacatgccaactctatccgcattaccctgggaagagcgagagaaaattctgtcaagcatggggaatgacgataagagctcgatcgcaggtagcgaagacgccgagccccttgcgcctccgatcaagcccatcaagccagttacaagaaacaaagccccgcaggagcctcccgttaagaaggggaggcgttcccggcgctgcggccaatgtcccgggtgtcaggttccggaggactgcggtgtctgcaccaactgtttagataaacctaaatttggtggtcggaatatcaaaaaacagtgctgcaagatgcggaaatgccagaacctgcagtggatgcctagcaaagcatacctacaaaagcaggcaaaggctgtcaagaagaaagaaaagaagagcaagactagcgaaaagaaggattcaaaagagtcaagcgtcgtaaagaacgtggtggacagctcacagaagcctacacccagcgctcgcgaggatccggcgcctaagaagtcaagctctgagccaccgccaaggaagcctgtagaagaaaaaagcgaggagggcaacgtaagcgccccaggccctgaatctaagcaggctaccacgcctgcatcccgcaagtcaagcaaacaggtaagccagccggccttagtgattccaccgcagccccccactacaggtccacccaggaaggaggttcccaaaactactccatctgagccaaaaaagaagcaaccaccccccccagagtccggcccggaacagtcgaagcagaagaaggtggctcctcggccatccattccggtgaagcagaaacctaaggagaaagaaaagccgcccccagtgaacaaacaggaaaatgccgggacactaaatatcctgtcaacactgtcgaacgggaactcctccaaacaaaaaattcctgccgacggggtgcacaggattagggtggacttcaaattcgtttactgccaggtgtgctgtgagccttttcacaagttctgcctggaggaaaatgaaagacccctggaggaccagctggaaaactggtgctgcaggagatgcaagttttgtcatgtatgtggaaggcagcatcaggccaccaagcagttgctggaatgtaataagtgcagaaattcttaccatccagagtgcctcggtcccaattatccgacaaaacccacaaagaaaaaaaaggtgtggatctgcacaaaatgtgtgcgctgcaaatcctgcggttcaaccacacccggaaagggttgggacgcgcaatggtcgcacgacttctcactgtgccatgattgcgcgaagctgttcgcaaaagggaacttctgcccgttatgtgacaaatgctatgatgatgatgattatgaatccaaaatgatgcaatgcggaaagtgtgaccggtgggtgcactctaagtgcgagaatctgagtgatgaaatgtacgagatcttgtcgaacctgccagaaagcgttgcgtacacctgcgtgaactgtacagagaggcatccagccgagtggcggcttgcgctcgagaaggagctccaaatctctctcaaacaggtgctgaccgccctactgaattcacgcaccacgtctcatctcttacgctaccgccaggccgccaagccgcctgatctgaacccagagaccgaggaaagcataccatcgcgctccagcccagaagggcccgaccctccggttttgacagaggtgtccaaacaggacgaccaacagccccttgaccttgagggagtgaaacggaaaatggaccagggcaactacacgagtgtgctggagttctcagatgatattgttaaaattattcaggccgcaattaatagcgatgggggacagccagaaattaagaaagccaacagtatggtaaagtctttttttatcaggcagatggagagagtgttcccttggttttccgttaagaaatccaggttctgggagccaaataaggtgagcagcaactcaggcatgctgccaaatgctgtcctcccccctagtctggaccataactatgcacagtggcaggaacgggaggaaaactcccacaccgagcagccccctctgatgaagaaaattatccctgcacccaaacctaaggggcccggcgaacccgacagccccacccccttgcaccccccaacaccgccgatcctgagcaccgaccgatctcgcgaggatagtccggaactgaacccaccacctgggattgaggataatcgccaatgcgccctctgcctgacctacggcgacgattcagccaatgacgccgggcggttactctatattggtcagaacgaatggactcatgtaaactgtgcgctgtggagcgccgaagtgtttgaagacgatgatgggtcactgaaaaatgtgcacatggcagttattcgcggcaagcagttgcgttgtgagttctgccagaaacctggggccaccgtgggatgctgtctgaccagctgtacctctaactaccacttcatgtgtagtcgcgcaaagaattgtgtgttccttgatgataagaaggtgtattgccagagacatcgggacctgatcaagggggaggtggtgcctgagaatgggtttgaggtgttccggcgtgtcttcgttgattttgagggcattagtctgaggcggaaattcctgaatggactggaaccggagaatatccacatgatgatcggatctatgaccattgactgcctggggattctcaatgacctgagcgactgcgaagataaactgttccctattggctatcagtgcagccgggtgtactggtctactactgacgcccgcaaacgttgcgtatacacttgtaagatagtggaatgtaggccccccgttgtggagccagacattaatagcacagttgaacatgacgaaaaccgcaccattgctcatagtcccacatcctttacagaatcttcctcgaaggagtctcaaaatactgcagagatcatctccccaccttctcctgatcgccctccacattcccagacatccgggtcctgttactatcatgtgatctccaaagtgcccagaatcaggacgccttcttatagccctacccagcgtagccctggctgcagacctctgccgtctgcaggatcgccaactcccacaacgcacgagatagtgacagtcggcgaccctcttctctccagcgggctgcgctctattggatctcgaaggcattctacctcatctctctcacctcagagatccaaactgaggataatgtccccaatgaggaccggtaatacctactcccgtaacaacgtgagcagcgtgtcgaccacaggcactgccaccgacctggaatcaagcgccaaagttgtagaccacgtcctcgggcctctgaacagtagtacatccctaggtcaaaatacttccacttcttccaacttgcagcgcacagtggttacagtgggtaataagaactcccacctggacggctcctcatctagtgagatgaaacagtcaagcgccagtgatttggtaagcaaaagctcaagtcttaaaggagagaaaactaaggtcctgagctcaaaatcctccgaagggtctgcccacaacgtggcgtatcccggtatacccaagcttgccccacaagtgcacaataccacgtcccgtgaactcaacgtttcaaagattggctcttttgccgaaccctcctccgtgtccttttcgtccaaggaagctttatctttcccacacctccatctgcggggccagaggaatgacagggaccagcacactgacagtacacagtccgccaatagctcaccagatgaagatacagaggtgaagactttaaaactgagtggaatgtctaaccggtcatctatcattaacgaacacatgggctcctcatcgagggacaggcgccagaaggggaagaaatcctgtaaagaaacatttaaagagaaacacagctccaagtccttcctggaacccgggcaggttaccacaggcgaagaaggcaacctcaagcctgagtttatggatgaagtcctcacgcccgagtatatgggtcagcgaccttgtaataatgtaagcagcgataagatcggagataagggcctctccatgcctggagttcccaaggccccgccaatgcaagtcgaaggatccgccaaagagttgcaggccccaagaaagcggaccgttaaagtgaccctcactcctctcaagatggaaaatgagtcccaatcgaaaaacgcattaaaggaaagctcgcccgccagccccctgcagattgagtcgacctcacccaccgagcctatcagcgcatctgagaaccccggtgacggcccagtggcccagccctcccccaacaatactagctgccaggatagccagtcgaataattaccagaaccttcccgtgcaggaccgcaatcttatgctccccgacgggcctaagccgcaggaggatggcagttttaaacggcggtacccaaggagaagtgcccgcgccaggagtaatatgttcttcggtcttacccctttgtatggagtgcgctcttacggcgaagaggacattcccttttactctagctcgacaggtaagaagcgcggcaagaggtctgctgaagggcaggtggacggtgccgatgatttgagcaccagcgacgaggatgatctttactattataattttaccaggacggtgattagctctgggggggaggaaaggctggcctcccacaatttgttccgggaggaggaacaatgcgatctgcccaagataagccaactggacggggtggatgatggcacggagagcgacacttctgtcacagcaaccacccgtaaaagcagtcaaatccctaagcgtaacggcaaagagaacgggaccgaaaacttgaagattgatagacctgaggacgcaggagagaaggagcacgtcaccaagtcttctgtcggtcacaaaaacgagcctaagatggataattgtcactccgtgtctagggtgaagacacagggccaggactctctcgaagcgcagttgtcctcacttgagtccagccggagagtgcacacatcgaccccctcggataagaacctgcttgacacttataacacagagctgcttaaatctgattcagacaacaataatagcgacgattgtggcaacatactccccagcgacattatggactttgtgctgaagaacactcctagtatgcaggcactgggcgagagccctgaatcatccagctcggagctcctgaacctgggcgaaggtctggggttggattctaaccgcgagaaggacatgggtcttttcgaggtgttcagccaacagctgccaactacagagcccgtggattcttccgtgagcagctctatctctgcagaggagcaatttgagctacctttggaactcccaagcgatctgtccgttcttaccactcggtctcctacagtgccgagccagaatccgagcaggctggccgtaattagtgattctggggaaaagagagtcaccataaccgagaaatcagtggcttcgtctgaaagcgaccccgcccttttgagccccggtgtcgatccaactcccgagggccatatgactccagatcactttatacagggacatatggacgccgatcatatctccagccctccctgtggcagcgtcgagcagggtcacgggaacaaccaagatctgaccaggaactcatccacgccaggcctgcaagttcccgtgagcccaaccgtacccatacaaaaccaaaagtacgtacctaatagtacagatagtccagggccctctcagatctcaaacgctgccgtgcagaccactccaccacaccttaagccagccacagaaaagctgattgtggtgaatcagaacatgcagcccctgtatgtgctccagactcttccaaacggagtgactcagaaaattcagctcacctcgtcggtctcctctacaccttccgtgatggagacaaatacatccgtgcttggacccatgggaggcgggttaactttgacaaccggcctcaacccaagcctgcccacttcacagagcctgtttccaagcgcatccaaaggactccttccaatgtcccatcaccaacacttgcatagctttcctgccgcgacgcaaagctcttttccacccaacattagtaaccccccttctggtttgctgattggagtgcagcccccacctgacccccaactgctagtcagcgagtcctcccagcggaccgaccttagcactaccgtggcaactccctcaagtgggttgaagaaaaggcctatttcacgtctgcagacgagaaagaacaagaaactcgccccttcatcaacgcccagcaacatcgcccctagcgacgtcgtatccaatatgacactaataaattttaccccaagccagttgccgaaccacccctctttgctcgacctaggaagcctcaatactagctctcaccgcaccgttcccaatattattaagcgatcgaaatcttctatcatgtattttgagccagcacccttgctcccacagtcagtagggggtaccgctgccacagctgcaggaacgagcaccatctctcaagatacgtcgcatcttacgagcggaagcgtctccgggctcgcatctagctcgtccgtgttgaacgtggtctcgatgcagaccaccactacacctacgtcaagcgcctcggtccctggccatgtcaccctgacgaaccctcgcctactcggaaccccagacattgggtccatctcaaacctactgatcaaagcgagccagcagagcctgggaattcaggatcagccagtggccctgccaccatcttctggtatgtttcctcagctcggaacctctcaaactccttcgacagccgccatcaccgctgcatccagcatatgcgtgctgccctctacccagactactggaattacagccgcctccccatctggcgaggctgacgagcattatcaactgcagcacgtcaatcagttgctggcgagcaaaacaggtatccacagcagtcagagagacctcgactccgccagcggtccacaggtgtcaaacttcactcagaccgtggacgcaccgaattcaatggggctggagcaaaacaaggccttgtctagtgccgtgcaggcgtccccaacctctcccggaggctccccaagcagcccctcatccggacaacgctctgcatcaccctcagtgcctgggccaaccaagccaaaaccaaagaccaaacgttttcaactgccacttgacaaaggtaacgggaaaaagcataaggtgtcccacttgagaactagttcctccgaagcgcacattccggaccaggaaacaactagcctaacaagtggaaccgggacccccggggcagaggccgagcagcaagacactgcttcagttgagcaaagctcccagaaggagtgcggtcagcctgccgggcaggttgccgtcctacccgaagtgcaggtgacccagaatccagcgaacgagcaggagtcagccgaaccaaagactgtggaagaggaggaatctaatttctcatccccacttatgctatggctccaacaggagcagaaaagaaaggagtccatcacagaaaaaaagccaaagaaagggctagtctttgagatctcaagtgatgacgggtttcagatctgcgccgagagcatagaggatgcctggaagagtctgaccgacaaagttcaggaagctcggagcaatgcaaggctcaaacaactgagctttgctggcgttaatgggctgcgaatgctggggatcctgcacgatgcagtcgtttttctcattgaacagctgtctggcgcaaagcactgccgcaactataagttccgattccacaagccagaagaggcaaatgaacctcctttgaatcctcacgggagcgcgcgcgccgaggtgcacttacgcaaatctgcgttcgacatgtttaattttttggcttcaaagcaccggcagccacccgagtataatcccaatgatgaagaagaagaggaagtccagctgaagagtgccaggagagctacttccatggatctgcctatgcccatgcggttccgccacctgaagaagaccagcaaggaagccgttggagtttaccgatcgccaatccatgggagaggcttgttttgcaaacgtaacatagacgccggagagatggttatagagtacgcaggcaatgtcatccgctccatccaaactgacaagcgcgagaagtactatgatagcaaggggataggttgctatatgttccgaattgacgattctgaggttgtcgacgctactatgcatgggaacgctgcaagattcatcaaccattcttgcgagcccaattgctatagtagggtcatcaacatcgatgggcagaagcatatagttattttcgctatgcgcaagatatacagaggggaggagttaacctacgactacaaatttccaatagaggatgcttctaacaagctgccatgcaattgtggcgctaagaagtgtcgtaaatttttgaattag

SEQ ID NO: 125232 - DNA, 8640 bp, Artificial Sequence
  Description of Artificial Sequence: Synthetic coding sequence
cacgcccatcccgagtgtttaacaatggaacgggagaagatactgtcctcaatggggaacgacgataagtctagcatcgctggatccgaagatgcggagcccttagcgccacccattaaacctatcaagcccgtgactcggaacaaagcccctcaagaaccacccgtcaagaaagggagaagatcacggaggtgcggccagtgccctgggtgccaggtccccgaagactgcggcgtgtgtacaaactgtctagacaaaccaaagtttggcggccgaaacattaagaaacaatgctgcaaaatgcgcaagtgtcagaacctacagtggatgccaagcaaggcttacctacaaaagcaagccaaggcggtgaaaaaaaaggaaaaaaaatctaagacttccgagaaaaaagacagcaaagagagctccgtggtcaagaacgtcgtggattcctctcagaaaccgacaccctcagcgagagaggatcccgcccccaagaagtcatcttcagaaccgccacccagaaagcctgtggaggaaaagagtgaggaaggaaatgtgagcgcgcctggaccagaatctaaacaggctactacccctgcgtcaagaaagagttccaagcaggttagtcagcccgcactggtgatacctcctcaaccacccacaacggggcccccaagaaaggaggtgcccaaaactacaccatccgaacccaaaaaaaagcagccacctcccccggagtcaggtccagagcaaagtaaacagaagaaggttgccccaagacctagcattcccgtgaagcaaaagccaaaagagaaggaaaaaccccctccagttaacaaacaagagaacgcagggaccctgaatatcctctccaccctgtctaacgggaattcatcaaagcagaaaatccccgctgacggagtacaccgcatccgagtggactttaaggaggactgcgaggcagagaacgtgtgggagatggggggactcgggattctgactagcgttcccattacacctcgtgtggtctgcttcctgtgtgcgagctccggacacgtcgaattcgtgtactgtcaagtttgttgtgaaccattccataagttttgtcttgaggagaacgagcgtcccctagaagatcagttggagaactggtgctgtagaagatgtaagttttgtcacgtttgtggccgccaacatcaggcaacaaagcagttgctcgagtgcaacaagtgccgtaatagttaccacccggagtgcctcgggccgaactaccccacaaagcccactaagaagaaaaaagtgtggatatgcacaaagtgcgtccgctgtaagagctgtggcagcacaactcccgggaagggctgggatgcccagtggagccacgacttctctctttgtcatgattgtgcaaaactgtttgcaaagggcaacttctgcccgctctgcgataagtgctatgacgatgacgattacgaaagtaagatgatgcagtgcggcaagtgcgaccggtgggtgcattctaagtgcgaaaacctatctgacgagatgtatgagatcctgtcaaacttgcctgagtccgtggcttatacatgtgtaaattgtaccgagaggcaccctgcggaatggcggctggcactggaaaaggaactccaaatctccctgaagcaagtcctgactgccctgctcaattctcggactacatcccatctgttgcgatataggcaagccgccaagccccctgatctcaatccagaaaccgaagagtccatcccgtctagaagctcccctgagggccccgatccacccgtgctgactgaagtctccaaacaggacgatcaacagcccctggatttagagggggtcaaacgcaagatggatcaggggaactacacctccgtgctcgaattcagcgatgacatcgtgaagattatacaggccgcaatcaacagcgatggaggccaacctgaaataaaaaaagccaattccatggtgaagtccttctttatacgtcagatggagcgcgttttcccttggtttagcgtgaagaagagcagattctgggagccaaataaggtaagtagcaactccggaatgcttccgaacgccgttctgcctccttccttagaccataattacgcccagtggcaggagcgggaggaaaactctcacacagagcagcccccactgatgaaaaaaattatacccgccccgaaacccaagggacctggggaacctgacagccctacccccctccacccaccaacccctcccattttgtcaactgatcggtcacgagaggattcacccgagctgaatcctccacccgggatagaagacaatcggcaatgtgctctttgcttgacatacggtgacgactctgccaacgatgctggtcggttgctttacatcggccaaaatgaatggacccatgtgaactgtgcgctgtggagcgcagaggtgttcgaggatgacgacggctctcttaagaatgtccacatggcagtgatcaggggcaagcaactgcgttgtgagttctgccagaaaccaggggccactgtcggctgttgtctgacttcatgcacatcaaattaccattttatgtgcagtcgggcaaagaattgtgtgttcttggatgataaaaaggtgtattgccagcggcaccgcgacctcatcaagggtgaggttgttccagagaacggtttcgaggtgttcaggcgagtatttgtggacttcgaagggattagcctgcgtcgcaaattcctgaacggtcttgagccagagaatatccatatgatgattggctccatgaccatcgattgtctgggaatacttaacgacctcagcgattgtgaagataaactgtttcccattggctaccaatgtagccgagtttattggtccacaacagatgctcggaagaggtgcgtgtatacttgcaagattgtcgagtgtaggccccctgtcgtcgagcccgacataaatagcacggttgagcacgatgagaatagaacaattgcccactctcctaccagctttaccgaatcctcttctaaagagagccagaataccgcagaaataattagccccccatcccccgatcggccgccacacagccaaacctcagggtcttgctactatcatgtgataagcaaagtcccgcgaattagaacaccctcctattcacccacccagagatcacctgggtgccgacccctgccttccgcagggagcccaaccccgacaactcatgaaatcgtgactgttggcgatccccttctgtcttctggtctgcgaagtatcggatcaagaagacattcaacgtctagtctgagtccacagagaagcaaactccgtatcatgtcaccaatgaggaccgggaatacctacagcaggaacaacgtgtcaagcgtttcaacaacaggcaccgccactgaccttgaatcttcggcgaaggtggttgaccatgtactcggacctctcaatagtagcactagtttgggacagaacaccagcaccagctccaatctgcagcgaactgtggtaaccgtcgggaataaaaattcccatctggacggatcttcctcaagtgaaatgaagcagtcgtccgccagcgacctcgtgagtaagtcaagctcactaaagggggaaaaaaccaaagtcctttcatctaaaagcagcgaagggtctgctcataacgttgcataccctgggatacctaagcttgctccccaagtccacaatactacatctcgcgagttaaatgtgtcgaagattggctctttcgcggaacccagttctgtttcatttagttcgaaggaggctctcagcttcccacatcttcatctcaggggtcagcggaatgatcgggatcagcacacggattccactcagagcgctaactcatctccggacgaagacacagaagtaaagacactgaaactttccggtatgagcaacaggtcatcaattattaacgagcatatgggcagttccagccgagatcgacgacagaaaggaaagaagtcctgcaaagagacttttaaggaaaaacacagctctaagtcgttcctggagcccggacaggtcaccacaggcgaagaggggaaccttaagcctgagtttatggacgaagtgctaactcctgagtacatgggccagaggccatgcaataatgtgtcctctgataagattggcgacaaaggactgagcatgcccggcgtcccaaaagctcctcctatgcaggtagaagggtcagctaaagagctgcaggctcccagaaagcgcacagtgaaggtcactctgactcccctgaaaatggaaaacgagtcacagagcaagaatgctctgaaggagtctagtcctgcctctccattgcaaattgagtcaaccagtcccacggaacctatctcggcttctgagaatccaggagatggccccgttgctcagccaagtcccaataatacctcatgccaggactcccaaagcaataactaccaaaacctgcccgtgcaggatcgaaaccttatgctgcccgatggcccaaaaccacaggaggatggttcctttaagcgcagatacccccggcgaagcgcccgggcgcgttctaatatgtttttcggcttgacccctctttacggagtccgatcatacggagaagaggatatcccgttttattcctccagtacggggaaaaagcggggcaaaagatcagctgagggtcaggtcgatggcgctgacgacttatcaacgtcagacgaagacgacctgtactattataacttcacacgcacggtgatcagctctggcggagaggaaagactggcctctcataatctgtttcgagaagaagagcagtgcgatttgcccaagatatctcagctcgatggggtcgacgacggcacagagtccgacacatccgtgactgccactacacggaagtcctcacagatccccaaacgaaacggtaaggagaacggcacagaaaatcttaagatcgacaggcccgaagatgcaggcgagaaggaacatgtcacaaagtctagtgtggggcacaagaacgaaccgaaaatggacaactgtcattctgtgagccgagttaaaactcagggacaggattctctggaggcccaactcagttcattggagagtagcaggcgggtacatactagcacccccagtgataaaaacttattggacacctataatacagagctgctcaagagtgactctgataacaacaacagcgatgattgtggaaacatcctgccttccgatatcatggattttgtgctcaagaacacccctagtatgcaagcactcggggagtcccctgaatctagcagttccgaactgctgaaccttggcgagggccttggtctggacagcaatagagaaaaagacatgggtctttttgaggtctttagtcagcagctccctaccaccgagcctgtggacagttccgtgtcaagcagcatttcagcggaggaacagtttgagctgcctctggagctgccttccgacctttcagtgctcactaccagatcacctaccgtcccatcacagaacccatcacgccttgccgtgatctcagattcaggcgagaaaagagtgactatcactgagaaatcagttgccagttctgaatctgaccccgccttgctcagtccaggcgttgaccccactccagaagggcacatgactcctgatcacttcatccagggacacatggacgccgatcatatctcatcgccaccttgcggaagcgtcgagcagggtcacggaaacaaccaagacctgactagaaacagttctaccccaggactgcaggtcccagtttctccaacagtgcctattcagaaccagaagtacgtccccaactctacagactcacccgggccaagccagatatccaatgcggcagttcagaccacccccccacacctaaaaccagccaccgagaagcttatcgtcgttaatcaaaacatgcagcccctatatgtcttgcagactctgccaaacggcgtcacacagaagatccagcttacttcatctgtgtccagcacgcccagcgtgatggagacgaatacatccgtgctcggtcccatggggggcggactgaccttgacaacggggctgaacccatccctgcctacatctcagtctctgtttccctctgcctccaagggactcttacctatgtcacaccaccaacatctgcactcattcccagcagcgactcagtcttctttccctcctaatatatctaacccaccatctgggctgcttatcggggtacagcctcctccagatccccaactgctggtgtctgagagttctcagaggacagatctttcaactacggtcgctactccttcttccggtctgaagaaacgacctatcagtcgcctccagaccaggaaaaacaagaagcttgcaccttcctcaacaccaagcaatattgccccatcggatgtcgtgtccaacatgacactgatcaactttaccccttcccagcttcctaaccacccctcactgctggatctgggctccctgaatactagttcccatcgtacagtgcccaacattattaaacgatctaaatcctctataatgtattttgaaccagctcctctgttacctcagagcgtaggaggaaccgctgccacggcagccggtacatctacaattagccaggacactagccatttgacctctggctccgttagcgggctggcatcatctagtagtgttttgaatgtggtgagcatgcaaaccacgaccacaccaacatcctctgcttccgtgcctggacatgtgacccttacgaacccccgactcctaggaacacccgacattggatccatttctaacttgctcatcaaagcatcccagcagtccctgggcattcaggaccaacctgttgctctgcccccatctagtgggatgtttccacagttagggacatctcaaactccttctactgcggctattacagcggcctcgtctatctgtgtcctgccaagcacccaaacaactggaattacagcagccagcccctccggggaagccgatgaacactaccagctccagcatgtcaatcagctgctcgcctcaaagacaggcattcacagctcacagagagacctcgacagtgctagtgggcctcaagtatccaattttactcagacagttgatgccccgaacagcatggggctcgaacagaacaaggcactaagctcggccgtgcaggcaagtcctacatcacccggggggtccccgtcgtctccctcttctggccagcggagcgccagtccgagtgtgcccgggccaaccaaacctaaaccaaaaaccaagaggtttcagttgcctctggacaagggtaatgggaaaaagcacaaggtgtcacaccttaggacctccagcagtgaagctcatattccagatcaggaaaccactagccttacctctgggacaggcactccaggggccgaagccgaacaacaggacactgctagtgtcgaacagagcagtcagaaggaatgtggacagcctgctggccaggtcgcggtactacccgaagtccaggtgacccagaatcctgccaatgaacaggagtccgccgagccaaagacagttgaggaagaggagagcaatttctcctcccctttaatgttgtggctccaacaagagcagaaacgtaaggaaagtatcaccgagaagaaacctaagaaagggctggttttcgagatcagctccgatgacggcttccagatttgtgctgagagcatcgaagatgcatggaagtccctgactgataaagttcaggaagcacgatctaacgctaggttgaagcagttgtctttcgcgggtgtgaacggattacggatgctcggcatcctacatgatgcagtagtgttcttgatcgaacagctgtccggagccaaacactgtcgcaattataagtttcggtttcacaaaccggaagaagccaatgaacctcctctgaatccacatggcagtgcaagggctgaggtccatctgcgtaagtcagccttcgatatgtttaactttctggcctctaaacatagacaaccgccagagtacaatcctaacgatgaggaagaggaggaagtgcaactgaagtctgcaaggagggccaccagtatggaccttcctatgcccatgcgcttcaggcacctgaagaaaacctctaaagaggcagtgggggtgtatagatcccccattcacggtcgtgggctgttctgtaaaagaaatattgatgcaggcgaaatggtcatagagtacgctggaaatgtcatccgcagcatacaaacggacaagcgagagaaatattatgattctaaggggatcggatgttacatgttccgcatcgacgattctgaagtcgtcgatgccaccatgcatgggaatgcggctaggttcataaatcatagctgtgagccaaactgttatagcagagtgatcaatattgatggccagaagcatatagtcattttcgcaatgcggaagatctatcgcggggaagaattaacctacgactataaattcccgatcgaggatgctagcaacaaacttccttgcaattgcggggcaaagaagtgtaggaagttcctaaattag

SEQ ID NO: 125233 - DNA, 11910 bp, Artificial Sequence
  Description of Artificial Sequence: Synthetic coding sequence
atggctcattcatgtaggtggcggtttcccgctcgccccggcaccactggcggcggaggcggcggagggcggcgagggctgggcggtgcacctcgacagagggtgccagccttactgctacctccaggaccccccgtgggaggtggcgggcctggagcccctccatcccctcccgccgtggccgctgccgcagccgctgctggatcctccggggcaggcgtgcccgggggcgcggctgcagcctccgcagcatcttcaagttctgcaagctcctcttcttcctcgtccagctctgccagctcaggccctgctttactcagggttggtccaggctttgacgcggctcttcaggtaagcgctgccattgggaccaacctgcggagatttcgtgcagtgttcggggaatctgggggcgggggcgggtctggtgaggatgagcagttccttgggttcggatcagatgaggaagttcgcgtcaggtccccaactagatccccaagcgtaaaaactagtccccgaaaacctcgcggccggccacggtccggttccgacaggaattctgcgatcctgagcgacccctcagtcttcagccccctgaataagagcgaaacaaaaagcggtgataagataaaaaagaaagatagcaagtccatagagaaaaaacgcgggagaccgcccacattccctggagtgaagattaaaatcacgcatggaaaagacatttccgaactacctaaagggaacaaggaagactccctcaaaaagattaagaggacgccaagcgccacctttcagcaggctacaaagatcaagaagctgcgcgccggcaaactgtctcctctgaagtctaaattcaagaccggcaagctacagatcggtagaaaaggggtgcaaatcgtccgcaggcgtggccgcccaccctcaacagaacgcatcaagacccccagcgggctgctgatcaattcagagctcgagaagccacaaaaggtgagaaaggataaggaagggactccccccctgactaaagaggacaaaaccgtcgtgcgtcagagccctaggcgtatcaagcccgtacgcataatcccctcttcaaaaagaacagatgcaactatagctaagcaattgttgcaacgagctaagaagggcgctcagaagaagatcgagaaagaagccgcccagttgcagggcagaaaggttaagacccaggtaaaaaacatacggcagttcatcatgccagtggtgtctgctataagcagcagaattataaagactccacgacgcttcatcgaggacgaagactatgacccaccaatcaagatcgcccgactggagtctaccccaaattctaggttctctgcaccttcatgtggaagttctgaaaaatcatctgctgcctcgcagcactccagccagatgagcagcgacagctctcgctcttccagcccatccgtagataccagcaccgacagccaggcctctgaggagatacaggtcctccctgaggaacgatctgacactcccgaagtgcacccccccttgcctatcagccagagtcccgaaaatgagtcaaatgatcgccgaagtagaaggtattcggtgagcgagcgctcatttgggagtcgaaccaccaagaagttatctaccttgcagtcggcaccacagcagcagacgagcagctcacctccccctcctctcctcacgcctcctcccccgctccaacctgcttctagcatttcggaccatacgccttggctaatgccgcccactattcctcttgctagtcccttcttgccagcctccactgctccgatgcaaggaaaaagaaagagcatcctgcgcgagcccactttcaggtggacaagtctgaagcatagtcggtctgaaccccagtacttttctagtgccaaatacgcaaaagagggcctcattagaaagcctatctttgataatttccgacccccacccctgacgcctgaggacgtgggatttgcatccggattctcagcgtctggcaccgccgcaagcgcgcgcttgttctcccctctgcactcagggacccgttttgatatgcataaaagatcccccctgctgagagctccccgctttaccccttccgaggctcacagcagaatcttcgagtctgtgaccctgccctctaataggacctcagcaggcacatcgtctagcggggtcagtaataggaaacggaaaagaaaagtcttttcccctatcaggtctgaacccaggagtcccagccattcaatgcggactaggtctgggaggctttcttccagcgagttgagccctctgacccctccatcttctgtgtcaagcagcctctccattagtgtcagccccttggccacttccgctctgaaccccacatttacctttccatcccactctctgacccagagtggagaatctgcagagaagaaccagcgccctcgaaagcagacttctgcccccgcagagcccttctccagtagtagtccaaccccgctgttcccttggttcacacccgggtcgcaaaccgagaggggccgcaataaagataaggccccagaggagctaagtaaggatagagacgcagataaatctgtagagaaggataaatcacgtgaaagagatcgtgaacgagagaaggagaataagcgcgaaagtaggaaggagaagcgcaagaaaggttctgagatccagtcgtcatctgccctttaccccgtgggcagggtgtccaaggaaaaggtcgtgggagaagatgtcgccaccagctcttccgcaaagaaagccacaggccgcaaaaagtcctcatcccacgactctgggactgatataacatcagtgacattgggagacacaaccgccgtgaagacgaagatcctgatcaaaaagggaagaggcaacctggaaaaaactaacctggatttaggccctaccgctcccagcttagagaaggaaaaaactctttgcttgtcaacacctagttcttcaacagtgaagcattctacttcatcaattggctcaatgcttgcacaggcggataaacttcccatgacagataaacgggtcgccagtctcctcaagaaagccaaggcccagctctgtaagatagagaaatccaaatccctgaaacagaccgaccagcctaaagctcagggacaggaaagtgactctagtgaaacctccgtgagaggtcctaggatcaagcatgtatgccgaagagccgccgtagccctgggccggaaacgggccgtattcccagacgacatgcctactctttcggccctgccatgggaggagcgtgagaaaattctttcatcaatgggtaacgacgacaaaagttcaatcgcggggtcggaagatgctgagccattagcccctcctattaagcccattaaacctgttacccggaataaggcgcctcaagagcctccagtgaaaaaggggcgcaggagcaggcgttgtgggcagtgccctgggtgccaggttcctgaggattgtggggtttgcaccaactgtctcgataaaccaaagtttggcggtaggaatattaagaaacaatgttgtaaaatgcgaaaatgtcagaatttgcagtggatgccctcaaaagcttatcttcagaagcaggcaaaggctgtgaagaagaaagagaagaaatctaagacatctgagaagaaggactctaaggaaagctcagtggtcaagaatgtggttgactcatctcaaaagcccaccccttccgctcgcgaagatcctgctccaaaaaagtctagtagcgagcctcctccccgaaaacccgtagaagagaagtccgaggaagggaacgtgagtgcacccggaccagagagcaagcaagcaacaactccggccagccgcaaatcctccaagcaagtatcccaacctgccttggtgattccaccccagccacctactacgggcccacctcgcaaagaggttcccaagaccacaccctcagagcccaagaagaagcaaccaccacccccagagtctggacccgagcagtccaaacagaagaaggtagccccgagaccatccatacccgtgaaacagaagcctaaggagaaagagaaaccccctccagtgaacaagcaagaaaacgctggcactctgaacattttgtcaacactgagcaatggtaatagtagcaagcaaaagatcccggccgatggcgtccaccggatccgtgtggactttaaggaggactgcgaggctgagaatgtgtgggaaatgggaggtctcggaatcttgacttcggtcccaatcacgcctcgggttgtttgcttcctgtgtgcctcatccggacacgtggagttcgtgtactgtcaagtgtgttgtgagccgttccacaagttttgtttagaggagaatgaacggcccctcgaggaccagttggaaaactggtgctgtcggagatgcaaattctgccacgtctgtggtcggcagcatcaggccaccaagcagctcctggagtgcaacaagtgcaggaactcgtaccaccctgaatgtttaggacccaattacccaaccaagcctacaaagaaaaagaaggtgtggatctgtaccaaatgcgtccggtgcaagagttgtggatccactactccaggaaaaggttgggatgcacagtggagccacgacttcagtttgtgtcatgattgcgctaagttatttgccaagggcaacttctgccccttatgtgacaagtgctacgacgatgatgattacgaaagcaagatgatgcagtgcggcaaatgcgacagatgggtgcattccaaatgtgaaaatctgagtgatgagatgtacgagatcctgtctaacctgccagagagcgtggcttatacctgtgtcaactgtaccgaaagacacccagccgaatggcgactcgcgctggaaaaggagttgcagatatcactgaaacaggtgctgactgccttacttaattctcgaactactagccatttgctgaggtacagacaagctgctaaacctcccgacctgaaccctgagaccgaggaaagcatcccttcccgctcctcccccgaaggccccgacccccccgtgttaacggaggtaagcaagcaggatgatcagcagccgcttgatttagaaggcgtgaagcgtaagatggatcagggcaattacacctctgttctggaattctcagatgatatcgtcaagatcattcaggcagctattaacagtgacggcgggcagcccgagatcaagaaggctaacagtatggttaaaagcttcttcatccggcagatggaaagagtgtttccctggttttcagttaagaagagccggttttgggagcccaacaaggtttctagcaattcaggaatgctccccaatgcagtcctccctcctagtctcgaccataattatgctcagtggcaggagcgggaagaaaacagtcataccgaacagccgcctttgatgaaaaaaattatcccggccccgaaacccaaaggccctggcgaacctgacagccccactcccctacaccctcctacaccaccaatcctgtctaccgataggagccgggaggattcaccagaattaaatcctccgcccggtatcgaagataatagacagtgcgcgttgtgcctcacttatggggacgattctgccaatgacgcgggccgactcctttacatcggacaaaatgaatggacacacgtgaattgcgccctttggtctgctgaggtgttcgaggatgacgacggaagcctgaaaaatgttcatatggccgtcatccggggcaaacaactgcgctgcgaattttgccaaaagccaggcgccaccgtcggttgctgcctaacaagctgcactagtaattaccactttatgtgctcccgagctaagaattgcgtttttctggatgacaagaaagtttattgccagaggcatagggatctcatcaagggagaagtggtgcccgagaacggattcgaggtgttccggagggttttcgtggattttgaaggcattagcttacgcagaaagtttctgaatggccttgagcctgagaatatacatatgatgataggctctatgacgattgactgtctaggtatcttgaacgacctaagtgattgtgaagacaaattgttcccgattggatatcagtgctcgcgggtgtactggtcaacaaccgacgccaggaaacgctgcgtatatacgtgcaaaatagtcgaatgcaggcctcccgtggtggagcctgacatcaacagcaccgtggagcacgacgagaacagaacaatcgcccatagccccacgagctttacggagagtagctcaaaggagtctcagaatacagccgaaattatcagccccccttcgccagacagacctcctcactctcagacctcggggtcgtgctactaccacgtgatcagcaaggtcccaagaatccgtactccatcctactccccaacacagaggtctccagggtgccggccccttccttccgccgggtcgcccactcccacaacccatgagattgtgaccgtcggggaccctttactgtcctccggtctccgttctatagggagccgcagacacagcacgagctccctgtcccctcagcgcagtaagctgagaataatgagtcctatgcggaccggaaacacttactctcggaataacgtgagctccgtatcaacaaccggcaccgcaacagatctcgagtcctccgccaaggtcgtggaccacgttctcggcccactgaatagttcaacaagtttgggacaaaacacgtctacttcttcgaatcttcagcggactgtcgtcacagtcgggaacaagaactcgcaccttgatggaagctcaagttctgagatgaagcagtcatccgcttctgacttggtgagcaagtcctctagtctgaagggagagaaaacaaaggtgctcagctccaaaagctctgaaggatcagctcacaacgtggcctacccagggattccaaaacttgctccacaagtccacaatacaacatcgcgggaactgaatgtgagcaagatcggtagttttgccgagcccagctcagtgtcattcagcagcaaagaggcactctcattcccacacctccacctgagaggccaacgaaacgaccgcgaccagcatactgattccacccagtctgccaactcctccccagacgaagacaccgaggtcaagactcttaagctaagtggcatgagtaatagaagtagcatcattaatgagcatatgggcagctcttccagggacaggcgccaaaagggaaagaaatcgtgtaaagagaccttcaaagagaagcactcatccaaatcattcttggagccaggtcaggtcacaactggggaagagggcaatcttaagcctgagtttatggatgaggttctgacgccagagtacatgggccaaagaccttgcaataacgtcagtagtgacaagatcggtgacaaagggctctctatgccgggcgtccccaaggcaccacccatgcaggtggaaggctctgcgaaggagctgcaggctcctcgcaaaaggaccgtgaaagtcacgcttacacctcttaaaatggaaaacgagtctcaatcaaagaacgctctgaaggagagcagccccgcttctcctttacagattgaaagtacctcaccaaccgaaccgatatccgcatctgaaaatcctggtgacggccctgttgcgcaacctagccccaacaacacttcgtgtcaggactctcaatcaaataactaccaaaatttaccggtgcaggatcgaaacctgatgctccctgacggccctaagcctcaggaggacggcagcttcaagcggcgctacccccgccggtcagcccgtgcaaggtcaaacatgttcttcggtctaacgccgctttatggggtgcggtcttacggcgaagaggacatccccttctactcgtcatcaaccggcaagaagagggggaagaggagcgccgaaggccaggtggatggggcagatgatctgagcacttccgacgaagacgacctttactattacaattttacgcgcacagtaatctcttccggaggggaggagcgcctcgcatctcacaacctgttccgagaagaggagcaatgtgatctccctaagatctctcagctggatggagtggacgatggtacagagtcagataccagtgttacagccaccacaaggaaaagctctcaaatacccaaacggaacggtaaggaaaacggaacagaaaatctgaagatcgatcgacctgaggatgccggcgagaaggaacacgtgacaaaatctagtgttggacacaagaatgaacccaaaatggacaactgtcattctgtcagtagggtcaaaacgcaaggacaggattcattggaggcgcagcttagctccctggagtctagcaggagggtacacacatccacaccttctgacaaaaatttactagatacatacaacactgagctgctaaaatccgacagtgataataacaattcagacgactgcggtaacattctgccgtcagatatcatggactttgttctgaagaacactccttctatgcaggccctcggggaatcgccggaatcatcttcctccgaactgctgaacctcggagaaggcctcggacttgactccaatcgcgaaaaggacatgggtctcttcgaagttttctcccaacaactccccaccactgagccagtggattcaagtgtgagctcaagtattagcgccgaggaacagttcgagctgcctttggagctgcccagtgatctgagcgtgctgactacgcgttctcctacagtgccttcccaaaaccccagccgcctggcggtcatatcagactctggcgagaaacgagtgaccatcactgagaagtcagtggcgagttccgagagtgatcctgcgttactgtctcccggggttgacccgacccctgaaggccacatgaccccagaccacttcattcaggggcacatggatgccgatcacatctcatcccccccttgtgggtccgtcgaacagggacatggcaataaccaggacctgactagaaactccagcacacccgggctgcaggtaccagtgtcccctacagtgcctatccagaaccaaaagtacgtaccgaatagtacagattcccccggcccatcccagatctccaacgccgctgtacagaccacgccaccccacttaaagccagccacagagaagctgatcgtcgttaatcagaacatgcagcctctttacgtacttcagacgctccccaatggcgttactcagaaaattcaactgacttctagtgtatctagtacaccttcagtgatggagaccaatacaagcgtgctcggccccatgggaggcggtctaacgctgaccacaggattgaatccttctctcccaactagccagagtctgttccccagcgcatcaaaagggttactacctatgagccaccaccagcacctacattctttccctgctgccactcagtcctcatttccccccaacatttctaacccaccaagcggcctgcttatcggcgtgcagccgcctcccgatccacagctactggtgtccgagagctctcagcggacggatctgagcactacagtagcaacacctagtagcgggctcaaaaagcggccgatttcaaggctccagacccggaaaaataagaaactggccccgagctccactccgtccaacatcgccccttcagacgtcgtttcaaacatgactttgataaatttcaccccatctcagctgcctaatcatccaagccttctggatctggggagtctgaacacctcttcccatcgtacggtgccgaatatcataaagaggtccaaatcctctattatgtactttgaacccgcacccctgctgccccagagtgtaggtgggaccgcagcgaccgctgccggcacatctactatcagccaggatactagtcatttaactagcggtagtgtgtctggtcttgcttcttcatcatcggtgctcaacgttgtctccatgcaaaccactaccacgcccacttcatctgcttcggtgcccggtcacgtgacactgaccaatccgaggttgctgggaacccctgacatcggtagcattagcaatctcctcataaaagctagtcaacaaagcctcggaatccaggaccagccagtggccctacctccaagtagcggcatgtttcctcagcttggtacgtcacaaacacccagcacagcggcaatcactgccgcttcttccatttgtgtgcttccttccacgcagactaccggcataaccgcggccagtccctcaggtgaagccgatgaacattaccagttacagcacgtcaaccagctgcttgcctctaagacaggaatccactccagccagagagaccttgacagtgcctctggcccacaggtcagtaattttacacagactgtcgacgcgcctaactctatgggcctggagcagaataaagccctgtcttctgccgtacaagcaagccctacaagcccagggggctcaccctcatctcccagttccggtcagaggtctgcaagtccttctgtgcccggaccaacaaagccaaaacctaaaacaaaaagatttcagcttcccttagataagggaaacggaaaaaagcataaggtctctcacctccggacatcgtcatccgaagcccatatccctgatcaggagaccaccagtctaacctccggaaccggtacacccggcgctgaagccgagcagcaagatacggccagcgtagaacagtcatcgcagaaggagtgtggccagccagcgggccaggttgctgtactgccagaagtgcaagtgacccagaaccctgccaacgaacaggaaagtgcagagcccaaaacggtggaagaagaagagtccaacttttcttcccccttgatgctctggctgcagcaggaacagaagcgcaaggaaagtattactgagaagaagcctaaaaaaggcctggtgttcgaaatttcctccgacgacggattccagatttgcgcggagtccatcgaagacgcctggaagtctctcactgacaaagtgcaggaagctcggagtaacgctcggctgaaacaactgtccttcgccggcgtgaacggccttaggatgctgggtatcctgcatgacgcagtggttttcctcattgagcagttatcgggcgctaaacactgtcgcaattacaagttccggttccataaacccgaagaggcgaacgagccacccctgaatcctcacgggtctgcccgagctgaagttcatctgagaaagagcgcctttgatatgttcaatttccttgcttcaaaacaccgccagcccccagaatacaatcccaacgacgaggaagaggaggaggtgcagttgaagagtgctcgcagggccacgagcatggatctgcccatgcctatgcgctttaggcacctgaagaagacctcaaaagaagccgtaggagtatatagatctcccatacacgggcgcggtctgttttgcaaaagaaatatcgacgctggggaaatggttatcgagtatgccggcaacgtcatccgttccatccagaccgataagagagaaaagtattatgattccaaaggaatcggatgctatatgtttaggatcgacgattccgaagttgtggacgccacgatgcacggcaatgcggcccggttcattaaccattcctgtgagcctaattgttattcccgtgttattaacattgatggtcagaaacatattgtgattttcgccatgcgaaagatctacaggggcgaggagctgacctacgattataagttccctattgaggatgcgtctaataaactaccttgcaattgtggcgccaagaaatgtcgcaagttcctcaattag

SEQ ID NO: 125234 - DNA, 336 bp, Artificial Sequence
  Description of Artificial Sequence: Synthetic coding sequence
gacttcaaggatgagcagtttttagggtttgggtctgatgaggaggttcgggtcagaagccccactagaagtccttccggcagtatgctagcacaagcagataagttacctatgaccgataagcgtgtggcgtctcttctgaaaaaggccaaggcacagctttgcaagatcgagaagtcaaaatcgttaaagcagacagaccagccaaaagcacagggtcaggaatccgacagctctgagacttccgttcgaggtccacgcatcaaacacgtgtgtaggagagccgccgtcgcattggggcggaagcgggccgtgttccccgatgacatgccctag

SEQ ID NO: 125235 - DNA, 4320 bp, Artificial Sequence
  Description of Artificial Sequence: Synthetic coding sequence
atggctcactcatgccggtggagattccccgcaaggccaggtactacaggggggggcgggggtggcgggcgccggggccttggcggcgcccctcggcagcgtgttcccgccctgcttctgccaccaggtcctcccgtcggcggcgggggtcctggagcccctccgagtccaccagccgtcgcggccgccgctgctgccgcaggatcctctggtgcgggagtgcccgggggcgccgcagcagcatcggcagctagtagttcgagcgcttctagctcaagctcgtcctcctcttctgcttcgtctggccctgcactgctccgagtgggacccgggttcgacgcagctctgcaagtgtccgcagctatcggcactaacttgcgccgtttcagagccgtattcggcgagtcgggcggcgggggcggctcaggcgaactaactacacaaataccttgctcatggaggacaaaggggcacatacacgacaagaaaactgaaccattccggctcctcgcatggagctggtgcctaaacgacgagcagttcctgggcttcgggtctgatgaggaggtgagagtgagatctcccacccgatcgcctagcgtgaagacaagtccccggaaaccccgtggcaggcctcgctccggaagtgaccggaattctgcgattctgtccgatccctctgtgttttcacccctgaataagagcgagacaaaaagcggcgacaaaattaagaaaaaggattctaagtcaatcgaaaaaaagaggggaagaccacctaccttccccggcgtaaagatcaagatcactcacggaaaggacatttcagagctgcctaagggtaataaagaggactccctaaagaagatcaaacgcacaccgagtgcaacgttccagcaagccaccaagattaagaaactgcgagcaggaaagctgtctccacttaaaagtaaattcaagactggtaaactgcagatagggagaaagggagtccagattgtacggaggagaggacgccctccctcaaccgaaaggataaaaacaccatcgggcctgctcatcaatagcgaattagagaaaccccagaaagtgcgcaaggataaggaggggaccccgcctctcacaaaagaggacaagaccgtagttcggcagagcccacggagaattaaacctgtcagaataataccatcctctaagcgaactgatgccacgattgcgaaacaactgttgcagcgggccaaaaagggggcccaaaagaagatcgaaaaagaggcagcccagctccagggacggaaggtgaaaacccaggtcaagaacatcagacagttcattatgcctgtagtttcggcaatcagctcacgcataattaagaccccgaggcggttcatcgaggacgaggattacgatccacccataaagatagctaggctggaatcaacaccaaacagccgcttctccgcaccatcgtgtggcagtagcgaaaaatccagcgctgccagtcaacacagcagtcagatgtccagtgattcctcccgctcctcctcaccttctgttgacacatccaccgacagccaggcctctgaagagatacaggtcctcccagaggagagatccgacaccccggaagtgcacccacccctgcccatctctcagtctcctgaaaacgaatccaatgatcgcagatcccgccgttattccgtgagtgagcggagctttggttcccgcacaacaaaaaagttgtccacactacagagcgcaccccagcagcagacaagttcaagccctcccccgccactgctgactccgccgccaccacttcagcccgcttctagcatatctgatcacaccccgtggttgatgcctcctacaatcccactggccagtccctttctgccagcttctacagccccgatgcaaggcaaaaggaaaagtattcttagggaacccaccttcaggtggacatctctcaagcattctcgctccgaacctcagtatttttctagcgccaagtatgcaaaggaggggctaatcaggaagcccatttttgacaactttcgtcctccaccattgacaccggaggatgtgggcttcgcctctgggttcagcgcgtcgggcacagcagcttctgcaaggctgttcagtcctctgcatagcgggactcggtttgatatgcataagagaagccccttattgcgtgcccccaggtttaccccaagcgaggctcatagccgcatattcgaatctgtcaccctcccctctaatagaacatccgccggcacttcctcatctggagtcagtaaccggaagcgcaagcgaaaggtctttagcccgattcgctccgagcctagatctccatcacactccatgcgcacacggtctggcaggcttagctccagtgaattgtccccgcttacacccccatccagcgtgagctctagcctctccatctcagtaagcccattggctaccagcgctctgaatccaacatttaccttcccaagtcactcactgacgcagagcggagagtcagccgaaaagaaccagagacccaggaagcaaacatctgctcccgcagaaccattttcctccagcagcccaacacccttatttccttggtttaccccagggtcccagacagagcgcggccgaaacaaggacaaggctcccgaagagttgtcaaaggatcgagatgccgataaaagcgtggagaaagataagtcacgagaacgagacagggaacgcgaaaaggagaacaagcgggagagcagaaaggaaaaaagaaagaagggatccgagatccaatcttcgagtgccctgtatcctgtgggaagagtgtccaaagaaaaggtagttggcgaagacgtggccacatcatcatcggctaaaaaggctaccggccggaaaaaaagtagttctcatgattccgggacagatattaccagtgttactttaggtgatactaccgcagtcaaaacgaaaattttgattaaaaagggcagaggcaacctggaaaagactaacctggatctggggcctaccgccccatcacttgagaaggagaaaaccctgtgtctgtccacccccagctcaagcacagttaaacactctacgagctctatcggatccatgctagcacaggcagacaaactgcctatgaccgacaagcgcgtagctagcttgctgaagaaggcaaaagctcaactgtgcaagatcgaaaaaagtaagagcttaaagcagaccgaccagccaaaggcccagggtcaagagtccgattccagtgaaacctcggtgaggggccctaggataaagcatgtctgtagacgggccgcagtcgcactaggacgaaaacgagctgtgttcccggatgacatgccaaccctaagcgcgctgccttgggaggagcgggaaaaaatcttatcatcgatgggcaatgacgataagagttctatcgctggctcagaagacgcggaacccttggccccacccatcaagcccattaagcccgtgactcggaataaggctcctcaggagcctccggtgaagaaaggtaggcgaagtagaagatgcggccaatgccctggctgtcaggtccccgaagactgtggggtgtgtaccaattgtctggacaagccaaaattcggtggtcgcaatattaaaaagcagtgctgcaaaatgaggaagtgtcaaaatctccagtggatgccttccaaggcctacctccaaaaacaggctaaggcagtgaaaaagaaggaaaaaaaaagtaagacctctgagaaaaaagactctaaagaatcctctgttgtgaagaacgtggttgatagcagtcagaagcctactccatctgcccgcgaggaccccgcgccaaaaaagagctcctctgagccgccccctcgaaagcctgtcgaggagaagagtgaggaaggcaatgtaagtgcccctggcccggagagcaagcaggctactactcctgcttctagaaagtcctcgaaacaggtctcccagcccgccctggtcatcccaccgcagccccctacaacgggacctcctcggaaggaggttccgaaaacgactcctagcgagcccaaaaaaaaacagcctccaccaccagaaagcggccccgagcagtccaagcaaaagaaggtcgcgcctcggccttcaatcccagtgaaacagaagccgaaagaaaaagagaagcccccacccgtgaataagcaggagaacgcgggcaccctaaacatattgtccacattatcaaatggaaacagtagtaagcaaaaaatccccgctgacggggtccatcgcataagagtggacttcaagtag

SEQ ID NO: 125236 - DNA, 11919 bp, Artificial Sequence
  Description of Artificial Sequence: Synthetic coding sequence
atggcacactcatgcagatggcgctttccagccaggccggggacaacaggtggaggggggggcgggggacggcggggtcttggcggtgcccctagacagagggtgcctgcactgctgttacctccgggccctccagtgggtgggggggggccgggcgccccgccgtccccacctgctgtcgctgcagctgccgcagccgctggcagttccggagcaggtgtcccaggaggcgccgcagctgcctcagccgctagcagttcaagcgcctcctcttcctcttcctccagcagttccgcatcctccggcccagcactattacgagtaggtcccggattcgatgctgcccttcaggtcagcgcagcgattgggactaatctcaggcgtttcagagcagtgttcggtgaaagcggtggaggaggaggcagcggagaggacgagcaatttcttgggttcggttccgatgaagaggtgagggttcgcagcccaacccggtctccctcagtcaagacttctcctcgaaaaccacggggacggccacgaagcggcagtgaccggaactccgctatcctttcagatccaagtgtgtttagtccactgaataaatcagaaaccaaatctggggacaaaatcaagaagaaggactctaagtcaatcgagaaaaaacgaggccggcctcctacctttccaggtgtgaaaataaaaattacccacgggaaggatatttccgaactaccgaagggaaacaaagaggatagtctgaagaaaatcaaaaggactccctctgcgacattccagcaggccaccaaaattaagaaattgcgcgccggcaaactgagcccgctgaagagcaaattcaagacaggtaaactgcaaattgggagaaagggcgtccagatcgtcaggagacgcggccgaccaccctctaccgaaagaataaaaaccccttccggccttctgattaactcagagttggagaagccccagaaggtgagaaaggacaaggaaggtacaccaccgctgaccaaagaggacaagactgtggtaaggcaatcaccacgccgcatcaagcccgtgcggatcattccatcctctaagcgcaccgacgcgactattgctaagcagctgctgcagcgcgctaagaaaggcgcccaaaagaagatcgaaaaagaggcagcccaactgcagggaagaaaggtgaaaacccaggtgaagaatatccgacagttcattatgccagtggtctctgcgataagctcaagaataatcaagacgccgaggcgctttatcgaggatgaggactacgacccccccataaagattgcaaggctcgaatctacacccaacagcagattcagtgcccccagttgcggctcctccgagaagtcaagtgccgcctcacagcattcaagtcaaatgtcaagtgactccagcagaagctcaagcccctccgtcgacacctcaacagattcacaagcatccgaagagatccaggtcctcccagaggaacggtcagacacccccgaggtccaccctccactgccaatcagccagtcacctgaaaacgagagtaatgataggaggagtcggaggtattctgtatcagagcgaagtttcggaagccgcacaacgaaaaagttgagtacactgcagtccgcaccacagcagcagaccagttcctctccgccaccccctctgcttactccgcctcctccactgcagccagcgagctcgatctctgatcatacgccctggcttatgcctcctaccatccctcttgcctctcctttccttccagctagcaccgcgcctatgcagggaaagaggaagtctatcttaagggagcctacgttccgttggacatcccttaagcacagccgatccgaacctcagtactttagctctgctaaatacgcaaaagaaggtctgattcggaagccgatttttgacaacttcagacccccacccctgacgcctgaggacgtgggctttgccagcggctttagcgcctcaggtacagctgcatcagcccgccttttttcacctctgcactccggaacgcgctttgacatgcataagcgctcccccctgctccgagctcctaggttcaccccttccgaagctcacagtaggatcttcgaatctgtgacactgccgagcaatcgcacgagtgcaggcacctccagcagtggggtatctaaccggaaacgaaagagaaaagttttctcccccatcaggtccgaacccagaagtccaagtcactcaatgcgcactaggtcaggccgattatccagtagcgagctgtctcctctcacccctccatcttccgtgagcagttctctgagcatttccgtgtctccactcgctacatctgctctcaatcctacattcacatttccttcccactctttgacacagtcaggagagtctgccgagaagaatcaaaggcctcgtaagcagacctctgcaccggctgagcccttctcctccagtagtcctaccccccttttcccgtggtttaccccgggttcacaaacagagcgcggccgcaacaaggataaggccccagaagagttatccaaggaccgcgatgctgacaagtctgtggagaaggacaagagccgggagagagatcgtgagagggagaaagagaataaaagagaaagtcggaaggagaagcggaagaaaggcagcgaaatacagtcatcctcagccctttaccctgtcgggcgtgtgagcaaagagaaagtggtgggagaagatgtggccactagtagctccgccaagaaagcgacaggaaggaagaagtctagttctcacgatagtgggactgatattacctccgttaccctaggagacactactgccgtcaaaacaaaaattctcattaagaaaggccgcggaaatctggagaagacgaatctggatcttggtccaaccgcgcccagtcttgagaaagagaagactctgtgtctcagtactcccagttctagcactgtcaagcacagtacttccagtattggtagtatgcttgctcaagccgataagctccccatgaccgataagcgagtcgcaagtttactgaaaaaggcaaaggcccagctctgcaaaatagaaaaaagtaaatcactgaaacagaccgaccagccaaaggcccaaggtcaggaatcagattccagcgaaaccagcgtgcggggccctcggatcaagcacgtgtgccggcgcgcagctgtggccctcggacgtaagagagctgtttttcccgacgatatgcccaccctctctgctctcccttgggaggaacgggaaaagattctgagttccatgggtaacgatgataagagctctatcgccgggagcgaggacgccgaacctctggcccctccaatcaagcctataaagcctgtgacacgaaacaaagcccctcaagaacctccggtaaagaaaggcagacggagtcgtagatgcggacaatgtccaggatgccaagtgcccgaggactgcggggtctgtaccaactgccttgataagcccaaatttggcgggcggaacatcaagaagcagtgttgtaagatgagaaagtgtcagaacctgcagtggatgccaagcaaagcctacctgcagaagcaggccaaagcagtgaaaaagaaggagaaaaaatcaaagacgagcgagaagaaggatagcaaagaaagctcggtggtgaaaaacgtcgtcgattcatcccaaaagcctacaccgagcgcgcgggaggaccccgcccccaagaagtcaagtagcgagcctcccccccggaagcccgtagaggaaaagagcgaagaaggtaacgtaagtgccccaggtcccgaatccaagcaggcgacaaccccagctagtagaaagtcttcaaaacaggtctcacagcctgcattagtgatccctcctcagccgcctaccactggcccaccaaggaaggaagtgcccaagacgactccttctgaaccaaagaaaaaacagccaccaccccccgaaagtgggcccgagcaatccaagcagaaaaaggttgccccccgtccaagtatccctgtgaaacaaaaacctaaggaaaaggaaaagccacctcccgtgaataagcaagaaaatgcaggaaccttaaacatactaagcacacttagtaatggcaactctagtaaacagaaaatacctgccgacggcgtccaccggattcgcgtggacttcaaggaagactgcgaggccgaaaatgtctgggagatgggtgggctgggaattctgacgagtgtgccaatcacacctagagtcgtgtgtttcctctgtgcctccagtgggcacgtagaatttgtatactgccaggtgtgctgcgagcctttccataagttttgtcttgaagagaatgaaaggcctctcgaggaccagctcgagaattggtgttgccgtcgttgcaagttctgccatgtctgcgggaggcagcatcaagctaccaagcaactgctggagtgtaataagtgtaggaatagctatcacccagagtgtctgggtcctaactacccaacaaagccgacgaagaaaaaaaaggtgtggatctgtacaaagtgcgtcagatgtaaatcttgcgggtccacaacacctggtaagggctgggacgcccaatggtcacatgatttctccttgtgtcacgactgtgccaaacttttcgccaagggcaacttctgcccactctgcgacaaatgctatgacgatgatgattatgagtccaagatgatgcagtgtggcaaatgcgatcgatgggttcattcaaagtgcgagaatctatccggcaccgaggacgagatgtatgagattctttccaatctgcctgaatcagtcgcctatacatgtgttaattgtactgagagacaccctgctgaatggcgcctcgccctggagaaggaactgcaaatcagtctcaagcaggtcctcactgcactgctgaacagtcggactacgtcacacctgctgcgctaccggcaggcggcaaagcccccggacctgaatcctgagacggaagaaagcattccaagcagatcatctcccgaaggacccgatcccccagtgttgaccgaggtctctaagcaggacgaccagcagccgcttgatcttgagggcgtgaagcgcaagatggaccaggggaattacacatctgttctagagtttagtgacgatatcgttaagataatccaagccgcgatcaattccgacggtgggcagccagaaataaaaaaagcaaactccatggtgaaaagcttttttattagacagatggagagggtcttcccttggttcagcgtgaagaagtccagattttgggaacctaacaaggtgtctagcaactcaggcatgctgcctaatgccgtcctaccaccaagccttgatcataactatgcccagtggcaggagagggaagagaactctcacaccgagcagccccccctaatgaagaaaatcattcccgcacccaagcccaaaggcccaggcgagcccgatagcccgacccccctgcacccacctactccacctatcctgagcaccgatcgttcacgcgaagacagccctgagcttaatccgccaccaggtatagaggacaaccggcaatgtgccctgtgtctaacatacggtgacgactcagccaatgacgcagggcgcctgctatacatcggtcagaacgagtggacacacgttaattgtgctttgtggagcgccgaagtattcgaggacgacgacgggagcctcaagaacgtacacatggctgtgattaggggcaagcaattgagatgcgagttttgtcaaaagcctggggctaccgttggctgctgcctcacctcatgtactagtaactatcacttcatgtgctcgcgggctaagaattgtgtttttctggatgacaagaaggtgtactgtcaacgtcatagagacctcatcaagggtgaggttgttcccgagaatggattcgaggtcttcaggcgcgtgttcgtcgattttgaaggcatatcgctaaggaggaagtttctaaatggactcgagccagaaaacattcacatgatgattggctctatgaccatcgactgccttggtatcctgaacgatctcagtgactgcgaagataaactgtttcccattggctatcaatgttctcgggtgtattggagtacaaccgatgcccgcaaaaggtgcgtctacacctgcaaaattgtggaatgccgaccccccgtggtggaaccagacatcaacagtaccgtggaacacgacgagaaccgcacaatcgctcactccccaacaagctttacagagtcctcctctaaagaaagccagaatacagctgaaatcattagccctcctagtcctgatcgcccaccgcacagtcagacatcaggaagttgctattaccatgttatttccaaggtcccaagaattagaactccgtcatactctccaacacagcgaagccctggttgccggcctcttccgtcggccggctcgccaacccctaccactcacgagatcgtcactgttggcgaccccctgcttagttcagggcttcgatccatcggatctagaagacattctacatcctccctgagtcctcagcggtctaaactgcggataatgtcacccatgcgcactggcaatacatatagcagaaataatgtgtcgagcgtgagtacaaccggaaccgccacagacctggagtcctcagccaaggtcgtggatcacgttctggggcccctcaacagtagtaccagcctcggtcagaacactagtaccagttccaatctccagcgaacagtagttaccgtggggaacaaaaattcccaccttgatgggagctcaagttcagagatgaagcagagtagtgccagcgacctcgtgtcgaagagcagctcattgaagggggaaaaaactaaggtgttgtcatccaagagcagcgagggctctgcgcacaacgtggcctatcccgggatcccaaagctggccccacaagttcacaacacaacgtcgcgcgaattgaacgtgtccaaaatcggctcatttgccgagccatcgagcgtcagcttttcctcaaaagaggctctctctttcccgcatttgcatctgagggggcaacgtaatgacagggaccagcacacagattcgacacagtcagcgaacagcagtccagacgaggacactgaggtgaaaacgctgaagctttcaggaatgtccaataggagctccattatcaacgaacacatgggcagtagctccagagatagaaggcaaaagggtaagaagtcgtgcaaagagaccttcaaggaaaaacactccagcaagtctttcctggagcctggtcaggtgacaacaggagaggaaggcaaccttaagcctgagttcatggacgaggtgctcacacctgagtatatggggcagcgaccatgtaataacgtgagcagcgacaaaatcggagacaaaggtttgagcatgcctggagtgcctaaggcaccccctatgcaggtagagggtagtgctaaagagctccaggcaccccgtaaacgtaccgtgaaggtgacacttaccccacttaaaatggaaaacgaaagtcaaagtaagaatgcgctgaaagagtcaagcccagctagccccttacagatcgaatctacatcacctacagaacctatctctgctagcgaaaatcccggcgacggccccgtggctcagccttccccaaataataccagctgtcaagacagtcagtcaaataattaccagaaccttcctgtccaggatagaaatctgatgctgcccgacgggcccaaaccccaggaggatgggtcctttaaacgacgttatccgcggcgctcggccagagccaggagcaacatgttttttggactgacacccctgtatggcgtccggagctatggagaggaagacattccattctactcttcatctaccggcaagaagcgtggcaaacgctcagctgagggccaggtcgacggcgccgatgacctgagtacatcagacgaggacgatctctattactacaattttacgagaactgttatctcctcgggaggggaggaacgattagcaagccataatctgttcagggaggaagaacagtgcgatcttcccaaaatctctcagctggacggcgttgatgacggcaccgagtccgacacttccgtgaccgccaccaccaggaaaagtagccaaattcccaagcgaaacgggaaagaaaatggaacagaaaacctgaaaatagatcggcccgaggacgcgggcgaaaaggagcacgtcactaagtcctccgttggccataaaaatgagcccaaaatggataactgccacagcgtgagtagggtgaagactcagggacaagattcgctggaagcccagctgtcaagcctggagtcgtcgcggcgggtgcacacaagtaccccttcagataagaatctgctagacacatacaatacggaactcctgaaatccgatagcgataataacaattccgatgactgcggtaacatcctaccatctgacatcatggactttgtgctcaaaaacacaccctctatgcaggccctgggagaatctccggagtctagtagctctgagctccttaacctcggagaagggctcggactggacagtaaccgtgaaaaagatatgggcttgttcgaagtgttttcccagcaactccccacaacagaaccagttgactcaagcgtgtcaagcagtatcagtgctgaggaacagtttgagcttccacttgagctcccctcagacctgagcgttctgacgacacggagccctactgttccctcccagaacccctcaagattggctgtaatttctgactccggcgagaaacgggtaactattaccgagaagagtgttgccagttccgagtctgatccagcactcctgagccccggcgtagaccccacacccgaggggcacatgaccccagatcactttattcaggggcatatggacgctgaccatatttcttccccaccctgtgggagcgttgagcagggtcacgggaacaatcaagacctaactcgcaactcaagcacccccgggctgcaggtccccgtgtctcctaccgtgccaattcaaaatcaaaagtacgtgcccaattcaactgacagccccgggccctcccaaatatctaatgcggccgtacagacaacccctccacacttaaagcctgctaccgaaaagctgattgttgtcaaccagaatatgcagcccctgtatgttttgcaaaccctccctaatggggtgactcaaaaaattcagttgacttcctccgtaagctccacgccatccgtcatggagacaaacacgtcagtgctaggcccgatggggggtggcttgaccctcaccacaggactcaatccatcgctccctaccagtcagtccttgttccctagtgcctcaaagggtctactgccaatgtcgcaccaccagcatctgcattcgttccctgccgcgacccagtcctcctttcctcccaatataagcaacccgccaagcggactactgattggcgtgcagccgccacccgacccccagctgctggtatccgagtcctctcagaggaccgatctgtccactactgtggccaccccctcaagcgggctcaagaaacgcccgatctctcgcttgcaaacccgcaagaacaagaagcttgccccgagcagcacacctagcaacattgcgccttccgatgtcgtgagcaatatgacactgattaatttcaccccatcacaattgccaaatcatccgagtctcctcgacctgggaagcctgaatacgtcatcacatcggaccgtgcccaatattatcaagagaagcaaatccagcataatgtattttgagccagctcccttgctgcctcaaagcgtcgggggaaccgctgccacagctgctggcaccagtactatctctcaggacaccagccaccttacttctgggtctgtctcgggcctggcttcctcttcatccgtgctcaacgtcgtttccatgcagacaaccacgactcccacaagcagtgctagtgtgccaggacacgtgactttgaccaacccaaggctgcttggcactcctgacattggatctatcagcaacctcctgattaaagcttcacaacagtctctggggattcaggatcagcccgtggctctgcccccatctagtggcatgtttcctcaactcggaacaagccagaccccatccaccgcagctataacggccgctagcagcatctgcgtgctcccgagcacccagaccactggtattactgctgccagtccaagcggcgaagctgatgaacactaccaactgcaacatgtgaaccagctcctggcttctaaaactggcatccactcatcacagcgggatcttgattcggcatctggcccacaagtgagtaatttcactcagactgttgacgcccccaactctatgggtctcgagcagaataaagctctgagcagtgccgttcaggcttccccgacttctcccggcggcagtccttccagcccaagttccggacagaggtctgcctctccatctgtgcctggtccaactaagccaaagccgaaaacaaaaaggtttcagctgcccctggataagggcaatggcaagaagcacaaagtgagccatcttcgcacttcgagtagtgaggctcacatcccggatcaagagactacatctctcacatctgggaccggaaccccaggcgctgaggccgaacaacaggacacagcaagtgtcgaacaaagcagccagaaggaatgcggtcagccagccggccaagttgccgtactgcccgaggtgcaggttactcagaatcctgctaacgagcaggaaagcgcggagccgaagacagtcgaggaagaagaatccaatttttcttcccccctgatgctatggctccagcaggagcagaagcgaaaagagtccattaccgagaagaaacccaaaaagggccttgtgtttgagatctcctcagacgacggattccagatttgcgccgagagcatcgaagacgcctggaagagcctcacagacaaggttcaagaggctaggagtaacgcgcgtctgaaacagctgagcttcgccggagtcaatggcctccgaatgcttggtatactacacgatgctgtcgtgttcctgatcgaacagctatcaggggctaagcattgtcggaactacaagtttagatttcacaagcctgaggaggctaacgaacccccactgaatcctcacgggtcagcgagagcagaggtccacttaagaaaaagtgcattcgatatgtttaactttctggcatcaaaacatcgccaacccccagaatataatcccaacgacgaggaggaagaagaggtacagctcaagtctgcacgacgggcaacatctatggacctccctatgcctatgcgattcaggcacctgaagaagacatccaaggaagctgttggtgtgtaccgcagccctatacacggtcgtggtctgttctgtaaacgcaacatcgacgctggggagatggtgatagaatacgctgggaacgtcatccgcagtatccagactgacaagagagaaaagtactacgattccaaggggattggttgctacatgtttaggattgacgattcagaagtggtggacgctaccatgcacggcaacgctgccagattcatcaaccactcttgcgaaccaaactgctactctcgcgtgattaatatcgacggtcagaagcatatcgttatattcgctatgcggaagatttaccgtggggaagaactgacctacgactacaagtttcctatcgaggacgcttcaaacaagctgccatgcaattgcggtgccaagaagtgcagaaagttcttgaactag

SEQ ID NO: 125237 - DNA, 1680 bp, Artificial Sequence
  Description of Artificial Sequence: Synthetic coding sequence
atggacaaccagtgcactgttcaagtgagacttgagctgggtcaccgcgctcagctgcggaaaaaacctacgaccgagggatttactcacgactggatggtctttgtgcgtggccccgagcagtgcgacatacaacatttcgtggagaaggtcgtgttttggctgcatgattccttccccaagccgaggagggtctgtaaggaacccccatacaaggtggaagagtccgggtacgccggttttataatgcctatcgaggtgcattttaaaaataaagaagagccacggaaagtgtgttttacctatgacttgttcctcaatctcgagggcaacccccccgttaaccatctccgctgcgagaagcttactttcaataatccaactacagagttccgctataagctgctgcgcgcaggaggcgtcatggtgatgccagaaggcgccgatacagtgtctcgtccatcccccgactaccccatgttgccaaccatccccctaagcgctttcagtgatcctaagaaaactaagcccagtcacggcagcaaagatgccaataaagaaagctcaaaaacatccaaaccacacaaggtaacgaaggaacaccgcgagcgcccacgcaaagacagtgaaagcaagtcatctagtaaggagctggaacgcgagcaggcgaaatcgagcaaggacacttccagaaagttgggagagggaagactcccgaaggaggaaaaggccccccctccaaaggctgctttcaaggaaccaaagatggctctgaaggagacgaaacttgaatctacctctcctaaaggtggcccccctccccctcctccacccccccctcgggcctcatcaaagcggcctgccactgcagacagccccaaaccgagtgctaagaagcagaagaagagcagcagcaaggggtctcgctccgcaccaggaacttccccacggacgtcgagctcatcctcattcagcgataaaaagcccgccaaggataaaagcagcacccgaggcgagaaagtgaaggccgagagtgagcctagggaagcaaaaaaggccctcgaagtggaggagagtaactccgaggacgaggcatctttcaagagcgagtccgcgcagagttctccatcaaactcctcatcttcttcagatagcagttctgatagtgatttcgagcccagccaaaaccacagccagggccctctgagatcaatggtggaggacctgcagagtgaagagtcagatgaggacgactcctccagcggggaggaagcagcaggcaaaaccaatcccggacgggacagccgattaagtttctctgatagcgagagcgataattctgccgatagcagcctcccgagcagagagcctcctcccccccagaagccgcctccgcccaactccaaagtttccgggcgtaggtcccctgagagctgcagtaagccagaaaaaatcctgaagaagggcacctatgataaggcctacactgacgaacttgtggagctgcacaggagattgatggctctgagggagcgcaatgtgctgcagcagatcgtgaacttgatcgaagagactgggcactttaacgtgactaacacaacttttgattttgacttattttcactggatgaaactaccgtacgaaaactccagtcttgtttggaggctgtcgccacttag

SEQ ID NO: 125238 - DNA, 273 bp, Artificial Sequence
  Description of Artificial Sequence: Synthetic coding sequence
atgcgcgatccagtgagctcccagtattccagcttcctcttctggcggatgccaatccccgaattagacctatcggagttggaggggctgggcctaagcgataccgcaacatacaaggtgaaagattcttccgtgggtaaaatgattggtcaggcaacggccgctgatcaggagaagaatccagagggggacggcctgttggaatactccacttttaatttctggagagcccctatcgccagcattcattcctttgagttagatttactgtag

SEQ ID NO: 125239 - DNA, 417 bp, Artificial Sequence
  Description of Artificial Sequence: Synthetic coding sequence
atgaaggatctgcattccgatgacaatgaggaagagagcgacgaggtcgaggacaatgacaacgacagcgagatggagaggccagttaacagaggcgggagtagatctagacgcgtctccctctctgacggcagcgactcggagtcctccagtgcttcgtcgccactgcaccacgagccgcctccgcccctcctcaagacgaacaacaaccaaatcctggaagtgaagagtcctatcaagcagtctaagagtgacaaacagatcaaaaatggagagtgtgacaagattgtcaacctaattgaagagacggggcacttccacatcacaaacaccacttttgacttcgatttgtgctcgttagataaaaccacggttaggaagctgcagtcatatctggaaacatcaggcacatcctag

SEQ ID NO: 125240 - DNA, 489 bp, Artificial Sequence
  Description of Artificial Sequence: Synthetic coding sequence
atgaaagacctgcactcggacgataatgaggaggagagcgacgaagtggaagacaacgataacgactccgaaatggagcgccccgtaaaccgggggggatcgagatctcgcagggtctcccttagtgatggatccgattctgaatcatcaagcgcttcaagccctctgcaccatgagccaccaccacccctacttaaaactaacaataatcaaatcttagaggtgaagtcccctatcaagcagagcaaatctgataagcagattaagaacggggaatgtgacaaagcatacctcgacgagctggtggaactgcatcgccggttaatgaccctgcgcgagaggcacatccttcagcagatcgtcaatctcatcgaagaaaccgggcattttcacataaccaatacaactttcgactttgacctgtgctcgctcgacaaaacgaccgtcaggaagctccagtcttacctggagacaagcgggacttcttag

SEQ ID NO: 125241 - DNA, 417 bp, Artificial Sequence
  Description of Artificial Sequence: Synthetic coding sequence
atgaaagatcttcacagcgatgacaatgaagaagagtccgatgaggtagaggacaatgataatgactccgagatggagcggcctgtgaataggggtggaagcaggagtcgaagagtgagtctgagcgatgggtcggactcagagtccagttccgctagtagcccactgcaccatgaaccaccacctcccctgcttaaaaccaacaataatcaaatcctggaggtgaaatctccaattaaacagagcaagtcagataagcagatcaagaacggggaatgcgacaaaatcgtgaacctaatcgaagagactggtcatttccacattaccaacactacctttgacttcgacttgtgcagtctggataagaccaccgttcgaaagctgcagtcttacttggaaacttcaggtacctcctag

SEQ ID NO: 125242 - DNA, 1707 bp, Artificial Sequence
  Description of Artificial Sequence: Synthetic coding sequence
atggccagtagctgtgccgttcaagtgaagctggaactcggccatcgtgcccaagtccggaaaaagcctactgtcgaagggtttacccatgactggatggtatttgtgcggggcccagagcactccaacattcagcacttcgtggagaaagtggtgttccaccttcacgagtcttttccacggccaaagagagtatgtaaggacccaccatacaaggttgaagagtcagggtacgcaggcttcatccttccaatagaagtgtactttaagaacaaagaggaaccgagaaaggtccgatttgactacgatctgttcttgcatttggagggtcatcctccagtgaaccatctgaggtgcgagaaactgacatttaataaccccacagaggatttcagacgcaagcttctgaaggcaggaggggaccccaaccgaagcatccatacatctagttcctcgtcctcaagctcatctagtagtagctcgtcgagtagctccagctcctcgagctcaagtagttccagcagtagctccagctcaagctcaagctcatcatcctcatcctcatcttctacttctttctcaaaaccacataagctcatgaaagaacacaaagagaaaccctctaaagactcccgtgaacacaaatcagcgttcaaagaaccttccagagaccataataagagtagcaaggaatcttctaagaagcctaaagagaacaagccacttaaagaggaaaagatcgtccccaaaatggctttcaaggaacctaagccaatgtccaaggagcccaagccagatagtaaccttttgaccattaccagtggtcaagataagaaggcaccatcaaagcgccccccaatcagcgattctgaggagctctcagccaagaaacggaaaaagagctcttctgaagctctctttaaatcctttagcagcgccccccctctgatcctgacctgctccgccgataagaagcagattaaggataagtcccacgtaaaaatggggaaggtcaaaatcgaaagcgagaccagtgagaagaaaaagtcgacgctccccccatttgatgatattgtggatcccaatgactctgatgtagaggaaaacatcagctccaagtcagatagtgagcagcccagtcccgcaagtagctctagcagtagtagttcttccttcaccccatcacagacacgtcaacagggcccgctgcgcagtattatgaaggacctccactcggatgataacgaggaggaatccgacgaggttgaggacaatgataatgatagcgaaatggagaggccagtcaatcggggtgggtcacgaagtcgccgagtgtccctaagcgacggcagcgattcagagtcatcctccgccagctcaccactgcaccacgaaccacctcctccgttacttaaaaccaacaacaaccaaattctcgaagtgaagtcacccatcaaacagtcaaagtctgataaacagataaagaatggtgaatgtgataaagcgtacctagacgaactcgtagagttacacagacgtctgatgacgctacgggagcggcacatcttgcagcagatagtgaaccttattgaagagacaggccacttccacattacaaataccacatttgacttcgacctgtgcagtctggacaaaacgactgtgagaaaactgcagtcgtatctggaaacttccggcaccagttag

SEQ ID NO: 125243 - DNA, 1698 bp, Artificial Sequence
  Description of Artificial Sequence: Synthetic coding sequence
atgtgcgctgtgcaggtgaaactggagctcgggcatagggctcaggtcaggaagaaacccaccgtggaggggttcacacacgattggatggttttcgttcggggaccagaacactccaatatccagcactttgtggaaaaggtggttttccatctgcacgagtcctttccgcgacccaagagagtgtgcaaggaccctccatataaggtggaggagagcggctacgccggcttcatcctcccaattgaggtgtattttaagaataaggaagagccccgaaaagttagattcgattacgatctctttctgcacttagagggtcatcctccagttaatcatctgagatgcgaaaagctcacgtttaataaccccaccgaagacttccggcgcaaactccttaaggccggtggtgatccaaatagatcaatccacacgagttccagttcttcatcctcgtcttcaagctccagctcatcatcaagcagttcctccagcagcagttcgtcttccagctctagcagcagtagttcatcaagttcttcgtcctccagctctagcagcactagcttcagcaagcctcacaagctcatgaaagagcataaggaaaaaccaagcaaggacagcagagagcacaagtctgcctttaaggagccatcacgggatcacaacaaaagttcaaaagagagctctaagaaaccgaaggagaacaagcctctgaaagaagagaagatcgtcccaaagatggcattcaaggaacctaagcccatgagcaaggagcccaagcccgactccaatcttctcaccataacttccggacaggacaagaaagccccatccaaacgtccaccaatcagcgacagtgaggagctgtcagccaagaagaggaagaagtcttcatctgaggctctctttaaatccttcagcagcgccccacctcttattctgacatgttcagctgacaagaagcagatcaaagataaatcacacgtgaagatgggcaaggtgaagattgagagtgagaccagcgaaaaaaagaaaagcacacttcctccctttgacgacattgtggaccctaacgactcggacgtagaggaaaatatttcgtccaaaagtgactccgagcagccgtcaccagcttcttcaagtagttctagctcttctagctttacgccctcccagacaaggcaacagggccctctacggtctatcatgaaggacctgcattctgatgataacgaggaggagtccgacgaggtggaagacaacgataatgacagcgaaatggagcgtcccgtgaacagaggcggcagcagatccaggagagtttccctatccgacgggtccgatagcgagagctcatccgcaagtagtccactccaccacgagccccccccgcctctgcttaaaactaacaacaaccagatccttgaagtgaagtcccctataaaacagtccaaaagcgataagcaaatcaagaatggcgagtgtgacaaggcatatctggatgagctcgtcgaactccaccgaagactgatgaccctgcgtgaaaggcatatcctgcagcaaatagtcaatctgattgaggaaactggacactttcacatcaccaatacaactttcgattttgacctttgttccctagacaagacaacagtcagaaaactccagtcctacctggagacctccggaacctcttag

SEQ ID NO: 125244 - DNA, 1824 bp, Artificial Sequence
  Description of Artificial Sequence: Synthetic coding sequence
atgcagcgagcccccccctttccatttatgtgtgtgtcccgtaggaggaaaaagtgccaagcccaaaggtccctgcctaagccccggctccctgtgatccacgggtgcctttctagcccctgcccacagtgcgccgtacaggttaaactggaactcggccatagagctcaggttaggaaaaagcccacagtcgaaggcttcacacacgattggatggtgtttgtgagaggccctgaacactccaacatccaacattttgtggagaaagtggttttccacctccatgagtcattcccccggcccaaaagggtgtgtaaggaccccccatataaagttgaggagagcggctacgctggttttatcttgcctattgaggtgtattttaagaataaagaggagccacgcaaggtacgtttcgattacgatcttttcctccacctggagggccatccccccgttaatcacttgcggtgcgaaaaattgactttcaacaaccccaccgaagacttccggcggaagctgctgaaggccggtggagatcccaaccgctctatccatacctccagttctagttccagtagtagctcctcaagttcgtctagttcatcctcttcttcctcgagctcatcttctagctcatctagctcaagctctagcagttcaagctcctcctcaagtagctcttccacctctttttccaagccccataaactgatgaaagaacacaaggagaagccatccaaggattcgagggagcataagagtgcattcaaagagccgagtagagatcacaataagtcatcaaaagagtccagcaaaaagcccaaggagaataagccactgaaagaagagaaaatagtccccaaaatggccttcaaagagcccaaaccaatgtctaaggagcctaaacctgatagcaacctacttacgattacttcgggccaggataaaaaggctcccagcaaacggccaccaatcagcgattctgaggaactcagcgcgaagaagcgcaaaaagtcctcttccgaggccctgtttaagtctttctctagtgctccccctctcatcctaacttgctctgccgacaagaagcagattaaagataagagccacgtcaaaatgggcaaggtgaaaatagagtccgagaccagcgagaagaaaaagtccaccctcccacctttcgatgacatcgtcgaccctaacgactccgacgttgaggaaaacatcagttcgaaatctgactctgaacagcccagtcctgcatcttcaagttctagctctagctcgtctttcaccccctctcagactcgccagcaaggcccattgaggagcattatgaaagacctccacagcgatgacaacgaagaggagtctgacgaggtggaagataacgacaacgactcagaaatggaacggcccgtcaacaggggtggttctcggtcgaggcgagtcagcttgagcgacggcagcgatagcgagagttctagtgccagttctcccctgcaccatgagccacccccacctcttctcaagactaacaacaatcagattctcgaggtaaagtcacccattaagcagtcaaagagtgacaaacagattaagaatggggaatgtgacaaagcatatctcgacgaactcgtggaactgcataggaggcttatgaccctaagagagcgacacatactccagcagatcgtcaaccttatcgaggaaaccggccactttcatatcactaacaccacatttgattttgatctctgcagcctggataagacaaccgtgcgcaaactccaatcttatcttgagactagcggcacttcctag

SEQ ID NO: 125245 - DNA, 4986 bp, Artificial Sequence
  Description of Artificial Sequence: Synthetic coding sequence
atgtctgccgggggtagagatgaagaaaggagaaagctagccgatattattcaccattggaatgccaatcgcctggacctatttgagataagccagcccaccgaggatcttgagtttcacggcgtgatgcggttctatttccaggataaggccgctgggaatttcgccacaaaatgcatccgtgtcagcagcacagccacaacacaagatgtgatcgagactctggccgagaagtttcgtccggatatgagaatgctgtcctcacccaagtacagcttgtacgaggtccatgtctccggggagcgaaggctggatatagacgagaaacccctggtggtccaactgaattggaataaggacgaccgagagggtcggtttgtgctgaagaatgaaaacgacgccattcctccgaagaaggcacagagcaacgggcctgagaaacaagagaaagaaggcgtaatccaaaacttcaagagaaccttatccaagaaagaaaaaaaggagaagaaaaaacgtgagaaagaggccctgcggcaggccagcgacaaggatgaccgcccctttcagggcgaggacgtggaaaattcaagattggccgccgaggtgtacaaggatatgccagagacgtctttcaccagaactatctcaaatccagaagtcgtaatgaagaggcgccggcaacagaagttggagaaacggatgcaagaattccggtcctctgatggccgacccgactccggtggcacactgaggatttacgccgattctcttaagccaaacataccttacaagaccattctgctgagcacaactgatcccgccgatttcgctgtcgcagaggctttagagaaatacggactggagaaagagaatccgaaagattattgtatcgccagagtgatgctgccccccggggcacagcacagcgatgagaagggtgcaaaagaaatcatcctcgacgacgacgaatgccctctgcagatcttccgcgagtggccctctgataaaggcattcttgtgtttcagttgaagcggaggccccccgaccatatccctaagaagaccaaaaaacatctcgaggggaagacccccaaggggaaggagcgcgcagacggatcaggatacggtagtacattgccacctgagaaactgccttatctcgtcgaactatctccgggtcgccgcaatcacttcgcatactacaattatcacacctatgaagatgggtctgatagcagagataaaccaaagctctacaggctccaactgagcgttactgaggtggggacggaaaaactggatgataactcaatccaactcttcgggccaggtatccaaccacaccactgcgacctgaccaacatggacggtgttgtgacggtgacaccaagatccatggatgctgagacctatgtggagggacagcggattagcgaaaccaccatgctgcagagcggtatgaaagtccagttcggcgcaagccacgtctttaaatttgtagacccttctcaggatcacgctctcgctaagaggtcagttgatggaggtcttatggttaagggcccccgacacaagccaggaatcgtgcaggaaacgacctttgacctgggaggcgacatccatagcggaactgcccttcctacctctaaatccacaacccgtctcgattccgaccgagtctcatcagcgagtagtacagcagaaaggggtatggttaagcctatgattcgagtcgagcagcagccagactatcggcgtcaggaatcccgaactcaagacgcctcaggcccggagctgattcttcctgcatctattgaatttcgcgagagctccgaggactctttcctgtccgcaattataaactataccaattcatcaacagtgcatttcaagctgtcccctacctatgttctatatatggcctgccgatatgtgctgtccaatcaatataggcctgatatcagccccacagagagaactcacaaagtgatcgcagtggtaaacaaaatggtgtctatgatggaaggagtaatacaaaagcagaagaatattgcaggggctttggcattttggatggcgaacgcaagtgaactgctgaatttcatcaagcaggaccgtgatctttcccggattaccttggacgcccaggatgtcctcgcccacctggtccagatggcctttaagtacctggtgcactgtttgcagtcagaactgaacaattatatgccagccttcctggacgaccccgaggagaattcactgcagcggccgaagattgacgacgtgctccacacactgacaggcgcgatgagtttactgcgtcggtgcagggtgaatgccgcactaactatccaactgttctcacaactattccactttatcaacatgtggctatttaaccggcttgtgaccgacccagacagcggtttgtgctctcactattggggcgcaatcatcagacagcagctaggacatattgaagcttgggccgaaaaacaggggttggaactggcagctgactgccatctctctcggattgtgcaggcaaccactcttctcacaatggacaaatatgccccagatgatattcccaacattaattccacttgtttcaaactcaattctcttcagctgcaggcactcctgcagaactatcattgcgctcccgatgagccatttatccctacagacctcatcgagaatgtggtgaccgtggccgagaacaccgctgacgaattggcacggagtgacgggagagaggtacagctagaggaggatccggaccttcagttgccgttcttactgcctgaagacggctattcctgtgatgtggttagaaatatcccaaatggtttgcaggaattccttgaccccctgtgccagaggggcttctgccgcctcattccacacacacgctcgccgggcacatggaccatatacttcgagggcgcagactatgaaagccatctcctcagagagaacactgaactggccatcccacttcggaaggaaccggaaattattaccgtgacactcaagaaacagaatgggatgggactgtctattgtcgccgcaaagggagctggacaagacaagttgggaatctacgtgaagagtgtcgtcaagggcggggccgcggacgtcgacggtagactcgcggctggcgaccagctgctgtccgtggatgggaggtctctggtcggcttatcccaggagcgggccgcagagctgatgacacgaacctcaagcgtcgttacactggaggtcgctaaacagggtgctatatatcacggactggcaactcttctcaatcagccctcccctatgatgcagaggatttccgaccgccgcggcagcggaaaacccagacctaagtctgaagggtttgagctctacaacaactctacccagaacgggagcccagagagcccacaactcccatgggccgagtattccgaacccaaaaaattacctggggacgatcgcttgatgaagaaccgcgccgaccatagatctagccccaacgtcgctaatcagccacctagtccggggggaaagtcggcctacgcatccggtacgacagccaaaatcaccagcgtctcaaccggcaacctctgcactgaggagcagacacctcctcctcggcccgaagcatatcccatccccacgcagacttacacgagggaatactttacctttcccgccagtaaatcacaggatcgcatggcccccccacaaaaccagtggcccaactatgaggaaaagcctcacatgcatacggatagtaaccacagtagcatcgccatccaacgcgtgaccaggagccaagaagagctgcgggaggacaaagcataccagcttgagcgacaccgcattgaagccgccatggaccggaagtctgacagtgacatgtggatcaaccagtccagttcactggattcatcaacctcctcacaggagcacctgaaccactcgagtaaatctgtgactccagcatccacacttaccaagtcaggacccggccggtggaaaaccccagcggcaatccccgccaccccagtggcagtgagtcaacctatccgtactgaccttcccccacctcctcccccgccaccggtccattacgcgggtgacttcgatggcatgtctatggacctccccctgcctccgcctccatcagccaaccagattggacttccgagcgcgcaagtcgcggcggcagagaggcggaaaagagaggagcaccagagatggtacgaaaaagaaaaggcccggctggaggaggagcgagaaagaaagcgcagggagcaagaacgcaagctcgggcaaatgaggacccagagcttgaaccctgctccattcagccctttgaccgctcagcagatgaagccagaaaagccttcaacgctgcaaagaccccaggaaacggtgatacgagagctgcagcctcagcagcaacctcgcactattgagaggcgggatctgcagtatatcacagtgagtaaggaggagctatcctcaggcgattcattgtccccagatccctggaaaagggatgctaaggagaagttggaaaagcagcagcaaatgcatattgttgatatgctctccaaggaaattcaggaactgcagagcaagcctgatcggtcagcagaagaaagcgataggctgagaaagctgatgctggagtggcagttccagaagcgcctacaggaaagcaagcagaaggacgaagatgatgaggaagaggaggatgatgacgtagacaccatgttgatcatgcagagactcgaggcagaaaggagggccaggcagacagcaatgccagcgatctccgtgctggaccttctgcaagatgaagagcggagaaggcagcagcaactggaagagatgcgaaagagagaggcagaagaccgcgctcggcaggaggaggagcggagaagacaggaggaggaacgcactaagagggacgcagaagaaaaatag

SEQ ID NO: 125246 - DNA, 4998 bp, Artificial Sequence
  Description of Artificial Sequence: Synthetic coding sequence
atgtctgccggcggaagagatgaggaaagaaggaagctggcagatatcattcaccactggaatgccaacaggcttgacctttttgagatcagtcagccaaccgaggatttagagtttcacggcgtgatgcggttttatttccaagacaaggccgcaggtaatttcgctaccaagtgtatacgcgtgtcttccaccgcaaccacgcaagacgtcattgagaccctggcggagaaattccgacctgacatgaggatgctatccagtcccaagtactccctctacgaggtgcatgtctctggcgagcgcaggctagatatagacgagaaaccacttgtagtccagcttaattggaacaaggacgaccgggagggaagatttgtgctgaaaaacgagaatgatgccattcccccaaaaaaggctcaaagcaatggcccggagaagcaggaaaaggagggggttattcagaattttaaaagaacactgtcaaagaaggagaagaaggaaaaaaaaaaacgtgaaaaggaggcactccggcaggctagtgacaaagacgataggcctttccagggggaggatgtggaaaattcccggttggctgcggaggtctacaaagatatgccagaaacttccttcactaggaccatctccaatcccgaagtggtaatgaagaggaggcgacaacaaaaacttgagaagcgtatgcaggaattcaggagtagcgatggccgcccggactctggcggaactctgcgtatttatgctgactccttgaaaccaaacataccatataaaacaatactactctctaccacagaccctgcagattttgccgtggcagaggctcttgagaaatacggcctcgaaaaggagaatcctaaagattattgtattgcacgagtcatgctgccacccggggctcaacatagcgatgaaaaaggcgccaaggaaattatcctagatgatgacgagtgtccgctccaaatcttcagagagtggccaagtgataaggggatactcgtcttccagctcaagcgccgtcctcctgatcacattcctaagaagaccaagaaacacctggagggcaaaacccccaagggtaaggaaagggccgacggatctggctacggcagtactctgcctccggaaaagctgccctaccttgtagagctctctcccggtaggagaaatcactttgcatactacaattatcacacgtatgaggacgggagtgacagccgggacaagcctaaactgtataggcttcagttgtccgtcactgaggtaggtaccgaaaaactggacgataattccatacaactgtttggcccaggtattcaaccacatcactgcgatctgacaaatatggatggagttgtcaccgtgacccccaggtccatggatgcagaaacctatgtggagggtcagagaatttctgaaacaaccatgttacagtccgggatgaaggtacagtttggcgcttctcatgttttcaaatttgtcgacccctcccaggatcatgcactggccaagcgctctgtggacggagggctgatggtaaagggaccgaggcacaaaccaggcatcgttcaagagaccacctttgatctcggcggtgatattcatagcggcactgccttgccgaccagtaaatccaccaccaggctcgactcagaccgagttagcagcgcttctagtacagctgaacgcggcatggttaagcctatgatacgagttgagcaacaaccagattacaggcggcaagaaagccgaacccaggacgctagcggccctgagttaatcctgccagcctcaatcgagtttcgtgaatctagtgaggactctttcctgagtgcgatcatcaactataccaatagcagcactgtgcatttcaagcttagtcctacctacgtgttgtacatggcttgtcggtatgtgctctccaaccagtatagacccgacatcagcccaactgaacgaacccacaaagttattgcagtggtcaacaagatggtaagtatgatggaaggtgtcatacagaaacaaaaaaacatcgctggagcccttgcgttttggatggccaacgcaagtgagctgttgaacttcatcaagcaggatcgagatctgagcaggattacattggacgcccaggatgtgctcgcacacctggtccagatggcttttaaatacctcgttcattgcttacaatccgagctgaacaattatatgcctgcatttcttgatgatcccgaagagaactcactgcaaagacctaaaatagacgatgttttacatacattgaccggcgctatgagcctcctgcgacgctgccgagttaatgctgctctgacgatacagctcttctctcagctgttccacttcatcaatatgtggctgttcaataggcttgtgaccgatcccgactctgggctttgctcccactactggggtgctatcatccgccaacagcttggccatattgaggcctgggccgaaaagcaggggttggaactcgctgctgattgccacctcagtaggatcgttcaagccactactttgctgaccatggataagtatgccccagacgacatccctaacatcaatagtacttgtttcaagctgaactctctccagctgcaggctttactgcaaaactaccactgtgcaccggacgagccctttatcccgacagacttgatagagaatgtcgtgactgtggctgaaaatactgccgatgaactggcacggagcgatggccgggaggtccagctcgaagaggacccggacctgcagctacccttccttttacccgaggatggctactcgtgcgatgtagtccggaacatccctaacggtctccaggaatttctggatcccctctgccagcgtggcttttgtcgtctgattccccatactcgatccccaggcacttggactatttacttcgagggagcagattatgagtctcacctgctcagagagaataccgagctcgcccagccactgcgaaaggaacccgagattataactgtgaccctgaagaaacagaatggtatgggcctgtccatcgtggccgctaagggcgccggccaagacaaactgggtatctatgttaagtccgtggtcaaagggggcgccgccgatgttgacggccggctcgcagccggggatcaactgttgagtgtcgatgggcgttccctcgtaggtctctcccaggagcgggctgctgagctgatgaccaggacgtcctcagtggtcacgctggaggtggctaaacagggcgcgatctaccatggactggcaactttacttaaccagccaagtcccatgatgcagagaatctccgaccgccggggatccggaaagcctcggccaaaatccgaaggcttcgagctgtataataactcaacacagaacgggagtcctgagtcaccgcagttaccttgggctgagtattcagagccaaagaagctgcctggcgatgaccggctcatgaagaatcgggcagaccatagatcttctcctaacgtggcaaatcaacccccatcacctggaggcaagagcgcttatgcaagcggcacaaccgcgaaaattacctccgtctcaaccggaaatctctgcaccgaagagcagaccccccctccgcgccccgaagcctatcccataccaacccagacctatacccgcgagtactttacgttccccgcctccaagtctcaagaccgcatggctcccccgcagaaccagtggccaaactacgaagagaagccgcacatgcatacagatagcaatcacagttctatcgcaatccagagagtaacaaggtcacaggaggaactacgggaggataaggcctaccagctagagcgccacaggattgaggcggccatggaccgtaagagcgactccgacatgtggatcaaccaaagtagctctctggatagctccacgtcaagccaggaacatctgaaccattctagcaagtctgtgacacccgcctccaccctcaccaaaagtggtccaggcaggtggaagacaccagctgcaatcccggccacacccgtagccgtatctcagcctatccgtaccgacctgccacctccaccaccaccaccacctgttcactacgccggcgactttgacggaatgtcaatggacttgccacttccaccacctccatctgccaatcagatcggtctcccttccgcacaggtagctgcagctgagcgtcggaagcgcgaggaacatcaacggtggtacgagaaagaaaaagcccgtctagaagaagaacgggagcgaaaacgacgagaacaggagagaaaactggggcagatgcgaacacagtcccttaatcctgcccccttcagtcccttgactgcccagcaaatgaagccagaaaagccctccacactgcagagacctcaggagaccgtgatacgggagcttcagccccagcagcaaccaaggactattgagagacgggacctccagtacataacagtcagcaaggaggaactgtcatctggcgatagtctgagtccagatccttggaagcgtgacgctaaggagaagctggaaaagcagcagcagatgcacatcgtggatatgctttccaaagaaatccaggagcttcagagcaaaccagatagatcagccgaagagtcagaccgcctgcgaaagctaatgctggagtggcagttccagaagcggctgcaggagagcaagcagaaagacgaagatgatgaagaagaggaagacgacgatgtggacaccatgctgattatgcagcgtctggaggcggaaaggcgggccaggcaaactgctatgccggccatcagtgttctggatctcctacaggacgaggaacgccgccggcagcagcagctcgaggaaatgcggaaacgcgaagccgaagaccgggctaggcaggaggaggaaaggcgccgccaggaagaggagcgcaccaagagggatgccgaggagaaggtaatggtactgtag

SEQ ID NO: 125247 - DNA, 5475 bp, Artificial Sequence
  Description of Artificial Sequence: Synthetic coding sequence
atgagcgcgggtgggcgggatgaagagagacggaaactggctgacatcatccaccattggaatgcaaatagactagatctgtttgagattagtcagccaactgaggacctggagtttcacggggtgatgagattctatttccaggataaggcagctggaaactttgcaaccaaatgcattagggtgtcgtcaaccgcaaccacacaggatgtgatcgagacactggccgaaaaattcagacctgatatgagaatgctttcatcacctaagtattccctatacgaagtgcacgtgagcggagagcggcggctggatatagatgaaaagcctttggtagtgcagctgaactggaacaaagacgaccgcgagggacgcttcgtgctgaaaaacgaaaacgatgccatccccccgaaaaaggctcagtccaatggaccagagaagcaagagaaagaaggagtgatccagaattttaagaggaccctgtccaagaaagagaagaaggaaaaaaagaagcgcgagaaggaggccctccgacaagcatcggacaaagatgatcgaccattccagggcgaagatgttgagaacagtcgcctagccgctgaggtatataaggacatgccggagacctcttttacacgaacgatcagcaacccagaggtcgtgatgaagagacgtcggcagcagaagctggaaaagcggatgcaagagtttagatcatcggatggcaggcctgactcagggggaaccctgcgtatttatgcagattcactgaagccaaacatcccatacaagacaatcttattgagcactacagaccccgccgactttgcggtggccgaagctctcgaaaaatatggcctggagaaggaaaacccgaaggattactgcattgctcgagttatgctgccacccggcgcacagcacagcgacgaaaagggggcgaaggaaattattctagatgatgacgaatgtccgctgcaaatcttcagggagtggcctagcgataaagggatacttgtttttcagctgaaaagacggcctcctgatcacattccaaagaagacaaaaaaacatctggagggaaagacccccaaagggaaggaacgggccgatggttctggctacgggtctactctcccccctgagaagctcccgtacctggtcgaactgtctccaggccgtcgaaatcactttgcatactacaactatcacacttatgaagatgggtccgacagtcgcgataagcccaagttatacaggcttcagctctccgtgacggaagtcggaacggagaagctggacgacaattcgattcaacttttcggcccaggcatccagcctcatcactgcgatctgactaatatggatggagtggttacagttacgccaagatctatggatgctgagacctacgttgagggccaacggatttccgagactacaatgctgcagagcggcatgaaagtccaattcggggctagccacgtattcaagttcgtggatcccagccaggaccatgcacttgccaagcggagtgtagacggaggacttatggtgaaggggccaagacacaagcccggaatcgtccaggagaccacttttgatcttggaggcgacatacacagcggcacggccttgcctacaagcaaatcaaccacccggctggatagcgacagagtgtcatctgctagctctacagcggagagaggaatggtgaagccaatgatccgcgtggagcagcagcccgactaccgacgtcaagagagcaggactcaggatgcttcgggacctgagctaatactccctgcctcaatcgaatttagggagtccagcgaagactcattcctatccgcgatcatcaactataccaactcgtctacagtgcactttaagctgtctcctacatacgtgctctacatggcctgtcgctatgtgcttagtaatcagtaccgacccgacatctctcctaccgaacgtacccacaaggtgatagcagtggtgaacaagatggtttcgatgatggaaggagtaatccagaagcagaagaatattgctggcgccctagccttttggatggccaacgcttctgagttactcaacttcatcaaacaggaccgagatctgagccggatcactctggatgcccaggacgtgcttgctcatctcgtacagatggctttcaagtacttggtgcattgtctgcagtcagagctcaacaattatatgccagcctttcttgatgatccagaagagaattcccttcaacggcccaagatagatgacgtccttcacacactgaccggggcaatgtctctgttgcggcggtgcagggtgaacgcagccctgactatccagcttttttcccaactgtttcattttattaacatgtggctgtttaatagactcgtgaccgacccagattccgggctttgctcccattactggggcgccattatccgccagcagctcgggcatattgaggcctgggccgagaaacagggacttgagttagccgccgactgccaccttagccggatagtgcaggctacaacactgctaacgatggacaagtatgcacctgacgatattcccaacatcaatagcacctgttttaagctcaatagccttcaactgcaggcgcttctccagaattaccactgtgcccctgacgaaccctttattcccaccgacctgattgaaaacgtggtgactgtggccgaaaacacggctgacgaactggcacgctcagacggtagggaagtacaacttgaggaggatccagatctgcagctcccgtttctcctgcctgaagatggttattcatgtgatgtggtgcgaaatatccctaatgggctccaggagtttctagatcctctgtgccagagaggtttttgtaggttgattccgcacaccagatcccctggcacgtggacaatctattttgagggggcagactacgagtctcacttattaagggagaacactgagctggcaattcccctgcgtaaagagccggagataataacggtgaccctgaaaaaacagaatggcatggggttgtctattgtggccgctaagggggccgggcaggacaagctaggaatctacgtcaaaagcgtcgtgaaaggtggagctgctgacgtggacggcagattagcggccggggatcagttactctctgtggacgggaggtccctcgtcgggttaagtcaggagagggccgcggaactcatgacacggactagcagcgtggtaacgctggaagtggcaaaacaaggtgctatctaccatggtctggcaacgttgctcaaccagccaagtcccatgatgcagcggatctccgatagacgtggctctggcaagccccgtcccaagtcagaggggttcgagctatataataattccacacagaatggctctcccgaatctcctcagttgccatgggccgagtactcggaaccgaagaagttgccaggtgacgatcgtctgatgaaaaatcgggcagatcatcgctcaagccctaacgtcgctaatcagcctccgagccctggagggaaaagcgcctatgcatccggcacgacagcaaaaattacctcagtgtccaccgggaatctttgcaccgaagagcagacccccccgccccgcccagaggcgtatcctatcccgacccagacgtatacccgtgaatattttacatttcctgcgagcaagtcacaagatcgcatggcccctccacagaaccagtggcccaattatgaggagaagccgcatatgcatacagattcaaaccactctagtatagccattcagcgcgtcacccgctcccaggaggagctgcgcgaagataaagcatatcagctggaacggcataggatcgaggctgcgatggaccggaagtctgacagtgatatgtggattaatcagtcaagttctttagactctagtacgagctctcaggagcatctaaatcatagcagtaagtctgtgacccctgcttcgacccttactaaatcgggtcccggccggtggaaaactcctgctgccattcctgcaacccccgtagccgtctctcaaccgatccgaacagatctgcctcctccgcctcccccccctccagtgcactatgccggcgacttcgacggtatgtccatggacctgccgttaccaccaccgccatccgctaaccaaattggacttccctccgctcaagtcgcagccgccgaacgccgcaaaagagaggagcaccagagatggtacgagaaggagaaagcgaggctggaggaggagagggagagaaagagacgagaacaggaacggaagttgggccaaatgcgtactcagagccttaatccagcccctttctctcccctcaccgcacagcaaatgaaacctgaaaagcccagcacgctgcagagacctcaggagacagtgatacgtgagcttcagcctcagcagcagccccgtacaattgagcgccgggacctgcaatacattaccgtgtctaaggaggagttgagtagcggagattccctgagcccggacccctggaaacgggacgccaaagagaagctggagaaacagcagcagatgcacattgtggacatgctgagcaaagagatccaggaactacagagcaagcctgaccggagtgcagaggaatcagatcgccttcgtaaactcatgctggagtggcaattccaaaagcgattgcaagaatctaagcaaaaagacgaagatgatgaggaagaagaggatgacgatgtcgacactatgctcatcatgcagaggctggaggccgagcgcagggctcgcttgcaggatgaagaacggaggcgccagcagcagttagaggaaatgagaaagcgggaggctgaagatcgtgcccggcaggaagaggagcgtagaaggcaagaagaggagcgcaccaaaagggatgctgaggaaaagcgacggcaggaagaaggctactacagccgtcttgaggcagagcggaggcggcagcacgacgaggcggccaggaggctcctcgaacccgaggcaccaggcttgtgtagacccccattgccaagagactatgaacctccttctccctcgcctgcccccggcgcacctcctcctcctcctcagcggaacgcttcttatctgaaaacgcaggttctcagtcctgattctctatttacagccaagttcgtggcctataatgaggaggaagaggaggaggactgtagcctagccggcccaaattcgtaccccgggtcaaccggcgcggcagtgggtgctcacgacgcatgcagagatgcaaaagagaaacgtagcaaatcacaagacgcagacagtcccggctcaagtggggctcctgagaatctaactttcaaggagcggcagcgcctgttctctcaggggcaggatgtctccaataaagttaaggcatcccgtaaactgacggagttggagaacgagctgaatactaagtag

SEQ ID NO: 125248 - DNA, 4956 bp, Artificial Sequence
  Description of Artificial Sequence: Synthetic coding sequence
atgagtgcagggggacgggatgaagagcgccgaaagctggctgatatcatccatcattggaacgcaaatcggcttgacctcttcgagatctcacaaccaacagaggacctcgaatttcatggcgtgatgaggttctactttcaagacaaagctgcaggaaatttcgcaacaaagtgcatcagagtcagttctaccgccacaactcaggatgtgatagaaaccttggcagaaaaatttaggcccgacatgagaatgctgagttcacccaagtactcactgtacgaggtccacgtgtccggcgagcgtaggctcgacatagacgaaaagcccttagtggtgcagctgaactggaacaaggacgaccgcgagggccggttcgtgctgaagaatgaaaacgatgctatccctccaaagaaagcccagagcaacggccccgagaaacaggaaaaagaaggagtcatacagaactttaaacggacactgtccaagaaggagaaaaaagaaaagaaaaagagggaaaaggaggcgctcaggcaggctagcgacaaggatgacaggccatttcagggggaagatgtggagaactcccggctggcggcagaggtgtataaagacatgccagagacttcattcaccagaacaatttcaaatccggaggtcgtgatgaaacggcgtaggcagcagaagttagagaaacggatgcaggaattcagatcaagtgatggccggcctgatagtggcgggaccctacggatctacgcggatagcttgaaaccaaatatcccctacaaaaccatcctcctctctacaaccgaccctgctgactttgccgttgccgaagccctggagaagtatgggctggaaaaggagaacccgaaggactattgcatagccagggtgatgttgccccctggcgcccaacattccgatgagaaaggggctaaggagatcattctcgatgacgacgagtgccctttgcagatctttagggagtggccctcagataaaggaatcctggtgtttcaactaaagaggcgaccccccgatcatattcccaagaaaaccaagaagcatctagagggcaagaccccgaaagggaaggagagggctgacggatctggctatggttccacattgcctccagaaaaactgccctacctggtcgagctttctcctgggcgtaggaatcacttcgcctactataattaccacacttacgaagacggaagcgactcaagagataagcctaaattgtaccggctgcagctaagcgttaccgaggtgggcacagagaaactggatgacaactctattcagttgtttgggcccggtatccagccccaccattgtgatctgactaatatggatggcgtagtcaccgtgacaccgcggtcgatggacgcagaaacctatgtcgaggggcagcgtattagtgaaaccaccatgctgcagagcggcatgaaggtccagttcggagctagtcatgtgttcaagttcgtggaccccagtcaggaccacgctctggctaagcgcagcgtggatggaggcctgatggtgaagggaccaagacataaacccgggatcgttcaggagacaacgttcgatttgggcggcgacatccactccggcactgccttacccacatctaagtctaccacacgtctagactcagaccgggtatctagcgcttcatccaccgccgaacgtggcatggtgaagccaatgatccgtgtggaacagcagcctgactaccgtaggcaggagtcccggacacaggatgccagcggaccagagctcatattgcctgcttcgatcgaattccgtgagtccagtgaggacagctttctgagcgctatcattaattacacaaattcaagcaccgtgcatttcaagctgtcgccaacttatgtgctatacatggcatgcaggtacgtcctcagcaatcaatacagaccagacatctccccaacagaaagaacacacaaggtaatcgccgtggttaataaaatggtgtcaatgatggagggcgttatacaaaagcagaagaacattgcaggtgcgttggccttctggatggctaatgccagtgagctcctgaatttcatcaagcaagacagagacctctctagaattacattagacgcccaggacgtgctggctcatctggtgcagatggccttcaagtacctcgtgcactgtcttcagtctgagctgaataactatatgcccgccttcttggatgaccctgaggaaaacagcctgcagcggccgaaaattgacgacgtgttgcacacacttacgggcgctatgagcttgctcagaaggtgtcgcgtcaatgctgccctcaccattcagctgttttcacaacttttccatttcataaatatgtggctgtttaacagattggtgacggaccctgactccgggctgtgttcccattattggggggccattatcagacagcagctaggccatattgaggcctgggccgagaagcaaggtctggaactagccgcggactgccatttaagtagaatagttcaggccactactctgttgacgatggacaagtatgcccccgatgatattcctaacattaattcgacctgcttcaaattaaatagtctccagctccaggccttgttacaaaactaccattgcgccccagatgaaccctttatcccaacagacctaatcgagaatgtagttaccgtagctgagaataccgcggacgagctggcccggtcggatggtagggaggtgcagctggaggaagacccggacctgcagctgccgtttctgctgcccgaggacggatattcctgcgatgtggtgcgaaacatacctaatggcctgcaggagttcctggacccactgtgccagcggggcttctgtcggctaataccacatacaaggtcccctgggacctggacgatctatttcgagggggccgattacgagtcccatcttctgcgtgagaataccgagctggctcagcccctcaggaaggagccggagattattacggttaccttgaagaaacaaaatgggatggggctctccattgtggccgccaaaggcgcggggcaggacaaacttggcatttacgttaaaagtgtggtcaagggcggagcggctgacgtggatggaagattggctgctggtgatcagctgttaagcgtggatgggcggagtctggtggggttatcccaggagcgggccgccgaactgatgacaaggacatcctcggtggtcacacttgaagtggcaaaacagggggctatctatcatgggcttgccacactcctaaatcagccttctcccatgatgcagcgaatctccgatagaagggggtcgggcaagccgcgccccaaatcagaggggttcgagctttataacaactcaactcaaaatggttctcctgagagcccgcagctgccttgggccgaatatagtgaacctaagaaacttcccggggacgatcgtctgatgaagaacagggcggaccaccggtcgagtcctaacgtagcgaatcagcccccgagccccggaggtaaaagtgcatacgcttccggcaccaccgccaagattacgtccgtctctacggggaacctgtgcacagaagagcagacacctcccccccggccagaagcatatcctattccaacacagacttataccagagagtattttacattccctgcctcaaagtcgcaggaccggatggcaccgcctcagaaccagtggcccaattatgaagagaagccccatatgcacacagattctaaccactcctccatcgcgatccagagagtgactcggagccaggaggaactcagagaggataaggcctaccagctggagcggcacagaatagaggcggccatggataggaagtcagacagcgacatgtggattaatcaatcatcctcactggactcctcgacatcaagccaagaacacctgaatcactcaagcaagagcgtgacacccgcgtcaacactcaccaagagcgggcctggaagatggaaaactcccgcagccattcccgctacccccgtggcggtcagtcagccaatacggacagacctgccaccacctcctccgcctccaccagtgcactacgccggcgacttcgacggcatgtccatggacttacccttgccccctccaccatccgccaatcagattggcctgccatccgcccaggtggctgcagccgagcggagaaagagggaggaacaccagcggtggtacgaaaaagagaaagcacgcctggaagaagagcgcgagaggaaaaggcgcgagcaggagaggaaactgggtcagatgaggacccaatctctcaaccctgcacccttcagcccactgacagcccagcaaatgaaaccagaaaagccttcaactctgcaacgaccacaggagactgtgatccgcgaactccagcctcagcaacaaccacggacaatcgagcgtcgtgatctgcagtatataacagtaagtaaagaagaactctcttcaggagactcgctgtcacctgatccgtggaagagagatgccaaggagaaactggaaaagcagcagcagatgcacatagtcgatatgttgtcgaaggagatccaagagctgcagagcaaacccgatcgaagtgctgaagaaagcgaccggcttcgcaagctcatgctggagtggcaatttcagaaaaggctacaagagagcaaacaaaaagatgaggatgacgaagaggaggaagatgacgacgttgacactatgcttattatgcagcggctagaagccgaacggcgcgctcgcgacgaggagagacgacgacagcagcaactggaagaaatgcgaaaacgggaggccgaagatcgcgctcgacaggaagaagaaagaaggagacaggaagaagagcgtacgaaaagggacgccgaggaaaaggtgatggtcctgtag

SEQ ID NO: 125249 - DNA, 5232 bp, Artificial Sequence
  Description of Artificial Sequence: Synthetic coding sequence
atgagcgccgggggccgggatgaggagcggaggaaattggccgatataattcaccattggaatgctaaccgcctggacctctttgagatctcccagccaactgaagatcttgagttccatggcgtaatgcggttctatttccaggataaggccgctggtaattttgctacaaagtgcatccgagtgagcagtactgctactactcaagacgttatcgagactttagccgaaaagttccgtcccgatatgcgcatgttgtcttccccaaagtactctctatacgaggtgcacgttagcggggagcgccggctggatatcgatgagaagcccctggtggtacagttgaattggaataaagacgacagggagggccgatttgtactgaagaacgaaaatgacgccatccctcctaaagcacagtctaacggccccgagaaacaggagaaagagggggtgatccagaattttaaaagaacattaagcaaaaaggagaagaaggaaaaaaagaaaagagagaaggaggcactacggcaagcctcagataaggatgatcgtccttttcagggtgaggatgtagagaacagtcgcctggccgctgaagtctacaaggatatgcccgaaacctcctttacacggacaattagcaaccccgaggtggtgatgaaacggcgcaggcagcagaagcttgagaaaaggatgcaggaattccgtagctcagacgggcgacccgacagcggaggtaccctccgaatttacgccgactctcttaagcccaacatcccttacaagaccatacttctatcaactaccgatcctgccgatttcgccgtcgccgaagcactggagaagtatggtttggaaaaagaaaatcccaaagattactgtatcgcacgtgttatgctaccccctggtgctcagcattcggacgagaagggtgccaaagaaattattctggacgatgacgaatgcccgctccagatcttcagggaatggccctccgacaagggtattttagtgttccagttaaagcgtaggccccccgatcacatcccgaagaagactaagaagcacctggagggcaagactccaaaggggaaggagcgggcagacggaagcggctacggttcaaccttacctcctgagaaactcccttatctcgtcgaattgagcccagacggaagcgactctcgggacaagccaaagctatacaggcttcagctgagtgtgacagaagttgggacagagaaactcgacgataattccatccaactgttcggtccaggaattcagccccatcactgcgatcttaccaatatggatggcgttgttacagtaactccaaggtcaatggacgccgagacctacgtagaagggcagaggatttccgaaacaaccatgttgcagtctggcatgaaggtgcagtttggggcctcccatgtgttcaagtttgttgatccctctcaggatcatgcactggccaagcgctctgtggatggtggtttgatggtgaaaggcccccggcacaagccaggcatagtgcaggaaactacctttgacctggggggcgacattcattcgggcaccgcgctacccacctccaaatctactacgagactcgactctgatcgcgtaagctctgcttcttcgacagcggaacggggcatggtcaaaccgatgattagggttgaacagcagcccgactaccgccgacaggagagtagaacccaggatgctagcggacccgaactcatcctccctgctagtattgaatttcgcgagagttccgaagacagcttcttatctgccattataaattacaccaactcatctactgttcactttaagctgagtcctacatacgtgctctacatggcttgccgatatgttctgtccaatcagtatcgtccagacatttcccctacagagagaacacataaggtgattgccgtagtcaacaaaatggtgagtatgatggagggtgttatacagaaacagaagaatattgcaggtgctctggccttctggatggccaacgcatcagagctcctaaacttcattaagcaggacagggacttaagtaggatcacactggacgcacaggatgtactggcacacctagtgcaaatggctttcaaatacctcgtgcactgtctccagagcgagctgaacaattacatgccggcctttttagacgatcccgaggaaaacagtctgcaaaggccaaagatcgatgatgtactgcacaccctgacgggcgcgatgtccctgctgaggagatgcagggtcaatgccgcgctgactattcagcttttctcacagttattccacttcattaacatgtggcttttcaaccggctggtcaccgaccctgattctggcttatgcagtcactattggggtgctatcataaggcagcaactgggccacattgaagcatgggccgagaagcagggattagaattggctgctgactgtcatctctccagaatcgttcaggctacgacactgctgaccatggataagtatgctcctgacgacattcccaacatcaactctacttgctttaaactcaattccttacaactacaggctctgctacagaattatcattgcgctcctgacgaacctttcattcctactgatttaatagagaacgttgtgacagtggccgaaaatactgcggatgaactcgcgcggagcgacggaagggaggtgcagttagaagaggaccccgatttgcagctacccttcctgctgcctgaggacggatattcatgtgatgtcgttagaaacattccaaatgggctccaggagtttcttgacccactgtgtcagagggggttctgcaggctgataccccataccaggagccccggaacatggacgatctatttcgagggcgccgattatgaaagtcatctgttacgtgaaaatactgaactggcaattcctctcaggaaagaaccagagattattaccgtaacactgaagaaacagaacggaatggggttgtctattgtggccgcgaagggagctggacaggataagctgggtatatatgtgaaatcagtggtgaaggggggggcggcagatgatgggcggcttgcagctggcgaccagctgcttagcgtcgacggcagatctttagtggggctttctcaggaacgcgctgcagaactgatgacccggacgtcctcagtagttaccctggaagtagcgaagcaaggggcaatttaccacggtctcgcaaccctgctaaaccaaccctcacccatgatgcagagaatcagtgatagacgtggcagtggaaaaccccgccccaagtctgaaggctttgagctgtataacaacagcacccagaatggctctccagagagtccacagctgccctgggcggaatacagtgaaccgaagaaattgcccggagacgaccgacttatgaagaacagggcagaccacaggtccagccctaatgttgcaaaccaaccgccttctcctggcgggaagagtgcatatgcatccggtactacggccaaaataacaagcgtttcaacgggcaacctgtgcacagaggaacaaacccccccacctcgaccagaggcctatcctatcccaacccagacttatacaagggaatacttcacttttcccgccagtaagagtcaagatcggatggcaccgccccagaatcagtggcctaactatgaggagaagccccatatgcatacggatagcaatcactctagcatcgccatccagagagtcaccaggtcccaggaggaattaagggaggacaaagcttaccagctggagagacacaggatcgaggccgctatggacagaaagtcggatagcgacatgtggatcaatcagagtagtagcctagactcatccacctcctcacaagaacacttgaaccattcttctaaatccgtgaccccggcctctaccctgactaaatctggccccggacggtggaagactcccgccgccatcccggctacacccgtcgctgtatctcagcccattcgcacggacttacctcctccaccccccccccctcctgtgcattacgccggagactttgatgggatgagcatggacctccccctaccccctccaccatcagccaatcagattgggttgccatctgctcaagttgcagcggctgagcggaggaagcgagaagaacatcaaaggtggtatgaaaaagagaaagctaggctggaggaggagagggagcggaagcggagagagcaagaacgcaaactgggccagatgcggacccagagccttaatcctgcgccttttagccctctgaccgcacagcagatgaaaccagagaaaccatccactttgcagcggccacaggagaccgtcatccgcgagctgcaaccccaacaacaaccacgaacaatcgagagacgcgacctccaatatataactgtctctaaggaagaactgtcctctggcgacagcctgtcccctgatccgtggaagagagacgccaaggagaaacttgagaagcagcagcagatgcatatcgttgatatgttatcaaaagaaattcaggagctgcagagtaagcctgatcgatctgccgaggagtccgaccgactgcgcaaactcatgcttgaatggcagttccagaagagactccaagaaagtaagcagaaggatgaagatgacgaagaggaagaagacgacgatgtggatacaatgctgattatgcaacgactggaagccgaacgcagggcacgactgcaggatgaagaaaggcggcggcagcaacaactggaagaaatgcgcaagcgcgaggctgaggacagggctcgccaagaggaggagaggcgtagacaggaagaagagagaaccaaaagggacgcggaggagaaacggcgtcaggaggaggggtactatagtcgtctggaggccgaacggaggagacagcatgacgaggccgcacgccgcttgttagagccagaagccccaggccctaactcctaccctggaagcaccggagccgccgttggtgctcacgatgcatgccgggacgcaaaagagaagcggtccaagtcccaggatgctgattctccgggctcctcaggagcccctgagaacctcaccttcaaagaaagacagaggttgttctctcagggacaggatgtcagtaataaggtgaaggctagtaggaagttaaccgagttagaaaacgagctgaatactaaatag

SEQ ID NO: 125250 - DNA, 5475 bp, Artificial Sequence
  Description of Artificial Sequence: Synthetic coding sequence
atgtccgcaggcggcagagacgaggaacggagaaagctggctgacatcatacaccattggaatgcgaataggctggatttattcgagatcagtcagcccacagaagatcttgaattccatggcgtcatgagattttactttcaagacaaggccgctgggaacttcgctaccaagtgcatccgtgtttctagcaccgctaccacacaagatgtcatcgagacactggctgagaagttcagaccagatatgagaatgctgtcctcccccaaatacagtctgtacgaagtgcacgtcagcggagagagaagactcgatattgacgaaaagccattggttgtgcagttgaactggaataaagatgaccgggaggggcgcttcgtgctcaagaacgaaaacgacgcaatacctcctaaaaaggctcagtccaacggccccgaaaagcaagaaaaggaaggcgtgatccagaattttaagcggacattgtccaaaaaggaaaaaaaagagaagaaaaagagggaaaaggaggctctgaggcaggctagtgacaaagacgataggccctttcaaggcgaggacgtcgaaaacagtcgcttggcagctgaggtgtataaagatatgcccgagacctcattcactcgcaccatcagtaacccagaggtcgtgatgaaacgccgtcgtcagcaaaagctagagaagcgcatgcaggaatttcgttcctcggatggcaggcctgactccggaggaacactgaggatttacgccgactccctaaagcccaacattccctataaaactatcctgctgagcaccactgatccggccgattttgcggtcgctgaagctctggaaaaatatggtctcgagaaggaaaaccccaaggactactgcatcgctcgagtgatgctgccacctggggcccagcactctgatgaaaagggcgccaaggaaataattttagatgatgacgagtgtcccttacaaatatttagggagtggccatccgacaaaggcattctagttttccaactcaaaaggcgacctccggaccacatcccaaagaaaacaaaaaagcacctggaagggaagacacctaaaggaaaggaaagagccgatggctctggctatggcagcacactgccccccgaaaagttgccatacctcgtggagctgtcaccgggtaggagaaaccatttcgcatactataactaccacacatacgaggacgggagcgattcgagagataaacctaaactgtataggctccagctaagtgttacagaagtcggtaccgagaagcttgacgataattctatacagctttttggacccggcatccaacctcaccactgcgatttaacgaatatggacggcgtagtcaccgttacccctcgctctatggatgccgagacatacgtcgagggccagaggatctcagagacaacaatgctccagagcgggatgaaggtccagttcggagcaagtcatgtttttaaattcgttgacccttcacaggaccatgctttggcgaagaggtccgtggatggcgggttgatggtgaaaggtcccagacacaaacctggtattgtacaggaaactactttcgacttaggaggcgatattcatagcggtactgcactgcccacttccaaaagcacaaccagattagatagcgaccgggtgtcatccgcatcgtcaaccgctgaaagggggatggtgaagccgatgatcagagtcgagcagcaaccagattacaggcgacaggagtctaggacgcaggatgccagtgggcctgagctaatccttccagcctccatcgagttccgagaatcctctgaggacagcttcttgtctgccatcatcaactatacaaattcctccactgttcacttcaagttgagtccgacctatgtcctgtatatggcttgcaggtatgtgctgagtaatcagtatcggccggatatctctccaactgaacggacacataaagttattgcggtggttaataaaatggtgtctatgatggagggggtaatccaaaagcaaaagaatatcgctggtgcactggctttttggatggccaacgcctccgagctactcaatttcattaaacaggatagggatctgagccgcatcacactcgatgctcaggatgtactggcccatctcgttcagatggctttcaagtaccttgtgcattgcttacaatccgaacttaacaattacatgccggccttcctcgacgacccggaggaaaatagtctccaaaggcctaagattgacgacgtactgcacacacttacaggcgccatgtcacttctaagaaggtgtagagtcaacgctgcgctgacgatccagctattttcccagttgttccatttcataaacatgtggttatttaacagactggtgacagaccccgatagcgggctgtgcagtcactactggggtgcaattattagacagcagctgggacacatagaggcctgggctgaaaaacaaggcctcgagcttgccgcagactgtcacttaagccgaattgtacaagccacaacactgcttacaatggataaatatgcccctgacgatatccctaatataaacagcacctgcttcaaacttaattctcttcaactccaagcactgctccaaaattatcattgtgccccagacgagcccttcattcccacagatttaattgaaaacgtggtgaccgttgcagaaaacactgccgatgagttagcacgaagtgatggacgggaagtgcagcttgaggaagatcctgatttacagctcccttttctgctgccagaggatggatattcatgcgacgtggtgcgcaatattcctaacggattgcaagaatttcttgatccactatgccagagaggattctgtcgactgatcccacacaccaggtcacctggaacctggaccatttacttcgagggcgccgactatgagtcacatctcttacgtgaaaatactgaactcgcccaacccctgcggaaagagcccgagattatcactgtgactctgaaaaagcagaatggtatgggattgagcatcgttgctgccaagggcgccggacaggacaaactgggtatctacgtgaaatccgtagttaaggggggagccgcagacgttgacggaaggctcgccgcaggcgatcagctgctatctgtggatggcaggagcctggtcggcctgtcacaggagcgcgccgcggagctaatgactagaacatcttccgtcgttactctcgaagtggcaaagcagggcgccatctaccatggtctcgccacattgctgaatcagcctagcccgatgatgcaaagaattagcgataggagaggctctggaaagccaagaccgaaatcagaggggttcgagctttacaacaacagtacccaaaatggttcacccgagtcccctcagctcccatgggcggagtactcggaaccaaagaagcttcctggcgacgaccgtttgatgaaaaacagggccgatcacaggagtagccccaatgttgccaaccagccacccagccccgggggaaaatccgcctacgcaagcggtacaacagcaaaaatcacctccgtgtctaccgggaacctctgtacagaggagcagactccacctccacgtccagaggcatatcccatacccactcagacttacactagggagtactttacgtttcctgcgagtaagagccaggacaggatggcccctccgcagaatcagtggccgaactacgaggagaaacctcacatgcataccgattcaaaccactcctctatcgctatccagcgggttaccaggtctcaggaggagctgcgcgaggataaggcctatcagctggaacgtcaccgcatcgaagcagccatggaccgcaaatcggacagcgacatgtggatcaatcagtcctcgtcccttgattcttctacaagttctcaggagcacctgaaccactctagcaaaagtgtgacccctgcttcaactctgacaaaaagtggccctggccggtggaagacccccgctgctattcccgccactcccgttgctgtgtcccagcccatcagaactgatctcccaccccctccgccaccaccacctgtccactatgccggtgatttcgacggcatgtctatggatcttcctctgcctcctccaccctccgctaaccaaatcggactgccctctgctcaggttgcggcagctgaaagaagaaagagagaagaacaccagcgatggtacgagaaagaaaaggctaggttagaggaagagcgggagcgtaagaggcgagaacaggagcggaaactggggcagatgcggacccagagcttaaatccagctcctttctcaccgctgaccgcacaacagatgaagccggaaaaaccttctacgcttcagagaccccaggaaacagtgatccgggaactgcagccccagcaacagcctagaacaatagaaaggcgggacctgcagtacattactgtctccaaggaggaactgtcttccggtgattctttgtctcctgatccttggaagagagacgcaaaagagaaattggagaaacaacagcagatgcacatcgtggacatgttgagtaaagagatccaggagttgcaatcaaagccagaccgcagtgctgaggaaagtgacagactgcgcaaactcatgctggaatggcagtttcagaagcgcctccaggagtcgaagcagaaagacgaggacgatgaggaagaggaagacgacgacgtggacaccatgttgattatgcagagattggaagctgaacgcagagctagactgcaagacgaagagaggaggaggcagcagcaactcgaagagatgcgaaaaagagaagcagaagaccgcgcgagacaggaagaggagaggaggcgacaagaggaagaacggacaaaacgcgatgccgaagaaaagagacgccaagaagaaggctattattctaggctcgaggcagagcggcggaggcagcacgacgaagccgcgcggaggctgcttgagcccgaggcacccggcctttgtcgacctccgctgcccagggattacgaacccccctcgccttctcctgctccaggcgcgcctcctcctccaccgcagagaaacgcctcttacctgaaaacacaggtattatcacctgacagcttgtttacggccaagtttgtggcgtataacgaggaagaagaagaagaggattgctccctggccggaccaaactcctatcctgggtccacaggcgctgctgtaggggcccatgatgcctgccgagatgctaaagagaaaaggagtaaatcgcaggacgccgattccccaggatcgtcgggcgcacctgaaaatcttacgttcaaggagaggcagcggctcttttcacagggccaggatgtctccaataaagtgaaggccagccgcaaacttaccgagctcgaaaatgaattgaatactaagtag

SEQ ID NO: 125251 - DNA, 3282 bp, Artificial Sequence
  Description of Artificial Sequence: Synthetic coding sequence
atgaaagagatggtgggcggctgctgtgtttgcagtgatgagcgcggctgggcggaaaatccccttgtgtactgtgacgggcatgcctgttccgtggtggtgcatcaggcatgctacggtatcgtacaagtccctaccgggccctggttctgccgaaagtgcgaatctcaggagcgcgccgctcgtgtccgttgcgaactgtgcccgcacaaagacggagcattgaaacgtacagacaacggagggtgggcacacgtggtgtgcgcgttgtacatccctgaggtacagttcgcaaatgtccttaccatggagcccatagtgctccaatatgtccctcatgaccggtttaataaaacgtgctatatctgtgaagaacagggccgcgagagcaaagccgcctcaggtgcttgtatgacttgcaaccggcatggatgtagacaagcgtttcacgtgacatgtgctcagatggcgggtctgctttgcgaagaagaggtcctggaagtagacaacgttaagtactgtggctactgtaagtatcatttttccaaaatgaagacttctcgtcatagttccgggggtggcggcggcggtgcaggtggaggtggtgggagtatgggaggcggtggcagcggatttatctcaggtaggcgcagccggtcagccagcccctcgacacagcaggagaaacatccaacacatcacgaacgcggacagaagaaaagccgtaaggacaaggagagactcaagcagaagcacaagaaaagaccagaatccccacctagtatactgactccgccggtcgtgcctaccgcagacaaagtgagcagctctgcctcctcgtcctcccatcatgaagctagtacacaggaaactagtgagagctcccgcgaaagcaaggggaagaagtcatccagccactcgctgtctcataagggcaaaaagttaagttccgggaagggagtgagctcgtttacctccgcgtcgagcagttccagctctagctcaagttcctcagggggccctttccagccagccgtgagttcccttcagtcctctcctgatttttctgccttcccaaaactggagcagcctgaggaagacaaatactcgaagcccaccgcccctgccccctctgccccaccatccccatccgcgcccgagcctcctaaagccgacctgtttgaacagaaagtggtgttttctggatttggaccaattatgaggttctctacgacgacttctagcagcgggagagctagggctccttctcctggcgattacaagtcgcctcatgtgacgggttccggggcgagtgccggcactcataaacgaatgccagcgttgtcagctacgcccgtgcctgcagacgaaaccccggaaaccggcttaaaggagaagaagcacaaggcaagcaaaaggagtcggcatggcccaggtcgtcctaaaggatcgaggaacaaagaagggactggcggcccggccgccccatctctgcccagcgctcaactggctggattcaccgccaccgcggcgtcaccctttagcgggggaagccttgtgtcatccggactgggcggcctcagtagtcggaccttcgggccatcaggtagtcttccatctctgtccctggagagcccattactgggtgccggtatttacacctctaacaaagatcctattagccactctggaggcatgctgagggccgtatgcagcaccccactgtcctcatctctcctcggaccccctggcactagcgcactgccccggctgagcaggagcccctttacatctactctcccatctagtagtgccagtattagtactacccaggtgttcagcttagcaggctctaccttctcgttacccagcacccacatttttggcactcctatgggcgcagtcaacccgttgctgtcacaggctgaatcctctcataccgagccagacctggaagactgctcatttcggtgtagaggaacttcgccacaggagagcctgagttcaatgtcccccattagctctcttcccgccctctttgaccagacagctagtgccccctgcgggggagggcagcttgaccctgccgcccctgggacaaccaacatggaacagctgctcgaaaaacagggggacggggaggcaggggtcaatatcgtggaaatgctcaaggcactgcacgctcttcagaaggaaaatcagcgccttcaggagcaaattttgagcctgactgcgaagaaggaacgactgcagatcctgaatgtgcagctgtcagtacccttcccagcactccccgccgctctccctgcagcaaacggacctgttccaggaccttacgggttgccacctcaggccggttccagtgattctctgagcacaagcaagtctcctcctggtaaaagttctctgggactcgacaactccttaagcacttccagcgaggacccccattccgggtgtcctagccgcagctccagcagcttaagtttccactccacacccccaccgctgccgctcttgcagcaatctcccgcgacattacccctcgctcttccgggcgctccagcccccctgcctcctcaaccacagaacggactaggtcgcgcacccggtgcggccggacttggagccatgccaatggctgaaggcctgctcggcggcctagccgggagcgggggactgcctttaaacggtctgctgggtggcttaaatggcgctgccgccccaaaccccgctagcctgtcccaggccggcggtgccccgacactgcagctccccggttgcctcaacagcctcactgaacagcagcgtcatctgctgcagcaacaggaacaacagctgcagcagctgcagcaactcctggctagcccgcagctgacaccagagcaccagaccgtcgtgtatcagatgattcaacagatccagcagaaaagagaattgcagcggctgcagatggcaggtggtagccaactgcctatggcatctctgctggccggcagtagcactcctttgctgagcgcgggcacccctggcctgctcccgaccgcgtccgctccaccactgttgcccgccggcgcattagtcgcaccctctctcggcaataataccagccttatggccgctgccgctgccgccgcagcagtggcagccgcaggtggacctcccgttctgaccgcacagactaacccgttcctttctctatcgggcgccgagggatctggcggaggcccaaaggggggaaccgcagataaaggagcatctgcaaaccaggagaagggttag

SEQ ID NO: 125252 - DNA, 978 bp, Artificial Sequence
  Description of Artificial Sequence: Synthetic coding sequence
atgaaagagatggtcggcggatgctgtgtgtgttccgacgagaggggctgggccgaaaatccactcgtgtactgcgatggccatgcttgttccgtggttgtgcaccaagcttgctatggaatcgtacaggtgccgactggcccgtggttttgtcgcaagtgcgagtctcaggagcgggccgcacgcgtacgatgtgaactgtgcccgcataaggacggagcactgaagcggacggataatggaggatgggctcacgtagtgtgtgccctgtacatccccgaggttcagtttgctaatgtgctgaccatggaaccaattgtgctgcaatatgtgccccacgacaggttcaacaaaacctgttacatttgcgaagagcagggccgagaaagtaaggcggcatctggcgcctgcatgacctgcaatcgacacgggtgtcgacaggcattccatgtcacttgcgcacagatggccgggctgctgtgcgaggaggaggttctcgaagtagacaatgttaagtactgtggatactgtaagtaccatttttccaaaatgaaaacgtcccgccactcttcaggaggtggggggggaggcgccgggggcggtggggggagcatgggagggggtggctctggcttcattagcggaagacgctctagatccgcaagcccctccactcagcaggagaaacacccaacacaccacgaacgcggccagaaaaagtcacgcaaggataaagagagacttaaacaaaagcacaaaaaacggcccgagtctccaccctccattctcactccacccgtagttccaactgcagacaaaccacgacgtggccaccaaagccctactaaccacggaattggttccctggggtgctgcttgcctgatacacccatttgcctttgtcccgaggggttatccccaggactcctgtctgcagaaagcggaggccggcattctggactcctttcaaaattctag

SEQ ID NO: 125253 - DNA, 16614 bp, Artificial Sequence
  Description of Artificial Sequence: Synthetic coding sequence
atggacagtcagaaattggctggagaggataaagacagcgagcccgccgccgatggccctgccgctagcgaagatcccagcgctaccgagtctgatctccctaatccccatgtaggcgaagtgagcgtgctgtcttcagggagccctaggctccaggagaccccccaggattgttccgggggccctgttcggcgatgtgcattgtgtaactgcggcgagccgtctttgcatgggcagcgggagctgcggagattcgagttgccgttcgattggccaagatgccctgttgtcagccctggcgggtcgcccgggccaaatgaggccgtactaccttctgaggatcttagccagatcggcttccccgagggcctcacccctgctcacctgggcgaacctggaggctcatgttgggcccaccactggtgcgctgcttggagcgcaggagtgtggggacaggaagggcccgaactttgtggtgtggacaaagctatattctccggtatcagccagagatgcagtcactgcactcggctcggggcctccattccctgccgctcccctggctgtcccaggctttaccatttcccatgtgccaccgcatctggaagctttctctctatgaagacgttacagttgctctgtcccgagcactccgaaggggcagcctatttagaggaggcgcgatgtgccgtatgtgagggccctggggaactctgtgaccttttcttttgtaccagctgtgggcaccattatcatggtgcatgtttggacacggcgctcacggcacggaaacgagctgggtggcagtgtccagagtgtaaggtttgtcaggcgtgtagaaaacccggcaacgactccaagatgctggtgtgtgagacttgtgacaagggttaccatactttttgtctgaaaccacccatggaggaattgccagcacactcctggaagtgcaaagcttgcagagtgtgcagagcgtgcggcgcaggctccgcagaattgaatccaaacagcgaatggtttgagaattattctctctgccaccgctgtcacaaagctcagggagggcagactatacggtctgtggcagaacaacacacaccagtgtgtagcaggttttcgcctccagagccaggtgacacccccacagatgagccggacgccctttacgtggcatgtcagggccagcccaagggagggcacgtgacgtccatgcagcccaaggaacctgggcccttgcagtgtgaggctaaacctcttggcaaggcaggcgttcagttggagccacagctggaagccccgctgaacgaagagatgcccctcctaccgccaccagaggaatctcctttgtctccgcccccggaggaaagtcccacatccccaccgcccgaggcctccagactctccccaccccccgaagaacttcccgcgtcacctcttcctgaagcgctccatctgtctaggcccctagaagaatctcccctgtctcctccgccagaggaatcaccactcagcccaccacccgagagttcaccttttagccccttggaggagagtccacttagtcccccggaagaaagccctccctcccctgccctcgagaccccgctgagccctcctcccgaagcttctcccctctcacccccttttgaggaatctccactgagtccccctcccgaggaactgcctacgtccccccctcctgaggcgtctcggctgtcgccccctccggaggagtctcctatgagtccgccccctgaggagagtcccatgtcaccaccccctgaggcatcacgacttttcccccctttcgaggagagccctttatcacctcctcctgaggagtccccactcagccccccacctgaggcctcaaggcttagcccccccccggaggacagcccaatgagccccccacccgaagagtcacctatgtctccaccccctgaggttagccgcctgagcccactgcccgttgtcagtcggttgtcccccccacctgaagagagcccgttgtcaccacccccagaagaaagtccaacgtccccacctccagaggcctccagattatcgccaccgccagaggactctcccactagccctcccccagaagattctccggcctcgccaccacccgaagacagcctcatgagcctgcccttagaagaatcacctctgctcccactgcccgaagagccccagctgtgtcctaggtcagaaggcccccatttatctcccaggcccgaggaaccacatctttccccacgccccgaagaaccccaccttagccctcaggccgaggagccccatctgtctcctcagcctgaggagccgtgcctgtgtgcagtcccagaagagccccatttgtctcctcaagcggagggaccccacttgtccccccaacctgaggagctccacctctcaccacagactgaagagccccacctctctcccgtccccgaggaaccttgcctcagtcctcagccagaagaaagccatttatccccccagtccgaagaaccatgtctgtcacctcgccctgaggagagtcacctgagccctgagctggagaaacctccgcttagtccacgccccgagaagcctcctgaagaacctggacagtgtcctgcaccggaggagctgcctctattccctccaccgggggagccttctctcagcccattgctaggcgaacccgccctttccgaacccggcgagccccctctatctcctctgccagaagagcttcctctgagtccctcaggagagccttccctatctccccaactcatgccgccagatccactccctccccccctgtcccccatcatcactgctgcagccccaccagctttaagccccctgggcgaactcgaatatcctttcggcgccaaaggagatagcgaccccgaatctccattagctgcaccaatcttggaaacccccatcagccccccgcctgaagctaattgtacagacccagagcctgtgcccccaatgatcctcccaccttcccctggatctcctgtcgggccggcgagtccgatcttgatggaacccctgcctccccagtgctcccctctcttgcagcacagtctggtgccacagaatagtccccctagccaatgttcaccccccgcgcttccgctgtccgtcccttccccactgagtccaatcgggaaggtagttggggtgtctgacgaagctgagctgcacgaaatggagacagagaaggtttcagaacccgagtgcccagccctggagcccagtgcgacatctccactaccatctccaatgggtgacctgtcctgccccgctccctcccccgcccccgctctcgatgacttcagcgggctgggcgaggacacggcacccttggacgggatagatgcccctggttcgcagcctgaaccgggacaaacaccagggagcctcgcatctgaactcaaaggctctcctgttttgcttgaccctgaggagctcgcccccgtgacacctatggaggtttatccagagtgcaaacaaacagcaggtcaggggagtccctgtgaagagcaggaggagccacgcgctcccgtggcaccaacgcctccaaccttgattaaatctgatattgtaaacgaaatcagcaacttatcgcagggggatgctagcgctagttttcctggtagcgaaccactgctgggcagtccagacccagaggggggaggctccctgtctatggaacttggggtatcaactgacgtttctccagcacgggatgaagggagccttcggttatgcactgattctctcccagagaccgatgattccctgctgtgcgatgccggaaccgctatttccggcggaaaagccgagggggagaaggggcgccgcaggtcaagtccagcaaggtcccggatcaaacagggaagatcctcctcctttccgggcagaagacgaccccgcggcggggctcacggagggcgaggacggggacgtgccaggcttaagagtacagcatcctccattgagaccctcgttgtggccgacattgatagcagcccctctaaagaggaggaagaagaagatgacgataccatgcagaatacagtagtcctcttttcaaacaccgataaattcgtgttaatgcaggacatgtgtgtagtgtgcggaagcttcggacggggcgctgaggggcaccttctggcatgctcccagtgctcgcagtgttatcacccttattgtgtcaacagtaagatcacgaaggttatgctgctgaaaggatggaggtgcgtggagtgcattgtctgcgaggtttgtggtcaggcctccgatcctagcaggctgctcctctgtgatgactgtgacatttcgtaccatacgtattgtcttgacccccccctgttgactgttcccaagggggggtggaaatgtaaatggtgcgtttcttgcatgcagtgtggggccgcgtcaccaggcttccactgtgagtggcaaaactcttacacacactgtgggccatgcgctagtctggttacatgcccgatctgtcatgcaccctacgttgaggaagaccttctcattcagtgccgccattgtgaaaggtggatgcacgccgggtgcgagagtttgttcacagaagatgacgtggaacaggcagccgatgagggcttcgactgtgtgagttgtcagccctacgtcgtgaagccagtcgcccccgttgcccccccagaactggtcccaatgaaggtcaaagagcccgagccgcagtacttcagattcgagggcgtctggcttactgaaacaggaatggcgctgctccgtaacttgacaatgtcacccctgcacaaacgccgacagcggaggggacggctggggttgcccggtgaggcaggactggaaggatctgagcccagcgatgccctgggacctgacgataagaaagatggcgacctagatactgacgagctgctcaagggcgagggcggtgtcgagcacatggagtgcgagatcaaactggaaggcccagtgtcacccgatgtcgaacccggaaaggaggagacagaagaaagcaagaagagaaaaaggaaaccctacaggccagggatagggggatttatggtgcggcagcgaaagtcacatactcgcacgaaaaagggccccgctgcccaggctgaagttttgtctggagatggtcagccagacgaagtaatcccggcagatctgcctgctgagggagccgtcgaacagtcattggcagaaggcgatgagaaaaagaaacagcaaaggcggggccgaaagaagagtaaacttgaagacatgttcccagcatatctgcaggaggcgttctttggaaaagaactgcttgacctgtcccggaaggcgctctttgcggttggggtgggcagaccatcatttggcctgggaacccctaaagctaagggcgatggcggaagcgaacgcaaggaattgcccacgtcacagaagggagatgacggtcccgacattgccgatgaggagtcgagaggcctggagggcaaggccgacacgccagggccggaggacgggggagtgaaggctagtcccgtgccctctgacccagaaaagccagggacgcctggtgaaggtatgctctcttccgatttagaccggatctctaccgaggagctgccgaagatggaaagcaaagatctgcagcagctcttcaaagatgtgctgggttcagaacgggagcaacatctcggatgcggcactcccggcctcgaagggtcccgaaccccactgcaacggccttttctgcagggcggtctgcctttagggaacttgccctcctctagcccaatggattcataccctggtctttgccaaagtcctttcttggattcgagagaaagagggggctttttttctccagagcccggggaacccgattcaccttggaccggcagtggcggcaccacacccagcacccccacaacgcctactacagagggagagggtgatgggctatcttataatcaacgatcactgcagagatgggaaaaggacgaggagctgggccaactctcaacgatttcacctgtgctctatgccaacataaattttcccaatctgaaacaagactatccagactggtctagccggtgcaagcagataatgaaactctggaggaaggtcccggcagctgacaaagccccctacctacagaaagctaaagacaatcgcgctgcccataggataaataaagttcagaaacaggctgagtctcagatcaataagcagacaaaagtgggcgacatagccaggaaaaccgatcgtccagccctgcacctgcgtatcccaccacagccaggggccctaggttccccaccacctgccgctgctcctactatttttattgggagccctaccaccccagcaggcctctccaccagcgcggatggattcttgaagccgcccgctggtagcgttcctggcccagattctccaggggagctttttttgaaactgcctccgcaggtcccagctcaggtgccttcgcaggatccttttggcttggccccagcttaccccctagagccccggtttccaacggctccccccacataccccccttacccttctccaaccggggctccagctcaacccccaatgctgggggcaagctcccgcccgggagcgggccagcctggagaattccacaccactccaccagggactcccagacatcagccgagtaccccggatccttttctcaagccgcggtgcccttctctagataacctggcagttcccgaatcaccgggagtcggaggtggaaaagcctcagagcccctgttgtcccccccgccttttggtgagtcccgaaaggccttggaggtgaagaaagaggagctgggtgcctctagccctagttacggacccccgaatctcggctttgtcgacagcccctcaagcgggacacatctcgggggcctcgaactcaaaacccctgacgtcttcaaggccccactgactccccgggcctcacaggtggaaccacaaagcccaggcctgggtctgagaccgcaagagcccccccccgcccaagcccttgccccatcccctccatcccaccccgacatcttccggccagggtcctatacagacccttatgcccagcctcccctgacgcctagaccccaaccgccgccaccggaatcctgctgcgctctcccaccgagatcgttaccctctgacccctttagcagagttccagcatcacctcaaagccagtcttcctcccagagtcccctaaccccgagaccactcagtgcagaggccttctgcccctcacctgtaacaccacgctttcagtcgccagatccatattccagaccgcctagcagacctcaaagccgcgatcccttcgcacctcttcataaaccccccagaccacagcctcccgaggtcgcattcaaagccgggtcactggcccatacttctctcggagccgggggcttccccgcagcactgccagccgggcccgctggagagcttcacgcaaaggtccctagcgggcagccacctaactttgtccgcagcccaggaacaggtgcgttcgtggggacccccagcccgatgaggtttaccttcccccaagccgttggcgaacccagcttaaagcctccagttccccaacctggcctgccgccccctcacggcataaactctcatttcggccccggccctacattagggaagccgcagtccacaaattataccgtagctacaggcaactttcacccatccggcagccccctggggcccagctccggctcaacaggtgagtcctatggactgagcccgctgagaccaccaagtgtgttgcctccaccggcccccgacggctctctcccctacctgtctcacggggccagtcaaagatccggcattacttcgccagtggagaagagagaggaccctgggactggcatgggatccagcctggcgaccgccgaacttccaggtacacaggacccgggcatgagtggactcagtcaaacagagctggagaaacagcgacagcgccagcggctgagggagttgctcatccgccagcagattcagcgcaatacccttagacaggagaaggagaccgccgccgcagccgccggcgcagtcggacctccagggtcctggggggcggagccttcctcaccagcattcgaacaactgtcccggggccagaccccttttgcagggactcaggacaaatcttcgttagtggggctgcccccctcaaaactgtccggtcctattttgggccccggatcttttccgtccgatgaccggctgagccgccctccccctcctgcaacacccagctcaatggacgtgaattcgcgccagctcgtgggcggctcacaggccttctaccagagggctccctatcccggaagtctacctcttcaacagcagcaacaacagctttggcagcaacaacaggctaccgcagcaacctctatgcggttcgccatgtccgctagatttccgagtaccccagggcctgagctgggcaggcaggctcttggcagtcctctggccggcatttccaccagattgccaggcccgggcgaaccagtcccaggaccagcagggcccgcacagtttatcgagctcagacataatgttcagaagggactgggtcccgggggcactccatttccagggcaggggccgccccagagaccacgcttctatccagtctctgaggaccctcacagacttgctccagaggggcttaggggcctcgcagtttctggcttgcctccgcagaagccatccgcaccacctgccccagagctaaacaattctcttcatccgacacctcacacaaaggggcccaccctcccaaccggccttgaattagtgaataggcccccctcctcaacggagctagggaggcctaaccccctggcattagaggccggaaagctgccttgcgaagatcctgaattagacgacgatttcgatgcccataaggcactggaggatgacgaagaactcgcccacctgggtctgggggtggacgtggccaaaggcgacgacgagttgggcacactcgagaacctggaaaccaatgaccctcatctggacgatttactgaacggagatgagttcgacctgctggcctacactgacccagagttggacactggcgataagaaggacatatttaatgagcacctgcggctcgtggagtcggcgaacgagaaagctgaaagggaggcactgttacgcggtgtggagcctggtcctctgggaccggaggaaagacccccacccgccgcagacgcgagcgaaccccgattggcgtccgtcctcccagaggtgaagcctaaagttgaggagggaggtcgccaccctagtccgtgccagttcactattgcgactcctaaggtggaaccagcacccgcagcgaacagcctcggtctcggcctcaagccaggacaatctatgatgggttctcgggatacaaggatgggtaccggcccattctcatcctccggccacaccgccgaaaaagctagtttcggcgccacagggggacccccggcgcatctcctcactccctctcctctcagcgggcctggagggtcatcgctgcttgaaaagttcgaactagaatccggggcgctgacactgccaggaggcccagcagcctccggagacgaactcgataaaatggaaagcagtctggtggcgtccgagttgccactgttaatcgaagacctcttagagcatgagaagaaagagctgcagaagaaacaacaactgtcagcacagctgcagccagctcaacagcagcagcagcaacaacagcagcatagtttgctgtcagccccaggccccgcgcaggccatgagcctccctcatgaaggctctagcccatcattagcaggctctcagcagcagttgtccctggggctcgcgggcgctcggcagcccggcctgccccagcccctaatgcccacccagccacctgcccatgctctgcagcagcggctggcacctagtatggcaatggtctcaaatcagggccacatgctgtcaggacaacacggaggacaggccggcctggttccccaacagtcatcacaaccggtcctctcccagaaaccaatggggacaatgccaccgagtatgtgtatgaagcctcaacagctggccatgcagcaacagctggctaattccttcttccccgataccgatcttgataaatttgcagctgaagacatcatcgacccaatcgcaaaggcaaagatggtcgcattaaagggaatcaagaaggtgatggcccagggcagcatcggggtggcccccggcatgaatcggcagcaggtgtcgttactggctcaacggttgagtgggggcccctcttctgatttacagaaccacgttgcagccgggtccggacaggagaggagcgctggcgacccaagccaaccgaggcccaatccgcccacatttgcgcagggggtgattaacgaggctgaccagcgccagtatgaggagtggttgttccacacccagcaacttctgcagatgcaactgaaagttctggaagagcaaatcggagtccatcgcaagtctcggaaagccctgtgtgccaaacagcggaccgccaaaaaggctggaagagagttccctgaagctgacgcggagaaactgaagcttgtcactgagcaacagagcaaaatccagaagcaactagaccaggtgcgcaaacagcaaaaggagcacaccaatcttatggccgaataccggaacaaacaacagcagcagcaacagcagcagcagcagcagcagcagcagcactctgcggtactggcccttagcccctcacaatccccgcggcttttgaccaagctaccaggccagttgctacccggccacggtcttcagcctccacagggtccacctgggggccaggcggggggccttcggctcactccaggcggtatggctcttccggggcagcccggtggaccgtttctcaacaccgccctggcccaacagcagcagcagcagcattccgggggtgccggctctttggcaggtccaagcggaggtttctttcccggcaatctggcccttagatcgcttgggcccgatagccggctgcttcaggaacgacagctccagctccaacagcagagaatgcagctggctcagaaactccagcaacaacagcagcagcagcaacagcagcagcatctcctgggccaggtggctattcagcagcagcaacaacagggaccgggggtgcagacaaaccaagctctcggtcccaaacctcaggggctgatgcccccctcttcccaccagggactgctcgtccagcagctgtccccccaacccccgcagggcccgcagggcatgctgggaccagcccaggtcgcagtcctgcagcaacagcatcctggggcactagggcctcagggacctcatagacaggtgctgatgacccagtctcgtgtgctttcaagtccccagctcgcacaacaggggcaagggttaatggggcataggctggtaactgctcaacagcagcaacagcagcagcagcatcagcagcagggctcaatggccggattatcccaccttcagcagagcttgatgagtcattcaggtcagcctaaactgagcgctcagccaatggggtctttgcagcagctccagcagcagcagcagctccagcagcaacagcagttacaacagcagcaacagcagcagcttcagcagcagcagcaacttcagcagcagcagttgcaacagcagcaacagcagcagcagctacagcagcagcagcagcagcagcttcagcaacagcaacagcaactgcagcagcagcaacagcaacagcagcaacagttccagcaacaacagcagcaacagcagatgggtttactgaaccagtctagaactcttctgtcccctcagcagcagcaacagcagcaggtcgcacttgggcctggcatgcctgctaagccactgcagcacttttcatcccccggagcgctcggccctacgttattgcttaccgggaaggaacagaacaccgtggatccagccgtcagctccgaggctacggagggtccgtctactcaccaaggaggaccactggcaatcggcacaactccagaaagtatggctacagaaccaggcgaagttaagccttcattatcgggggacagccagttgctgctcgtacaaccccaaccccaaccacagccctcctccttgcagcttcagcctcccctgcggctgcccggacagcagcagcagcaggtatccttgctgcatacggccgggggagggtctcacgggcagctcggttctggctcgagctccgaagcctccagcgtgccacatttgcttgcacaaccctctgtatcacttggcgatcagcccgggagcatgacacagaatttgttgggcccgcaacaacccatgttggagcggccgatgcagaacaatacgggtccgcaaccgcccaaaccaggcccagttcttcaatccggtcaaggcctgcccggtgtgggaatcatgcctaccgtgggccagctgcgggcacagctacagggcgtcctggcgaagaacccccagttacgtcacctctccccccagcagcagcagcagctccaggccctgcttatgcaacggcagttgcagcaatcacaggctgtccggcagactcctccctatcaggagccgggaacgcagaccagtcctctacagggccttctggggtgccaaccgcagctggggggtttcccaggtccccaaaccgggccactccaggagctcggcgctggcccgaggccacaaggcccgcccagattgcccgcccctcctggcgctctgtcaaccgggcctgtgcttggccctgtccatccaacaccccccccatcatcgcctcaagagcccaaaaggccctcacagcttcccagcccctcgtctcagctgccaacggaagctcaacttcctcccacccatcccgggacccctaaacctcaaggtcccaccctcgagccgcctccaggtcgagtcagccctgccgcagcccagctggctgacacgttgttctcaaagggcttaggtccctgggaccctccggataatctggccgaaacccagaagcccgagcaatcttccttggtgcctggccatctcgaccaggttaacggacaggtcgttccagaagccagccagctgtccattaagcaggaaccacgggaggaaccttgcgcactgggagctcagagcgtaaaacgcgaggcgaacggagaacccattggggcacccggcacaagtaaccacctcttgctcgccggccccaggtctgaagctggacatctgcttttgcagaaactgctgagggctaagaatgtccagctgagcactggaagagggagcgaaggacttagagctgagatcaacggacatatcgacagtaagcttgctggactcgaacagaagctccaaggtaccccgagtaataaagaagacgccgcagcaaggaagcccctaacccctaagccaaagcgcgtgcagaaggcgagcgaccggttggtgtcctcccgcaagaagctgcgcaaagaggatggcgtccgggcttccgaagcgctgctgaagcagttgaagcaggaactgagtctgttgccactgacagaacccgctattacagctaattttagtctttttgctccgttcggatcagggtgccccgtgaacggccagtctcagttacggggcgccttcggttctggcgctctgccaactgggcccgattactattctcagctgctgaccaagaataacttgagcaaccctcctaccccccccagcagcctcccccccacaccccctccctcagttcagcaaaaaatggtgaacggagtcacaccgagtgaggagctcggagagcatcctaaggatgccgccagtgctagggactccgagcgagctctgagggacacaagtgaggtcaaaagcctggatctgctggctgcactccccacaccaccccacaatcagactgaagacgtgcggatggaatccgatgaggatagtgatagccctgactccattgtgcctgcctccagcccggagtcaatacttggagaagaggccccgagatttccccatttaggatccgggcggtgggagcaggaggatagagcactgtctcctgtgatccccttgatccctcgcgccagcatcccagtgttccctgatacaaagccttacggggctctgggacttgaagttccgggaaaacttccagtcacgacatgggagaaaggcaagggaagtgaggttagcgtaatgttaactgttagtgcagctgccgcaaagaacctgaatggggtaatggttgccgtggccgagcttcttagcatgaagattccgaattcctatgaagtcctgtttccagagagtcccgctagagcagggacggagcctaagaagggcgaagcggagggccctggggggaaggaaaagggtttggagggcaagagccccgacactgggccagattggctcaagcagtttgacgccgtgctgcctggctacaccctgaaaagccaattggacatactgagcctattgaagcaggagtctccggcccctgaacctcccacgcagcactcctacacctataacgtgtctaatttggatgtgcgccagctatctgccccacccccagaggagccttcaccgccaccatcacctttggccccatctccagcctctcctcctactgaaccacttgtggagctgccaactgaaccccttgcagaacctccggtcccttcccctcttccattggccagctccccggaaagtgcgagacctaaacctagagccaggccacctgaggaaggtgaggattcacgccccccccgtctcaaaaaatggaaaggcgtacgatggaagcgtctccgactcctgctgacaattcaaaagggaagcggccggcaggaagatgagcgagaggtcgctgagttcatggagcagctcggaacagccctccgccccgataaggtcccaagagacatgaggaggtgctgtttttgtcacgaggaaggcgatggcgctactgacggaccggctcgtctgttaaacctcgatctggatctctgggttcacctgaactgtgcactgtggagcactgaagtgtatgagactcaggggggggcgctgatgaacgtggaagtcgctcttcaccgcgggctgctgaccaagtgtagcctctgtcagcggactggcgctacgagcagttgtaataggatgcggtgccctaacgtgtaccacttcgcatgtgccattcgcgccaagtgcatgttcttcaaggacaaaactatgctgtgtccgatgcataaaatcaaaggaccctgcgagcaggaactgtccagcttcgctgtgtttagacgtgtatacatagagcgggacgaagtgaaacaaatcgcttctattattcagcgcggggagcgcctgcatatgtttcgagtgggcggcctcgtgttccatgccattggccaacttctgccccaccaaatggcagactttcattcagctaccgccttataccccgtaggatacgaagccacacgtatttactggtctctgaggacgaataatcggcgttgttgttaccggtgcagcattggggagaacaatggcagacctgagtttgtaattaaggtaatagaacagggcctggaagacctagtgttcacagatgcttctcctcaggccgtctggaataggattattgaacccgttgccgccatgagaaaagaggctgatatgctgagactcttcccagaatacttgaaaggggaggaattgtttggcctaaccgtgcatgctgtattacgaatcgcagagtccttgcccggggtggagagctgtcagaattatctgtttcgttacggcaggcaccccctgatggagctgccattgatgatcaatccaacaggatgtgcccgatccgaacctaagatcctgacccactacaaacgacctcacacactgaattccacctccatgtccaaggcctatcagtcaacctttacaggggagaccaacacgccgtattctaagcagtttgttcattccaagagttcacaatacaggaggctgcggaccgagtggaagaacaatgtgtatctggcgcgtagccgaatccaaggcttgggcctgtatgcagcaaaggacttagagaagcacaccatggtcatagagtatattggaaccatcatcagaaatgaggtggctaatagacgtgaaaagatctacgaagagcagaaccgcggaatttatatgtttcgcattaataatgagcacgttatcgatgcaacattgaccggaggacctgctcggtatatcaaccatagttgtgccccaaactgtgtggccgaggtggtaactttcgacaaggaagacaagatcatcattatatcttcacgccgtatccctaagggagaggaactgacgtacgattatcagttcgatttcgaagacgaccagcacaagattccatgtcactgcggagcctggaattgtcgaaaatggatgaactag

SEQ ID NO: 125254 - DNA, 441 bp, Artificial Sequence
  Description of Artificial Sequence: Synthetic coding sequence
atggactcccaaaagcttgccggagaagataaggactcggagccagccgccgacggacccgcagcttccgaggacccatctgcaaccgaaagtgatctgccaaatccccacgtgggggaggtgagcgtactgtcttccgggagccctaggctgcaggagactcctcaagactgttcgggtgggcctgtgcgccggtgtgctctttgtaattgcggtgagcctagcctgcatggccaaagggaacttagacggtttgaactgccatttgattggcctcgatgccctgtggtgtccccagggggctcccccgggcctaatgaggctgtgcttccttccgaagacctcagtcagataggctttcctgaggggctgacccccgcccacttgggagagcctggaggatcctgttgggctcaccactggtgcgcagcctggtcttag

SEQ ID NO: 125255 - DNA, 14736 bp, Artificial Sequence
  Description of Artificial Sequence: Synthetic coding sequence
atgtcatctgaggaagacaaaagtgttgaacagccacagcctcctcctccgccccctgaggagccaggcgcccctgctcccagtcccgcagccgcagacaagaggccgagaggccggccacgcaaggatggcgcttccccatttcaacgggcccgaaaaaagccccggagtcggggcaaaacagctgtagaggacgaggactctatggatggtctcgagacaaccgagaccgaaacgatcgtagagaccgagatcaaagagcagtccgcagaagaagatgcggaagccgaggtggacaacagcaagcagctcattcccactctacagcgttctgtgagcgaggaatctgctaacagcctcgtctctgtgggggtggaagccaagatttcagagcagctatgcgcattttgctattgtggcgagaaaagctcccttggccagggggatctcaaacaatttcggatcacccccggcttcatcctcccctggcgaaatcagccttccaataaaaaggacattgatgacaatagtaacggtacatacgagaaaatgcagaactcagcgcccagaaaacagagaggacagagaaaagagcgcagtccccagcagaatatcgtttcgtgcgtttctgtctcgacccagaccgcaagtgacgatcaggcgggtaagctttgggacgaactttctttagtgggcttgcccgatgcgatcgatattcaggctctcttcgatagcacaggtacctgctgggcccatcaccgctgcgtggagtggtctctcggggtttgccaaatggaagagccccttcttgtgaatgtcgacaaggctgtcgtgtccggatcgactgaacgctgcgcgttctgcaagcatcttggagctacaattaagtgttgcgaagagaagtgtacccagatgtatcactacccgtgcgcagcgggcgccggaacctttcaggacttcagtcatatctttttgctctgccccgagcatatcgatcaagcccccgagcgcagcaaggaggacgctaactgcgcagtgtgcgactcacccggagatttgctggaccagttcttttgcaccacctgtggccagcattaccatggaatgtgcctggatatcgcagtcacaccacttaaacgcgctgggtggcagtgcccggagtgcaaggtgtgtcagaattgcaagcaatccggggaggattctaagatgctggtttgtgacacttgcgataaaggatatcatacattttgtctgcagcccgtcatgaagtccgtacctaccaatggctggaaatgcaagaattgtaggatctgtatcgagtgcgggacccgatccagttcccagtggcaccacaattgcctgatttgcgataattgttatcagcagcaggacaacctctgtccattttgtgggaagtgctaccacccagagctgcagaaagacatgttgcactgtaatatgtgtaagcgctgggtacacctagagtgcgacaagccaacggaccacgaactggacactcaattgaaggaggaatatatctgcatgtattgtaagcatctaggcgccgagatggatcgcctgcagcctggcgaagaagtggaaatcgctgagctgacaactgactataataacgagatggaagtggagggtcccgaggaccagatggtcttttccgaacaagctgcaaataaggatgtgaatgggcaggaatcaacccccgggatcgtcccagacgctgtgcaggtgcataccgaggagcagcagaaaagtcacccctctgagagcttggatactgactcactactcattgccgtgagttcccagcacacagtgaacacggagctggaaaagcagattagcaatgaggtagattcggaggacctcaagatgagcagcgaggtgaagcatatctgcggagaggatcagatcgaggataaaatggaggtgacggagaatatcgaagtggtgacccatcagattacggtgcagcaggaacagctccaactcctggaggagccagagactgtcgtttcgcgagaggagagtaggcccccaaaactcgtcatggagagcgtgacgctgccgctggaaacccttgtttcccctcacgaagaatcaatttctctgtgtcctgaggagcagctggtgatagagaggctccagggcgagaaggaacagaaggaaaacagcgagctctccacaggcttaatggactcggagatgacaccaactattgaaggctgcgttaaagacgtcagctaccagggtggtaagagtatcaaactgtcatccgagaccgaatctagctttagctcctctgccgacatctcaaaagccgatgtttccagtagtcctactccctcttccgacttgccctctcatgatatgctgcataactaccccagtgccttgtcttcctccgcaggaaatatcatgccaactacttacatcagtgttacacctaaaatcggtatggggaaacctgccataaccaagaggaaattctctcccgggcggccaaggtcgaagcaaggcgcttggagtacccataacacggtgagccctcccagctggtccccagacatctccgaggggagagagatttttaagcccagacagctccctggatccgctatatggagcataaaggtgggaagggggtctggattcccaggaaagcggcgaccacggggcgcgggcctgtcagggcggggcggcaggggacgtagcaaactgaagtcgggaatcggcgcagttgtcctacccggcgtttctacagccgatatcagttctaataaagacgatgaggagaatagcatgcataataccgtggtgctcttctctagctcggacaaatttacgctgaaccaggacatgtgcgtcgtttgtggatcattcgggcagggtgcggaaggcagattgctagcctgttctcagtgtggccagtgttaccacccatattgcgtaagtataaagatcaccaaggttgtgcttagtaagggatggagatgtctggaatgcacagtgtgtgaagcttgtggtaaggcaacggacccgggaagactcctgctgtgcgatgattgtgacatatcttaccacacttactgcctggatccacctttgcagaccgtgcctaaaggtggttggaaatgcaagtggtgtgtttggtgcagacattgcggagcaacctccgcggggcttcgatgcgagtggcagaataactacactcagtgcgccccatgcgctagcctgtcttcctgcccggtctgttaccggaactatcgtgaggaagaccttatcctccagtgtcggcagtgcgacaggtggatgcacgccgtgtgccagaatctgaatacagaggaagaggtagaaaacgttgcagacattggttttgattgttccatgtgccgcccctatatgcctgcttccaacgtgccctccagcgactgctgcgaaagcagcctggtagcgcagatcgtcaccaaagtgaaagaattagatcccccaaagacctatacccaggacggagtgtgcctcacagagtcaggcatgacacagctgcaatccctgacggtaaccgtgccacgccggaagagaagtaaaccgaagctgaaactcaaaataattaatcagaatagcgtggccgttttacagacccctcctgatatccagtctgaacacagcagagatggggagatggatgattcaagggaaggggagctgatggattgtgatgggaagtccgagtcatcgcccgaacgcgaggctgtggatgacgagactaaaggagtggagggaaccgacggcgtgaagaaacgcaagcgcaagccttacaggcctggcattggcggattcatggttcggcagcgtagtcggacaggtcagggtaagaccaaaaggtctgtgatccgcaaggactcttcaggctccatttcagaacaactgccctgtcgggacgacggctggtctgagcagctgcctgatacgttagtcgacgaaagcgtttccgtcacagaatccaccgagaaaatcaaaaagcggtataggaagcgcaaaaacaaattggaggagacattccccgcttacctgcaggaagctttcttcgggaaggatctgttagacacaagtagacagtccaagatcagcctggataatttatccgaggatggtgcacaacttctttataaaacaaacatgaatactggatttcttgatccaagcttggatcccctattgagcagtagtagcgcaccaaccaagtctgggactcacggccccgccgacgatcccctggctgatatcagtgaggtgctgaataccgatgacgatatattgggaattatcagtgatgacctggcaaaatctgtggaccactctgatatcggccccgttaccgatgacccaagttccctcccgcaacctaacgtcaatcagtcatcaagaccactgagtgaagagcaactggacggaatactcagcccagagctagataaaatggtgacagatggggccatcctgggcaagctgtacaaaattcctgagctggggggcaaagacgttgaggacctgttcactgccgtgctgtctcccgccaatactcagcccaccccactgcctcagcccccaccccccacccagcttctgcctattcataatcaagatgcctttagtcggatgcctctcatgaatggcctgatagggtctagccctcatttgcctcacaactctctgccacccggatccggcctgggaacattttcagctattgctcagtccagctacccagacgcaagggataaaaactccgcctttaatccgatggccagcgatccgaataacagttggacgtcttcggcacccaccgttgaaggagagaacgataccatgtccaacgcccagcgctcgacactgaagtgggaaaaagaagaagcactgggcgagatggctactgtggcgccggtgctgtacacgaacattaatttccctaacttaaaagaggaattcccagactggaccactcgggtgaagcagatcgcaaagctgtggcgtaaggccagctcccaagagcgggcgccgtacgtccagaaagccagggacaacagggcggcattgcgaattaacaaagtccagatgtccaatgatagcatgaaacgccagcaacagcaggactccatcgatccaagctccaggatagattccgagctcttcaaagatccgctgaaacagcgggagtccgagcatgaacaggagtggaaatttcgacagcagatgcggcagaaatctaagcagcaggcgaagatagaagctacacagaaactggaacaagtaaaaaacgagcaacaacagcagcagcaacagcagttcggcagccagcacctgctagtgcaatccggctcagatacgccatccagtgggattcagtcccccctgacaccccagcctgggaatggtaacatgagcccagctcagagctttcacaaggagctctttaccaagcagcctccctcgacccctacctccacatcgagtgacgatgtgtttgtgaagccgcaggccccacccccccctcctgcccccagcaggatccctattcaggactctctgtcacaggcacagactagccagcccccaagtccgcaggtcttctctcctggctccagcaatagtcggcccccgtccccgatggatccgtacgcaaagatggttggcactcctcggcccccacccgttggacattccttctcccgtaggaacagcgcggctcctgtcgagaactgcactcctttgagttcggtctcccgccccttacagatgaacgaaacgactgccaaccggccctcccctgttcgagatctctgttcaagctcgactacgaataatgacccatacgctaaaccaccagacacaccacgccctgtgatgacagatcagttccctaaatccctgggtctctcaaggagtcccgtggtgagcgagcagacggcaaaggggcccattgctgccggaacttccgaccatttcactaagccctcacctcgggctgacgtatttcaacggcaaagaattccagacagttatgctaggccattactgacaccagctcctttggattccggacccgggccttttaaaacccctatgcagccaccgccctccagccaggacccctatggatcagtcagtcaagccagcaggaggctctctgtcgatccttacgaaagacccgcgttgacacctcggcctatcgacaactttagtcataatcagtctaatgacccctactctcagccaccactgacacctcacccagcagtgaacgagagcttcgctcacccttcgcgcgcatttagtcaacccggaactatcagtcggccaacatcccaggacccatattctcagcctcctggtacgccgcggcccgtggtggactcgtattcacagagctctggcaccgcacgtagtaacacagatccctactctcaaccacccgggacccctcgacccaccacggtcgacccatattctcagcagccccaaactcctcggccaagtacacagacagatctgtttgtcacacctgtaaccaatcagcgccattctgacccctatgcgcaccccccgggcacaccccgcccaggaatctctgtgccatacagccagccgcctgccaccccgcgcccgcggatatctgaaggatttactcgaagctcaatgacacgcccagtgctgatgcctaatcaggaccctttcctccaggcggctcagaacaggggacctgccttgcctggccctctggtgagacccccagacacctgctctcagacaccacgtccgccgggtccgggactgagtgacacttttagcagggtaagtcctagtgctgccagagatccctatgaccagtctcccatgacccctcggtcccaatcggactcattcggcaccagccaaacagcgcacgacgtagcggaccagcctaggcccggttccgagggtagcttttgcgccagttccaactcccctatgcattcccaggggcagcagttctctggcgttagccagctgcctgggcctgtgcccacaagtggagttaccgatacacagaacaccgtcaacatggcacaagccgacactgagaagctaagacagcgacagaaattacgggagatcattctgcagcagcagcaacagaagaagatcgcggggagacaggagaaaggaagccaagattcccccgccgttccacaccccggcccccttcagcattggcagccagagaacgtcaaccaagcctttactcggccccccccaccatatcccggcaatatccgttcgcctgtagcacctcctctcggtccaagatacgctgtctttccaaaggatcagaggggaccctaccctccagatgtggctagtatgggcatgcgaccacatggatttcggtttggattcccgggaggctcacacggcactatgccctcccaggagcgctttctcgtgccgccgcagcagatccagggatccggggtctcccctcagctgcggagaagcgtatctgtcgatatgccgcgtccactgaataattcccagatgaataatcctgttggactcccgcagcacttcagcccacagtctctgcccgtccagcagcataacatcctaggtcaggcgtatattgaactaaggcatagggcgccagacggccggcagagactgccctttagcgcgccgccgggtagcgtggtggaggcttctagcaatctgagacacggaaacttcattccgagacccgacttcccaggcccgagacacaccgatccgatgaggcggccaccacagggattgcccaaccagctgccagtccaccctgacctggagcaggtccccccatctcaacaagaacagggacactcggtgcattctagctccatggtcatgcgcactcttaatcaccctctgggcggggagttttctgaagccccactttccacttcggtgccttccgaaaccactagcgacaacctccagataaccacccagcctagcgacggtctggaggaaaagctcgattcagacgacccgtcagtgaaggaattggatgtgaaggaccttgagggggtggaggtgaaggatctcgatgatgaggatctcgaaaatctcaatctggacaccgaagatggcaaagtggtggagctggacactctggataatctagagacaaacgatccaaacctggacgatctgctgcgatctggagagtttgatattatcgcctacaccgatccagagttggacatgggggataagaagagtatgtttaacgaggaacttgacctgccaattgacgacaaactggataaccagtgtgtctcggttgagccaaagaaaaaggaacaggagaacaagacccttgtgttgtcagataagcacagtccgcagaaaaagtcgactgtgacaaacgaagtgaaaaccgaagtcctgagcccaaatagtaaagtggaaagtaaatgcgagacagagaaaaatgacgaaaacaaagacaatgtggacaccccatgctcccaggcctctgctcattcggacctgaatgacggagagaagacatccctccatccttgtgatcccgatttgtttgagaaacggaccaacagggagaccgcaggacctagcgccaatgtcatccaggcttcaacccagctccctgcacaagatgtgatcaactcatgtggcattacaggctccacacctgtcctgtcctctctgctggctaatgaaaagtccgacaatagcgatatccgaccttctgggagcccccccccacctaccctacccgcctccccgagcaatcacgtcagtagtttacccccctttatagcgcccccaggcagggtgctagacaacgctatgaactcaaacgtgacagtggtgagtagggtgaatcatgttttctcccagggagttcaggtcaatcctgggctgattcctggacagtcaaccgtgaatcatagcctcggcactgggaaaccagccacccagaccggcccccagacgtcccagtcgggcactagctccatgtctggtcctcaacagctcatgattccccagacacttgcccagcagaatcgcgagagaccattattgctggaggagcaacctctactgctacaggatctgcttgatcaggagcggcaggagcaacagcagcagcgtcagatgcaggctatgataagacaacggagcgaacccttcttcccaaacattgactttgacgcgatcaccgaccctatcatgaaagcaaagatggtggccttgaagggtatcaacaaagtcatggcacagaataatctcggtatgccacccatggtcatgtcacgttttccattcatgggccaggttgtgaccggcacacagaattctgaagggcagaatctcggcccgcaggctatcccccaagacggctcaatcactcaccagatcagccggcccaacccgcccaacttcggccctggcttcgtgaatgattctcaaaggaagcagtatgaggaatggttacaggagacccagcaactactccaaatgcagcaaaaatacttggaagagcagataggagcccacaggaaatctaaaaaggctcttagcgccaagcagaggacagctaaaaaggctggaagggaatttccggaagaagacgctgaacagctcaagcatgtgactgagcagcaatcaatggttcagaaacagctcgagcagataagaaagcaacagaaagagcacgcggaactcatagaggattatcgaataaagcagcagcagcaatgcgccatggccccgccaacaatgatgcccagtgtgcagccccagccccctctgattccaggagccaccccccccacgatgagccagcctacgtttcctatggttcctcaacagctgcagcatcaacagcacacaactgttatcagcggccacacctcgcccgtaagaatgccctccctgccgggttggcaacccaatagcgctcccgctcacttacctctgaatcccccacggatccagcctccaatcgcgcaactccccataaaaacatgcaccccagctccgggcacggttagcaacgctaatcctcagagcggtcccccgccccgggtggagtttgacgacaacaatcctttttccgaaagcttccaagaaagagagcggaaggaacgcctccgggaacagcaggaaaggcaaaggattcagctcatgcaagaagtagataggcagagagccctgcagcaacggatggagatggagcagcacggcatggtggggtcagagatatcctccagtcgaacatccgtctctcagatccctttctattccagcgacctgccatgtgactttatgcagcccctgggccccctgcagcagagcccccagcaccaacagcagatgggtcaagtgcttcagcagcaaaacattcagcaaggctctatcaactctccctcgacacagacattcatgcagaccaacgagcggcgccaggtgggtccaccctccttcgttccggactcgccatcgattcctgttggtagtccaaacttctcatccgtgaagcagggccatggcaacctatcaggtacctcatttcagcagagccctgttagaccctcatttacaccggcgcttcccgcagcaccgccagtcgccaattcttctctgccttgtgggcaagacagcacaatcacccacggacactcctacccaggatccacgcagagcttgatccaactttactccgacatcatcccggaggaaaaaggaaaaaagaaacggactcgaaaaaaaaagagggatgacgatgctgagtccacaaaggcaccgtctacccctcactcggatattacagccccaccaacccccggtatctcagagacaacgagcacgcctgctgtgtccacgccctctgaactgcctcagcaagcagaccaggagagcgtggagcctgtgggcccctcaacacccaatatggccgccgggcaattatgtacagaactcgaaaacaagctgcccaactctgatttctctcaggctacaccaaaccagcagacatacgcgaattccgaggtcgacaaactcagtatggagacccctgcaaagaccgaagagatcaagctcgagaaggccgagaccgaatcttgtcctggccaagaggaacctaaactcgaggagcagaacgggagcaaggtagagggcaacgctgtggcctgcccagtgagctcagctcagtcccctcctcactcggctggagccccagcggccaagggtgattccggcaacgagctgttgaagcatctgctgaaaaataaaaagtccagcagcctgttaaaccagaagccggaggggtccatttgctcagaggatgactgcactaaggacaataaactggtcgaaaaacagaacccggcagaaggtttgcagaccctgggggctcaaatgcaggggggcttcggatgcggcaatcagctccctaagacggatggaggcagcgagactaagaagcagcgatccaaacgcacacagagaaccggcgagaaggcggcaccacgtagcaagaagaggaaaaaggacgaggaggagaaacaagctatgtactcttccactgacaccttcactcacctgaagcagcagaacaacctatcaaaccctccaacgcctccagctagcttacctccaacccctccaccaatggcctgtcagaagatggccaacggcttcgctaccaccgaggagcttgcaggcaaggcaggcgtgctcgtcagtcacgaagttaccaaaacgcttggccctaaaccttttcagctgcccttccggcctcaagacgacttgctcgcccgcgctctcgcccagggtcccaagactgtagacgtgccagcctccctcccgacccctcctcacaacaaccaggaagaactgagaattcaggaccactgcggagatcgggataccccggacagctttgtcccatcttcctcccctgagtcagtcgttggagtggaagtgtcacggtatcctgatctgtcactggtaaaggaagaacctccagaacctgtacctagccctatcatccccattttacccagtacggcgggaaagtcctcagaaagtcgcagaaatgacataaaaactgaaccagggaccctgtatttcgccagtccttttggccccagcccaaacgggcctcgaagcggcttaatttcagtcgccataaccctccatcccactgctgccgaaaacatcagcagcgtggtagccgcttttagtgatctactgcatgtgaggatacccaactcatatgaagtgtccagtgcccccgatgtcccttctatggggctcgtctcatcccatcgtatcaaccccggtctggagtatcgccagcatttgctgttgaggggcccaccccccggatccgcaaaccctccacgcctagttagctcgtaccggcttaagcagcccaacgtccccttcccacccactagcaatggcctgtctgggtataaagattctagtcacgggatcgcggagagcgctgccctcagaccacaatggtgttgccactgcaaggtggttatccttggcagtggggtacggaagagtttcaaagacctgactctgctcaacaaggattcaagagagtccaccaagcgagttgagaaagatattgtcttctgtagcaacaattgtttcatactctactcctcaactgctcaggcgaaaaatagtgaaaataaagagagcatcccaagcctcccacagtcccccatgcgcgagactccaagcaaggctttccaccagtattcaaacaacattagtacactggatgtacattgtttacctcagctgcctgagaaggcgtccccaccagctagccctccgatagccttcccacccgccttcgaggccgcacaggtggaggccaagccagacgaactgaaggtcactgtgaagctgaagcctcgacttagagcggttcatggcgggtttgaggattgcaggccgttgaacaaaaagtggcgaggcatgaagtggaagaaatggtcaattcatattgttattcccaaaggcacatttaagccaccttgtgaagatgagatcgatgagttcctaaagaaactgggaacctcccttaagcctgatccagtcccaaaggactaccgcaaatgctgtttctgccatgaggagggagacgggctcaccgatgggccggcaagactccttaatctggatctggatctgtgggtgcaccttaactgcgccctgtggagtactgaagtgtacgaaacgcaggcgggtgcactgatcaacgtcgagctggccctaagaaggggactacaaatgaagtgtgtattttgccacaaaactggcgccaccagcggctgtcaccgcttccgttgtaccaacatttatcattttacttgcgccatcaaggcacaatgcatgttctttaaggacaaaaccatgctgtgccctatgcacaagcctaaggggatacatgaacaagaattgtcttactttgctgtgttccgccgggtgtacgtgcaacgcgatgaggtccgtcaaatcgcctctattgtccagcgcggagagcgagaccacacattcagagtcggatctctaatcttccacactatcgggcagctgctgccacaacagatgcaggcctttcacagccctaaggccctcttccccgtggggtatgaggctagcaggctgtactggagcacaaggtacgccaatcgccgttgccgctacctgtgcagcatagaagaaaaggacggcaggcccgtgttcgtgataaggatcgtcgaacaggggcatgaagatcttgtcctgtcagacatctccccgaaaggcgtgtgggataaaatcctagagcctgtggcctgcgttaggaagaaatccgaaatgctgcagctctttccagcctacttgaaaggagaggacttattcggcttaacagtttctgcagttgcgcgaatcgcagaaagcctgccgggggtggaagcctgcgagaactataccttccggtacgggagaaatcccctcatggagctccccctagccgtgaatcctaccggctgtgcccgatctgagcccaagatgtcagcccatgtgaaacgctttgtcctgcgtcctcataccctcaacagcacttccacctccaagagttttcagtctaccgtgaccggtgaactcaatgccccatactccaaacagtttgtacactctaaatctagccagtacaggaagatgaaaaccgaatggaagagcaacgtgtaccttgcaaggtcccgtatacaggggctgggcctgtatgcagcccgagatatcgaaaaacataccatggttattgaatacataggaactatcatccgtaacgaggtggccaacaggaaggaaaagctgtacgagagtcagaacaggggagtgtacatgtttagaatggataatgatcatgttatcgatgctaccctgacaggaggaccagcgcgatacatcaatcattcgtgtgcccctaattgcgtggctgaggtggtgacgttcgagcggggccataagatcattatctcctcctcacggcggattcagaagggcgaagagttgtgttatgattacaagttcgattttgaggacgatcaacataaaattccctgccattgcggtgccgtgaactgtcggaaatggatgaactag

SEQ ID NO: 125256 - DNA, 14907 bp, Artificial Sequence
  Description of Artificial Sequence: Synthetic coding sequence
atgagcagcgaagaggataagagcgtggagcagccccagcctcctccgcccccgccagaggaacctggtgccccagcaccctcacccgctgccgccgataaaaggcctcggggaagaccccgcaaagacggcgctagccctttccagcgtgcccgaaagaaaccgagatcccgcggaaagaccgctgttgaagacgaggacagcatggacggattagagacaaccgaaaccgaaaccatagtcgagactgagattaaagaacagtccgctgaggaagatgcggaggccgaagtggacaacagcaagcagctgattcccaccctccagagaagtgtgagcgaagagagtgccaatagcttggtgagcgtcggagtagaggctaaaatctctgaacagctgtgtgcattttgctactgtggggagaaaagctcgctcggccagggtgacctgaagcaattcagaataacacctggcttcattcttccttggcggaaccagccatcaaacaagaaggatattgacgacaattccaatggaacctatgaaaagatgcaaaactccgccccaagaaaacagaggggccaacgtaaggagcggtcaccacagcagaatattgtgagctgcgtgagtgtgtctacgcagaccgcctcggacgatcaggccggaaagctttgggatgaactttctctcgtcgggttgcccgacgcgatagacattcaggccctctttgactctacagggacatgctgggctcatcatcgctgcgtggaatggagtctgggggtgtgtcagatggaagagccactcctagtgaatgtggataaggctgtggtctccggctccacggaaagatgtgccttttgtaagcatctgggggctaccattaagtgctgcgaagagaaatgcactcagatgtaccactacccgtgcgccgccggcgcaggcaccttccaggacttctctcacatctttctgctttgtccagagcatatcgatcaggccccagagagatccaaggaagacgccaattgtgcggtttgtgacagtcccggcgatttgctagaccaattcttctgtactacgtgcgggcaacattatcatggtatgtgcctggatattgccgtcaccccactgaaaagggctgggtggcagtgtccggagtgtaaggtgtgccagaactgtaaacagagcggtgaagatagcaagatgctggtgtgtgacacctgtgacaagggctaccacaccttctgtctgcagccagtgatgaagagcgttcctaccaatggttggaagtgtaagaactgtaggatctgtatcgagtgcgggaccaggtcctcttcacagtggcatcacaactgtttgatctgtgataactgctaccaacagcaagacaatctttgtccattttgtggcaagtgctaccatccggagctccagaaggacatgctgcattgcaacatgtgcaagagatgggtccatttagaatgcgacaaacctactgatcacgagctggatacccaactaaaggaggagtacatttgtatgtactgcaagcatttgggcgccgagatggacagactccagcctggagaggaagttgaaatcgcagagcttaccactgactataacaacgaaatggaagtggaaggccctgaagaccagatggtcttctcagaacaagccgccaataaagatgtgaacggccaagagagtacacctggaatcgtacctgatgctgtgcaggtacacacagaggaacagcagaagtcccacccttccgaatcactggataccgactccttgctgatcgccgttagcagccagcataccgtgaatacagagctggagaagcaaatcagtaacgaagtcgactctgaagatctgaaaatgagctcggaggttaagcatatttgtggtgaagaccagatcgaggacaagatggaagtgacagagaacattgaggtcgtaactcatcagatcactgtacaacaggaacaactgcaattgttggaggagccggaaacagtcgtgtcccgcgaggaaagtcgccctccaaagctggtgatggaatccgtgactctgcctctggaaaccctggtttccccccatgaagagtccatctctttgtgccctgaggaacaactggtcattgagcgcctccaaggagaaaaggagcagaaagagaactcggagctatcgacagggcttatggattcagaaatgacgcccactattgaaggttgcgtcaaggacgtttcgtatcaaggggggaagtcaatcaaactttcatctgagacggaatcatcattctccagctccgccgatattagcaaggctgatgtcagttcctctcctacccctagtagcgatcttcctagtcatgacatgttgcacaattacccttctgcattgtccagtagcgcaggaaacatcatgccgacaacttacatctctgtcactcccaaaatcggtatgggtaaacctgctatcaccaaacgcaaattttcacccggcagaccacgctctaagcaaggagcctggtccacccacaacactgtgtctcctcccagctggtcgcctgacatcagcgagggccgtgaaatattcaaaccaaggcagctccctggctcagctatttggtcaattaaggttggccgggggagcggattcccggggaagcggcggccacgaggagccggactgtccggaagaggcggacgcggtcgctcaaaactgaaatccgggattggggccgtcgtcctcccaggggtttccacggccgacattagttctaacaaggacgatgaagaaaacagcatgcataacacagtggttttgttctcttcttcagataagttcacacttaaccaggacatgtgcgtggtttgtgggagcttcggccagggggcagagggaagattgctggcttgtagccagtgtggccagtgctatcacccatactgtgtcagtatcaaaattacaaaagtcgtcctttctaaaggttggcggtgcctggagtgcaccgtgtgtgaagcatgcggaaaggccacagatcccggcaggctattgctgtgcgatgactgcgacatctcttaccatacttattgtctagacccacctttgcagactgtacctaagggagggtggaagtgtaagtggtgtgtttggtgtagacattgcggagccacaagcgcgggcctaaggtgcgaatggcagaataattacacacagtgcgccccatgcgcatccctctctagttgtcctgtgtgttacaggaattatcgcgaagaggatctcatactgcagtgccgacaatgtgacaggtggatgcatgctgtatgccagaaccttaacacagaagaagaggtcgaaaacgtcgccgatatcggcttcgattgttctatgtgtaggccctatatgcccgcgtctaatgtgccaagtagcgactgctgtgagagtagtttagttgctcagatcgtgacaaaagtgaaggaactcgaccctcctaagacttacacacaagacggcgtctgcctgaccgagtctggtatgacccagcttcaatcgctgactgtcaccgtgcccagacgtaaaagatcaaaaccaaagctgaaattgaagatcataaaccagaactcagtggcagtgctccagactcctcctgatatacagtctgagcatagccgtgatggcgaaatggatgatagccgagaaggcgaactaatggactgcgacggaaagtctgagtctagtccggaacgggaagccgtcgacgacgaaacaaaaggcgttgagggtacagacggtgtcaaaaagaggaaacgcaagccttacaggccgggcatcggggggtttatggtgcggcagcgatccaggacgggacaaggaaaaactaagagatccgtgattagaaaagattcctctggctccatatccgagcagctgccatgtagagatgacggatggtctgagcaactgcccgacaccctagtcgacgaaagcgtttctgtgactgaaagcacagagaagatcaaaaagaggtatcggaagcgcaaaaacaaattggaagagaccttccccgcttacctacaggaagcattcttcgggaaagatctcctggacacctcgcgtcagtccaagatatctctggacaatttgtccgaggacggagcccagctgctttacaagaccaacatgaacaccggattccttgacccctccttagacccgctcttatcgtcctcgtctgcaccaacgaagtcaggcactcatgggcccgcggatgatcctcttgccgacattagcgaagtgcttaataccgatgacgacattctggggatcattagtgacgacctggcaaaaagtgtggatcattctgacataggccccgtgacagatgacccctctagtctcccacagccaaatgtgaaccagtcctccaggccactttcagaagaacagttagacgggatcctctcacccgaattggacaagatggtgacggacggagccatcttaggcaagctctataagatcccagagctgggtggaaaggatgtggaggacctgtttaccgccgtgctgagccccgcaaatacacagcccacccccctgccacagcccccaccacccacccagctgctgccaatacataaccaagacgccttcagtagaatgcctttaatgaatgggctcatcggatcaagcccgcacctccctcacaattccctcccaccaggatcagggctgggtacttttagtgcaattgcacagtcttcttacccagacgcccgagataaaaattctgcgttcaatcccatggcttccgaccccaataatagttggacctcgagtgcccccactgtcgaaggcgagaacgatactatgtcaaacgcacaacgcagcaccctgaagtgggaaaaggaggaagccctgggggaaatggccaccgtggccccggtgctgtacaccaatattaacttccctaacctcaaggaagagtttccagactggacaacaagggtgaaacagattgctaagctctggcgcaaagcctcctcgcaggagcgcgcaccatatgttcagaaggcaagggacaaccgtgctgccctgcggattaataaggttcagatgtccaacgatagtatgaagagacagcagcaacaagattcaatcgatccaagctcccgcatcgactctgagctcttcaaagacccgctgaagcagagagagagcgagcacgagcaagagtggaagttcagacagcagatgagacagaagtccaagcaacaagcgaagattgaggcaacccagaagcttgagcaggttaaaaacgagcaacagcagcagcaacagcagcaattcggaagccagcacctgctggtacagagtgggagcgatactccctcttctgggatccaatcccctctgaccccccaaccagggaatggcaatatgtcccctgctcaatcttttcacaaggaactgtttactaagcaaccccccagcactcccacctcaacatcgagcgatgatgtgttcgtgaaaccgcaggccccgcctccccctccagctccatccaggattccaatacaggatagcctgagccaggcccagacttctcaaccgccctccccccaggtcttcagtcctggatcctccaatagccgaccccccagcccgatggatccatatgctaaaatggtcggcacaccacggcctcctccggtgggccactccttcagtcgcagaaattcagcagcccccgtggagaactgtacgcctcttagttcggtgtctagaccccttcagatgaacgaaactactgccaatagaccttcccctgttagagatttgtgctccagttcaaccacgaataacgacccgtacgcgaagcctcctgacacccctagacctgtcatgaccgatcagtttcctaagtccctggggctgtcacggagccctgtggtgtcggaacagacagccaagggcccaatcgccgccggtacatctgaccacttcactaagccgagtccccgtgcggacgtgtttcagagacagcggatccccgactcatatgcccgtcctttgctgacaccggcccccctggactctggaccaggtccttttaaaactcccatgcaaccacccccctcctcccaagacccatacggaagtgtttcccaagcatcgcggcgattgagtgtggacccttacgaacgtccagccctgacgccacggccgatagataatttctctcacaatcagtctaacgacccctactcacagccacccctcaccccacatccggcggtcaatgagagctttgctcatccctctcgtgccttttcacagccaggcaccatcagcagaccaacatctcaggacccctactcccaaccgccggggactcccaggcccgttgttgatagctactctcaaagctcgggcaccgcccgctccaacaccgacccctattcacaaccgccgggtactcccaggcctactacagtcgacccctactcccagcaaccccagactccaagacctagcacacagaccgacctctttgtcacgcctgtcacaaatcagcgccactctgatccctatgcccatcccccaggaacgcctcgcccggggatctcagtaccttatagtcagccgccagccactccaaggccccgcatctccgaggggtttactagaagtagtatgactcgacctgtcctgatgcccaatcaagacccctttctccaggccgctcagaatagaggccccgctctgccaggcccacttgtccgacctccagatacttgcagtcagactccaaggccccccgggcctggccttagcgacacatttagcagggtgagtccaagcgctgcccgggatccatacgatcagagccccatgacccctcgtagtcagagtgactcgtttgggacgagccagaccgcacacgatgtcgcagaccagccccggcctgggtccgagggatctttttgcgcatcttccaatagccccatgcactcccaggggcaacaattcagtggtgtgtcacaattgcctggccctgtcccaactagcggcgtcaccgacacccagaatacagtcaatatggcacaggctgacaccgaaaagcttcggcagcgccagaaactgagagagattatcctacagcagcagcagcagaaaaaaatcgctggaagacaggaaaagggatctcaagattcccccgccgtgcctcatccaggcccactgcaacattggcagccagagaatgttaaccaagcctttactcgtcctcctcctccatacccagggaacattaggagtcccgtcgctccacccctgggaccccggtatgcggtgttcccaaaggatcagaggggtccctacccccccgacgtcgcctctatggggatgaggccacatggatttcggttcggcttcccagggggcagccatggcacaatgccctctcaggaacgtttcctggtaccgccccagcaaattcagggttctggcgtgagccctcagttacgccggtctgtgagcgttgacatgcctcgtccactgaacaattctcaaatgaataatcctgttggcttgccacaacacttttctccacagtctttgccagttcagcagcacaacattctaggacaggcatacatcgagctaaggcatcgtgctcctgacggtcggcaaaggctaccctttagtgccccacctggctcggttgtggaggcttctagcaatctccggcacgggaatttcatccccagacccgatttccccggacctcggcacaccgaccctatgcggcgaccaccccaggggctgcccaatcagctccccgtgcacccggacctggagcaggtgccaccttcccagcaggagcagggacacagcgtacactcctccagcatggtgatgcgcaccctcaatcaccctctaggaggagagttttccgaagctcccctttctacaagcgtgcctagcgaaactacgtccgataacttgcagatcaccacccaaccatccgacggactagaggagaagttggactcagacgacccttccgtcaaagagctcgacgtaaaagacctggaaggcgtggaggtcaaggatctggacgatgaggatctcgaaaacctgaacctggataccgaggatggcaaagtggtcgaactagatacccttgacaacctggaaactaatgacccgaatctagatgatctgctgaggtctggggaatttgatatcatcgcatacaccgaccctgagctcgacatgggagataagaaatccatgttcaacgaagaactggatctccccattgatgataaactggacaatcaatgcgtttcagtggaacctaagaagaaagaacaagagaacaagaccctggtgttgagtgacaagcacagccctcagaaaaagagtaccgtgaccaacgaggtgaaaacagaggtactaagccctaactcaaaagtcgaaagtaaatgcgaaaccgagaagaatgacgaaaacaaagacaatgtggacactccgtgctcccaagcttcggcccatagcgacctcaatgatggtgaaaagacatccttacacccctgtgatcccgatctctttgaaaagcgcaccaaccgcgaaaccgcgggcccctcggctaacgtaattcaagcgtccacccagttgcctgcccaggatgtaatcaattcatgcggaatcaccggatctactcctgttctatcttccttacttgctaatgagaaatcagacaacagtgacatccgcccttcgggttccccaccgccccctacattgccagcaagcccctcgaaccatgtatctagtctgcctccatttatcgcgcctcctggccgcgttctcgataacgctatgaacagcaacgtcacagtggtaagccgcgtgaatcacgtgttcagccagggcgttcaggtgaatccgggactgatccctggccagtctacagtaaaccatagcctcggtacaggcaaacccgctacacaaaccggccctcagacatctcagtcaggcacaagtagcatgagtgggccgcagcagctcatgataccacagacactcgcacagcaaaatcgtgaacgacctctcttgttggaggaacaacctctcctgcttcaagacctgctggatcaggagcgccaagagcagcagcagcagcgccaaatgcaagcaatgatccgccagcgatctgagcctttttttcctaatattgattttgacgcgatcactgaccccattatgaaggccaagatggtggcgctcaagggaattaataaggtgatggcgcagaacaacttaggaatgcctcccatggtgatgtctcgatttccatttatgggtcaagtggtaaccggtacccaaaactccgagggccagaatctgggaccacaggccattccccaggacggcagtatcacccatcagatcagcagaccaaacccacccaacttcggccccgggtttgtgaatgattctcaaaggaaacagtacgaggaatggctgcaggagacacagcagttactacagatgcagcaaaaatatttggaagaacagattggcgcccatcgtaaaagtaagaaggcgctttctgcgaagcagcggacggccaagaaggcaggaagggaatttcctgaggaagacgccgaacagttgaagcacgtgaccgaacagcaaagtatggtacaaaaacagctagagcagattcgcaaacagcagaaagaacatgctgagctgatagaggactatagaatcaaacaacagcaacagtgcgctatggcgccccccacgatgatgcctagcgttcaaccgcagcccccactgatcccaggagcaaccccgcccacaatgtctcaacccacatttcccatggtcccccaacaactccaacatcaacagcacaccactgtgattagtggacacacctccccagtgagaatgccctcgctacctggttggcagccgaactccgcccccgctcaccttccacttaatcctcctcgcattcagcctccaatcgcccagttgccgattaagacctgtacacctgcccccggtaccgtcagtaacgccaatccacagtcagggccccctcctcgcgtggagtttgatgacaacaatcctttcagcgaatccttccaagagcgggaacgcaaggagaggctgagagagcagcaggaacgacagcggattcaattaatgcaggaggtggacaggcagcgcgcactccaacagcgtatggaaatggaacagcatggcatggtcggatcggaaatcagtagctcccggacaagcgtctctcagatccctttctacagctctgacctgccatgtgactttatgcagcctctgggaccattacaacagtcccctcagcaccaacagcagatgggtcaggttttgcagcagcaaaatatacaacaaggaagtatcaattcgccttctacccagacattcatgcagaccaacgaaagacggcaagtaggaccccctagctttgttccggattcaccctcaattcccgtcggcagcccgaatttttcatccgtgaaacaggggcatggcaacttatctggcactagctttcagcagtcacccgtgcgccccagcttcacaccggccctacccgccgctccccctgtggccaattcctcccttccatgcgggcaagacagcactattacgcacggacattcttatcccggaagcactcaaagtctgatccagctctattccgacataataccagaagagaagggaaaaaagaagagaacccggaaaaaaaaaagggatgacgatgcggagtctaccaaagctccttccacgccacattcggacattacagccccgcctacacccggtatcagcgagacgacgtcaacacctgctgtgagcacaccatccgaactacctcagcaggccgatcaggaaagtgtagagcccgtaggaccgtccacacccaatatggctgcgggccagctgtgcacagaactggagaacaagcttccgaatagtgacttcagccaggccactcctaaccagcagacctacgcaaactcggaggtggataagctgagtatggaaactcctgccaagacagaggagatcaagcttgagaaggcagagactgagagttgtcctgggcaggaggaaccaaaactggaggaacagaacggcagcaaagttgaggggaatgcagtagcgtgccctgtatcgagcgcgcagagcccacctcactctgcgggggcgcctgcggctaaaggagacagtgggaacgagttactgaaacatttgctaaagaacaaaaagtcatcttccttactcaaccagaagccggaaggcagcatctgcagtgaggacgactgcactaaggacaataaactcgtcgagaagcagaatcccgcggagggcctgcagacactcggggcccagatgcaaggcggattcggatgcggcaatcagctgccaaagactgatggggggagcgagacgaaaaaacagcgctctaaacggacgcagcggacaggtgaaaaagctgcgcccagaagcaagaagcggaagaaggacgaagaagaaaaacaagccatgtatagttctacggataccttcactcatttgaagcaggttcgtcaattatctctgctgcccctgatggaaccgataattggggtcaattttgcccacttcctgccatacggaagcggccagttcaactctggaaaccggctgctgggaacctttggatccgccacactggaaggtgtcagtgactactactcccagctaatttacaagcagaataacctgagcaatccaccaacccctccagcctccctgccaccaacaccccccccaatggcttgtcagaagatggctaacgggtttgccactaccgaagagctagcaggcaaggccggtgtgctggtcagccacgaggtgacgaagacactagggccaaaaccgtttcagttgccgtttaggcctcaggacgatttgctggccagggctttagcccaaggacctaagactgtagacgtgccagcctctctgcccaccccaccacataataatcaggaggagttaagaatccaggaccactgcggggaccgggacaccccagactcctttgttccatccagctctcccgagtcagtggttggcgtggaagtgagtcgctatcctgatctgtccctggtaaaggaggagcctcctgagcctgtgccttcccctattattccaattctcccttctacagctggcaagagcagcgagtctagacgcaacgatataaaaacagaacctggtacactgtatttcgccagcccgtttggacctagccccaacggcccccgatctgggttaatttctgtggctatcaccctgcacccaactgcagccgagaatatttcaagcgtcgtggccgcctttagcgacttactccacgttcggataccaaactcatatgaagtatcctcagctcctgatgtccccagcatgggcctggtaagcagccataggatcaatccagggcttgagtacaggcagcacctgctgttgagaggccctccacctggatctgccaatcccccgaggctcgtgtcctcctatagactgaaacagcccaatgtgccttttccgcctacctccaatggcttatccgggtataaggactcctcccacgggatagctgagagtgccgctctgagacctcagtggtgttgtcattgtaaagtagtgatccttggctcaggggtgcggaaatcatttaaggacctcacactcctgaataaagactcccgcgagtctactaaacgggtggagaaagatattgtgttctgttccaataactgctttatattgtatagcagcactgcacaggccaaaaattccgagaacaaggagtcaatcccaagcctccctcagtccccgatgcgagaaacacctagcaaagctttccatcagtacagcaacaacatttccactctggacgtgcactgtctccctcagctgccagagaaggcctcaccacccgcgagtccccccatagcgttccctcctgccttcgaagccgcccaggttgaagccaagcccgatgagctgaaggtgaccgttaagctgaaacctcggctgcgagcagtacacggaggatttgaggattgtcgcccgctgaacaagaagtggcggggtatgaagtggaagaagtggtcaattcacatagtgattccaaaggggacattcaagcccccatgtgaagacgaaatagatgagtttctcaaaaagcttggcaccagtttaaagccggacccggtgcctaaagattatagaaaatgttgcttctgccatgaagaaggagatggactaaccgacgggccagctcgactcttaaacctggacctggacctttgggtgcacctcaactgcgccctgtggtcaaccgaggtatacgagacacaggctggggctctcattaacgtagagctggctctgaggagaggacttcagatgaaatgcgtgttctgccacaagacaggggcaacatctggctgtcaccggtttaggtgtacaaatatctatcatttcacatgtgccatcaaggcacagtgcatgttttttaaagacaaaacaatgttgtgtccgatgcacaagccaaagggcattcacgaacaggagctgtcctacttcgcagtcttcagaagggtgtacgttcagcgagacgaagtgagacaaatcgccagcatcgttcagaggggcgagagggaccatacctttcgggtgggctctttgatctttcacacgatcggacagctgttgcctcaacagatgcaggcattccattcccccaaagccctcttccccgtcgggtatgaggcctccaggctgtattggagtactcgctacgctaatcgacgctgcagatatctgtgttctatcgaggaaaaggacggcagacccgtttttgtgattagaatcgttgagcagggacatgaagatttggtgctgagtgatatctcacctaaaggagtttgggacaaaatcctagaaccagtggcctgcgtgagaaagaaaagcgaaatgctgcaactgttccccgcctatctcaagggcgaggacctttttggacttaccgtttccgccgtggcacgtatcgctgaatccctacctggtgtggaggcatgcgagaactacacatttcgctacgggaggaacccactgatggaactgccccttgccgtcaaccccacaggatgcgctcggagcgaacccaagatgagcgcccacgtgaaaaggttcgtccttaggccacatacccttaactcaactagtacctctaagtctttccagtccacagtgacaggagagttgaatgcaccatactccaaacagtttgtgcactccaaatcttctcagtacaggaaaatgaagacagagtggaagagcaatgtgtaccttgccagatctagaatccaggggctgggattatatgcggctcgggatattgaaaaacacaccatggtcatcgagtatatcggcacaattatccggaacgaggttgcaaatagaaaagagaagctatacgaatcgcaaaatagaggtgtgtacatgttcaggatggacaacgatcatgtcatcgatgccactctgacaggtggacctgccagatacatcaaccactcttgcgccccaaactgtgttgcagaggtggttacttttgagcggggccataagattatcataagcagctcccgccgaatccaaaaaggtgaagaactgtgctacgactataagtttgacttcgaggacgatcagcataagatcccttgtcactgcggtgccgtgaattgccgcaagtggatgaattag

SEQ ID NO: 125257 - DNA, 4575 bp, Artificial Sequence
  Description of Artificial Sequence: Synthetic coding sequence
ctcatgcaggaggttgatagacagcgcgccctgcagcaacgtatggaaatggaacaacacgggatggtcgggtccgaaatcagttcctctcgcacctctgtttctcagataccattctatagtagcgacctgccttgcgattttatgcaacctctgggacccctgcagcaaagcccccagcatcagcagcagatgggccaagtgctgcaacaacagaatattcagcaggggtccatcaactccccttccacgcaaactttcatgcagaccaacgaaagaagacaggtcggcccaccaagttttgtgcctgatagccctagcattcctgttggtagcccgaacttcagcagtgtgaagcaagggcacggaaacctgagtggtactagcttccagcagtccccagtgagaccatcctttacccctgcgctgcctgcagccccccctgtggccaacagctctctgccttgcggtcaggactccaccatcactcacgggcattcctaccctgggtcaacccagtcactgattcagctgtattccgatattatccctgaagaaaagggtaagaagaagcgcactcgaaaaaagaaacgggatgacgacgccgaatccactaaggcccctagcactccacacagcgatattactgcaccccccacgcccggcatcagcgaaaccactagcacccccgcagtcagcactccctccgaactcccccagcaggcagaccaggaatctgtagaacctgtcgggcccagcacccctaatatggcagcagggcaactgtgcaccgagctagagaataagctgcccaactccgactttagccaggccacacctaaccagcagacctacgcgaactctgaagtcgacaagttgagcatggagacgcctgccaagacagaggaaatcaaactcgagaaggcagagacagaatcctgccccgggcaggaagagccaaagcttgaggaacagaacggctctaaagtggaaggtaatgccgtggcctgtccagtttccagcgcccaatccccacctcattcagctggtgctcctgctgctaagggagatagcgggaatgagctattgaagcatctgctgaagaataaaaagagctcaagtttactcaaccagaagccagagggttcaatttgctctgaggacgactgtactaaggacaataagctggtcgagaaacaaaaccctgccgaaggcctgcagactctgggcgctcagatgcagggaggcttcggctgtggtaaccagctacccaagacagatggaggctctgagacaaaaaaacagagaagcaaaagaacacagaggaccggtgaaaaggcggccccccggtctaaaaaacggaagaaggacgaagaagagaagcaagcgatgtactcaagcaccgataccttcacccacttaaaacagcaattgtcccttttgccactgatggagccaattattggagtgaatttcgcgcacttcctgccatatggctcaggccagttcaatagtgggaatcgcctgctgggcacctttggaagcgctacccttgagggtgtttcggactactactcccagctgatttacaagaaaatggccaacgggtttgcaaccaccgaggagctggccggcaaagctggagtcctggtgtcccatgaggtaacaaagacattaggtccaaagccctttcagctaccctttaggcctcaggatgatcttctcgcaagggcgctggcacaagggcccaaaaccgtcgatgtcccggcatccctgcccactccgccgcacaataaccaggaagagcttcgcatacaggatcactgcggggatagggacacccccgacagcttcgtgccctcttcttcccccgagagcgtggtgggcgtcgaggtttcaaggtaccccgacctcagcctagttaaagaggaacccccagagcctgtgcctagtccaattatccccattctgccctccacagccggaaaatcctcggagtcaaggcggaacgacataaaaaccgaacccgggaccttgtacttcgcgagcccattcgggcccagcccaaatggaccccgttcaggactcatttctgtggcaataacgctccaccccaccgctgcagagaacatctctagtgttgtcgctgcattctctgacctcctgcacgtgagaattcccaattcttacgaagtttccagcgccccagacgtccctagcatgggcttagtgtcctcgcacagaattaatcccggtttggagtaccgccagcatttgctcctccgcggaccccccccaggttccgccaacccaccccggctcgtatcttcgtaccgtctgaagcaaccgaacgtccccttcccacctacatcaaacggcctatcaggatataaggattcaagccacggcatcgctgaaagtgcagccttgcgccctcagtggtgttgtcactgtaaggtcgtcatcctgggtagcggcgtgagaaaaagtttcaaggacctgacattattaaataaagatagtagggaatcgactaaacgggtcgaaaaagatattgtgttctgttccaataattgttttatattgtactcatccactgcccaagctaaaaactctgagaacaaggagtccatcccttccctgccacagagtcctatgagggagaccccctcaaaggcttttcatcagtactccaacaatatctccacactggacgtgcattgcctgccccaactcccggaaaaggccagcccccccgcttcacccccaattgcgttcccccccgcgttcgaagcggctcaagttgaagcgaaaccggatgaattgaaggttacagtaaagctgaagcctcggcttagagcagtgcacgggggcttcgaggactgccggcctctgaacaaaaagtggagaggcatgaagtggaaaaaatggtctattcacatcgtcattccaaagggaactttcaaaccaccatgtgaagatgagattgacgaatttctgaagaagttggggacatccctcaaaccagatcctgtgcccaaggattaccgcaaatgctgtttttgtcacgaggaaggtgacggtctgaccgacggaccagcacggctcctgaatctcgaccttgatctgtgggtccatctgaactgcgcgttgtggtccacagaggtgtatgaaacacaggcgggcgcgctgattaacgttgagctggcccttaggagaggtctccagatgaagtgtgtgttttgccacaagactggcgccacatctggctgccataggtttcggtgtaccaatatctatcattttacatgtgcaatcaaagcccagtgcatgtttttcaaagataaaactatgctgtgccctatgcacaaacctaaagggatccacgaacaggagctgagctactttgctgtcttccgacgtgtgtatgttcagcgcgatgaggtacgccagattgcatctattgttcagaggggggaacgcgatcacacgttccgggtggggtctctgattttccatacaatcgggcagctgttaccacagcagatgcaggcctttcattctcctaaagctctgtttcccgtgggttatgaggcaagtcgcctgtattggtctacaagatatgcgaaccggcgctgcaggtatctttgcagcatagaggaaaaggacggaagaccagtcttcgttattcgcatcgtggaacagggccatgaagatctggtactgtcggatatctcgcccaagggggtctgggacaaaattctggagcctgtcgcctgtgtccgtaagaagagcgaaatgttgcagctgtttcccgcttacctgaaaggcgaagatttgttcgggctgacagtaagcgccgtggcaaggatcgcagagagcctgcccggagtcgaagcgtgtgaaaactatacttttagatatggcaggaatccattaatggaattaccactagccgtgaatcccaccggttgcgcccggagtgagcctaagatgtccgcacatgttaagagaccacataccctgaattccacctccaccagcaagtccttccaatccacagtgacaggcgagctgaatgccccatatagcaaacagttcgtgcattcaaagagtagccagtatcgaaagatgaagactgagtggaaaagcaatgtgtatctcgctcgctcgcggatacaagggttgggcctgtacgctgcaagagacatcgaaaaacatacaatggtcatcgaatacattggtacaatcattcgcaacgaagtggctaatagaaaggaaaaactttacgagtctcagaataggggcgtgtacatgtttcggatggacaacgaccacgtcatcgacgccaccctcacaggtggacccgcccggtatatcaatcattcgtgtgctcccaattgtgtggccgaggtggtgacgtttgagcgtggccacaagattatcatctcttctagccgccggatacagaaaggggaagagttatgttatgactacaagtttgacttcgaggatgatcagcacaaaatcccctgtcactgcggagctgtcaattgccggaaatggatgaattag

SEQ ID NO: 125258 - DNA, 351 bp, Artificial Sequence
  Description of Artificial Sequence: Synthetic coding sequence
atggtcatcgagtatatcggaacaatcattaggaacgaagtagccaatagaaaagagaagctgtacgaatcccagaacaggggagtctacatgttccgaatggataacgatcacgtgattgatgcgaccctaacgggcggtccagccaggtatatcaaccactcttgcgctccaaattgcgtcgcagaagtggttactttcgagcggggccacaagattatcatctccagtagccgacgcattcaaaagggcgaggaactgtgttatgactacaagttcgattttgaagatgatcagcacaaaatcccttgtcattgtggcgccgtgaactgcagaaagtggatgaattag

SEQ ID NO: 125259 - DNA, 5577 bp, Artificial Sequence
  Description of Artificial Sequence: Synthetic coding sequence
atgagcatagtcatcccgctgggcgtggacacagctgaaacctcatatttagagatggccgcaggaagcgagccagagagtgtggaagctagccctgttgtggttgaaaagagcaacagttatcctcaccagctctacacctcctcttcacatcactcacattcttatatcggccttccatatgcggatcacaactacggagcacggcctccccctactccccccgcgtcccctccaccctccgtcctgatcagtaagaacgaggtgggtatttttactactccaaacttcgacgaaacctcgtccgctaccaccataagcacttcagaggatgggagctatgggactgacgtgacccgatgcatatgtggcttcacacacgacgacggctacatgatctgttgtgacaagtgctctgtatggcagcacatcgactgtatgggcattgatcggcagcacattcccgatacttatctgtgcgaacgctgccagcccagaaacctggataaggagcgcgctgtgctgctccagcgccgcaaacgggaaaacatgtctgacggggacacttctgctactgaaagtggggacgaggttccagttgagctgtacaccgcctttcagcacacaccaaccagtatcacgctcactgctagtagggtatcaaaagtgaatgataagaggaggaagaaatctggtgagaaagaacagcatatatctaagtgcaagaaggctttccgggaggggtctaggaagagctccagggtcaaagggtccgcccccgaaatcgatccaagctcggacggcagcaactttggctgggagacaaaaataaaggcctggatggatcggtatgaggaggccaacaataatcagtattcggaaggggtccagcgcgaggcccagagaatcgccctgcgcctcgggaacggcaatgataaaaaggagatgaataagtctgacctcaatacaaataatcttcttttcaagcctcctgttgagagccatatccagaaaaataagaaaatcctgaaatcggcaaaggacctgcctcccgacgcactgatcattgagtatcgggggaaatttatgctccgcgagcagttcgaagccaacgggtatttctttaaaaggccctatccgttcgtgcttttctatagcaaattccatggattggaaatgtgtgtggacgctcgtaccttcggtaacgaagctcgctttattcggcggtcgtgcactccaaatgcagaggttcgacatgaaatccaggatggaactatccatctctacatttattccatccattccatcccgaagggcacggagatcacaatcgcttttgattttgactatggcaattgtaagtacaaggtggactgcgcctgcctgaaggaaaatcctgaatgccccgtgcttaaaaggagtagcgagtctatggaaaacattaacagcggttatgagacccggagaaagaagggtaaaaaggataaagatatttccaaagagaaagatacgcagaaccagaatattacactcgactgcgagggcacaacaaataaaatgaagtctccagagaccaagcagaggaaactctcgcctctaaggctgagtgtatctaacaaccaggaaccagacttcattgacgacatcgaggagaaaactcctatatccaatgaggtggaaatggaaagcgaggaacagatcgccgaaagaaaaagaaaaatgacccgagaggaacgcaagatggaggctattctccaggcgtttgctaggttagaaaagagggagaagagaagagaacaggccttggagaggatcagtacagccaagacggaagttaagactgaatgcaaggacacgcaaatagtcagcgacgccgaagttatacaggaacaagctaaagaggagaacgcatccaaaccgacgccagcaaaggtgaatcggaccaagcagcgaaagtctttcagccgatccaggacccatatcgggcagcagagaaggcggcataggactgtgtctatgtgcagcgacatccaaccgagctctcctgacattgaggtgacttcccagcagaatgacattgagaacactgtgctgactatcgagcctgagactgagacagctctggccgagatcattaccgaaaccgaagtgcccgccctgaacaaatgccccacaaaatatcccaagaccaaaaaacacttagtaaatgagtggctctccgaaaaaaatgaaaagaccggcaagccgtctgatggcttaagtgagcgccctctgcgaattacaacagacccggaggttcttgcaacacaacttaattccctgcctggcctgacctacagcccccacgtgtacagcacaccaaaacactacatccgattcacgtccccgtttctatcggaaaagcgccgccgaaaggagcccactgaaaacattagcggaagctgcaaaaagcggtggctcaagcaggctttagaagaggagaatagtgcgatcttgcacaggttcaattccccatgccaggagaggagtcggagccctgcagttaatggagaaaataaatcaccgcttctgctcaacgactcatgcagcctacccgatctgacaacaccccttaaaaagaggcggttttatcagctgctggatagcgtttacagcgagacctcaacacccactccatccccctatgcaacaccgacacacacggacattaccccaatggatccaagctttgcaaccccccctagaattaagtcggatgatgaaacttgcaggaacggctataaaccaatctactcacccgtgactccagtcacaccaggaacccccggaaataccatgcacttcgagaatatcagcagccctgagagcagccctgagattaagcgcaggacctattcacaggaagggtacgaccggtcttccactatgttaacactgggaccttttcgcaattcaaatctgaccgaattgggcctgcaggagattaaaactatcggctatacctctcccaggtctagaacagaggtaaaccgacaatgtcccggagaaaaagagcccgtctctgatctgcagctcggactggatgcggtcgaacctacggccctccacaaaactcttgagaccccagcccacgatcgggcagagcccaattcacaactcgattcaacccacagcggcagggggaccatgtatagctcttgggtcaaatcccctgaccgcacaggagtcaattttagcgtcaattcaaacctccgcgacttgacaccaagccatcagctggaggtggggggcggcttcaggatctctgagtctaaatgccttatgcaggatgacactagaggaatgttcatggagactaccgtattttgtaccagtgaggatggactggtcagcggctttggcaggacagttaacgacaatctgattgacggcaattgcacaccacaaaatcccccccaaaagaagaaggtatcactattagagtatagaaaacgacagcgagaggcccgcaagtccggaagtaagaccgagaattttcccctcatatcagtatcacctcacgcttccggatcactgagcaacaacggagacggatgtgcatcctccaatgacaatggagagcaggtagaccacaccgcaagtttgcctctccctacccccgcaaccgtgtataatgctacgagtgaagagaccagtaataattgccccgtgaaggacgccaccgcctcggagaagaatgagcccgaggtgcagtggaccgcctctacgtcggttgagcaagttagggagcgcagctatcagagagcgctgttgctttctgatcaccgcaaggataaggacagtgggggggagtccccctgcgtctcctgttctccatcgcacgttcagtccagtcccagctcgcactctaaccacataccacagctgcaagctaaaggtcctgtccccagcttctcggagctgatggaagaccccgacccagagaacccagagcccaccaccacgaatgagtgccctagtccagacaccagtcagaatacctgtaagtccccccccaagatgagtaaaccaggaagccccggcagcgttattcccgctcaggctcacggaaagatctttaccaagccagacccacagtgggactccacagtctccgcatcggaggctgagaatggggtccatctgaaaactgaattacaacaaaagcagctgagcaacaacaatcaggccttgtcaaagaatcatcctccacagacccacgtcaggaacagctctgaacagttgtcccagaaactgcccagcgtcccaacgaagctgcattgtcctcctagcccacaccttgagaaccccccaaagtcttcgacaccccatactcccgttcaacatgggtatctgagccctaagcccccatcacaacagcttggctccccctacaggccccatcatagccagagcccacaagttggaactcctcagagggagccacagcggaatttctacccagccgctcagaacctgcccgctaatacccagcaggctacaagcgggacactgttcacgcaaactccctcagggcagagttcagccacatactcacaattcaaccaacagagtctaaactccacagcgccccccccgcccccgccaccccctccaagttcttcatactatcagaaccagcagccatccgcgaacttccagaattataaccagctcaagggctcactgtcacagcagaccgtatttaccagcggcccaaatcaggctctcccaggcaccacgagccagcagacggtgcccggtcatcacgttactcccggccacttcttgccctctcaaaacccaaccatccaccaccagaccgcagccgccgttgtgccaccaccccctccccctcccccagccccaggcccacatttagtgcagcagcccaattcccaccagcagcactccgtcgcccacgtggtgggtcctgttcacgccgtgactcccggatcccatatccactcgcagactgcaggccatcacctcccaccacctccgccaccacccggcccagcaccccaccatcaccccccacctcacccttcaactggactgcaaggactccaggcccagcatcagcacgtggtcaattccgcaccccctccaccacccccaccaccaccctcctccgtcctggcttctggacaccatacgacctcagcacaggccttgcatcatcctccccatcaaggaccccctttgttcccttccagcgcccatcctacagtgccaccttatcctagccaggccactcaccacacgacactcgggcccggaccccagcatcaaccctctgggacaggtccgcactgtcctcttcccgtcaccgggcctcatttgcaaccccagggccccaatagtatcccaactcctacagcctccgggttctgccctcatcctggcagcgttgcccttccacacggcgtgcagggcccccagcaagcctcacctgtcccaggccagatcccaatccaccgggcccaggtaccaccaacattccagaacaactaccacgggtcaggctggcattag

SEQ ID NO: 125260 - DNA, 5577 bp, Artificial Sequence
  Description of Artificial Sequence: Synthetic coding sequence
atgtccatcgttattccccttggcgtagataccgccgaaacctcatatctggagatggctgctggctctgaaccagaaagtgtggaagcatcccctgtcgtggtagaaaaaagcaactcttacccacaccagttatacaccagcagtagtcaccactctcacagctatattggcctgccatacgcggaccacaattacggagcccgtccacctcctacaccacccgcttccccaccacccagcgttctgatatccaagaacgaggtgggcatatttactacaccaaattttgatgagacatcctcggccacaacgatctcaacatccgaggacgggtcatacggcaccgatgtcaccagatgcatttgcggcttcacccatgatgatgggtatatgatatgttgtgacaagtgctccgtgtggcagcatatcgattgtatgggtatcgaccgtcagcatatccctgatacgtacttgtgtgagcgctgtcaacccaggaatctggataaagagcgcgccgtccttctccaacgccgtaagcgcgagaatatgtccgacggcgatacgtccgccaccgagtccggagacgaggtgccggtggagctgtataccgcctttcagcacacccctacttccatcactctgactgcatcaagagttagcaaagtgaacgacaaacggagaaaaaaatccggcgaaaaggaacagcacatttccaagtgtaaaaaggccttccgggaggggagtaggaagtcatcgcgagtcaaaggatccgctcccgagattgatccttcctccgacggatctaattttggttgggaaactaagattaaagcatggatggaccggtacgaagaggccaacaataaccagtatagtgagggcgtgcagcgagaagctcagcggatcgccctacgcttagggaatggaaacgacaaaaaagagatgaacaagtcagacctgaatactaataacttgctgtttaagcctcctgtcgagtcacacatccagaaaaacaagaaaatcttaaagtctgcaaaggacctcccacctgacgcgttgattatcgagtacagaggaaagtttatgctgcgagaacagttcgaggcaaacgggtactttttcaaaagaccgtacccgtttgtgcttttttattcaaaattccatggacttgaaatgtgcgtggacgcacgcacattcggcaacgaagcccggtttattcgtcgttcttgtactcctaatgctgaggtgagacacgagattcaagatggcactatacatctgtatatttattctatccactccatacccaaagggaccgagatcactatagcttttgactttgattacggaaattgcaagtataaagtcgattgcgcatgtcttaaggagaaccctgaatgccccgtgctgaaaaggtcatccgagtccatggaaaacataaactcagggtatgagaccagacgtaagaagggcaaaaaagacaaggatatctccaaggagaaagacacacagaaccagaacatcactctggattgtgagggaaccactaacaagatgaagtccccggagaccaaacagcggaagctctcccccctgaggctctcagtgtccaacaaccaggagccagatttcattgacgacatcgaggaaaaaactcctatttccaacgaggtcgagatggagtctgaggagcagatagccgaacggaagagaaagatgacaagggaggagaggaaaatggaggcaatcctacaggcttttgctaggttggagaaacgagagaaacgcagagagcaagcactggaaagaatctccaccgccaagaccgaagtgaaaactgagtgcaaggatacgcagatcgtgagtgacgctgaggtcatccaggagcaggctaaggaggaaaatgcttcgaaacctacgccagctaaggtcaatagaacaaaacaacgcaagtctttcagccggagtagaacccatatcggccagcaaagaagaaggcatcgaacagtgtctatgtgtagcgacatacagccgtcttcaccagacattgaagtgacgtctcagcagaatgacatagagaacactgtgctcacgattgaaccagagacggagaccgcacttgccgagataatcaccgagacagaagtgcccgcgctgaacaaatgtcctacgaaatatcctaagactaaaaagcacctggtcaatgagtggctgagcgagaagaacgaaaaaaccggcaagccatccgacgggctgtccgagcgcccacttcggattacaacagaccctgaagtattggccacccaactgaattcgctcccaggacttacatactcaccacacgtttattcaacccctaagcattatattaggtttacgtcacctttcttgagcgagaaacgcaggcgtaaagaacccactgaaaacattagcggatcctgtaagaagcgatggttgaagcaggccctcgaggaggaaaacagtgcaattctccatagattcaattcaccatgtcaggagcgatctagatctcccgctgtgaacggcgagaacaagagtcctctactgctaaacgattcctgtagccttcctgatttaacaactcctcttaaaaaaagacgcttttatcagctcctggacagtgtgtattcagagaccagtactcctacgccctccccttacgccactccgacacacactgatatcactcctatggaccctagcttcgccacgcctcctaggatcaagtccgacgatgagacctgtcggaacggatataaaccgatttactcccccgtcaccccggtcactcctggaacacccggcaacactatgcacttcgagaacatctcaagtccagaaagcagtcccgaaataaagcgcagaacttatagccaggagggctatgaccgcagctctactatgctgactctcggtccttttaggaactccaatctgactgagctcggtctgcaggagatcaagaccatagggtatacatccccaagaagccgcacagaggtcaacagacagtgtccgggggaaaaggaaccagtgtcagatctgcagctgggactggatgctgtcgagcccaccgccctgcataaaacattggaaactccagcacacgacagggccgagccaaattcccagctggactccacccactctgggcgaggaactatgtacagcagttgggtcaaatctcccgacagaacgggagtcaattttagcgtgaattctaacctaagagatttgacaccaagtcaccagctggaggtgggcggtggcttcaggattagcgagtctaagtgtcttatgcaggatgatactcgcggcatgttcatggagacaactgtgttctgtaccagcgaagacggactagtctccggctttggtagaaccgtcaacgataatctgatcgatggcaattgcacacctcagaacccaccccaaaagaaaaaggtgtcgctgctggagtacagaaaaaggcagcgtgaggcccggaaaagcggatccaagactgaaaacttcccactgatttccgtttctccccacgcttccggatcactgtcaaacaacggtgacggatgtgcatcaagtaatgataatggggagcaagtagaccacacagcaagtctcccattacctacgccggccacagtgtataacgccacatcagaggaaacttctaacaattgcccggtgaaggacgcaacagcctccgagaagaatgaaccagaggtccagtggacagccagcacatctgtcgaacaggtgagggaacgcagctaccagcgagctctgttgctgagcgatcataggaaggataaggacagtggcggggaaagtccctgcgtcagctgttcaccgagccatgtgcagtcttccccttcatcccactcaaatcacatcccccagcttcaggccaagggacctgttccttccttttctgagttgatggaagaccccgatcctgagaaccccgagcccacaactaccaatgagtgcccttcaccagacacctcacagaatacatgcaaatcaccacccaagatgagtaaaccaggtagcccagggtcagtgattcccgctcaggcccatgggaaaatctttaccaaaccagatccacagtgggactctactgtgtcggcgtcagaagccgagaatggggtccacttaaagactgagctgcagcagaagcagctgtcaaacaataatcaagccctgagtaaaaaccacccaccacagacacacgtgcggaattcctcagagcagctgtcacagaagctcccaagcgttcccacaaaattacactgccctccttcgccacatttagaaaatccaccaaaatcttctaccccccatactcctgttcagcacggctacttatctcccaaaccccccagccagcagctggggagcccctatagaccacaccacagccagagtccacaagtgggaacaccccaaagagaaccacagaggaacttctaccccgcagcccagaatctcccggccaacacccagcaggccacctctggtaccctgttcacgcagacgccatctggccagtcatccgcgacttactcacagttcaatcagcaaagcttaaacagcacagccccacccccaccccctcctccaccaccaagttcaagctattaccaaaaccaacagcctagcgcaaactttcagaattacaaccagcttaagggctcattgagccagcagacagtattcacgtccggcccaaaccaggccctcccaggcacaacatcacagcagacagttcctggacatcatgtgactccaggacacttcctgccctcacagaatcctacaatccaccaccagacagcagcagcggtggttccaccgcctccgcctccgcctcccgccccagggccacatttggttcaacagccaaattcccatcaacagcatagtgtggcacatgtcgtgggcccggtgcatgcggttactcccgggtcccatatacactcacagactgctggccaccacctccccccacctccccctccacccggacctgccccccatcaccatcccccaccccacccaagtacaggcttgcaaggactgcaagcccagcaccaacacgtggtcaactcggccccaccccccccgcccccgcctccgccttcgtctgtgctggcaagcggacatcacacaaccagcgcccaggccctgcaccatcctccgcaccagggtccccccctgttcccctccagcgcccatcccaccgtgcccccctatccctcgcaggctactcatcacactacactcgggcccggcccacagcatcagccttcaggtaccggccctcactgccctcttcccgtgacaggaccccacctccagcctcagggtcctaactcaattcccaccccaacagcgagtggtttttgcccccacccaggcagtgtggcgctgccacacggggtgcaggggccacagcaagcaagtcccgtgccgggccagataccaattcaccgggcccaggtgccccctacctttcagaataactaccatggttccggctggcattag

SEQ ID NO: 125261 - DNA, 5451 bp, Artificial Sequence
  Description of Artificial Sequence: Synthetic coding sequence
atgtctattgttataccattgggcgtggacacagccgaaacgtcctacctggaaatggcggcaggatcagaaccagagagtgtcgaggctagccccgtggtagtggaaaagtccaatagttatccgcaccagctgtacacatcttcaagccaccactcacacagctatataggtctaccttatgccgaccacaattacggagctcggcccccacccacgcctcccgcctcccccccgccttcggtgctgatctccaagaatgaggtaggcatctttaccactcccaacttcgatgagacttcatccgccaccaccatcagcacttcagaagatggctcttatgggacagacgtgacccgatgtatctgtgggtttacccacgatgacggctacatgatatgttgcgataaatgctcggtttggcagcatatcgactgtatgggcatcgatagacaacatattcccgatacctatctgtgcgaacgctgtcagcctcgtaatctggacaaggagcgggccgtgctacttcagagacgcaaaagggagaatatgtccgacggggatacaagcgccacagaatctggagatgaagtgcctgtggaactgtacaccgcctttcagcatacgccaacaagcataactctaaccgcgtccagggtctcaaaggttaatgacaagcgacgtaagaagtcaggagaaaaggagcaacatataagtaaatgtaaaaaggccttccgggaaggcagccgaaagtcttccagggtaaagggctctgcccccgaaatagacccctcctcagacggatctaactttggctgggagacaaaaattaaagcctggatggatcgctacgaagaggccaacaataatcagtattctgagggggtacagagggaggcacagcgtatcgccctacgtctgggcaacggcaatgacaaaaaggaaatgaacaagtccgacttgaacacgaataacctgcttttcaaaccacctgtggagagtcatatacaaaaaaataagaagatattgaagtcggccaaggacctccctccagatgcactaattatagagtacagggggaaattcatgctccgcgagcagtttgaagcgaatgggtacttttttaagcgaccctatccattcgtgctgttctatagcaaattccacggtctggagatgtgcgtggacgcccgcacttttggaaatgaagccagatttatccgacggagctgcacccctaacgcagaggttcggcatgagatacaagatggcacaatccacctgtatatctatagcattcatagtattcctaagggcactgagatcactatcgcattcgattttgattatggcaattgcaagtacaaagtcgattgtgcttgcctaaaagagaatccagagtgccccgtgctgaagaggagctccgaaagcatggaaaacatcaatagtggttacgaaacccgccgaaagaaaggaaaaaaagacaaggacatcagcaaagagaaagatactcagaatcaaaacatcaccctggattgtgaggggacaaccaacaagatgaagtcgcctgagaccaaacagcggaaactgagccctctccgactcagcgtgtcaaacaaccaagaacctgactttattgacgacatcgaagaaaaaacacccattagcaatgaagtggagatggaatccgaggagcagattgccgaacgcaagaggaagatgacaagagaagagcggaagatggaggctattctccaggcctttgcccgtctagagaagcgggaaaagcgtcgcgaacaggcactcgagaggatcagtacagccaaaaccgaggtgaagacggagtgcaaggatacgcaaatcgttagcgacgctgaagtcatccaggagcaggcgaaggaggaaaatgccagtaaaccgacccccgccaaggttaataggaccaaacaacgcaaaagcttcagccgcagtcgcacgcacattggacagcagcggcgtagacacaggactgtgagtatgtgctctgatatccagccttccagtcctgatatcgaggtaactagccagcaaaatgatattgagaatactgtcctaaccatcgaacctgagacggaaacagctcttgctgagatcatcaccgagactgaagttcctgcacttaataaatgcccgaccaaataccccaagacgaaaaagcacctcgtcaacgagtggctgtccgagaagaatgagaagactggtaaacctagcgacggcctgagcgagcgccccttgagaatcacaaccgatcccgaagtgcttgcgacgcagctgaactcccttcccgggttgacttacagtcctcacgtgtactccaccccaaaacattatatccggtttaccagcccattcttatctgagaagcggcgtcgaaaggagcccactgaaaatataagtggatcctgcaaaaaacgttggctcaaacaggccctggaagaagaaaatagcgcgattctccaccgctttaacagcccctgccaagagcggtcaagaagccctgcggtaaacggtgaaaacaagtctccattacttctgaacgattcttgttccctgccagacctcaccacgccgcttaaaaaaaggaggttctaccagctgttagatagtgtgtactcagagacatccactcctactccaagtccctatgcaacccccacccatactgatataacgccaatggaccccagcttcgccacgccacctcgaattaagagtgacgacgaaacctgtcgaaatggatataaacctatttattcccccgtgactccagtgacacccgggacacctggaaacactatgcattttgaaaacatctccagccccgagtcatcgcccgagataaaaagaagaacatacagccaagaggggtatgaccgcagttccaccatgctcacactcggacccttcaggaactccaacctgactgagctagggctgcaggaaatcaaaacgattggctacaccagcccaagaagtcggacggaagtcaatcggcaatgccctggagaaaaagaacctgtgtctgacttgcagcttgggctagacgccgtcgaacccactgccctccataagaccctcgagacaccagcacacgaccgggcagagcccaattcacagctagattctacacatagcgggcgaggcacaatgtattcctcttgggtgaagagccctgatagaacaggtgtcaacttttctgttaactcaaaccttcgcgatctcaccccaagccaccagttggaggtaggtggaggctttaggatctccgagtccaagtgtctcatgcaggacgatactcgaggaatgttcatggagactacagtgttttgcaccagcgaggacggtctggtgagcggattcggtcggaccgtgaacgacaatctgatcgacggcaactgcactccccaaaatcctccacagaagaagaaggtgtctctgctggaataccgcaagagacagcgggaggctaggaagtctgggagtaagacagagaatttcccccttatttcagtcagcccccacgcctccggatctttatccaacaacggagatggatgtgcttctagtaacgataatggggagcaggtagaccacaccgcttcgttaccgttgccaacgcctgccacagtatacaacgccacatctgaggagacatcgaacaactgccccgtcaaggatgccacagcctcagagaagaacgagcctgaggtccaatggaccgcatccacttctgtggagcaggtgcgggagcggtcctaccagagggcgctgctacttagcgatcaccgcaaagataaagacagcgaccccgaccctgagaatccagagcctaccacaactaacgagtgtccttcacccgataccagccagaatacttgcaagagcccacctaaaatgtcaaagccagggtctccgggttctgtcattcctgctcaggcacatggtaagatttttaccaagcccgaccctcagtgggacagtacagtctcggcatccgaggcagaaaatggggtgcatttgaagactgagttgcagcaaaaacagctgtcgaacaataatcaagccctctcaaagaatcaccctccgcagacccatgttagaaatagcagtgagcagctctcacagaaactgccatccgttccaacgaagttgcactgtccaccttccccacacctggagaatcccccaaagtctagtactccccatactccagtccagcacgggtacctatcccctaaaccacccagccagcagctcggatccccatatcgtcctcaccattcccagagtccccaagtaggcacgccacagagagaaccgcaacgcaacttctaccctgccgctcagaacttgccagctaatactcaacaagctacctccggcacactattcacacagacaccctccgggcagtccagcgctacatactcacagttcaatcagcagagcctaaatagcaccgccccacccccgcccccgcctcctccccccagctccagttattatcagaaccagcaaccctcggccaactttcaaaactacaatcagttaaagggctccctgtcacagcagacggtttttacgtctggtccaaaccaggcccttcctggcactacctcacagcagaccgttcccggacaccatgtgacccccggccattttctgccgtcccagaatccaaccatacaccaccaaacagcagccgctgtagtgccccccccgccacccccgccgccagccccaggcccacacctagtgcagcagcccaattcgcaccagcaacatagtgtggctcacgttgttggcccagtccatgccgttacgcccggcagccatatccacagccagaccgcggggcaccaccttccgcctcccccgccacccccaggccctgctccacaccaccacccccccccacacccatctactggccttcaggggctgcaggctcagcatcagcacgttgtaaactcggcgccgcccccgcctccccctccacccccttcctccgtgctggcctcaggtcaccacaccacctctgcgcaggcactccatcaccccccccaccaagggccgcccctgttccccagtagcgcacacccaactgtgcccccctacccttcccaggccacccaccacacaactctgggtccgggccctcagcatcagccaagcggaacggggccgcactgtccactgccggtaacaggcccacacctacagccacagggtccgaattccattccaacacctacggcttccggcttctgcccccatcccggcagcgttgccctgccccacggcgtacagggaccacagcaggcaagccctgtccccggacagattccaatccatagagcgcaagtgcctcctacatttcagaacaactatcacggctccggttggcactag

SEQ ID NO: 125262 - DNA, 1770 bp, Artificial Sequence
  Description of Artificial Sequence: Synthetic coding sequence
atgcatttcgaaaacatctctagccctgaaagcagtcccgagattaagaggaggacatacagtcaagaggggtatgatcgaagttctaccatgctgaccctgggcccatttaggaattctaatctgactgagcttggccttcaggagatcaagactattgggtatacctctcccagatctaggaccgaagtgaatcgtcagtgtcctggcgagaaggaacctgtgtctgatcttcaactcggactggatgccgtagagcctacagctctgcacaagacccttgagaccccagcccacgacagggccgagccaaatagtcagttggacagcacccactcaggtcggggaacaatgtatagctcctgggtgaagagcccggatcggaccggagtgaacttcagtgttaatagcaacctacgcgacttaacacccagccatcaattagaggttggcggggggttcagaatctccgagagtaaatgcctgatgcaggacgacacacggggaatgtttatggaaacaacggtgttctgcacatcggaggatggcttagtaagcggcttcgggaggactgtaaacgataatctcatcgatgggaattgcacccctcagaacccaccccaaaagaagaaagtgtctctgctggagtatcgcaagagacaacgcgaggcccgcaaatctggctcaaagacggagaactttccacttatctccgtgtctccccatgcaagtggatctctgtcaaataacggtgatggatgcgcaagttcaaacgacaacggtgagcaggtagatcacacagcgtcgctaccacttccaacccccgccaccgtctacaatgctacaagcgaagaaaccagtaacaactgccccgtcaaagatgccaccgcgtcagagaaaaacgagccagaggtccaatggaccgccagcacctctgtggaacaggtgagggaaaggtcctaccaaagagctctgctgctgagtgaccatcgcaaagataaagatagcggaggagagtccccttgcgtatcctgctcgccctctcacgtgcagtccagcccctcttcacatagcaatcacatccctcagctgcaagcgaaaggacccgtgccatctttctctgagctcatggaggacccggacccagagaacccagagccgacaactacaaacgagtgcccaagcccggataccagtcaaaacacatgtaagagtcctccaaaaatgtccaagcctggaagtcctgggagcgtaataccagcccaggcccacggcaaaattttcacaaagcctgatccccaatgggacagtacagtatccgcgtccgaggccgagaacggtgtacacctgaagactgagctgcagcagaaacagctctccaacaacaaccaagctctgagcaagaatcatccaccacagacccatgtacggaacagtagtgagcagctcagccagaaactcccttccgttcccacgaagcttcactgccctccatcacctcacctggagaatccccccaagtccagcacccctcataccccagtgcagcatggctatttgtcccccaagccccccagtcagcaactgggaagcccttatcggccacatcactcacaaagtccacaggtagggacgcctcagcgagagccacagagaaatttctaccctgcggcccagaacctcccagcaaatacccaacaggccacctctggcacgttgtttactcaaacccctagtgggcagtcgagcgctacatatactcagcgctag

SEQ ID NO: 125263 - DNA, 5337 bp, Artificial Sequence
  Description of Artificial Sequence: Synthetic coding sequence
atgtccatcgttattcctctgggcgtcgacactgccgaaactagctatctggaaatggctgctggaagcgagcccgagagtgttgaggccagtcctgtcgtagtcgagaagagcaacagctatccccatcagctctatacaagtagcagtcatcactcacacagctatatcgggctgccttacgcggatcacaactacggcgcccggccacctcccacgccgcctgcgagcccacctccctccgtgcttatttccaagaacgaggttgggatttttactacacctaactttgacgagacaagttctgctaccacaatctctacttcggaggacggaagttatggtacagatgtgacacggtgcatttgtgggttcacccacgatgacggttacatgatctgttgtgacaagtgcagtgtgtggcaacacatcgactgtatgggaattgacaggcaacatatccctgatacctacttatgcgagcgttgccagccacgcaacctggacaaggagcgggccgtgttgctacaacgtcggaaaagagaaaacatgagcgatggcgatacatccgcgactgagagtggggatgaggtgcccgtggagctgtacacggctttccagcacactcctacttccatcacactcaccgcctctcgagtcagtaaggtgaacgacaaacggagaaaaaaatctggagaaaaggagcagcatatcagtaaatgcaagaaggctttcagggaggggtctaggaagagttctagagtgaagggcagtgcccccgagatcgatccatcttccgatggttctaactttggctgggagacaaaaattaaggcctggatggacagatacgaagaagctaacaacaaccagtactccgagggcgttcagcgggaagcccaacggatcgccctgcgactgggtaatggaaacgataaaaaagaaatgaataagagtgacctgaataccaataacctgctgtttaaacctcccgtcgaatctcacatacagaaaaataaaaagatcctgaagagcgccaaggacttgccccccgatgcattaatcattgaatatcgaggaaagtttatgctgagagagcagttcgaagctaatgggtacttttttaaaagaccttatccctttgttcttttttactccaagtttcacgggctcgagatgtgtgttgacgctcgcactttcggtaatgaggctcgctttatccgcaggagttgcacccctaacgcggaggtgcgccacgaaattcaagatggtactatccacctctatatttactcaatacactcaatcccaaagggtaccgagatcacaatcgcctttgactttgattacggcaattgtaagtataaggtcgattgcgcctgtctgaaagagaatcctgaatgcccggtccttaagcgcagcagcgagtctatggagaatattaactctgggtacgagacaagacgtaagaagggaaagaagacccgcgaagagagaaaaatggaagcaatcctacaggcgttcgcccgcttggagaaaagagagaaacgaagggaacaggcgctcgagagaatatccactgccaaaacggaggtgaaaacagagtgcaaagatacccaaatcgtgagtgatgcagaggtcatccaggaacaggccaaagaagagaatgcgtccaaaccaactccagcaaaggtaaacaggacgaaacagaggaagtcattctcacggagcagaacccatattggacagcagcgacggagacataggacagtttcaatgtgcagcgatatccagccctcttccccagatattgaagtcacctctcagcagaacgatatcgagaacactgttctgacaatagaacccgaaacagaaaccgctctggcagaaatcattacagagaccgaagttcctgcactgaacaagtgtcctacaaaataccctaagacaaagaaacatctggtgaacgaatggctctctgagaaaaacgaaaaaaccggcaaaccatccgacggcctctcggagcgcccgctgcgcataaccacagatccagaagtgctggccacacagctgaacagtctgcccggcttgacttacagcccgcatgtgtactcgacacccaagcactatattcggtttacttctccattcctctctgaaaaacgaaggcgcaaagaacctactgagaacatttcaggcagctgtaagaaaagatggcttaagcaggcccttgaagaagagaactcggccattctgcatagattcaactccccgtgtcaagaacgctcaaggtccccagccgtgaatggcgaaaataagtcccctctgctgctgaacgattcatgcagcctccctgatctgaccacacctctgaaaaaaagaagattttaccagctgttggattctgtttatagcgagaccagcaccccaaccccatcaccttacgccaccccaacacatacagacatcacgcccatggacccatcattcgcaactcccccacgcattaagtctgatgatgagacctgcagaaatggctataagccgatttatagcccagtgactcccgtcacgccaggaacgcctggaaataccatgcactttgaaaacatcagtagccctgaatctagtcctgaaatcaaacgccgcacctacagccaggagggatacgatcgctcaagcaccatgctcaccttgggtccatttcggaactctaatcttacagaactcgggctccaagagatcaaaacaattggatacaccagtccccggtccagaacagaggttaaccggcaatgtccaggggaaaaggaacccgttagtgacctgcagctgggcctggacgctgttgaaccgactgctctgcacaagacactcgagactccagctcacgatcgggcggagcccaacagccagctagattccacacactccggtcggggcacaatgtacagctcctgggtaaagtctcccgaccgcacaggtgtcaatttctccgtgaattcgaaccttcgcgatctcacaccctcccatcaattggaggtgggcgggggtttccgcatcagcgagagcaaatgcctaatgcaggatgatacacgcgggatgtttatggaaacgacagtgttttgcacgtccgaagatggattagtgtcaggctttggaagaaccgtgaatgacaatcttatagatggcaactgtacccctcagaatccaccccagaagaaaaaagtgagcctcctggagtaccgtaagcgacagcgggaggcaaggaagtcaggctctaagactgagaattttcccctgattagcgtctcaccccacgcttcagggtctctgagtaataacggcgacggctgcgcaagctcaaacgataatggtgaacaggtagatcacactgctagcctgccattgccgactcctgctacggtgtacaacgccacatcagaggaaactagtaataactgcccagtgaaggatgccaccgcatctgagaagaatgaaccagaagtgcaatggactgccagcacatctgtagagcaagtcagagagagatcttaccagagagctctgctgctcagcgaccatcggaaagataaagactcagggggagagagcccgtgcgtctcctgctcgcctagccatgtgcagagcagcccatcctctcactccaatcatataccccaactgcaggccaagggtcccgtgccaagcttctccgaacttatggaggaccctgatcctgagaaccccgaacccacgactacgaacgaatgccctagcccagacacatctcagaacacatgtaaatcccctccaaagatgagtaagccagggtccccagggtcggttattcctgcccaggcacacggaaaaatattcacaaagcccgatcctcagtgggatagtaccgtgtccgcaagcgaggctgaaaatggggtccacctcaaaacagaactccagcagaaacaacttagcaataataatcaagcgttatccaagaatcatccgccccaaacacatgtgcggaactctagtgagcagctcagccagaaattacctagtgttccaactaaactacactgcccgccgagcccacacctggagaacccgcccaagtccagtacgccccatactcccgtacaacacggctacctaagtcccaaaccccctagtcaacaattgggttctccatatcgcccacaccactctcagtccccacaggtcggcactccacaaagggaacctcagaggaatttctaccctgccgcccagaacctgccagccaatacccagcaagcaacaagtggaactctgttcactcagaccccctctggccagtctagcgccacatatagtcaattcaatcaacaaagccttaattcgacggccccacccccaccccccccaccgccaccaagcagcagctactaccagaaccagcagccctcagcaaactttcagaactataaccagcttaagggatccctgtcacagcagacagtgtttacatcaggacctaaccaggccctgccaggtaccacctcacagcagaccgtgcctggacaccatgtcacacctggccattttttgcccagccagaatcccaccatacatcatcaaaccgcggccgccgtcgtcccgcctccacctccgcccccccctgccccaggtccacatctcgtccaacagcccaactcccatcagcagcactccgtggcacatgttgtcggtcccgttcacgccgtgacaccaggtagccatatccactcccaaaccgcaggtcaccaccttcccccccccccaccccctcccgggccggctcctcaccatcatcctcctccacacccttctacggggctacagggcctgcaggcacaacaccagcacgtggttaacagcgctccgccgccaccaccccccccaccaccatcatcggtgttggcatctggtcaccacacgacaagcgcgcaggccctccaccatcccccgcaccagggccctcctctgttccctagctcagcacacccaaccgtaccaccctatccatcccaggcaacacatcacacgactctggggcctggcccgcagcaccagccaagcggcacaggaccgcactgcccattacctgttaccggacctcatctgcagccacagggacccaatagcatccctactcctactgcctcgggcttttgcccgcaccctggttcggttgccctcccacacggagtgcagggtccccagcaagcatcccccgtcccagggcagatcccaattcatcgggcccaggtgccgcctacttttcaaaacaactatcacggaagtggttggcattag

SEQ ID NO: 125264 - DNA, 4962 bp, Artificial Sequence
  Description of Artificial Sequence: Synthetic coding sequence
atgtctatcgttataccactgggggtggacaccgcagagaccagttatctcgagatggcagcggggagcgaacctgaatcagttgaagccagccctgtcgtggtggagaagagcaattcttacccacaccagctttataccagcagttctcaccatagccacagttacatcgggctgccatatgctgatcacaattacggtgcgaggccacctcctacaccgcccgcatccccccctccttcggttcttataagtaagaatgaggtcggaatcttcacaaccccaaactttgacgaaacctcctccgccacaacaattagcacatcggaggatggtagctatggtacggacgtcacacgctgtatctgcgggtttacccatgacgatggttatatgatttgttgcgataagtgcagcgtgtggcagcatatcgattgcatggggattgataggcagcatattccagatacctacttatgtgaacgctgccagccccgaaatctggacaaagagcgcgctgtcctcctccagcggcgaaagcgggagaacatgtccgatggggacacctcggccaccgagtcaggggatgaggtgcctgtggagttgtatactgcatttcagcacacccccactagcatcactctgacagcttcaagggtatctaaagtgaacgataaaagacggaaaaaatctggtgaaaaagagcagcacatcagcaagtgtaagaaagctttcagagaaggctcgaggaaaagtagccgagtgaaaggttccgctcctgaaatcgatccctcaagtgacgggagtaatttcggctgggagactaaaataaaggcttggatggatcggtacgaggaagcaaacaataaccagtacagtgagggagtgcagcgggaagctcagcggatcgccctccgactaggtaacggcaacgacaagaaggaaatgaataagtccgacctcaacactaataatctgttgttcaaacctcccgtcgagagtcacatccaaaagaataagaagatcctaaagagcgctaaggatcttccacctgatgctcttattattgaataccgaggcaaatttatgctgagggaacaattcgaggccaacggatatttcttcaagaggccatacccgttcgtgttattctattcaaaattccacggattggagatgtgcgtcgatgcccggaccttcggcaacgaagcacgatttatccgccgtagctgtacccccaacgccgaagtgcggcatgaaatacaggatgggactattcacttgtacatctatagtattcactcaatccccaaagggaccgaaatcacgatagcctttgattttgactatggcaactgcaaatacaaggtagactgcgcctgtctgaaagagaaccccgagtgccctgtcctgaagagatcatctgagtccatggaaaacataaattcaggttacgaaacccgcaggaagaagggaaagaaggacaaggacattagcaaggaaaaggatacacagaatcaaaatatcacactggactgtgaaggaactacaaataaaatgaaatctccggagactaaacagcgcaagctttcacctctcagactctccgtgagtaataaccaggagcccgacttcattgacgacatcgaggagaaaacacccatctcaaacgaggtggagatggagtccgaggaacagatagccgagcggaaaaggaaaatgacgcgtgaagagaggaaaatggaagctatacttcaggccttcgcgcgactcgagaagagagaaaagcggcgggaacaggccctggagcggatcagcactgctaagaccgaggtaaagaccgagtgtaaggacacacaaattgtctctgacgctgaggtcattcaggagcaggctaaagaggaaaacgcatctaagccaacccccgcaaaagtcaaccggacaaagcagaggaaaagcttctctagaagcaggacccacatcggccagcagcgtaggcgccatcggacagtttccatgtgctctgacattcaaccaagttctccagacatagaagttaccagtcagcagaacgatatagagaacaccgtgctgaccattgagccggagacagagaccgccctggcagagattataactgaaaccgaggttcctgccctcaataaatgccccactaaatatccaaagacaaagaaacacctcgtcaatgaatggctctccgaaaagaatgagaaaactggaaagccctctgatggactgagtgagaggccactcagaattactacagacccagaagttttggctacacaactaaattctctgcctgggctcacctactccccccacgtgtactccacccctaagcattacatcaggttcactagtccattcctttctgagaagagaaggagaaaggaacccaccgaaaacatttcaggctcttgtaagaaaaggtggcttaagcaggcccttgaagaagagaactcagccattctgcacagatttaattctccatgccaagaacgatctcgcagccccgcggtcaatggtgagaacaagtcccccctgttgctgaacgattcctgcagtttacccgacctgaccacaccactgaaaaaacgacggttttaccagctgcttgactccgtttactcggaaacctccacgcccactccaagcccttatgccacaccaactcatacggatattacacccatggatccgtccttcgcgacccccccacgaattaagtccgatgatgagacatgtcggaacgggtataaacccatctactcgccagttacccccgttacccctgggacacctgggaatacaatgcacttcgaaaacatctcatccccggagtcctcacccgagatcaaacgccggacgtacagccaagagggatacgacaggagctcaaccatgctgaccctggggccttttagaaacagcaacctcaccgaactgggtttgcaggagattaaaaccattggatatacttcgcccaggtccaggaccgaagtgaacagacagtgccccggagaaaaagagccagtcagtgacctccaattgggactggatgcagtcgagccaacggccctccacaagacgctggagacgcctgctcatgatcgagctgagccaaactcacagctggatagcacacattctgggagaggtactatgtactcctcctgggttaaaagcccagatagaacaggtgtgaactttagcgtcaattctaacctccgcgatttgactccctctcatcagctggaggtaggcggaggtttccgcatttctgagtcaaaatgcctgatgcaggatgacacgcgcggcatgttcatggagacaactgtgttttgcacaagtgaggacgggttggtctctggatttggaaggacagtgaatgataatttgatagacgggaattgcacgccacagaatcccccccagaaaaaaaaagtgtcactgctggagtatcgcaaacggcagcgagaggcccgcaagtctggttccaagaccgagaactttcccctgatcagcgtgtcacctcatgcatctggtagtctgtctaataatggagatgggtgtgcaagctccaatgataacggagaacaggtggatcacacagcatctctgccactaccgaccccagccacagtctataacgccacatctgaggagacctcaaacaattgcccagtgaaggacgctactgcttccgaaaaaaatgaacccgaggtgcagtggactgcttcaacaagcgtcgagcaggttcgagagcgcagctatcagcgggccctcctattgtccgatcaccgcaaggacaaagatagtggcggagagtccccatgcgtcagctgctcgccttctcatgtgcagagttcaccttcatcgcattctaaccacataccacagcttcaggcaaaggggcccgtcccctcattctcagaattgatggaggaccccgatccagagaaccctgagccaaccacaactaatgagtgcccctctcctgacacgagccagaacacatgtaagtccccccccaaaatgtctaaacctggctcccccggcagcgtcatccctgctcaagcacatggtaagatctttacaaaacctgatccccaatgggactccacagtctccgctagcgaggctgagaacggcgtccacttgaagaccgaattgcagcagaaacaactgagcaacaataaccaggccttgagcaaaaatcacccgccacagacccacgtacgaaattcctctgaacagctcagccagaaactgccttctgtgccaacaaaactccactgtcccccttcaccccatctcgagaatccccccaagtcctccacccctcatactcccgtccaacacggttacctctcgccgaagccgccctctcagcagctgggatcgccctatagacctcatcattctcagtcccctcaggtcggaacccctcaacgagaaccacagagaaatttctatccagctgcccagaacctccctgtgttttggctcctgggcataatccctcaccaacttaagccgtacacgactcaccttatcaaagacctgcatttcttcttgagggttctaatccagttgtatcaccggataccacataagctgcacataatacccctgtgggatagagacccttcaacaagtctactggaacagggtcacattgtgcactacttgtcccaagtcctgatctcctcaccaaaggaccagactgtgttccagcatctccttctgcagggttctgtgttgatcttggcactgtggccctgccatatgggctttaaggacttgagcaggcacctccagtgcctggaccgttttcagttcactgagcacaggtgtcaccagcacttcaaaacaataaccatggggcaaggcggcatcaaaatggacagcaaaaatatttttttgaacgtgctctag

SEQ ID NO: 125265 - DNA, 378 bp, Artificial Sequence
  Description of Artificial Sequence: Synthetic coding sequence
tgaggttccttgtccaataatggcgacggttgcgcctcaagcaacgacaacggtgagcaggtcgaccacaccgccagcttaccattgccgactcctgcaaccgtttataacgctacttctgaggaaacctcaaacaattgcccagtcaaggacgccactgcttccgaaaaaaatgagcccgaggtccagtggaccgcctccacttccgttgagcaggtgagggagcggtcttatcaacgcgccctcctgctctccgaccatcgtaaagacaaagattcagatcctgatcctgaaaatcccgagccaacaacaaccaacgaatgtccttccccggacacttctcagaacacgtgtaaaagcccacccaaaatgtcttag

SEQ ID NO: 125266 - DNA, 216 bp, Artificial Sequence
  Description of Artificial Sequence: Synthetic coding sequence
atgagcattgtcatcccgctgggcgtggacacagcagaaacgtcttatctggaaatggcagcaggatccgagcccgagtccgtcgaggcatcccccgtcgtggtggagaagtccaattcctatccccatcaactctatacaagctccagccaccactcccatagttacattggattaccctacgcagaccataactacggggcacgacctccctag

SEQ ID NO: 125267 - DNA, 1830 bp, Artificial Sequence
  Description of Artificial Sequence: Synthetic coding sequence
atgtccatcgtgatccctctaggtgtggacactgctgaaacctcctacttggagatggctgcaggaagtgaaccagaatccgtggaggcatcgccggtcgtggtggagaagagcaacagttatccccatcagctgtacactagttcttcccatcactctcattcatacatcgggttgccatatgctgaccataactatggtgcaagacctcctcccaccccaccagcatcccctcctccgagcgtgctgatcagcaaaaacgaggtgggaatcttcacgaccccaaacttcgatgaaacatcctctgctacaacaatttcaacttctgaagatggcagctacgggacagacgtgacccggtgcatttgcgggttcacacatgatgacggctacatgatttgctgcgataagtgctctgtgtggcaacacatagattgcatgggaatcgatagacagcatatccccgacacctacctttgtgagagatgtcagcctcgcaaccttgacaaggaacgcgccgtattgctgcagaggagaaaacgagaaaacatgtcagatggcgataccagtgctaccgagagtggcgacgaggtgccagtggaactttacacagcctttcagcacacgccaactagcataactctgactgcttctcgcgtctccaaggtgaacgacaaacgccggaagaagtctggagagaaagagcaacacatcagcaagtgcaagaaggcctttagggaaggcagtaggaagtcatcaagggtcaagggaagcgcaccagagattgacccaagctctgatggtagcaactttggctgggagactaagatcaaggcctggatggatcggtacgaggaggcaaacaataatcaatattcagagggagtgcagagggaggcccaacgcattgccctgcgccttggaaatggaaatgataaaaaggagatgaacaaaagcgatctcaatactaacaacctgttgttcaaaccacctgtagagtcacacattcaaaaaaacaaaaaaatcctgaagtccgccaaagatctacctcctgatgccctgataatcgagtaccgcggcaaatttatgctccgggaacaattcgaggctaatggatatttttttaaacggccctacccgtttgttttattctactccaagttccacggacttgaaatgtgtgtggatgcaagaaccttcggtaacgaggcaaggttcataagaagatcttgtacgccaaacgcagaagtgagacatgaaattcaggacgggactattcacttatatatctacagtatccatagcatcccaaagggcactgagatcaccatcgctttcgactttgactatggtaattgcaaatacaaggtggactgcgcctgtctgaaggaaaaccctgagtgtcctgtgttaaaacgaagctccgaaagcatggagaatatcaacagtggctacgagacccgccgcaagaaaggtaagaaagacaaagatatttcaaaagaaaaagatacccagaaccagaacataaccttggactgtgaagggactaccaacaagatgaaaagccctgagacaaaacagagaaagctgagcccactgagactgtctgtctctaacaatcaagaacctgacttcatcgatgatatcgaagagaaaaccccaatatctaatgaggtggagatggaatccgaggagcaaattgctgagcgcaagagaaagatggtgtcttgggaggctagcagtctcgggctcgtgacggccgctctccacatggtgatcgtggccgccttcacttgggctttcaccctcttctttgaggtgtctgagtag

SEQ ID NO: 125268 - DNA, 693 bp, Artificial Sequence
  Description of Artificial Sequence: Synthetic coding sequence
atgagtattgttatccctttgggagtagatactgctgagacctcctatctcgagatggcagccgggtcggagccggaatccgtagaagcctcacccgtggtcgttgaaaaaagcaacagttacccacaccagctgtacacatcctcgagccaccactcccactcctacatcggccttccttatgccgaccacaattacggcgctaggcccccccctactcccccagcttcacccccccctagtgtgctgatttctaagaacgaggttgggattttcacgaccccaaattttgacgagaccagttccgctactaccattagcacttctgaggacggctcctacggcacagatgtgactcgttgtatctgtggattcactcatgacgatggatacatgatttgctgtgacaagtgcagcgtgtggcagcacattgattgcatgggaattgatcgtcagcatatacctgatacctacctgtgtgaaaggtgccagccccggaatctggataaggaaagggccgtgttgctgcagcgcaggaaacgggaaaatatgtctgatggcgacacaagcgctacggaaagcggcgacgaagtgcctgttgagttgtatacggccttccaacatacaccaaccagcatcacgctcactgctagtagagtgagcaaggtgaatgacaagagacggaagaaatag

SEQ ID NO: 125269 - DNA, 1362 bp, Artificial Sequence
  Description of Artificial Sequence: Synthetic coding sequence
atggtcctggtgctgtccgacacgtctgccagccctccaccctcagtactgatttctaagaacgaggtcggtattttcaccactccaaattttgatgagacatcatccgcgaccactattagcacatccgaagatgggtcatacggcaccgacgtcacgcggtgtatctgcgggtttactcatgacgacggctacatgatttgctgcgacaaatgttctgtgtggcaacacatcgattgcatggggatcgaccggcagcatatacccgacacatatctgtgtgagaggtgtcagcctaggaatctcgataaggaaagggctgtccttctacagagaagaaaacgcgagaacatgagcgatggggacacctccgcgaccgaaagcggcgacgaggtgccggtcgagctgtacaccgcattccagcatacccctacctccatcacactcacagcaagccgcgtgtcaaaagtgaacgacaagaggaggaagaagtctggggagaaagagcaacacatttccaagtgcaagaaggcttttcgggagggatcgcggaagagtagtcgggtgaaaggcagcgctcctgaaatagatcccagtagtgatggctcgaatttcggctgggagaccaagatcaaggcctggatggaccgctacgaagaagcaaataacaatcagtattccgagggggttcagagagaggcgcagaggatcgccctgcgcttgggaaacggcaacgataagaaggaaatgaataagagcgacctgaatactaataaccttctgttcaaaccccctgttgagagccatatacagaagaacaagaaaatcctcaagtccgccaaggacttaccacccgacgcgctgatcatcgaatacaggggaaagtttatgctgcgagaacagttcgaggctaacgggtacttctttaagaggccgtaccctttcgttcttttctacagcaaattccatgggcttgaaatgtgcgtagatgctcggacgtttggaaacgaagcacgttttataaggcgaagttgtacccctaacgccgaggtgcgacacgaaattcaagatggcaccatacacctgtacatatattcaatacacagcattccaaaagggactgagatcaccattgccttcgattttgactatggtaactgtaagtacaaggtggattgtgcttgcttaaaagaaaaccccgagtgccccgtgctcaaacgaagttccgagagcatggagaacattaacagcggctatgagacgcgccgtaaaaaagggaagaagactaagattttccagaagaagaaaatccacaagatccgtatcctgctgtggatcgtgaaagagcgtccaaccaagtag

SEQ ID NO: 125270 - DNA, 969 bp, Artificial Sequence
  Description of Artificial Sequence: Synthetic coding sequence
atgccagtgactgtcactcggacaaccatcacgactaccaccacctcatcctccggccttggctctccaatgatcgttggctccccaagggcactgactcagccactgggcctattgaggctgctgcaactcgtctccacctgcgtcgccttctcattggtcgcgagtgtcggcgcctggacaggctccatgggaaactggagcatgttcacctggtgtttctgcttctccgtgacactgatcattctgattgtcgagctttgcggactccaggcccggttcccccttagttggagaaatttccccattactttcgcatgctatgcagccctgttctgcttatccgcctcaatcatttatcctacaacctacgttcaatttctgtctcacggacgctccagagatcatgccattgctgctacatttttctcctgtatcgcgtgcgttgcttatgcaaccgaagtagcctggacccgagcccgccccggcgaaattacgggctacatggccacagtccccggtctgctcaaggtcctggagacttttgtggcttgcataattttcgcctttatcagcgatcctaacctctatcagcaccagcccgctctggagtggtgtgttgccgtctacgctatatgttttatactggcagccatagctattctgttgaacctcggcgaatgcactaatgttctgcccattcccttcccgagctttctcagcggtctggcccttctgtcagtcctcttgtatgcaacagctctcgttctgtggccactgtatcagttcgatgaaaagtacggcgggcagccccgccggtcccgtgatgtgtcgtgtagccgatctcacgcttattacgtttgtgcttgggataggcggttggcagtggctatcctcacagcgataaatttgctggcctatgttgctgatctggtgcatagcgcccatcttgtgttcgttaaggtatag

SEQ ID NO: 125271 - DNA, 969 bp, Artificial Sequence
  Description of Artificial Sequence: Synthetic coding sequence
atgccggtaactgttacccgaacaaccataaccaccaccaccacctcttcctctggactaggtagtcccatgatcgtgggtagcccccgcgctctgacccaacctctgggattgctgagattactacagttagtctctacttgtgtcgctttctcacttgtagcgagcgtaggagcttggactggcagcatgggtaactggtccatgttcacttggtgtttttgtttctctgtgaccctgattatcctgatagtcgagctatgcgggctgcaggcccgatttccgttgtcctggcggaattttcctatcactttcgcttgctatgccgcacttttctgtctcagcgcatcaattatttaccctacaacctacgtgcagttcctgagtcatgggagaagtagagatcacgccatcgccgcaacttttttttcctgcatagcctgtgtcgcttacgctaccgaagtggcctggacccgcgcccgcccgggtgaaataaccgggtacatggccaccgttccggggctccttaaggttctggagaccttcgtggcttgcattatatttgctttcatctcagatcctaatctgtaccagcatcagcctgccttggaatggtgtgtggccgtttatgcaatctgcttcatcctagctgcaatcgctatcctcctcaacctaggggagtgcactaacgttctgccgatcccctttccttctttcctgagcggtctggctttgctatctgtgctcctgtacgcaaccgctctcgttttatggccactctaccagttcgacgaaaagtatggagggcagcccaggcgaagccgcgacgtgagctgctcaaggtcccacgcatactacgtgtgtgcatgggatcgacgcttggcggtcgcaattctgaccgcaatcaatctgcttgcttatgtagctgatttggtgcactctgctcatctcgtcttcgtgaaggtgtag

SEQ ID NO: 125272 - DNA, 969 bp, Artificial Sequence
  Description of Artificial Sequence: Synthetic coding sequence
atgcctgtaaccgttacaagaacaactataactacaaccacaaccagttcgagcggacttgggtccccgatgattgtgggcagcccgagagctctcacacagcccctggggcttctgaggctgctacagctggtgtctacctgtgtagctttttctctggtcgcaagtgtcggcgcctggaccgggagcatgggtaattggagcatgttcacgtggtgtttctgctttagcgttaccttgattatactgatcgttgagctttgcggactacaggcgcgctttccgttatcatggcgcaattttccaattaccttcgcctgttacgccgcccttttctgcttatcagcctccattatctaccccacaacttacgtgcagtttttaagccacggccggtccagagatcatgccattgctgcgacttttttttcctgcattgcatgtgtcgcttacgcgaccgaggtggcttggacaagagcgagacccggtgaaatcaccggctacatggctacggttccgggccttttgaaagtcctggagacctttgttgcctgtataatctttgcatttatttccgatcccaacctctaccagcatcagccagcacttgagtggtgtgtggctgtgtatgccatttgtttcattcttgccgcgatagcgattctactgaacctaggcgagtgcactaacgtccttccaattccattccccagttttttgagtggcttggcgctgctctccgtgcttctttatgcaaccgcactcgttttgtggcctttgtatcagttcgacgagaagtatggggggcagccgcgccgaagcagggatgtgagctgcagccgctcccacgcgtattatgtgtgcgcatgggaccgcaggcttgccgtagctattcttaccgccattaacctcctggcctacgtggcagacctggtgcactccgcccatctggtgtttgtgaaagtttag

SEQ ID NO: 125273 - DNA, 969 bp, Artificial Sequence
  Description of Artificial Sequence: Synthetic coding sequence
atgcccgtcactgttacccgcacaacaatcaccaccacgaccacgtcctcaagtgggctcggctctcctatgatcgtgggttcacctagagccctcacccagccacttggcctcctgagactgttacagttagttagcacctgcgtggccttctctctcgttgcaagcgtcggcgcgtggacagggtctatgggtaattggtccatgtttacttggtgcttttgtttcagcgtcactctcattatcctaattgttgaattgtgcggcttgcaagcgcgatttcccctcagctggagaaactttccgattaccttcgcttgttacgccgctctattttgtctctcagcatccatcatttacccgacaacttatgtgcagttcctctcccatggaagaagcagagatcacgccatcgcggccactttcttctcgtgtatagcctgtgttgcctacgccactgaagtcgcctggactcgggcacgccctggtgagatcacaggctacatggctaccgtacccggactcctgaaagtcctggagacctttgttgcgtgcattatctttgccttcatcagcgatcctaatctgtaccaacaccaaccagccctggagtggtgcgtggccgtgtacgcaatctgctttatactagccgccattgctattctcttgaatctaggggaatgcacaaacgtgctccccataccctttccttcatttctctcaggtctggctctactctctgtgctgctgtatgcaacagcactggtgctgtggcccctgtaccagttcgacgagaaatacggaggccagccacgccgttcaagagacgtgtcctgcagtaggagtcacgcttactacgtttgcgcgtgggaccgcaggctcgccgtggccattctcacagctattaacctcctcgcatacgtggccgatcttgtacactccgcccaccttgtctttgtgaaggtgtag

SEQ ID NO: 125274 - DNA, 969 bp, Artificial Sequence
  Description of Artificial Sequence: Synthetic coding sequence
atgcctgtaacggtgactagaacgactattacgaccacaacaacatcaagctctggacttggatctccgatgatcgtaggttccccacgcgccctcacacagcccttgggcctgttgagactactgcaacttgtgtcaacgtgcgtcgcattctcactggttgcgtccgtcggagcctggacgggatccatgggaaattggtccatgttcacctggtgcttttgcttctcggttaccctgatcattcttatcgttgagttgtgtggactgcaggccagattccccctgtcttggagaaattttccgatcacattcgcttgctacgcagctcttttttgtctatctgctagcattatatatcccaccacttacgtgcagtttcttagccatggaagatcacgtgatcacgcaatagccgccaccttcttttcctgtatcgcatgtgttgcttatgcaacggaggtagcgtggacccgtgcaaggccaggtgaaatcactggatatatggccacagtgcctggtctcttaaaagtgcttgaaactttcgtggcatgtattattttcgcatttatatcggaccccaatctttatcagcaccagcctgccctcgaatggtgcgtcgccgtgtatgctatatgcttcatcttggccgccatcgccatccttctgaatctgggagagtgtacaaacgttcttccgatcccctttccatcattccttagcgggctggctctgctatccgttctgctgtatgcaactgcgctagtcctctggcctctctaccagtttgacgagaaatacggcggtcagcccaggagatctcgagacgtcagctgcagtcggtcgcacgcgtattatgtatgtgcctgggatcgacgtctggctgtggcgatactgacagcgattaacctacttgcgtacgtcgccgatttggtgcacagcgcccacctggtttttgtgaaggtatag

SEQ ID NO: 125275 - DNA, 444 bp, Artificial Sequence
  Description of Artificial Sequence: Synthetic coding sequence
atgcccgtcactgtcacccgtacaaccataacgaccaccacaacttcttcctccggcttggggtcacccatgattgtcgggtccccccgcgcactgacccagcccctcggtctcctccggcttctgcaattagtgtctacgtgcgtggcattttctctggtcgcttctgtaggtgcttggactggctcgatgggcaattggagcatgttcacttggtgtttttgtttctcagttactcttatcatcctgatcgtagaattatgcggcctgcaggcaaggtttcctctgagttggcggaactttcctataacgtttgcatgttacgcagcactgttctgcttatcagcatctatcatctacccaacaacctacgtgcaatttctctcccacggtcggtccagagaccacgcaatagctgcaacatttttctcctgtatcgcctag

SEQ ID NO: 125276 - DNA, 858 bp, Artificial Sequence
  Description of Artificial Sequence: Synthetic coding sequence
atgccagtaaccgttactagaactacgatcacaaccactactacttcttcctccggtctgggaagccccatgatcgtggggtcacccagggcactgacacagcccttaggacttctgcgacttctgcagttagtcagcacatgtgtagcattctctctggtcgcttctgtgggcgcctggaccggatctatggggaattggagcatgttcacctggtgcttctgttttagcgttaccctgattatcctgattgttgaactctgtgggcttcaggcaaggtttcctctttcttggaggaattttcctattaccttcttctcatgtatcgcctgtgttgcctacgcgaccgaggtcgcatggacgagggcccggccaggagagataactggatacatggccacagttcctgggcttctgaaggtcctggagacttttgttgcttgcattattttcgcattcatcagcgatccaaatctctatcaacaccaaccagccctggaatggtgcgtagccgtctacgcaatctgtttcattctggctgcgatagccatcctgctcaacctgggagagtgcaccaatgtgcttcctatcccgtttccgtctttcttatcaggcctcgcactactttccgtactgttgtatgccactgcactggtgttatggccactataccagtttgacgaaaagtacggaggtcagccgaggagaagccgggacgtgtcatgctctagatctcatgcctactacgtgtgcgcctgggacagaagactggccgtggccatcctgacagctattaatctgttggcttatgtggcagacctcgtgcattctgcgcacttagttttcgtcaaggtgtag

SEQ ID NO: 125277 - DNA, 729 bp, Artificial Sequence
  Description of Artificial Sequence: Synthetic coding sequence
atgcccgttaccgtgacacgcaccacaatcactactacaactacgtcgtcctctggcctgggctccccaatgattgtagggtcccctcgggctctaacacagccactgggccttctccggctattgcagctggtttcgacctgtgtggcctttagcctcgtggcatcagtcggcgcctggacaggatctatgggaaattggtcaatgtttacctggtgtttctgttttagcgtgacactcattattctcattgtggaactgtgtggcctgcaggcccgattccctttgtcatggcggaattttcctatcactttcgcatgctatgccgctcttttttgtctgtccgcaagcataatctatcccaccacttacgtgcagtttttgtcacacggccgctctcgggaccacgccatcgccgcaacctttttttcatgtatcgcctgtgtcgcatacgccactgaggtggcctggacccgagccagacctggcgaaatcactggttacatggcaacagttcctggtctgctcaaagttttagaaaccttcgtggcctgcatcatttttgcattcatctccgatccaaacctttatcagcatcagcctgccctggagtggtgtgtggctgtatacgccatctgctttatcctcgctgccatcgccattctgctcaatcttggagagtgtacaaatgtcctgcctattcctttcccctctttcctaagtgggtag

SEQ ID NO: 125278 - DNA, 780 bp, Artificial Sequence
  Description of Artificial Sequence: Synthetic coding sequence
atgccggtcactgttacacgcacgactattacaacaacaactacctctagcagtggcctggggagtccaatgatcgttggaagcccacgagctctgacgcagccgctcggcctcctgagactgctgcagctcgtgtctacatgtgtagcatttagcttagtggcctcagtcggtgcctggacggggtccatgggaaactggtctatgtttacatggtgcttctgcttttcggtaacacttattatcctgatagtggagctgtgtggccttcaggccagattccccctctcttggaggaacttcccaatcaccttcgcctgctacgctgccctcttctgccttagcgcctccataatttaccccacgacgtacgtccagtttctctcacacggaaggagtcgggatcatgcaattgccgccaccttcttctcatgtattgcgtgtgtggcgtatgccacagaggtcgcctggacccgcgccagacccggggagattacaggatacatggcaacggtaccaggactcttgaaagtgctggagaccttcgtggcctgcattatatttgcttttatttctgacccaaacttatatcaacatcagcctgctttggagtggtgcgttgccgtttatgctatttgcttcattctggctgcaatcgccatcttactcaatctgggggaatgtacaaatgttcttccaatcccgttcccaagctttctgtcgggcttagctctcttgagtgtcttactgtacgctacagctttagtgctgtggccctag

SEQ ID NO: 125279 - DNA, 567 bp, Artificial Sequence
  Description of Artificial Sequence: Synthetic coding sequence
atgcccgtgactgttacaagaacaaccatcacgactacaacaacctcctcaagtgggctaggatcccctatgatcgtaggatctccgcgggccctcacacagcctctgggtctgcttcggcttctgcaactggttagtacttgtgtggccttcagtctggttgcctctgttggtgcctggactgggagcatgggaaactggagtatgtttacctggtgcttctgtttctctgtcacactgatcatcctgattgtggagctgtgcgggcttcaggcacgattccctctgagctggagaaactttcccatcacattcgcctgctatgccgcactcttctgcctgtcagcctctatcatttatcccacaacctacgtacaatttctctcccacggaagaagccgggaccacgctattgctgccaccttcttcagctgtatcgcatgcgtggcgtatgccacagaggtggcctggactcgtgctaggcccggagagatcacaggatacatggctactgttccggggctccttaaagtgctcgagactttcgtagcatgcattatcttctag

SEQ ID NO: 125280 - DNA, 942 bp, Artificial Sequence
  Description of Artificial Sequence: Synthetic coding sequence
atggctcttcgaatatgcgtgacatatactcccgcgcttcccatcgggctgtgcacaaggtgttgcctgtgtctggagcaatcaccgtcttggtgccattgcctgagaggggtcagctttcttacctttcacctccaccagtccgttcctctgggggatcgcgatagtctcctgatgtttacgagacaggccggccatttcgtggaaggatcaaaggccggtaggtcccgcgggcgcctctgtctaagccaggcgctgagagttgccgttaggggggccttcgtttcgttatggtttgccgccggggcgggggaccgcgaaagaaacaagggcgacaagggggcccagactggtgctggcctgtctcaggaggctgaggatgttgacgtgtctagagctagacgagtaaccgatgcaccccagggtacactttgcggcaccggaaatagaaactcaggcagccagtctgccagagtcgtcggcgtggctcatctgggcgaagctttccgagtgggcgtcgagcaggccatcagctcctgccctgaggaagtgcatgggcgccacggtctttctatggaaattatgtgggcacgcatggacgtggcactgcgatcccccggtagaggattgctggctggcgctggcgccctatgcatgaccctcgcagaaagctcatgcccagactacgagcgcggacgtcgcgcctgtttaacacttcacagacaccccaccccccattgttccacctggggcctccccttaagggtggcaggtagctggctgactgtcgtgacggtggaggccctcggggggtggagaatgggcgtgcgccgcactgggcaggtagggcccactatgcaccctcctcccgtaagcggtgcgtccccactcttgcttcaccatctgttactcctgttacttattattatactgacctgttag

SEQ ID NO: 125281 - DNA, 942 bp, Artificial Sequence
  Description of Artificial Sequence: Synthetic coding sequence
atggccctgcgaatatgcgtcacttatacgcctgcccttccaattggcctctgcacccggtgctgcctgtgcctggagcagagcccgagttggtgccactgtttacgtggcgtgtcctttcttactttccatctccatcagtcggtgccactgggagacagagatagcctgttaatgttcactaggcaggccggccacttcgtggaaggctcaaaagcaggaagatccaggggccgcctctgcctgagtcaggccctgcgggtggctgtgcgaggagccttcgtgtcattgtggtttgcagcaggggccggcgaccgggagcggaataagggtgacaagggggcccagactggagcaggacttagccaagaagccgaagacgtcgacgtgagtcgcgcccgcagagtgacagacgcaccccagggcactttgtgcgggaccggcaatcgcaattcaggttcacagtccgcccgtgtggtaggcgtagcacatctgggagaggccttcagggtgggagtggagcaggctatctcaagctgtcccgaagaagtgcatggccgccacggactgtccatggaaatcatgtgggcgaggatggacgtggccctgagatcacctggacgtgggctgttagctggcgccggcgcactctgcatgacgcttgctgagtcatcttgcccagactatgagcgcggtcggagggcctgcctgactttgcataggcaccctactccacactgttctacatggggtttacccctaagagtggctgggtcttggcttactgtggtaacggtggaagccctcggagggtggaggatgggggtcaggagaacgggtcaggtaggtcctacaatgcacccccctcccgtaagtggcgcttcccctctactgctacaccatctgctgctgttgctgctcattatcattttgacttgttag

SEQ ID NO: 125282 - DNA, 279 bp, Artificial Sequence
  Description of Artificial Sequence: Synthetic coding sequence
atgcaggtttcgactgccgcactcgccgttctgctgtgtaccatggccctgtgcaaccagttttctgcttcattagccgctgacacacctacagcgtgttgcttttcatacacaagcagacaaatacctcagaactttattgctgattactttgagacaagctcacagtgtagcaaacctggagtcatctttctgacaaagcgcagcaggcaggtttgcgcagatccgagcgaagagtgggtccagaaatacgtttccgacctggaacttagtgcctag

SEQ ID NO: 125283 - DNA, 2334 bp, Artificial Sequence
  Description of Artificial Sequence: Synthetic coding sequence
atgggagtccccttcttctcttcactgcggtgtatggtcgacctggggccgtgctgggccggagggttgactgccgaaatgaaactgttgctagctctcgctggactgctcgctatcctcgccacccctcagccctccgaaggagcagctcccgccgtcctcggcgaagtcgacacatccctggtcttgagtagcatggaagaggcaaagcagctagtcgacaaggcatataaggagagaagagagtcaattaaacaacgcctgagaagcggttcagccagcccaatggaactcctgtcatactttaagcagcccgttgctgccactcggaccgctgtcagggcggccgattacctacatgtggcactggacctgttggagcggaagctccgctctctctggcgacggcctttcaatgtgaccgatgttcttaccccagcacagttgaatgtgctgagtaagtcctccggctgcgcctatcaggatgtcggcgtcacttgcccagaacaggacaagtaccggactatcactgggatgtgtaacaaccggtgcgggtggttgggcgtagctgctggcaccgggcttcgagaggccagccgcacaccacaagcctcgagatgtcagaggccggttcttccttgccgcaggtcacctaccttgggagctagcaaccgcgctttcgttagatggctgcccgcagaatacgaggacggctttagtctcccctatggctggaccccaggtgtgaagcgcaacgggtttcctgtggctctggctcgagcagtctcgaacgaaattgtccgttttcctaccgaccagctcacccccgatcaggaaagaagcctgatgttcatgcagtggggtcagctgttggaccacgatctcgatttcactccggaacctgctgcgcgggccagctttgtcacaggtgtcaactgtgaaacttcctgcgtgcagcagcccccctgctttcctctgaaaatcccacctaacgatccccgaattaagaatcaggccgactgcatccctttctttcgaagttgccccgcatgtccagggtccaacattaccatcagaaatcaaataaacgcacttactagctttgtggacgcctccatggtgtacggatctgaggagcctctggctagaaaccttcgaaatatgagcaaccaattgggcctgctggccgtgaaccagaggtttcaagacaacggtagagcgctccttccattcgacaatctgcacgacgacccctgccttcttactaataggtccgctcggataccttgcttcctcgccggcgatacccgaagttcagagatgcccgagcttacttcaatgcatactctattgcttcgtgaacacaatcgacttgccacggagctaaagagccttaacccgaggtgggacggggaacgactttaccaggaggctcgcaaaatcgtcggggcaatggtgcaaattatcacttatagagactacctgccgcttgtcttgggccctaccgccatgagaaagtacctccccacataccggagctacaatgacagtgtcgatcctaggatcgctaatgtcttcacgaatgccttccggtacggccacaccctgatccagccgttcatgtttcgattggacaaccgctatcagcccatggaacccaatcctcgcgtcccactgtcccgggtgttctttgccagctggcgcgtggtgctggaaggtggaatcgaccccattctgagaggtcttatggcgactcctgcaaagctgaatcggcagaatcagatcgcagtggatgagatccgcgagcgcctgttcgaacaggtgatgcgcatcgggctggacctccccgcattgaacatgcagcggagtcgagaccatggcctacccgggtataacgcctggagacgcttttgtggcctgccacagccagagaccgttggccagctcggtactgttctccgcaacttaaaactcgctcgaaaactcatggaacagtacgggactcccaacaacattgacatttggatgggcggtgtatccgaaccactcaagcgaaaaggaagagttggacctctacttgcttgtattataggtacccaattcaggaagttgcgggacggcgatcgtttttggtgggagaatgaaggtgtcttttccatgcagcagagacaggctctcgctcaaatcagcctgcccagaatcatctgtgacaatactgggatcacaaccgtttctaaaaataacatattcatgagtaactcctacccccgggatttcgtgaactgcagcacattgcccgctctgaatctggcctcatggcgggaagcaagctag

SEQ ID NO: 125284 - DNA, 1542 bp, Artificial Sequence
  Description of Artificial Sequence: Synthetic coding sequence
atgccctcttgggctctatttatggtgacgtcttgcctgttgttagcacctcagaatctggcccaagtctcttctcaagatgtatccctcctggctagtgatagcgaacccctgaaatgcttctcccgcactttcgaggacctcacatgcttctgggatgaggaggaagctgcgccatcgggaacatatcagttattgtacgcttatcctagagagaagccccgcgcatgccctctgtcatcgcaatccatgccacactttgggactagatacgtttgccagttcccagaccaggaggaagtgaggctgtttttccctctccatctctgggttaagaatgtcttcctgaatcaaacgcgcacccagagggtgttattcgtggatagcgtgggtctccccgcacccccgtcaatcatcaaggcaatgggtggcagccaacctggagaactgcagatttcctgggaggagccagcacctgagatctcagactttctgagatatgagctgcggtatggcccccgcgatcccaagaactccaccggacctacagttattcagctgattgccacagagacctgttgccctgcacttcaacgcccacatagcgcatccgcactggatcagtccccttgtgcccagcctactatgccttggcaagatgggcctaaacagacctctcccagccgagaagccagtgccctcactgctgaaggtggatcgtgcttaatcagtggactgcaaccaggtaatagttactggttacagctgcggtccgagccggacggcattagccttggcggctcctggggatcttggagtctgccagtcacggtggatctgccgggggatgctgtcgcgctgggactgcagtgctttacactcgacctgaaaaatgtgacctgccagtggcagcagcaggatcatgcaagctcccaggggtttttttatcactcccgtgctcgctgttgcccccgggatcgctatccaatttgggagaactgtgaggaagaggaaaaaactaacccggggcttcagacccctcaattctcccggtgtcactttaaaagcagaaatgacagcatcatccatatcctagtagaggtcacaactgcgcctgggacggtacactcttacctgggatcgcctttttggattcaccaggcagtgaggctgcccacccctaatttgcattggagggaaattagctccggccacttagagctggagtggcagcatcctagttcctgggcagcccaggaaacatgctaccagctgcggtatacaggcgagggccaccaagattggaaggtgctcgagccaccgcttggagcaagagggggaaccctagagctgcggccccgaagtcgctaccggcttcagctgagggccaggctcaacggacctacttatcagggcccttggtccagctggtccgacccaactcgcgtcgaaacggccacggagacagcctggatctctctagtgactgcgctccatctagtgcttggactgtctgccgtgctgggacttctcttgctctag

SEQ ID NO: 125285 - DNA, 1908 bp, Artificial Sequence
  Description of Artificial Sequence: Synthetic coding sequence
atgccatcttgggccttgtttatggtgacatcttgcctcctgctggcaccacagaatttagcacaggtgtcctcgcaggatgtgagcttgctcgcctctgactctgagcctctgaagtgctttagtcgcacatttgaagacctcacctgcttttgggacgaagaggaggcagcaccttcggggacgtatcagctcttatacgcctaccctcgggaaaaaccaagggcctgtcccctgtcgtctcagagcatgccccacttcggaacgaggtacgtgtgccaattcccagaccaggaagaggtgaggttattcttccccctgcatctgtgggtcaagaacgtgttcctgaatcaaacacggactcaaagagtgctgttcgtggattcggtcggtctgcctgccccaccctcaatcatcaaagcgatggggggtagccagcccggagagctgcagatcagttgggaagaacctgctcctgagatcagcgatttcctcagatatgagctgcggtatggcccacgtgatcccaagaattccactgggcccactgttatccagcttatagccacagagacatgttgtccagctctgcaacgaccgcactctgcaagcgccctggatcagagcccttgtgctcagcctacaatgccttggcaggacggtccgaagcaaacttcaccctccagggaggctagcgctctgacagccgaggggggctcctgtctgattagtgggttgcagcccggtaattcctactggcttcagctcagaagcgagccagatgggatttctctgggcggctcttgggggtcctggtcactccctgtaaccgtggatctccccggagatgcagttgccctcggcctccagtgcttcacccttgacctgaaaaacgtgacatgccagtggcagcagcaagaccatgcatcatcacaggggtttttctaccatagtcgcgctcgctgctgcccccgcgataggtaccccatctgggaaaattgcgaagaggaagagaaaactaatccagggctgcagaccccgcagttcagtcgttgccactttaaatcccgcaacgactctatcatccacatcctagtagaagtgacaacagcgcccggcaccgtccactcatacctggggagtcccttctggatccatcaggcggtgcgccttccgactccaaatcttcattggcgtgagatatctagtggccacctggagctagaatggcagcaccccagttcatgggcagcccaagagacatgttaccagctcaggtacaccggggagggtcaccaggattggaaggtgcttgagccacccctcggcgctcggggcggcaccctcgaactgcggccacgtagtagatacagacttcaacttagagctcgtctgaatggtccaacgtaccagggtccgtggtcctcttggtctgaccctacacgggtggagactgccaccgaaaccgcctggatctctctggtgacggctctccacctggtgctgggtctgtccgccgtcctgggacttctgctactgcgatggcagtttcctgcccattatcgccgtctgcgccacgccctctggccaagcttgccagaccttcacagagtgctcgggcaatacctacgagatacagccgctttaagcccaccaaaagcaaccgtatccgatacatgcgaagaggtggagccctccctgctcgagattctccctaagtcttccgaacgaacccccctgcctttgtgcagctctcaagcacagatggactaccgtcgcctgcaaccctcttgtctgggaaccatgcccctgagcgtttgcccacctatggccgagagtgggagctgctgtacaactcacatcgccaatcattcttacctgccattgtcttattggcagcaaccctag

SEQ ID NO: 125286 - DNA, 1650 bp, Artificial Sequence
  Description of Artificial Sequence: Synthetic coding sequence
atgcctagttgggctctctttatggtcacaagctgcctcctcctggccccccagaatctggcacaggtgtcctcccaagatgtttccctgctggcaagcgacagcgagcctcttaagtgcttcagccgcacattcgaggacttaacctgcttctgggatgaggaggaggcggccccttccggcacctaccagctgctctacgcatatccacgagaaaagccgcgcgcttgccctctgagcagccagtccatgccccacttcggaacacggtatgtgtgccaattccctgaccaggaagaggtgcgactgttttttccactgcacctatgggttaagaacgtcttcctgaatcagactcgaacccagcgggtcctctttgtggactccgtgggtctcccggcgccgccatccatcataaaggctatgggtggttcgcagccaggagagctgcagataagttgggaagagcctgcccctgagatctccgattttcttcgttatgagctgcgttatggaccacgggatcctaagaatagtaccggccctaccgtcatccaactgattgctacagaaacttgttgtccggcgttgcaacggcctcatagtgccagtgccctggatcaatccccatgtgctcagcctacgatgccctggcaagacggccccaaacaaactagtccttctcgcgaagcctctgcacttaccgcggaaggcggcagctgtctgattagtgggctgcaacccggaaactcatattggctgcaactgaggtccgaacccgacggtatttcgctaggggggtcgtggggctcttggagcctgccagtcacggttgatcttccaggagacgctgttgctttagggctgcaatgcttcacccttgacctgaaaaatgtcacatgtcagtggcagcaacaagatcacgcaagcagccagggcttcttttatcattcaagagcgaggtgctgtcctagggaccgctaccccatctgggagaactgcgaggaggaggaaaaaacgaaccctggactccagacaccgcagtttagcagatgtcacttcaagtcacgcaatgattctattatccacatcctagtagaggtgacgactgctcccggtaccgtccattcctacctgggaagcccattttggatacaccaagctgtccgccttcctacccccaacctgcactggcgggagatttcctcaggtcatctggaactggagtggcagcacccatcatcatgggctgcgcaagaaacatgctaccagctgcgatacactggggagggacaccaggactggaaggtcctagagccacccctgggcgcgcggggcggaaccctggaattacgcccaaggtcccgatacagattgcagctaagggcaagactcaatggtccaacctaccagggtccttggtctagttggtccgaccctacgcgcgtcgagaccgctaccgaaaccgcttggatcagcctagtgacagcattgcacctcgtgttagggctctcggctgtgctgggcctactgctgctgcgatggcagtttcccgcccattatcgctatcggccccgacaggccggtgactggcgctggaccagatggtctagacgcccagtgaaccggcactcatggttcgctctctag

SEQ ID NO: 125287 - DNA, 2817 bp, Artificial Sequence
  Description of Artificial Sequence: Synthetic coding sequence
atgactctcctggggtctgagcactcactgctcattcgctctaagtttcgcagcgtgttacagctccgcctgcagcagcgacgtacgcaggagcagctcgctaatcaggggatcattcctcctctcaagcgccccgccgagtttcacgaacagcgcaagcacctcgactccgacaaagctaagaattcattgaagcgaaaagcacgaaatcggtgcaactcagcagatctggtgaatatgcacattctgcaggcatctacggcagaacggtcgattccgaccgctcaaatgaaactcaaaagggctcggttggccgacgacctgaatgagaaaattgctcttagacctgggcctctagagttagtggagaagaacatattgccagttgacagcgccgttaaggaagccataaagggcaaccaggtgtccttcagcaagagcaccgatgcgttcgcattcgaagaggacagctcctcagacgggttaagcccagatcagaccagatctgaggatccccaaaacagcgcagggagtccccctgatgccaaagcttctgacactccatcaacagggagcctgggcaccaaccaagatcttgctagcggctcggagaacgatcgaaatgattccgcgtcccagccatcccatcagtcggatgctggcaaacagggcctgggacctccctctacacctatcgccgtgcacgccgccgtgaagtccaaatccttaggcgatagcaagaaccgccacaaaaagccaaaagacccaaagcccaaggtcaagaagctgaagtaccaccagtacatcccgccagaccagaaggcagaaaagtcacctcctccgatggattcagcttatgccaggctgttgcagcaacaacaactgtttctacagctccagatcctctcgcagcagcagcaacagcagcagcacaggtttagctacctcggcatgcaccaagctcagctcaaagagccaaatgagcagatggtgagaaatcccaactccagtagtacaccactcagtaacacaccgctgagtccagttaaaaactcgttctcgggtcagaccggagttagctcattcaagccgggaccccttccccctaacctcgacgaccttaaggtctcagaactgcggcagcagcttcgtatccggggactgccagtgtccggtacaaagacggccctgatggaccgcctgaggccgtttcaggattgttccggcaatcctgtccctaactttggtgacattactactgtgaccttccctgtgaccccgaacactctccccaactaccagagctctagttcgacgtcggcactgtcaaacgggttttatcatttcggatccacttcgagcagccctcccatctctcccgcttctagcgacctttccgttgccggctcactccctgacacatttaacgacgcatcacctagctttggtctacaccccagccctgtgcatgtgtgtacggaggagtctctgatgtctagtctgaacggggggagcgtcccttctgaactggatggcctggattcagaaaaggacaagatgctagtcgagaagcaaaaagttattaatgagctcacgtggaaactgcaacaagagcaacggcaagtggaagaacttcgaatgcagcttcagaagcagaaaagaaataactgctcagagaagaagcctttgcctttcctggctgcaagcatcaagcaggaggaggccgtatcttcgtgccccttcgcaagtcaggtcccagtgaagagacagagttcgagcagcgagtgccacccgcccgcatgtgaagccgctcaacttcagcctctcggcaatgcccactgcgtggagtcatctgaccagactaacgtgcttagttcaacatttctgtcaccgcagtgctccccgcaacatagcccactaggggctgtaaagtcacctcagcacatttctttgccaccaagccccaataacccacatttcctgcccagctctagcggtgcccagggggagggtcaccgcgtctcaagcccaataagctcacaggtgtgtaccgcccagatggctggacttcactcaagcgacaaagtggggcctaaattctctatcccgtcacctacgtttagcaagagctcttctgccatatccgaggtgacccaaccaccctcgtatgaggacgcagttaaacagcagatgactaggtcccagcagatggacgaactcttggatgtgctgattgaatctggggagatgcccgccgacgcccgtgaagaccacagttgtcttcagaaagtcccaaagatccctaggtccagcagatcccctaccgctgtgctgactaaaccaagcgcaagcttcgagcaggcttcttctggatcacagattcccttcgatccctatgccaccgacagtgatgaacacttggaggttttacttaactcacagtcgccccttggaaagatgagtgatgttactttgctaaaaatcggttcagaagagcctcactttgacggaattatggatgggttttcaggcaaggctgctgaggatctgtttaacgcacacgaaatattgcctggacccctaagtcccatgcaaactcagttctccccgagctctgttgattctaacgggcttcagctgtctttcactgaatctccgtgggaaactatggagtggttggatcttacacccccgaactccacgccgggcttctcagcactgaccacaagcagcccttctatctttaacatcgattttctagacgtgacggatctgaacctcaatagcagcatggacctgcatttgcagcaatggtag

SEQ ID NO: 125288 - DNA, 1989 bp, Artificial Sequence
  Description of Artificial Sequence: Synthetic coding sequence
atggatagtgcgtacgcccgcctgctacagcagcagcagctgttccttcagctgcaaattctctcacagcaacagcagcagcagcagcaccgcttttcctacttggggatgcaccaggcccagctgaaagaacctaatgagcaaatggtgaggaaccctaactcctcttcgacacccctgagtaatacgccccttagccctgtaaaaaattctttttccggacaaacaggagtgagcagcttcaaaccgggtcccctgccccccaatctggacgatttgaaagtgtctgagttgaggcagcagctgcgcatcagaggattacctgtgagtggtacaaagacggcccttatggaccgcttgagaccattccaggattgctcaggaaatccagtcccaaattttggcgatattacaactgtcacctttcctgtcaccccgaatacactacctaattatcagtctagtagttcgacgtcagccctgagtaacggcttctaccatttcggcagcacaagctcctctcctcctatatccccagcttcttctgatctgtccgtcgcagggagtcttccagatacctttaacgacgcaagcccgtctttcggcctgcaccccagccccgtacacgtttgtacagaagagtctctgatgagcagtctgaacggcggatctgtacctagtgaacttgacggactcgattcagaaaaggacaagatgctggtcgagaagcagaaggtcatcaacgagctgacttggaagttgcagcaagagcagaggcaggtggaggagttacgcatgcagctgcagaagcagaaaagaaacaactgtagtgaaaagaagccattgccatttttagctgccagcatcaaacaggaggaggccgtctcctcctgtccctttgcttcccaggtccccgtgaagagacagtcttccagcagcgaatgccatccccccgcctgtgaggcagctcagttacaaccccttggcaacgcacattgcgtggaaagctctgaccagaccaatgtcttaagctccacattcctgtcccctcagtgttctccacagcactcccctctgggtgccgtcaagtctccgcagcacatctctctgccgccttctcctaataacccccactttctcccctcttcctcaggtgcccaaggtgaggggcatagggtgtcatcccccatttcctcacaggtatgcacagcgcagaatagtggtgctcacgacgggcaccccccatcatttagtcctcactcctcttctctccatccacctttctccggcgctcaagctgatagtagccatggtgctggaggcaatccctgtcctaaaagcccctgcgtgcagcagaaacagatgaccaggagccagcagatggacgagcttctggacgtgttgatcgagtcaggagaaatgcctgctgacgctcgagaagaccattcttgcctgcagaaggtacccaaaatacctagatcgtccagatcccccaccgccgtcctcacaaagccttctgcctcattcgagcaggcctcctcaggatctcagatcccctttgatccctatgccacagacagtgacgagcacctagaagtgctgcttaacagccaaagccctctgggcaagatgagtgatgtaacactgttgaaaatagggtcagaggaaccccattttgacggcatcatggacgggttcagcggcaaggctgcagaggatctgttcaacgcacacgagatcctccctggacctctgtctccaatgcagactcaattctccccgtcctcagtggactccaacggactacagttgtctttcacagagtcaccctgggaaaccatggaatggctggatctcacaccgccgaacagtacaccaggcttttctgccctgacaaccagttcccccagcatcttcaatattgacttcctcgacgtgacagatctgaatctcaatagtagcatggatttacacctccagcaatggtag

SEQ ID NO: 125289 - DNA, 2055 bp, Artificial Sequence
  Description of Artificial Sequence: Synthetic coding sequence
atgaagttaaagagagccagactcgctgatgaccttaacgagaagattgcgctgaggcccggtccgttagagcttgtagaaaagaatattttgcctgttgacagcgcggtcaaagaggccatcaaaggcaaccaggtgtcattttcaaagagtactgatgccttcgcatttgaagaggacagttcttcggatgggctgtcccccgatcaaacacgcagcgaagatccacagaacagcgcaggttcaccgcctgatgctaaggcctcagacaccccttcaaccggatctctaggcactaaccaagatctcgcctcaggctctgaaaatgatcgcaacgactctgcaagccaaccttctcatcagtccgatgcgggaaagcaagggctgggtcctccttccactccaatcgcagtacacgccgccgtcaagagcaagtcactaggggactctaagaacagacataagaaaccaaaagaccctaagcctaaggtaaagaaactgaaataccatcagtacatcccacctgaccagaaagccgagaaatcgcctcccccgatggattcagcctatgccaggctcctgcagcaacaacaactcttcttgcaattgcagattctctctcaacagcagcagcagcagcaacaccgcttctcctatctcggaatgcaccaggctcaacttaaggagcccaatgaacagatggttcgcaacccaaacagtagcagtactccactatcaaataccccgttatcccctgtgaaaaactccttttctggccagaccggtgtcagctccttcaagccaggtccccttcccccgaacttggatgatctgaaagtctccgagcttcggcaacagctcaggataagggggctgcccgtgagcggaaccaagacagctcttatggatcggttgcgtccgtttcaggattgttccggcaacccagtccctaactttggtgacattacgacagtgacgtttcccgtgactcccaataccttgcctaattaccagtccagcagttcaacctcagccctgtccaacggattttaccatttcggttccacctcatcttcacctccaatatctcccgcctcaagtgatctctcggtcgccggttccctccccgacacctttaatgacgcctctccgagcttcggactgcatcccagccctgtgcacgtatgtacggaagaaagcctgatgtcttccttaaacggtggctccgtcccctcagagctggatggcctcgatagcgaaaaggataagatgttagttgagaagcagaaagtgatcaatgaattgacctggaaacttcagcaggagcagcggcaggtcgaggagctacgtatgcagctccaaaagcagaagaggaacaactgtagtgagaaaaagccactgcccttcctggcagcctctatcaaacaagaggaagccgtaagctcctgcccatttgccagtcaagtgcccgtcaaaaggcagtccagctcatcggaatgccacccccctgcctgcgaggccgcccagctccagcctctcggaaacgcgcactgcgtagaaagctcagatcagaccaatgtgctgagctcaacattcctgtcacctcagtgctctcctcaacactccccattgggggccgttaagtcgcctcagcatatctcgcttccaccctcaccgaataaccctcatttcctccctagctctagcggtgcccagggcgaaggccatcgcgtgagttcacctatctccagtcaggtgtgcaccgcacagaattccggcgctcatgacggccacccaccctctttttcacctcactctagcagtctgcatcctcccttctccggggcccaggccgactcctcccacggagcagggggtaacccttgccctaagtccccttgcgtccagcagaaaatggcaggcctgcattcttccgataaagtcgggcccaaattctcgatcccgagcccaacattctctaagtcttcttccgccatttcggaggtcacccagccaccatcatacgaagatgcggttaaacaagtcactatgtag

SEQ ID NO: 125290 - DNA, 2961 bp, Artificial Sequence
  Description of Artificial Sequence: Synthetic coding sequence
atgacacttttggggtccgaacatagcctcctgatcagatccaagttcagatctgtgttgcagctgcggctgcagcagaggcgaacccaggagcagttggcaaaccagggcattatcccccctcttaagaggcctgctgaattccatgagcagcggaagcatctggattccgacaaagctaagaatagcttgaagcgcaaggctcggaatagatgcaacagcgcggatctagtgaacatgcatatcctccaagcttccaccgctgagaggagcatccctactgctcagatgaaactgaagagggcccgcctggccgatgacttgaacgagaaaattgctcttcgccccggcccactggaactggtggagaaaaacatccttccagtggactccgccgtcaaagaggctattaaaggaaaccaagtgtcattctctaaatcaacggatgccttcgcgttcgaagaagatagctcatcagacggcctttcacccgaccagaccaggtctgaagatccacagaacagtgctggctcccccccagatgccaaggcaagtgacacaccctcaaccggctccctcgggaccaatcaggatttagcttccggctccgaaaatgatcgcaatgattcagccagccaaccctcgcaccaatccgatgctggtaagcaaggtctgggccccccgtcaacacccattgctgttcatgccgctgtgaaaagtaagtctttgggggacagcaagaacaggcataaaaagccgaaggaccctaagcccaaggttaagaaactgaagtatcaccaatatatccccccagatcagaaggctgaaaaaagccctccaccaatggactctgcctacgccagactgttgcagcagcagcagctgttcctacagcttcagatactgagccagcagcaacagcaacagcagcataggttcagttatctggggatgcaccaggcccaactgaaggagccaaacgaacagatggtcaggaatccaaattcatcatcaactcccctcagtaatactcctctgtctccggtcaaaaacagcttctcagggcaaacaggcgtatcctccttcaagccagggccactcccccctaatttagatgatctgaaagtcagcgagttacgacagcagctgcggatcaggggattgcccgtctctggaaccaagaccgcacttatggatcggttgaggcccttccaggattgtagcggcaaccccgtcccaaattttggggacattaccactgtgaccttccccgtgacccctaatactttgccaaactaccagtcctcgtctagcacttctgcactgagcaatggtttctaccacttcggtagtacctccagcagtccacccatcagtccggcttccagtgacctaagcgtggccgggtctctcccagataccttcaacgacgcaagcccatctttcggtctgcacccctcacccgtgcatgtctgtacagaagagtccttgatgagcagtctgaacggcgggtctgtgccttccgaacttgatggcctcgattccgagaaggataaaatgttggtcgaaaaacagaaggtgatcaatgaactgacatggaagcttcagcaggaacagcgacaggtagaagagctgaggatgcaattgcaaaaacaaaagagaaacaactgcagcgaaaaaaaacctttgccttttttagcagcatctataaaacaggaggaggcggtgtcctcttgtcctttcgctagccaggtccctgtgaaaaggcagtcttctagctctgaatgtcacccgcctgcctgtgaagcagctcaattgcagcctctgggtaacgctcattgtgtggagtcctcggaccagacaaatgtgctctccagtacttttctctctccccaatgttccccccagcactctccattgggggcagttaagtcgccccagcacattagcttacctccttcacccaataacccgcacttcctcccttcctcatcaggagcccagggtgagggacatcgcgtgtcctctccaatctcatcccaggtctgtaccgcacagaactcgggggcccatgacggccacccaccttctttcagtcctcattctagcagcctgcatcctccttttagcggcgctcaggccgactcatcgcacggggctggcggaaacccgtgccctaaatccccctgcgtgcagcaaaagatggctggcctccactcgtcagataaggtggggcccaaattcagcattcccagcccaacgttcagcaaatcaagtagcgcgatctctgaggtcacacaaccgccaagctatgaagatgcagtaaaacagcaaatgacacggagtcaacagatggacgagctgctggacgttctcattgagtccggcgaaatgcctgccgatgcgcgggaggatcattcttgcttgcagaaggtgcccaagatcccccgctccagcagaagcccaaccgcggtgctcacaaagcccagtgcatcattcgaacaggcatccagcggaagccagataccgtttgacccctatgctacggacagcgacgagcatctcgaggtcctcctaaattcacagtctccactgggtaagatgtctgacgttacacttttgaagattgggtcggaagagcctcacttcgatggcatcatggacggcttcagcgggaaggctgctgaggatctcttcaacgctcacgagattctcccagggccgcttagccctatgcagacacaattctctccctcaagcgttgactctaatgggctccagttgtcatttacagaaagcccttgggagacaatggaatggttggacctcaccccaccaaattccacccctggattcagcgccctgaccacctcctcccccagtatttttaatattgatttcctggacgtcaccgatctgaacctgaactcaagtatggatctgcacctgcagcaatggtag

SEQ ID NO: 125291 - DNA, 1947 bp, Artificial Sequence
  Description of Artificial Sequence: Synthetic coding sequence
ttcctgcagttgcagatcctgagccagcagcagcagcagcagcagcatcggttctcttatctgggaatgcaccaagcccagctgaaggaacctaacgagcagatggtccggaatccaaattcgagttccacaccccttagcaataccccgctctcccctgtgaaaaacagtttctctggccagacgggcgtttcttccttcaaacccggtcctcttcccccgaaccttgacgatctaaaggtgtcagaactacgtcagcaactgaggatccgggggctgcccgtgtcagggaccaagaccgccttgatggatagactgaggccattccaggactgtagtggcaaccctgtccctaatttcggggatataaccactgtgacatttccggttacaccaaacacactgcctaattaccagagtagctccagcacctctgcactgtctaacggcttctatcatttcgggtcaacttctagctcaccgcctatatcccctgctagcagcgatctatcggtggccggaagcctccccgacacattcaacgatgctagccccagtttcgggcttcacccctccccggtgcatgtgtgcacagaggagtcactgatgtctagcctgaacgggggctctgtgccgtccgagcttgatggcttagacagcgaaaaagacaagatgctggtcgaaaagcagaaggttataaacgagcttacttggaaactgcaacaggagcagaggcaggttgaagagcttcggatgcagctgcagaaacaaaagagaaacaactgctcagagaaaaaacctttaccttttctggccgcctcgattaagcaagaggaagctgtgagctcatgcccgtttgcctcccaagtgccagtgaagaggcagtcttcaagctctgaatgtcaccctcccgcttgtgaggctgcacagctacaaccgctgggcaatgctcattgtgtcgagagtagtgatcagaccaatgtgctcagcagtacgtttctttccccgcaatgctccccccaacattccccgctgggcgcagtaaaaagtccccagcatatttcccttcctccttcacccaataacccccactttctgcccagtagcagcggcgctcaaggggagggacaccgggtgtcatcacctatctcatctcaagtgtgcacagcccagaattccggtgctcatgacggacacccaccgagcttcagcccacactcctcttcgctgcatcctcctttcagtggagctcaggccgatagctctcacggggctggtggaaatccgtgtccaaagagtccatgcgtgcagcagaagcagatgacccgtagccaacagatggatgaactgcttgacgttctgatcgagtctggagagatgccagccgacgcacgtgaggaccattcttgtcttcaaaaggtccccaaaatcccacgcagctcacgctctcctacagcagtgctcacaaagccaagcgccagctttgaacaggccagttccggttcacaaatcccattcgatccctatgctactgattccgatgagcatctagaggtactacttaactctcagagcccacttggcaaaatgagcgatgtgacattgcttaaaatcggcagcgaggagccacacttcgacggtataatggacgggttttcgggcaaggctgcagaagacctttttaatgcccatgaaatactccccggccctctttcacctatgcagacccagtttagtccatcaagcgttgactccaacgggttgcagctgagttttaccgagtccccctgggaaactatggagtggctcgacttgacccctcctaactcaacacctgggtttagtgctttgaccacttcttctccaagcatcttcaacattgatttcttggatgtgaccgatttgaatcttaattcaagcatggatctgcacctccaacagtggtag

SEQ ID NO: 125292 - DNA, 1515 bp, Artificial Sequence
  Description of Artificial Sequence: Synthetic coding sequence
atgagattcttctgcgcccggtgttgcagttttggtcccgaaatgccggccgttcagctcctgctgcttgcttgcctggtgtgggatgtgggcgctcggaccgctcagctgcggaaggctaatgatcagtccgggagatgtcagtacacttttagcgtggccagtccaaacgagagctcctgccccgaacaatctcaggccatgtctgtcatacacaatctccagcgcgactcttcaacgcagaggttggacctggaggccaccaaggcccgcctatcaagccttgaaagtctactgcaccagctgacactcgaccaggccgccaggccccaggagacacaggagggtctgcagagagaactgggcacacttcgccgggagcgtgaccagctagaaactcaaacacgcgagttggaaactgcgtattccaatctacttcgcgacaaaagcgtgttggaggaggaaaaaaagaggctacggcaggagaacgagaatctggccagacggttagagagttcgtcccaggaagtcgcaagattgcgcaggggccaatgtcctcaaactcgggatactgcaagggcggtgcctcctgggtcccgcgaggtgagtacctggaatctggacacactcgcctttcaagaactgaagtccgagttaacagaagtgcctgcctcccggattctgaaagagtctccaagcggctatctgagatctggtgagggcgacacaggatgtggggaactggtgtgggttggagagccactgactctgcgtaccgccgaaacaatcactgggaaatacggagtgtggatgcgagaccccaagccgacatacccctacacccaggaaaccacctggaggatagatacagtgggaaccgatgtgcggcaggtcttcgagtatgacctcatcagccagtttatgcaggggtacccgtcaaaggtccacatcctgccgcgccccctagaatcaaccggggctgtggtatactccgggtcactttactttcagggagccgaatcaaggaccgtaattcggtatgagctaaacaccgagacagtcaaggctgagaaggagattcccggagccggatatcatggacagttcccatattcttggggtgggtatacagacatagacttggccgtggatgaggctgggctgtgggtcatctattcaacggacgaggccaaaggagccattgtcctgagcaagctcaaccccgagaacctagaactagaacagacgtgggaaacgaatatccgcaagcagtcggtcgcaaacgcattcataatatgcgggactctttataccgtttccagctatacctcagccgacgccactgtaaactttgcctacgatactggaactgggatcagcaagaccctgaccatcccattcaagaatagatataagtatagttcaatgatagattacaatcccctggaaaagaagctgttcgcttgggacaacttgaacatggtcacatatgacatcaaactcagtaagatgtag

SEQ ID NO: 125293 - DNA, 1374 bp, Artificial Sequence
  Description of Artificial Sequence: Synthetic coding sequence
atgcggttcttttgcgctaggtgttgctccttcgggcctgagatgcccgcggtgcagctattgctcctcgcgtgcctggtgtgggacgtgggagcacggactgcccaattaagaaaagccaacgaccagagcgggaggtgccaatataccttctccgtggcctccccaaatgagtccagctgtccagagcagtctcaagctatgtccgtcatccacaatctgcagcgggactcatccacacagcggctcgatctggaggcaactaaggctaggctgtcctcactggagtctctgctgcgtgacaaatccgtccttgaagaggagaagaagagacttcggcaggagaatgaaaatctggcccgtaggctggaatcttctagccaggaagtagcccgactgcgacgcggacagtgccctcagacaagagacacagctcgcgcagtccccccaggtagcagggaagtcagcacctggaacctagacaccctggctttccaggagttaaaaagcgagttgaccgaggttccagcctctcggattctcaaggaatcgccttctgggtacctgagaagtggggaaggtgatacaggttgcggggagctggtgtgggtcggagaaccactgacacttagaaccgcggaaacgattacaggcaaatacggggtttggatgcgcgacccaaaacctacatacccctacacgcaggagactacttggagaatagacacagtggggaccgacgtgcgtcaggtgtttgaatatgacctgatcagccagtttatgcagggttatccctcaaaagtccacatactgcccagacccctggagagcaccggtgctgtggtatacagtgggagcctctacttccagggggctgagtcgagaactgtaatcaggtatgaactgaacacggagactgtgaaagccgagaaagaaatcccaggcgcgggttatcatggacagtttccctactcttggggaggatacacagatatcgacttagccgtggacgaggcaggactctgggtcatttactctaccgatgaagctaagggcgccatcgtgctcagtaagttgaaccccgaaaaccttgaattggaacagacgtgggaaacaaacattcggaagcaatccgtggcaaacgcgttcattatctgtggtaccctttacaccgtaagttcttatacaagtgcagacgctaccgtgaacttcgcatacgacaccggcacaggaatttctaagaccctcacgatacccttcaagaacaggtacaaatatagctccatgattgattacaaccctttggaaaaaaaattgtttgcttgggataatctcaatatggtcacgtatgacatcaaactcagcaaaatgtag

SEQ ID NO: 125294 - DNA, 1314 bp, Artificial Sequence
  Description of Artificial Sequence: Synthetic coding sequence
atgagtgtgatccacaatttgcagagggattctagcacacaaaggctggacttagaagcgacgaaagcccgattaagtagtctggaatcactgctgcaccagttgaccctggatcaggccgcacggccccaggaaactcaggagggtctccaacgggagctgggaacattgcgtagagagcgcgatcagctcgagacccaaacaagggaactggagaccgcttacagtaacctactgagggacaaatctgtcctggaggaggaaaagaagagactcaggcaggagaacgaaaatctggcgcgccgtcttgagagctcatcccaggaggtcgcacgcctgcgtagaggtcaatgccctcaaacacgggataccgcgagggctgtgcccccaggatccagagaagtttccacatggaatctggatactcttgcattccaggagctgaagtccgagcttacggaggttcccgcaagtcgtatcctgaaggagtctccttccggttatctgagaagcggcgagggggacacagggtgcggtgaactcgtctgggtaggggagcccctgacgctgcgcaccgcagaaaccattaccggaaaatacggagtatggatgcgcgaccctaagccaacatacccttatactcaggaaacaacctggagaattgataccgtcggtaccgacgtcagacaggtgttcgagtacgatcttatatctcagtttatgcaggggtacccttcaaaagtgcacatccttcccagacccttggagtcgaccggggctgtggtatatagtggcagcttgtacttccaaggcgccgaaagccgtactgtgattcggtacgaacttaataccgaaaccgtcaaggcagagaaggagattcccggcgccgggtaccatggtcagttcccttacagctggggaggctatacagatattgatctcgctgtagacgaggccggactttgggtgatatacagcaccgatgaggcaaaaggggccattgtattgagtaagctgaacccagaaaatcttgagctagagcagacgtgggagacaaatatcaggaagcagtccgtggctaacgcctttatcatctgtggcacgctgtataccgtgagtagttatacgtccgcagatgctacagttaacttcgcatatgacacaggcaccggtatctccaaaaccctgactatcccttttaagaatcggtataagtattccagtatgattgactacaaccccctcgagaagaagttgttcgcctgggacaatctgaacatggtaacctacgacattaagctctcaaaaatgtag

SEQ ID NO: 125295 - DNA, 1035 bp, Artificial Sequence
  Description of Artificial Sequence: Synthetic coding sequence
atgaggtttttctgcgcacggtgctgctcctttggcccagagatgccagccgtgcagctgctgctgttagcgtgtcttgtgtgggacgtgggggctcggaccgcgcagctccggaaggcaaacgatcagagcggccggtgtcagtacaccttttcggtcgcctcccctaatgagtcttcgtgccccgaacagtctcaggctatgtcagtgattcacaacttgcagagggactcctctacgcagaggctggatctggaggccaccaaggcccgactgagttcacttgaatctcttctgcaccagctgacgctggatcaggccgcacgcccccaggaaacccaggaagggctgcaacgcgagctcggaaccttgcggagagagagggatcagctggagacacagaccagagaacttgaaaccgcctactcaaaccttctccgagataagagtgtgctcgaggaggagaagaagcgattgcgccaggagaacgagaatctggccagacggttggagtcatcttctcaggaggtggcacggttgaggcgagggcagtgtccgcagacccgtgacactgctagagctgtgccccctgggagcagggaggtaagtacatggaacctcgacactttagcgtttcaggagcttaagagtgaacttacagaggtgcccgcctccagaattctcaaggaatccccgtccggatatctgagaagtggagagggggacaccggctgcggcgagctggtgtgggttggtgagccacttaccttaagaacggctgagacaataacaggcaagtatggcgtgtggatgcgagacccaaaacctacctacccctacacgcaggagacgacttggcgaatagatacggtgggcactgacgtccgccaggtcttcgagtatgacctgatttcccaatttatgcaaggctatccaagcaaggtacacatcctgccccgacccttggagtccaccggcgcagtggtgtacagtggaagtctctatttcagagctctaagtcccgaactctcttag

SEQ ID NO: 125296 - DNA, 1521 bp, Artificial Sequence
  Description of Artificial Sequence: Synthetic coding sequence
atgggacggaagaaaatccaaatcactagaattatggatgagcgcaatcgacaagtcacatttaccaaaagaaaattcgggctgatgaagaaagcatatgagttatctgtgctttgcgactgcgagattgctcttattatcttcaactccagcaataagctgttccagtatgcgtccaccgatatggacaaagtgctactgaagtataccgagtacaatgaaccacacgaatcccggaccaactccgacatcgtcgaaacacttagaaagaaaggactaaatggatgtgagtctcccgacgccgatgattattttgagcactcacctctgagtgaagacaggttcagtaagttgaacgaagatagcgactttatcttcaagcggggtccgcccggactgcccccccagaatttctccatgtcagtgacagtccccgtgacaagcccaaacgcgctatcttataccaatccgggttcctctttggtgtccccgtcactggcggcctccagcaccctgacggatagttcaatgctgtctcctcctcagaccaccctgcacagaaacgtgagtccaggcgctccccaacgtccaccttcgactggcaatgccggcggcatgctttccaccacagacttgactgtccctaacggtgcaggttcatcccccgtgggaaatggcttcgttaactcacgtgccagcccgaatcttattggagccacaggggccaactccctgggcaaagtgatgcctaccaagtccccccccccaccaggcggtggcaacctgggaatgaactcccggaagccggatttgagggtggtaatccctccgtccagcaaaggtatgatgccaccactgtacttaaaacgtcagctcaatacaaacaacacccaaaggataagctctagtcaagctactcagcctctcgctacccccgtggtgagcgtaacaaccccttcactgcctccacaaggtttggtgtactccgccatgccgacagcctataatacggactactcattgactagcgcagacttaagcgcactgcagggatttaacagtcctgggatgctgtccctaggccaggtgagcgcctggcaacagcaccaccttggccaggctgcactgagctcccttgtggccggaggccagcttagccagggcagcaatttgtcaatcaacactaatcagaacattagtattaaatctgagcccataagcccccccagagacagaatgaccccgtctggattccagcagcagcaacagcagcagcagcaacagcaaccgccaccccctccccaaccccaaccacagccacctcagccacagcccagacaggagatgggaagatcaccggttgatagcctttccagttcctcctcctcctatgacgggtcggaccgagaggatccccgtggtgattttcactcccccattgtcctcggccgaccacctaacacggaagaccgagagagtcccagcgtgaagaggatgcgcatggacgcctgggtgacctag

SEQ ID NO: 125297 - DNA, 1500 bp, Artificial Sequence
  Description of Artificial Sequence: Synthetic coding sequence
atgggtcgcaaaaagatacaaatcacacgaatcatggacgagagaaatcggcaggtgacttttacaaaacggaagttcggtctgatgaagaaagcatatgagcttagcgtgctatgtgactgtgaaatcgccttgattatctttaattccagcaacaagctgttccagtatgcaagtaccgacatggataaggtgctgctgaagtacaccgagtacaatgaaccacacgaaagtaggacgaatagcgatattgtggaagctctcaataagaaggaacataggggctgtgactcccccgatcccgatacttcttatgtccttacccctcataccgaagagaaatacaaaaaaatcaacgaagaatttgataacatgatgagaaatcacaagattgctccaggcttacctcctcagaattttagtatgtcagtcaccgtgcccgtgactagccctaatgccctatcttatacaaatcccggctcaagcctggttagcccctcattggccgcctcttcaactctgacggacagctccatgctgtccccacctcagacaaccctccatcgcaatgtttccccgggagcccctcaaaggccaccttctactggaaacgctggaggtatgctaagtacaactgacttaaccgtgccaaacggcgcaggctcctccccagtcgggaatggatttgtaaactcaagagcctcacccaatcttatcggggccactggtgcaaacagtctaggcaaggttatgcccaccaagtcgcctcctccacccgggggtggcaatctcggcatgaattcacgcaaacccgacctgagggttgtcataccaccatcttcgaaggggatgatgcctccactcaatacgcagagaatctctagttcccaagcgactcagcccctggcaaccccagttgtgagtgtaacaacaccctccttaccaccccaaggactggtctactcagcgatgcctaccgcgtacaacactgactattcactcaccagcgcagacctatccgcactgcaggggtttaactccccaggaatgctctctctgggccaggtgagcgcttggcagcaacaccacctgggacaggccgccttgtccagtctggtggcgggtggtcagttgagtcagggctctaacctgtctattaacactaaccaaaatatctctattaaaagcgagcccatcagccccccaagagatcgcatgactcctagtggctttcaacagcagcagcaacagcagcaacagcaacagcccccccccccacctcaaccacagccccagcctccacagcctcagccacggcaggaaatgggtcggagccctgtggactcattgagtagcagctccagttcatatgacggttccgacagagaggacccgcggggtgacttccactctccaatcgtcctcgggcgacctcccaacacagaggaccgcgagtcaccaagtgtgaaacggatgaggatggatgcgtgggtcacatag

SEQ ID NO: 125298 - DNA, 1290 bp, Artificial Sequence
  Description of Artificial Sequence: Synthetic coding sequence
atgggccggaaaaaaattcagatcactagaattatggacgaacgcaatcggcaaacactaaggaaaaaaggacttaatggatgcgagtcacccgatgccgatgactactttgaacatagccccctgtcagaagaccgattctcaaagctcaacgaggatagcgacttcattttcaaacgcggaccccccggcttgccaccccagaatttttcaatgagtgtcacagtacccgtcacttcgcctaatgccttgtcatacactaaccccggatcgtcgctggtttctccgtctctggctgcctctagcacgctgactgattccagtatgctgtctccaccacagacaacacttcacaggaatgtcagccccggagctccgcagcggccaccaagtactggcaatgctggcgggatgctcagtacgactgatttgaccgtaccaaacggagctggaagctcacccgtgggtaatgggttcgtaaactcacgcgctagtcccaacctgatcggcgctacaggggccaatagtttgggaaaagtgatgcccactaagtctccacccccgcccggtggcggtaacctcggaatgaatagtcgtaagcctgacctgagagtcgttattccacctagctcgaaaggcatgatgcctccccttaacacacaacgtataagttcaagccaagccacacagccactggcaaccccagtagtttcagtgacaactccctccctgccaccccagggtcttgtctactcagccatgcccacagcttataatactgattatagtctgacatctgcagatctgagtgcacttcaaggcttcaacagtcccggcatgctgagtcttgggcaggtgagtgcctggcagcagcaccaccttggtcaagccgctctgagctccctcgtggcgggagggcaactgagccaaggaagtaacttgtcaatcaacaccaatcagaacatttcgatcaagagtgaaccgatttctcctcccagagaccggatgacccctagcgggttccaacaacagcagcagcagcagcaacagcagcagcctcctcctcctcctcagccccagccacaacctcctcagccccaaccacgtcaggaaatgggacggtctccagtcgactctttgtcttcatcgagcagctcgtatgatggcagtgatcgggaggatcccaggggcgattttcactcaccaatcgtcctgggccgcccgccaaacactgaggatcgggaaagtccctctgtaaagcgaatgaggatggatgcctgggtgacatag

SEQ ID NO: 125299 - DNA, 1494 bp, Artificial Sequence
  Description of Artificial Sequence: Synthetic coding sequence
atggggagaaagaagatccagatcacgaggattatggatgagcgcaatcggcaggtgacattcactaagcggaaattcggtttgatgaagaaagcctacgagctgagcgtactgtgcgattgtgagatcgctttgattatattcaattcaagcaataagttattccagtacgccagcaccgacatggataaggttctcctgaagtacactgaatataacgagccgcacgagtcccgtactaactcagatatcgtcgagactttgagaaagaaaggcctgaacggctgcgagtccccagacgccgacgattactttgagcatagcccactctcagaagaccggttctctaagcttaacgaagacagtgacttcatttttaaacgcggacctcctgggctaccaccccagaacttcagcatgtcagtgacagtgcctgtgactagtcccaacgccctgtcatatacaaatcccggatcaagccttgtgagcccgagcttagccgctagctccactctcaccgactcttcaatgctgagcccacctcagacgactctccatagaaatgtaagtcccggcgctccccagagacctcctagtactggcaatgcaggcggaatgctttcaacgacggacctgaccgttcctaatggcgccgggtcatctcccgtggggaatggatttgtcaactctcgtgcctcacctaatctgattggtgcaacaggagccaattccctggggaaggtgatgcctaccaagtctccccctcctccagggggcgggaatttggggatgaatagccgcaagcctgacctccgcgtggttatacccccctcctccaaggggatgatgccacctctgaacacccagcggatatcaagctcgcaagcaacacagcccttagctacaccggttgtttcggtgactaccccttcgctgcctccccagggcctggtctatagcgctatgcctaccgcatacaataccgattacagccttacctcagcagatctctcagcgctgcaggggttcaattcaccaggaatgctgagcctcggccaagtctccgcttggcagcagcaccacttaggccaagctgcgctcagcagccttgtggcagggggccagctttcccagggttctaacctgagcatcaatacaaatcagaatatatcgataaagagcgagccgatttcaccacctcgcgatcgcatgacaccctctggtttccagcaacagcagcagcaacagcagcagcaacagcccccacctccaccccagccacaaccccaacccccacagccgcagccaagacaagagatgggccgatcccccgtggatagcctgagcagcagttccagttcttatgatggtagcgaccgggaagatcccaggggggacttccacagcccgatcgttctgggccgccccccaaacacggaggatagagagtctccctcggtcaagagaatgagaatggacgcgtgggtcacttag

SEQ ID NO: 125300 - DNA, 1494 bp, Artificial Sequence
  Description of Artificial Sequence: Synthetic coding sequence
atggggagaaaaaagatacagatcactcggatcatggacgaacgcaaccggcaagtgacgttcaccaagcgcaagttcggcctgatgaaaaaagcatatgagcttagcgtgctttgtgactgcgagatagccttgattattttcaattcatcaaataagcttttccaatacgcttccacggatatggataaagtactgctcaagtatactgagtacaacgagccccacgaatctaggacaaattcagatatcgttgagacccttagaaagaaaggcttgaatggctgtgaatcccctgacgccgacgactacttcgagcacagccccttgagtgaagatagattctctaagttgaatgaagattccgactttatctttaaacgtggtccgcctggactgccacctcagaacttctcaatgagcgtcactgtgcctgttacatcccctaatgccctgagctacaccaaccccggatcctccctggtgagcccatccctggcggccagcagtaccttaacagactcatctatgctgagtccaccccagacgacgctccaccgaaatgtgtcaccaggagcaccgcagagacctccaagcaccggaaacgctgggggcatgctctccacaacagacctaacagtgcctaacggcgcaggtagcagcccagtcgggaatggcttcgtgaattctcgagcatcacccaatcttatcggagccactggtgccaattccctgggcaaggtgatgcctaccaagtcccctcccccacccggcggcggtaatctggggatgaactcgcgcaagccagacctgcgggtagtcatccccccctcgtcaaaagggatgatgccccccctcaatacccaacgtatatctagtagccaggccacacagcctctggcaaccccagttgtgagcgtaactacaccaagtcttcctcctcaggggttggtgtatagcgctatgcccacagcttataacaccgactactctctaacctctgctgacctctctgccttgcagggatttaattcccccggcatgctctccttgggacaggtctccgcctggcagcagcaccacctcgggcaggctgccttatcatctttagtagccggcggccagctgtcccagggatctaacctctccataaatacgaatcagaatatcagcatcaagagcgaacccatttccccaccacgcgaccgcatgacaccaagtggcttccagcagcagcagcagcagcaacagcagcagcagccaccccctccccctcaaccccaaccgcagccgccacaaccccagccccggcaggagatggggcgatcacctgtcgattcactgtctagcagctccagctcctacgatggatctgacagggaagacccgcggggggacttccatagccccatcgtgcttgggaggccacccaataccgaagaccgcgaatctccaagcgtgaaacggatgagaatggacgcctgggtcacctag

SEQ ID NO: 125301 - DNA, 1518 bp, Artificial Sequence
  Description of Artificial Sequence: Synthetic coding sequence
atgggtagaaagaagattcagatcacgagaataatggatgagcgaaacagacaggtgaccttcacaaaacgtaagttcgggctgatgaagaaggcttatgaactttctgttctctgtgattgcgagatcgcgctgatcatattcaattcatctaacaaattgtttcaatatgcgtccaccgacatggacaaagttctgttgaagtacaccgagtataatgagccccacgaaagccgaacaaattctgacattgtggagactcttaggaaaaagggcctgaatggctgtgaaagcccggatgcagatgattacttcgagcacagcccgttaagcgaagatcgattcagcaaactgaatgaggacagcgactttatcttcaaacgaggtccccccggtcttcccccccaaaacttcagcatgtccgtcacagtgcccgttacttctcccaatgcccttagttacactaaccctgggtcatctcttgtgagtcctagcctcgcagcaagtagcactctcaccgacagctccatgctcagtcctccccagacaactttgcatcgaaacgtgagccccggcgccccacaacggccaccttcaacaggcaacgcagggggcatgctgtccacaacggatctgacggtgcctaacggagcaggctcctctcccgtaggtaatggattcgtgaattcacgagcctctccgaatctgattggagcaacaggggccaacagccttggcaaagtgatgccgaccaaatctccccctccccctggaggagggaacctcggcatgaactctagaaaacctgacctcagagtcgtgatcccccctagcagtaagggcatgatgccacctctttctgaggaggaggagttagaacttaacacacagcggatctcttcaagccaagccactcaaccactcgccacaccagtagtgtccgtgactaccccctccttgccacctcagggactggtgtattcagcgatgcccaccgcttataatactgactactccttaacttctgccgatctgtccgcactgcagggatttaatagccctgggatgctaagtctgggccaggtgagtgcctggcaacaacaccatctggggcaagccgctctttcgtcactagtcgccggcggccagttgtcacaggggagtaacctttccatcaatactaaccaaaacatatctatcaagtcagagccgatcagtccgcctcgggatagaatgacaccttcagggtttcaacagcagcagcagcagcagcagcagcagcagccacctcctcccccacaaccacagccccagccacctcagccccagcctcgccaggagatgggccggtccccggtcgactctctttcatctagctcatcttcctacgatggtagcgatagggaggatccccgtggagattttcactcacctatagtgctggggagaccccctaatacagaagatagagagtccccctccgtgaaaaggatgcggatggacgcctgggtaacatag

SEQ ID NO: 125302 - DNA, 117 bp, Artificial Sequence
  Description of Artificial Sequence: Synthetic coding sequence
atgggacgaaagaaaatccagatcacgagaatcatggatgaacgcaacagacaggtgacctttactaaacggaagttcggcctaatgaagaaggcctacgagctctcagtactgtag

SEQ ID NO: 125303 - DNA, 1314 bp, Artificial Sequence
  Description of Artificial Sequence: Synthetic coding sequence
atgggaaggaagaaaattcaaataacccggattatggacgagcgcaatcgccagacactgcgcaaaaaagggttgaatggatgtgaaagccctgatgccgacgattacttcgaacacagcccactttcagaagatcgtttttcaaaactcaatgaggattcagattttatatttaaaagggggccccctggcctccccccccaaaacttcagcatgtcagtgacagtgcctgttacatcgccgaacgccctgtcatataccaatcccggttcatcgcttgtgagcccttctctggccgcaagctctaccctgaccgatagcagcatgctatccccaccacaaacgaccttacatcgaaacgtcagccctggggcacctcagcggcctcccagtaccggcaacgctggtgggatgctgtctactacagatcttaccgttcccaatggagcaggcagctcaccagtggggaacggtttcgtgaatagcagagcatctccaaatctgataggggccaccggcgccaatagcctaggcaaagtgatgcccacaaaaagcccgcctcctcccggcggcggaaatctgggaatgaactccaggaagcctgacctccgcgttgtgatcccaccttccagcaagggtatgatgccccccctcagcgaagaagaagagcttgagctgaacacccagcggatttctagctctcaggcaacacagcccctggccaccccagtggtctctgttaccacaccctccttaccccctcagggattagtgtactctgcaatgcctaccgcctacaacactgattacagcctgacctccgctgatctatctgccttgcagggctttaattcccccggaatgctatccttaggccaagtgtcggcctggcagcagcatcacctcgggcaggctgccttgtcctccctggtagctggtgggcagctctcacagggaagtaatctgtccatcaacaccaaccagaacatctctataaaatccgagcccattagcccacctcgcgaccgaatgaccccctcagggttccaacagcagcagcagcagcagcaacagcagcagccccccccccctcctcagccccagcctcagccaccacagccccagccccgccaagagatgggcagaagcccagtcgattcgctctcgtcaagttcatcctcttacgacggttcagaccgcgaggacccccggggggatttccactcccctatagtcctgggacgcccacccaacacggaggatcgagagtcaccttctgtaaagaggatgcgcatggatgcctgggtcacatag

SEQ ID NO: 125304 - DNA, 234 bp, Artificial Sequence
  Description of Artificial Sequence: Synthetic coding sequence
atgggtcgcaagaaaattcagatcacgaggatcatggacgagcgtaatcgacaggtcacctttaccaagagaaaatttggcctcatgaagaaggcttatgaactgagcgttctgtgtgactgtgaaatcgccctgatcatctttaattcttccaacaagctgttccagtatgcctccacagatatggacaaagtacttctgaaatatactgagtacaatgaaccccacgaatag

SEQ ID NO: 125305 - DNA, 258 bp, Artificial Sequence
  Description of Artificial Sequence: Synthetic coding sequence
atgggccgcaagaagattcaaattactagaataatggatgagcgcaatagacaggtcacctttactaagcgaaaattcggtcttatgaaaaaggcctatgaactgtccgtactgtgtgactgcgaaatcgccctgatcatttttaattcttctaacaaactgttccaatacgcctcgacagacatggacaaagtgctcctcaagtacactgagtacaacgagccacacgagtcacgcacaaattcggatatcgtgtag

SEQ ID NO: 125306 - DNA, 1107 bp, Artificial Sequence
  Description of Artificial Sequence: Synthetic coding sequence
atgggcagaaagaagattcagatctcccggatcctggaccaaagaaatcgacaggttaccttcactaagcgaaagttcggcttaatgaaaaaagcctatgagctctccgtgttatgtgactgtgagattgctctcattattttcaactccgcaaatcggttatttcagtatgcatccacagatatggaccgtgttcttcttaaatatacagaatacagcgaaccccatgagtccagaactaacaccgatatcctcgagactctcaagcggaggggcatcgggctggacggtcctgaactggagcctgatgaaggccccgaggaacccggggaaaaattcagaagactggccggcgaaggtggcgaccccgccctcccaagacctcgactgtacccagccgctcctgcaatgcctagccccgatgttgtgtacggggcactgcctcccccaggttgtgatccaagcggccttggcgaggcactgccagcgcagtcaaggcccagcccgtttagaccggccgcacctaaagctggcccccctgggctcgtgcatcccttattttctccgagccatctaaccagcaaaacacccccaccgctctacttgccaaccgagggcagacgctccgacttaccagggggccttgctgggcccaggggcgggctgaatacctcccggtccctatacagcggcctacagaatccatgttctactgccactcccgggcccccgttgggctctttcccctttctgccagggggccctccagaatacggcttgggtgatccaccaccaccccccggcctcctgcagccaccgacattggccccttggcagccctcaagaggagacggaccccctgccgtgtcttcacagccctccggcggtagatcacttggtgaggaaggccccccaactcgcggtgcatcccccccaaccccccccgtgtcgattaagagcgaacgtctctccccagccccaggtgggcctggggactttccaaagactttcccctaccccctcctgttggccagatccctggccgagcctctgaggccgggtcctgccttgcggcgactgcctctagctgacggttggccaagatag

SEQ ID NO: 125307 - DNA, 894 bp, Artificial Sequence
  Description of Artificial Sequence: Synthetic coding sequence
atgggtcgaaaaaagattcaaatctctcgaatcctggaccagaggaaccgtcaggtcacatttacaaaaagaaagttcggactgatgaaaaaggcctacgagctgtccgtactatgcgattgcgagattgctctaatcatatttaacagcgcaaaccgtttgttccaatacgcctcaacagacatggatagagtgctcctcaagtacactgagtacagtgaaccacatgagtcccggactaacactgacatcctggaagtgccacagaccctgaagcgtaggggcatcggacttgatgggccagaactagagccagatgaggggccagaagagcccggagaaaagttcagaaggttagccggtgaggggggtgaccccgccttgcctcgcccccgcctctatcctgcagcgcctgccatgccttcacctgatgtggtttacggggctctcccacctccaggctgtgatccctcaggactgggagaggccctgccagcacagtctaggcccagtcctttccgccccgcggctcccaaggctggcccccctggtctcgtccaccccttgtttagccctagtcacctgacatcaaagacaccccccccgctgtatttgccaacagagggcagacggagcgacctccctggaggactcgcaggcccacgaggtggcttaaacacgagcagaagcctgtatagcgggctccaaaatccatgttctactgccaccccgggcccgccacttggcagttttccattcttgcccgggggacctccggagtacggtctcggagatcctccccctccgcccggcctgcttcagccacctacactggctccctggcagcccagcagaggagacggaccacccgccgtgtctagccagccaagatag

SEQ ID NO: 125308 - DNA, 1107 bp, Artificial Sequence
  Description of Artificial Sequence: Synthetic coding sequence
atgggtagaaaaaaaattcaaatctcccgaatcttggaccagagaaatcgccaggttacattcaccaaacggaagttcggactgatgaagaaagcttacgaactgtcggtactgtgtgattgcgagatcgcactaataatcttcaattcagcaaacagattgttccaatacgcttcaacagacatggatcgcgtgctcctcaagtacaccgaatatagtgagcctcacgaatcaaggactaataccgatatcctggagactctgaaacgacggggcatcggcctggacggcccggagctagaacctgacgagggcccagaggaacccggggaaaagtttaggcgcctggcaggcgagggaggcgatccagcgctgccaagaccacgcctgtatccagcagccccagctatgccttctcccgacgtggtctatggcgccttgccccccccagggtgcgatccatccggcctgggagaagcgcttcccgcacagagtcgaccaagcccattcaggcctgctgcccccaaggccggtccacctggactggtgcatccattattcagcccctctcatcttacatctaaaacgccccctccactctacctgcccacagaaggccggagaagtgatttgcccggcggcctagctggacccaggggagggctgaatacctcacggtcgctctactctggtcttcagaatccttgtagcactgcaacgccaggccctcctctaggatccttccccttcctgcctgggggcccccctgagtatggcctcggagatcccccacctccccccgggctgctccagccaccgactttagcaccttggcagccgagtcgcggcgacgggccgcccgctgtgtcgagtcaaccttctggaggaagatcccttggagaagaaggaccccccaccaggggagcctcacctccgactcctccagtgtcaattaagtcagagcgactttccccggcacctggcggacccggggatttcccaaagaccttcccataccccctacttcttgcacgaagtcttgctgaacccctgcggcctgggccagccctcagaaggctgcctttggccgacggctggccaaggtag

SEQ ID NO: 125309 - DNA, 1098 bp, Artificial Sequence
  Description of Artificial Sequence: Synthetic coding sequence
atgggaaggaaaaaaatacagatcagcagaatcctcgaccagagaaataggcaagtaacattcaccaaaagaaagtttggcttgatgaaaaaggcctacgaacttagtgtgctgtgcgactgtgaaatagcccttatcatctttaattctgctaatagactgttccagtacgctagtaccgacatggacagggtgctgttaaaatacactgagtattcggaaccgcatgaaagtcgaaccaatacagatatcctggagaccctgaagcgccgcggcataggtctggacggaccagaattagagccagacgagggcccagaggagcctggggagaagtttagacgactggcaggcgagggtggagatccagctctgcctaggccacgactataccccgccgcccctgccatgccatctcccgatgtggtctatggagctctgccccctcctggatgcgacccatcaggtctgggcgaagccctgccggcccagtcgcgaccttctcccttccggcctgcagcccccaaggctggccctccgggactggtccatccactattcagtccctcacacctgacctccaaaacccctcctcctttgtatctgcccacagaaggcagacgctcagacctccccgggggattagcgggcccacgcggtggacttaatacatctcgctcgctgtacagcggcctccaaaacccatgtagcacagccacacctggaccacctttgggaagcttcccttttctgcccggaggtccgcccgtgggagcagaggcctgggctcgccgggtcccacaaccagcggctcccccacgccgaccgcctcagtccgccagtagtctttctgccagcctgaggccacctggtgcacccgcaacattcttaaggccctcacctatcccttgctcatctcctggtccatggcagagcctctgcggtctcggtcccccatgtgccgggtgtccttggcccactgccggacccgggagacggtccccaggcgggactagcccggaacggtctccgggtactgccagagctaggggtgatccaacttcactgcaggccagcagtgaaaagacgcagcaatag

SEQ ID NO: 125310 - DNA, 1392 bp, Artificial Sequence
  Description of Artificial Sequence: Synthetic coding sequence
atggggcggaagaaaattcagattacccgcatcatggatgaaagaaacaggcaggtgacgttcactaaacggaaatttggtttaatgaagaaagcctatgagctcagcgtactgtgcgactgcgaaatagccctgataattttcaatagtacgaacaagctgttccagtacgcctccaccgacatggacaaggtacttctcaagtacactgaatataatgagccgcacgagagcagaacaaatagtgacatcgtcgaggccttgaataaaaaagagaacaaaggctgtgagagtcctgatccagacagttcctacgcactgacccccagaacggaagagaaatacaaaaaaattaatgaggagttcgacaatatgatcaaatcccataagattcctgctgttccacccccgaacttcgagatgccagtgtctatccccgttagctctcataactccctcgtctattccaatccggtgagttcattggggaacccaaacctgttgcccttagctcacccatcgctgcagcggaattcaatgagtcccggcgtgactcacaggcctcccagcgccggaaatacaggggggcttatggggggcgatcttaccagcggcgccggaacttcagcgggcaatgggtatgggaacccacggaattctcctggtcttttggtgtcccctggcaacctaaataaaaatatgcaagcaaaatcaccacctccaatgaaccttggtatgaataatagaaagccggacctgcgcgtactcatccccccaggatcgaaaaatacaatgccatctgtgaaccagaggattaataattcccagtcagcccaaagcctggcaaccccagtggtcagcgtggcaaccccaacgctcccggggcagggtatgggcggctacccgagcgcgatatcgactacttacggtaccgaatacagcctgagctccgcagatctgtctagcctcagcgggtttaacactgcctccgcattgcacctggggtccgtcactggatggcaacagcagcacctgcataacatgcctccgtccgctttgagccagctgggagcctgcactagtactcaccttagccaatcatctaatcttagtttaccctctacacagtctctaaacatcaaatccgagccagtcagccctccacgggaccggacaaccacaccatctcggtaccctcagcatactcgtcacgaggcaggtcgctccccggtggatagcctttcgtcttgttcttcctcttacgatgggtctgaccgggaggatcacaggaacgagtttcacagccctataggactgacccgtccgagtcccgatgagcgcgaatcacccagcgtgaagcggatgcggctgagtgagggatgggcaacatag

SEQ ID NO: 125311 - DNA, 1422 bp, Artificial Sequence
  Description of Artificial Sequence: Synthetic coding sequence
atgggacgcaagaaaattcaaataaccaggattatggatgaacgcaacagacaggtgaccttcaccaaaagaaagttcggcctcatgaaaaaagcctacgaactgtctgtcttgtgcgactgcgaaatcgccctcattatcttcaattcaactaacaaattgtttcaatacgcctccacggacatggataaagtcttgctcaaatacaccgagtataatgaacctcacgaaagccggaccaactctgacatagtcgagacactgaggaaaaaagggctcaatggttgtgactcccccgaccctgacgctgacgattccgtggggcactccccagagtcggaagataaatataggaagattaacgaggacattgacctgatgatatctagacagcgattgtgtgccgtacccccacccaatttcgaaatgcctgtgtccattccagtgagttcacataattcgctcgtgtactctaatccggtgtcttcccttggtaaccctaacttgttgcctctggcacatcctagtctgcaaagaaactccatgtcacctggcgtgactcatagacctcccagcgccgggaacaccggtggcctcatgggaggcgacttaacatctggggctggaactagcgctggcaacggttacggcaacccaagaaattctcctggcctactagtctccccaggcaacctaaacaagaatatgcaggccaagtcaccccctccaatgaatttgggtatgaataatagaaagccagatctgagagtgctcatcccacccgggtcaaaaaataccatgccatctgtgtccgaggacgtcgacttactcctgaaccagcgcatcaataattcacagtcagcccaatcattggcaactccggtcgtgagtgtggcaacccccactctgcctggccagggtatgggtgggtacccttctgccatttccactacgtacggcactgaatattcactgtccagcgcagatctgagttcccttagtggctttaacaccgcgtccgcactacacctgggatctgtgaccgggtggcaacagcaacacctacataatatgcccccttcagccttgagccagctcggagcttgtacgtccacccacctgtcgcagtctagcaacctgtcactcccaagcactcagtcgctgaatattaaaagtgaacccgtgtcgccgcccagagacaggaccaccactccaagcagatacccacagcacacaaggcacgaagcggggcggagtcctgtcgattccctcagttcatgttcttcctcttatgatggaagtgatcgcgaggaccataggaatgagtttcattccccaataggactgacccgcccgtccccagacgagcgagaatccccctcagttaaaaggatgcgacttagtgaagggtgggccacttag

SEQ ID NO: 125312 - DNA, 297 bp, Artificial Sequence
  Description of Artificial Sequence: Synthetic coding sequence
atgggcagaaagaaaattcagatcacccgcatcatggatgagcgcaaccgacaggtgacttttactaaaagaaaattcgggctcatgaagaaagcttatgagttgtcagtactttgcgactgtgaaatagcacttatcatttttaatagcaccaacaagctttttcagtatgcgagcacagacatggataaagtgcttctcaagtacaccgaatataatgagccccatgagtcccgaaccaactccgatatcgtggagacgcttagaaaaaagggcctcaatggctgcgactcctag

SEQ ID NO: 125313 - DNA, 390 bp, Artificial Sequence
  Description of Artificial Sequence: Synthetic coding sequence
atgggccggaaaaagattcagatcacccgcataatggacgagaggaatcggcaggttacattcacaaagaggaaattcggtctgatgaaaaaggcctacgagctgagcgttctgtgcgattgtgagatcgctcttataatatttaacagcactaataagctgttccagtatgcatccacggacatggataaggtcttgctgaagtacactgagtataatgagccccacgaatcgagaaccaattcagatatcgtggagaccttgcgcaagaaaggcttgaacggatgtgatagccctgaccccgacgccgatgatagtgttggacatagcccggagagtgaggacaaatatagaaagattaacgaggacattgacctgatgatctcttag

SEQ ID NO: 125314 - DNA, 264 bp, Artificial Sequence
  Description of Artificial Sequence: Synthetic coding sequence
atgggccgtaagaaaatccagataaccagaattatggacgagcgtaacagacaggtaacctttaccaagcgtaagtttggcctcatgaagaaagcatatgaactgtcagtcctgtgcgattgcgagatcgcgctgatcatctttaattcaacgaacaagctgttccagtatgcctccactgacatggacaaagtcctgctgaaatatacagagtataacgagcctcatgaatctagaactaactcggacatagtagagacctag

SEQ ID NO: 125315 - DNA, 1422 bp, Artificial Sequence
  Description of Artificial Sequence: Synthetic coding sequence
atgggtcgaaagaagatccaaatcacaagaataatggatgagcggaatcggcaggtgacctttactaagcgaaaattcggtctgatgaaaaaggcctacgagctgtccgtgctgtgtgattgtgaaatcgccctcatcatttttaatagtactaataagctgtttcagtatgcttcgaccgacatggataaggtgctcttgaagtatacggaatacaatgaaccacatgaaagcaggacaaattcagatattgtggagaccctgcgtaagaaaggcctcaacggttgtgactctcccgatcctgatgccgacgatagcgtcgggcattccccggagagcgaagataaatatcgcaagatcaatgaggacatcgacctaatgattagcagacagaggctctgtgcagtgccacctccaaatttcgaaatgcctgtgagcattcctgtgtcttctcataatagtctggtctatagcaatcccgtgagttcactgggtaatcctaacctgcttcctcttgcgcatcctagcttgcagaggaatagtatgagccccggagtcacacacagacccccatccgccggaaatacaggcggcctgatgggtggtgaccttacctccggcgccggaacctccgctgggaacggttatgggaaccccaggaattcacccgggctgctagtctcccccgggaacctcaacaagaatatgcaggcaaaatcccctccccccatgaacttgggcatgaataataggaaacctgatctcagggtcttgatcccgcccgggtcaaaaaacactatgcctagtgtggtgatccagaactatatcctgaaaaatcaaagaatcaacaatagtcaatccgctcaatctctcgcgacgccggtggtctccgtagctactccgacgctccccggccaggggatgggcggctacccatccgccatctctactacctacgggacggaatattcactctcctccgccgacttaagttcactgagtggatttaacaccgcaagtgccctgcatctggggtccgttactggctggcagcagcaacacctacacaatatgccgccctccgcccttagccagttgggggcctgtaccagtacccatctttctcagagtagcaacctgtcattaccctccacccaatcactgaacattaagtctgaacctgtgtcccctccaagggaccgcacgaccacgccttccaggtacccacaacacacccgacatgaagcaggcaggagcccggtcgattctttgtcctcttgttccagttcctatgatggtagcgatcgggaagatcataggaatgagtttcacagcccaattggcctcacaaggcccagccctgatgagagagaaagtccgtctgtaaaacgcatgagactgtcagaaggatgggctacatag

SEQ ID NO: 125316 - DNA, 684 bp, Artificial Sequence
  Description of Artificial Sequence: Synthetic coding sequence
atggggaggaaaaaaattcagattacacggattatggatgaacgtaatagacaggtcaccttcactaagcgcaagttcggtttgatgaagaaagcctatgagctttccgtgctgtgcgattgcgagattgcactgataatttttaacagtactaacaagcttttccagtatgcatccactgatatggacaaggtactattaaaatacaccgaatacaatgaacctcacgaatcccggacaaattcagatatcgttgaggcccttaataaaaaggagaataaaggttgcgaaagtcccgacccagatagcagctatgcattgactcccagaaccgaggaaaagtataaaaaaattaacgaagaattcgacaacatgataaagagccacaaaataccagctgtcccacctcccaacttcgaaatgcccgtgagcatccccgtttcctctcataacagcttggtgtattctaaccccgttagcagcctcgggaatcctaatctgctacctttggcccaccccagtctgcagcgcaactctatgtctcccggcgtgacacatagacccccaagcgccggtaacaccggggggctgatgggcggtgacttaactagtggagccgggacgagtgccggcaatggctatggcaacccccgaaacagcccaggcctgctggtcagcccatag

SEQ ID NO: 125317 - DNA, 363 bp, Artificial Sequence
  Description of Artificial Sequence: Synthetic coding sequence
atgggccgaaagaaaatccagattactcgtataatggacgagcggaaccgacaagtgacattcactaaacgcaaattcggactaatgaaaaaggcttacgaattgagtgttctgtgcgattgcgagatagccttgatcattttcaacagcacaaataagctattccagtatgcgagcaccgacatggacaaggtgctgctaaagtatacggagtacaacgaaccacacgagtctaggaccaactcagacatcgtcgaagcacttaataaaaaggaaaataaggggtgcgagtcacccgaccccgactcttcctacgcgctgacccctcgaaccgaggaaaagtacaagaaaattaatgagtag

SEQ ID NO: 125318 - DNA, 381 bp, Artificial Sequence
  Description of Artificial Sequence: Synthetic coding sequence
atgggccggaagaaaatccaaattacaagaattatggacgagcgcaacagacaggtgaccttcacaaagagaaagtttggactgatgaagaaggcctacgaactctcagtgttgtgtgactgcgaaattgcccttatcatctttaactcaacgaacaagcttttccagtacgcctctactgacatggacaaggtcttgctcaagtatactgaatataacgagccccacgaatcccgcacaaactctgatatcgtggagactctccgaaaaaaaggcttgaatggatgcgactctccagatcctgatgcagacgactccgtcggacactctcccgaaagcgaagataagtataggaagattaacgaagatattgatctttag

SEQ ID NO: 125319 - DNA, 87 bp, Artificial Sequence
  Description of Artificial Sequence: Synthetic coding sequence
atggggcgcaagaagatacagatcacgcgcataatggacgagaggaataggcaggtaacatttacaaaacggaaattcggtctgtag

SEQ ID NO: 125320 - DNA, 1398 bp, Artificial Sequence
  Description of Artificial Sequence: Synthetic coding sequence
atgggtcgcaagaagatccagatcacccgcatcatggacgagcggaaccggcaggtgacctttactaaacgaaagttcggtcttatgaagaaagcctacgagctgagcgtcctgtgtgattgcgagatagcacttattattttcaattcaactaataaactcttccagtacgcttccactgacatggataaggttctcctcaaatatactgagtacaacgaaccacacgaatccaggaccaactcagacattgtggaaaccctgcgtaaaaagggtttgaacgggtgcgattctcccgacccagatgctgacgattctgttgggcactccccagaaagcgaggataagtatcgaaaaattaacgaagatatagatctcatgataagtcgccagcgtttgtgcgctgttccaccacccaattttgaaatgcctgtatctatccccgtgtcttctcacaattctctcgtttatagtaacccagtgagcagcctcggcaaccctaatttgctccccctagctcatccctctttgcagaggaattccatgtcaccaggcgtgacacatcgcccaccctctgcaggtaatacgggcgggctgatgggaggggacctgacgtccggcgccggcacctccgctggcaacggctatggcaatcctagaaattcgcccggattattagtatctcccggaaatctgaataagaatatgcaggcaaaatctccacctcccatgaacctggggatgaacaaccggaagccggatctgcgtgtactgataccccctggaagtaaaaatactatgccctctgtcaaccagaggattaacaactctcagtccgcccagtctcttgcaacccctgtcgtatctgtagcgacaccaactttacctggtcaggggatgggggggtatcctagtgctattagtacaacatatggcacagagtactccttaagttcagcggatctgagctcactatcagggtttaatacggccagtgcccttcatctgggctctgtcacaggctggcagcagcagcacttacacaatatgccaccatctgccctcagccagctgggggcatgtacaagtactcacctctcacagagctctaacctctcgcttccctcaactcaatcgctgaacattaagtctgagcctgtctcgcccccgcgggatcgaacaactacgccctcgcggtatccacaacacacaagacatgaagctggcagaagcccagtggactccctttcatcatgttcctcttcatacgatggtagtgaccgggaggaccaccgcaatgagttccactcaccgattggtctaacaaggccgtcacccgatgagagagaatcaccaagcgttaagcgcatgcggttgtctgagggctgggcgacatag

SEQ ID NO: 125321 - DNA, 729 bp, Artificial Sequence
  Description of Artificial Sequence: Synthetic coding sequence
atggggagaaagaagattcagattactaggattatggacgagcgaaaccgccaggtgactttcacaaaacggaagtttggccttatgaagaaggcgtatgagctgagcgtactatgtgactgcgagatcgctctgatcatctttaattctaccaataagcttttccaatatgcaagtaccgacatggacaaggtgctactcaagtatacagaatataatgaaccccacgaatctaggactaacagtgatattgtggaggcgttgaataaaaaagaaaataagggctgtgaatcgcccgaccctgacagtagctacgcgctcaccccccgtacggaggagaaatacaaaaaaatcaatgaagaatttgacaatatgatcaagagccataagataccagctgtgcccccacccaacttcgaaatgccagtctctattccggtgtccagtcataattcactggtgtacagtaaccctgtctccagcttgggcaatcccaatctgctacctttggctcatcccagcctccagcgtaactccatgtctcctggcgtgacgcacaggccccccagtgccggcaataccggcgggctaatgggcggagatctgacctcaggcgcaggtacgtctgcggggaacggatatggcaaccctagaaactctcccggactgctggtgagtccaggaaacctgaacaaaaacatgcaggcaaaaagccctccccctatgtag

SEQ ID NO: 125322 - DNA, 1326 bp, Artificial Sequence
  Description of Artificial Sequence: Synthetic coding sequence
atgggacggaaaaaaatccagataactcgcattatggacgagaggaaccgtcaggtaaccttcacaaagaggaaattcggtcttatgaagaaagcctacgaactctctgtgctgtgtgattgtgagatagctctgattatatttaactccacaaacaaattgtttcagtatgcgtctaccgatatggacaaggttttgctgaagtacaccgaatacaatgagccacacgagtcccgcacaaactcagatatcgtggaaacactgcggaagaaaggtctgaatgggtgcgatagtcccgatcctgacgcagatgacagcgtgggccacagtcctgagtctgaggacaagtatagaaagattaacgaggacattgatttgatgatcagtcgacagagactctgtgctgtgcctccgcctaattttgagatgcccgtctctatccccgtgtctagtcataacagcctagtgtactccaaccccgtgtcttcccttggtaatccaaacctcctaccactagcccacccatctctccaacggaactcaatgtctcctggtgttacccaccgcccacctagtgcaggcaacacggggggtcttatgggcggagatctgacgtcaggggcggggaccagcgcggggaacggatatggtaacccacgtaattcgccaggcctcctggtgtctccaggaaatctcaacaaaaatatgcaggccaaatctccccctcctatgaatttagggatgaacaaccggaaacctgaccttcgggtgctcattccccccgggtcaaagaacacaatgccaagcgtaagcgaggacgtggatctcttgttgaatcagagaattaataatagccagtccgcgcaaagccttgcaacaccggtagtttctgtcgccacccccacgctgcctggacagggcatggggggctacccatccgctattagcacaacctatggaaccgaatacagcctctcctccgcagacttgtcttccctcagtgggtttaacacagcttctgccctgcatctgggttcagttacaggatggcagcagcagcacctccataacatgccgccatcggctttatctcaactgggtgataggacaaccactccttctcggtatccgcagcacaccaggcacgaggctggccgatctcctgtggactcacttagctcttgtagctcgtcctatgatggcagcgatagagaagaccatagaaacgaattccatagccctatcggcctaactaggcccagtcctgatgagagagagagcccatcagtcaaacgcatgcgcctcagcgagggttgggccacatag

SEQ ID NO: 125323 - DNA, 1422 bp, Artificial Sequence
  Description of Artificial Sequence: Synthetic coding sequence
atgggaagaaagaagattcagataacacgtatcatggatgaacggaatcgccaggtcacattcaccaaaagaaaattcgggcttatgaagaaggcttatgagctgagtgtcctttgcgattgtgaaatcgcgctgatcatttttaacagcacgaataaactttttcagtatgcaagcacagacatggacaaagtgttgctgaagtacactgagtataatgaaccgcacgaatcccggacaaattcagatatcgtggaaacgctgaggaagaaggggctcaatggatgcgattcacccgaccccgacgcagatgattccgtcggtcactcccctgagagcgaggataaatatcgcaagatcaacgaggacatcgatctgatgatcagcaggcagaggctgtgtgctgtgcccccccctaattttgaaatgccagtgagcattcccgtatcatcccacaattcattggtctattccaacccagtgtcctcgctgggcaaccccaacctgctccctctggcccacccttccctgcagcggaattctatgtctcctggagtaacccaccggcccccatccgccggcaacacaggtggactgatgggtggagatcttacaagtggggctgggacctcagccggcaatggttatggtaatccccgcaactcacctgggctgctagtatcccctggaaacctgaataagaacatgcaagccaaatctccccctccaatgaacctcgggatgaacaatcggaagcctgatctcagagtgctgataccacctggctccaagaataccatgccatccgtttccgaggacgtggacctcctcctaaatcagaggatcaataattcccaatcagcacaaagcttggctacgccagtggttagtgtggccactcccacgctgccgggacagggaatgggtggctacccatctgcgattagtacaacttatggaaccgaatatagcctgagcagcgccgatctatcttccttgtctggcttcaacacggcgtcggcgctgcatttaggcagcgttaccggctggcagcagcagcacctgcataacatgcccccatctgcgctgagtcaactcggagcttgtacatcaacccatttgagccagtcctctaacctcagtttaccgagtactcagagtttaaatattaaaagcgagcccgtgtctccaccgcgggaccggacaactaccccctctagataccctcagcacacacgacatgaagcaggtcgctctcccgtagactcactttcctcctgttcctctagctacgatggaagcgatcgcgaggatcatcgcaatgagtttcattccccaatcgggttaacgcgacctagccctgacgagagagagagtcctagcgtgaagcggatgcggctttcggaaggctgggcgacatag

SEQ ID NO: 125324 - DNA, 1254 bp, Artificial Sequence
  Description of Artificial Sequence: Synthetic coding sequence
atggggaggaagaagatacagatcactagaatcatggacgaaaggaaccgtcaggttacctttacgaagcggaaattcggactgatgaaaaaggcatacgagctgtctgtcctctgtgactgtgaaatcgcgctgattattttcaacagcacaaacaaactattccaatatgcctcaacagacatggataaggtgctccttaaatacaccgaatacaacgagcctcacgagtcgcgaactaattctgacatcgtagaagccgtccccccaccaaactttgagatgcccgtgtctatcccggtgagttcacataactccctggtgtacagcaacccagtgtcctcattggggaatcccaatctattgcccctcgcccacccgagtcttcagaggaattccatgagccccggtgtgacacatcgtcctccttctgctgggaacaccggcggtctcatgggcggtgatctgacaagtggcgctggcactagtgcggggaatggttacgggaatccacgtaacagtcccggcttactcgtgtcaccggggaacctgaataaaaacatgcaggcgaagagtccccccccgatgaatttaggcatgaacaaccgcaaacctgaccttagagtcttgattccccctggtagtaagaacaccatgccgtctgtgaatcaacgtatcaataacagccagtccgctcagtcccttgctactccggtggtatcagtggccaccccaaccctgcccggccaagggatggggggttacccaagtgcaatctctactacttatggaacagaatattccctgtcaagcgcagacctcagctcgctgagtggcttcaatacagctagtgcccttcaccttggttctgtgaccggctggcagcagcagcacctgcataatatgcctcccagcgctctgagtcaattgggcgcctgcaccagcacgcacctgagtcaatcctccaatctgtctctgccatcaactcagagcctgaacattaagtccgaacccgtgtctcccccgcgcgatagaacaaccaccccctctaggtacccccagcacacgcggcacgaagccggacgatcccccgtcgactcattatccagctgtagttcctcctacgatggttcagatagagaagatcatagaaacgagttccacagtccaataggcttaacaaggccgtcccccgacgagagggaatcaccaagcgtgaaacgaatgcgcctgtctgagggctgggccacatag

SEQ ID NO: 125325 - DNA, 1452 bp, Artificial Sequence
  Description of Artificial Sequence: Synthetic coding sequence
atgggcaggaagaaaatacaaatcactcgaataatggacgaacgcaataggcaggtgacttttaccaagagaaaatttgggcttatgaagaaggcttacgagctgtcagtgttgtgtgattgcgaaatcgccctgattatttttaacagtaccaataagctcttccagtacgcatccactgacatggacaaggtgctgcttaagtacactgagtacaacgagccccacgagtctcggaccaattccgatatcgtggagacattacgcaaaaaggggttgaatggctgcgactcccctgatcctgatgccgacgattcggctctcaacaaaaaggaaaacaaaggctgtgaatcccctgaccccgacagcagctatgcgttgacacccaggacagaagagaaatacaagaaaatcaatgaggaattcgacaatatgattaagagccataagattccagccgtgccccctcccaacttcgaaatgccagtttcaatcccggtgtcctcacacaactccctggtctacagcaatcctgttagctctctgggaaatcccaacctgctaccactggcgcatccatcattgcagagaaactccatgtcaccgggcgtgacccataggccccccagtgccggcaacaccggcggtctcatgggcggagatctaacctctggcgcagggaccagtgccgggaacggctacgggaacccccggaatagcccagggctgctcgtgagtcctgggaacttgaataagaacatgcaggccaaatcacccccacctatgaacctcggaatgaataatcggaaaccagacctcagagttctgattcctccgggatccaaaaacactatgccctctgtcaatcagcgcattaataattcgcagtcagcacagagcttagcaacaccagtggtgtcggttgccacccccaccctgccaggccagggaatgggtggctacccttccgcgatcagcactacatatgggacggagtatagtctatctagtgcggatctctcctccctttctggattcaacactgcgtctgccctgcacctcggtagtgtgactgggtggcaacagcaacatttgcataatatgccacccagcgccctgtctcagcttggtgcatgcacatctacacacctgtcccagtctagcaatctgtcactgccatcaacccagtctttaaacatcaagtctgagccagtatccccccccagagatcgcaccaccaccccgtctcgttacccacagcacactcgtcacgaggccggcaggtcccccgttgacagcctatcatcctgttccagcagctatgacggatcagaccgagaggaccaccggaacgagttccattccccaatcgggctgaccaggccaagccctgacgaacgcgagagccccagtgtcaagcggatgcgcctgagcgagggttgggccacgtag

SEQ ID NO: 125326 - DNA, 1563 bp, Artificial Sequence
  Description of Artificial Sequence: Synthetic coding sequence
atgggtaggaaaaagatacagatacagagaatcaccgacgagaggaacagacaggtcaccttcaccaagcgtaaatttggattgatgaagaaggcctatgagctgagcgttctctgcgattgcgagatagctctgatcatctttaatcattcaaataaactcttccagtacgcttccaccgacatggataaagtgttacttaagtataccgaatacaatgagccacacgaatccagaacaaatgcagacattattgaagccctgcacaagaaacatagagagtgcgaaagtcctgaagttgatgaagtgtttgccttaacaccccagactgaggagaaatataagaaaatcgacgaggagtttgataaaatgatgcagtcctatcgactcgcctccacagtgccggccccaaattttgcaatgcctgtgacggtgcccgtatcaaatcaatcctcactgcagttctcaaatccgtccgggtccctggttactccatcactcgtgacatcgagtctcacagaccctcgcctattgagcccacagcaacctgcccttcagcgcaacagtgttagtccgggcctaccgcagagacccgcctctgcaggagctatgcttggcggcgacttgaatagtgctaacggagcctgcccttcccctgtaggaaacggatatgtgagcgcccgggccagtcctggcctgttgcctgttgccaacggaaattctctgaacaaggtcattcccgctaaaagcccaccacccccaacccacagcacccagctgggtgccccaagccggaagccggaccttcgggtcatcacctcccaagccggtaagggtctaatgcaccatctgactgaggaccacctcgacctgaacaacgcacagagactgggagtgtcccagtctacccattcactgactactcctgtggtgtccgtggccaccccatccctactgagccaggggttgccttttagctcaatgcctacagcctataatacggactatcagctgacatccgcagagctgtcctctctgcccgcttttagctctccaggaggactgtctctcgggaacgtgactgcctggcagcagccacagcagcctcagcaaccccagcagccacagcctccacagcaacaaccacctcagcctcagcagccccaaccccagcaacctcagcagccgcagcagccccctcagcaacagagccacttggtgcccgtcagtttgagcaacctcattccaggctcacctctgcctcacgtcggtgcagctctaacagtcaccacgcatcctcacataagcattaaaagtgagccagttagtccatctagagagcggtctcccgctccccctcctcccgcggtgtttcctgctgcccgccccgaacctggtgacgggctgtctagtcctgctggggggtcatatgaaaccggcgatagagacgatgggcggggcgacttcggcccgaccctgggacttcttagaccagcacccgagcctgaagcagagggcagtgcagtgaaacgtatgagacttgatacatggacactgaagtag

SEQ ID NO: 125327 - DNA, 1566 bp, Artificial Sequence
  Description of Artificial Sequence: Synthetic coding sequence
atgggcagaaagaaaattcagattcaacgcatcacagacgaacgaaatcgccaggtgactttcactaaacgcaaattcggtctgatgaaaaaggcatacgaactgtccgttctctgcgattgcgaaatcgccctgatcatctttaaccacagcaataagctctttcaatacgcttccactgacatggacaaggtgcttctgaaatatacggagtataacgagccccatgagagccgtaccaacgcggacatcattgagacacttaggaaaaaaggcttcaacggctgtgacagccccgaacctgatggggaggattcattagagcagagcccactgctcgaagataagtatcgtcgcgcgagcgaagagttagacggcttgttcaggaggtatggttctacagtccctgctcctaacttcgctatgcccgtaacggtacctgtgagcaatcagtccagccttcagttctccaatccttccggtagcctggttactccctctcttgttacttcatcactgacggaccctagactcctctccccacaacaacctgcactccagcgtaacagcgtgagcccggggctgccacaaaggcccgctagtgccggggcaatgctcggaggtgatctgaacagcgcaaatggagcgtgcccaagccctgtaggaaatgggtacgttagcgcccgagcaagccctggactcttgcccgtggcaaatgggaacagcttgaataaagtcatacccgctaaatctcctccgcccccaacgcattccacccaattaggcgcccctagccgaaagcctgaccttcgggttatcaccagccaggcgggaaagggtttaatgcaccatctgacagaagatcacctggacctgaacaatgcgcaaaggctgggtgtgagtcagagcacccacagcttgactaccccagtcgtcagcgtcgccacaccctctttactgagtcaagggctgcccttctccagcatgccgacagcctacaacacggattaccagcttacctcagccgagctgtcttcactaccagctttctcgtctcctgggggcctatccctagggaacgtgactgcatggcagcaaccacagcagccccagcagccccagcagccgcagccccctcagcagcagccccctcagcctcagcaaccacagcctcagcagccacaacagccccagcagcccccacagcagcagtctcacctggtcccagtaagcctgagtaatctaatcccggggtcccctctgcctcatgtcggtgccgccctgaccgtcacaactcatccacatattagcatcaagtctgagcccgtctctccttcaagagagaggtctcctgccccacctccacctgctgtgttccccgctgctcgacccgaaccaggcgacggactctcctcacccgctggcgggtcttacgaaaccggagaccgcgatgatggtcggggcgattttggaccaacactaggcttgctgaggcctgcccctgagcctgaggccgagggcagcgccgtcaaacggatgcgactggatacgtggacattgaagtag

SEQ ID NO: 125328 - DNA, 1428 bp, Artificial Sequence
  Description of Artificial Sequence: Synthetic coding sequence
atgggccgtaaaaagatacagattcagaggataaccgacgagcggaatcgccaagtgactttcaccaagcggaagttcgggttgatgaaaaaggcttacgaactgtccgtgctgtgtgattgcgaaatcgccctgatcatattcaatcatagcaataagctgtttcaatatgccagtaccgatatggacaaggtactcttgaaatacaccgagtacaatgaaccgcatgagtccaggaccaacgccgacatcatcgagtctacggtccctgcacccaacttcgccatgcccgtcactgtgccagtgagtaatcagtcttctctgcagttcagtaacccttctggaagtctcgtgactccctctcttgtaacctcttcactcacggatccccgtctgctgagtccccaacagccagcgctgcagaggaatagtgtatcaccaggcctacctcagcgccccgcttccgcaggggctatgctcggcggggatctgaatagcgcgaatggagcttgtccctcccctgttggcaacgggtatgtttccgccagggctagcccagggcttcttccagtcgctaatggtaatagtctgaacaaagttattccagcgaaaagcccaccaccccccacccatagcacgcagctaggggctccatcacgcaaaccggaccttagagtgattacttcacaagcagggaaagggcttatgcaccaccttaccgaagaccatcttgacctcaacaacgcgcaacgtttgggcgtgtcccagagcacccacagtctgacgactccagttgtgagtgtcgctaccccgtccctcctgtctcagggtctcccattttcctctatgccaaccgcatacaatactgattaccagcttaccagcgccgaactttcaagtttgccggctttttcgtcccctggtggactctctttaggcaacgtgaccgcatggcaacagccccagcagccacagcagccccagcagcctcagccaccccagcagcagccacctcaacctcagcagccacagccacaacagcctcaacagccacagcagccgcctcagcagcagtcacacttagttcccgtgtcactgagcaatttgattcctggctccccgcttcctcacgtgggagcagctctgactgtgacgactcatccccatatctctattaagtctgaacccgtatctccgtcccgcgaacggtcaccggcccctccaccccccgccgtgtttccagctgcgcgaccagagccgggcgacggcttgtccagtcctgcaggaggatcttacgaaactggggatagagacgatggtagaggagactttggacccacactgggcctgctgcgccccgccccggagccagaggccgaaggctcagcagtgaagcgcatgaggctggatacctggacccttaaatag

SEQ ID NO: 125329 - DNA, 1545 bp, Artificial Sequence
  Description of Artificial Sequence: Synthetic coding sequence
atgggtaggaagaaaatccaaattcaaagaatcacagacgaaaggaataggcaggtgacttttaccaaacgaaaattcggactaatgaagaaagcctatgagttgagcgtcctgtgtgattgcgagatagccctgataatcttcaaccacagtaacaagctgtttcagtatgccagcacggatatggataaagtactactgaagtacaccgagtataatgaaccacatgaaagcagaaccaatgctgacattattgaaactctgagaaagaaagggttcaatggttgtgacagcccagaaccggacggcgaggattctctagaacaaagcccgttgcttgaggacaagtacaggcgcgcctcagaagaattggatgggctgttccgaaggtacgggtctacggttcccgctccaaacttcgcaatgcctgtcacagtgcccgtgagcaaccagagtagcctacagttcagtaatccctcgggctcactggtgacaccctcactggtgacttcttcactgaccgatcctcggctactcagcccacaacagccagcattgcaacggaatagcgtctctcctggactccctcagcgccctgctagtgccggcgccatgctggggggggacctgaactcagccaatggcgcctgcccttcccctgtgggaaacggatatgtctcagcaagggccagccccgggctgctgcctgtagcaaatggtaacagccttaacaaggtaattcctgctaagagccccccacctcctacccactcaactcagctgggcgcaccatcgcgaaagcctgacctccgcgtcataacctcacaggctggcaaaggacttatgcaccatctcaataacgctcagcgcctgggtgttagccagtctacccatagccttactactcccgtcgtctctgtggctaccccttccttgttaagccagggtctccccttcagctctatgccaaccgcatataatacggactaccagctgaccagcgcggagctttcaagtctgcctgccttcagtagccctggcggccttagtctgggtaatgtcacggcttggcaacaacctcagcagcctcaacaaccccaacaaccccagccgccccaacagcagcccccacagcctcagcagccacaaccacagcagcctcagcagccccaacagcctccacagcaacaatctcacctggtgcccgtcagcctctcgaaccttatacccggatctcccttaccacatgttggagctgctctaacagtcaccacacacccacatatttcaatcaagtccgagccagtcagcccgtcccgcgagaggagcccagccccgccaccccctgcagttttcccggccgcaagacccgaacctggcgacggactctccagcccggcaggcggatcctatgaaactggagacagagacgatggccgcggcgactttggacccacactaggtctgctcagacccgcgcccgagcccgaagctgagggttcagcagtcaaacggatgcggctggacacctggacgctgaaatag

SEQ ID NO: 125330 - DNA, 1545 bp, Artificial Sequence
  Description of Artificial Sequence: Synthetic coding sequence
atgggtcggaagaaaatccagattcagaggatcaccgacgagagaaatagacaagtgactttcacaaaaagaaagttcggcctgatgaaaaaagcctacgagctttccgtactatgtgactgcgaaattgctctgattatctttaaccattccaacaagctcttccagtacgcatctacagatatggacaaggttcttttaaaatacaccgagtataacgagccgcatgagtcccgcacaaacgctgacatcatagagactctacgcaagaaaggattcaacggatgtgattctcctgaacccgacggtgaagatagtctggaacagtcgcctttacttgaggataagtacagacgcgcctcagaggagctcgatggattgttccgacgttacggctcaaccgtccctgctcccaactttgcgatgcccgtgaccgtgccagtgagcaatcagagttccttgcagttctccaacccaagcggaagtctcgtcactccaagcctagttacatcctcccttacagaccctcgactgctcagccctcaacagcccgccctccagcgcaactccgttagccctggtcttccccaacgtcccgcttcagccggggctatgctgggcggagacctgaactccgcaaatggagcctgtccatctcccgtggggaatggatacgtttccgcacgggcctcccctggacttctacctgtcgcaaacgggaattctctgaataaggttatcccagccaagtcgccaccaccacctactcatagcacacaactgggtgcgcctagtcggaaaccggacctcagggtcatcactagccaagcaggtaaaggtctgatgcaccatctgaataacgcacagaggttgggagtatctcagtcaactcacagtctgacaacacccgtggtgtcagtggccactccctcccttttgtcccagggcctgccttttagtagcatgccgaccgcatataacactgattaccagctgacgtccgctgagctgtcaagcctccccgccttttcatcacctgggggattgtctcttggaaatgtgaccgcttggcagcagccacagcagccccaacagcctcagcagccccagcctccccaacagcagcctcctcagcctcagcagccgcagccacaacaaccccagcagccccagcagccgccacagcagcagtcacatctggtgcccgtgtccctgtccaatttgatccctgggtccccccttcctcatgtgggagccgccttaacagttactacacacccccacatttccataaaaagtgagcccgtttcgccatcccgggaacgaagtcccgcgccaccaccacccgctgtcttcccagcggcccgccctgaaccaggcgacgggctttcctctccagcgggcggaagctatgagacaggcgatagggacgatggacggggtgactttggaccgacgctcgggctgcttcggccggccccggaacccgaggcggaaggatccgcagtgaagcggatgaggctggacacctggactctcaagtag

SEQ ID NO: 125331 - DNA, 1533 bp, Artificial Sequence
  Description of Artificial Sequence: Synthetic coding sequence
atgggaaggaagaaaatccagatccagcgaatcacagatgaacgtaacaggcaggtgacatttactaaaaggaaatttggcttgatgaagaaggcctatgagctgtctgtgctgtgcgattgcgaaattgcgctcatcatctttaaccactcgaacaaactgtttcagtatgcctccactgatatggataaagtcctgcttaagtacacagagtacaacgaaccccacgaatcccggaccaacgctgacataatcgaggctctccacaaaaaacaccgggaatgcgaatcacccgaagtggacgaggtgttcgcactgactccccagacagaagagaaatacaagaaaatcgacgaagaatttgacaagatgatgcagtcatacagattagcctctaccgttcccgccccaaactttgctatgccagtcactgttcccgtcagcaaccagtcaagtctgcagtttagcaacccctccgggtctctggtgactccttcacttgtcaccagctccctcactgacccccgcctcctgtcaccacagcagcctgcactccaaagaaactcagtgtctcccggtctgccccagcggcccgcaagcgccggcgcaatgctagggggcgatctaaactcggccaatggcgcatgtccaagtccagtcggcaatgggtacgtgtctgcccgcgctagccctggcctgctgcccgttgctaatggaaatagcctgaataaggtcataccagcaaaatcccccccccctcctacgcacagcacccaactcggagccccatcgcggaaacctgatcttcgggtgattacctcccaggcaggtaagggccttatgcaccatttgaacaacgcacagcggctcggtgtcagccagtctacccactctctgacaacaccagtcgtgagcgtcgcaacccccagccttttgagccaggggctgcctttttccagcatgcccaccgcgtacaatacggattatcaactaaccagcgcggaactgagctcgctgcccgctttttctagccccggcggcctgtcactagggaacgtgactgcctggcaacagccccagcaacctcagcaaccccaacagcctcaaccacctcagcaacaaccaccccagccacagcagccacaacctcagcaacctcagcagccccagcagcctccgcagcagcagtcccatctggtacccgtgtcgctcagtaatctgattcctggctcacctttaccccacgtcggagccgccttaaccgtgacaacacatccccatatctctatcaagagtgaaccagttagtccaagccgggagcgcagcccagcgccgcccccacctgctgtcttccccgccgcaagacccgaacctggcgacggattgtcttctcctgctggtgggagttacgagactggagacagggacgatgggagaggagatttcggcccaactctggggctgttgcggcccgctcccgagccagaggctgagggctctgctgtgaagcggatgcgattggacacttggtag

SEQ ID NO: 125332 - DNA, 420 bp, Artificial Sequence
  Description of Artificial Sequence: Synthetic coding sequence
atggggcgcaaaaaaattcagattcagagaattactgacgagcggaatcgccaggtcacctttactaagcgcaagttcggactcatgaagaaagcttatgaactgagtgtcctctgcgattgtgagatcgccttgattatctttaaccactcaaataaactgttccagtatgcttcgactgacatggacaaagtcctgctgaaatacacagagtacaatgagccccacgagtcgcgtacgaatgcagatattatagaaactttacgaaaaaaaggattcaacgggtgcgattcccccgaacccgatggcgaggactccctggagcagagcccactgttagaggacaaataccggcgggcgtccgaggagttggatggactcttccggcgatacggcggcccctgctggggagtgacttag

SEQ ID NO: 125333 - DNA, 1410 bp, Artificial Sequence
  Description of Artificial Sequence: Synthetic coding sequence
atggccgaggaacgcgagccagaattgtatttgaaatggaaacattgtgagactccaggggtgaaaaccctttgcaatctgaaacactgcgagactccgggagtcaaaacactctgcaatctgaagaagctgcttaaccggctgcagaaagatcatagggaggatgtgtatctgtacatctcgggtcaccttaatcccaacaagctctatcaacccccggagacaatcctccagcattggcccaatgctcatagaccaaagggcgagagggccagtgaagtgggcgagccacctgccgggaaagtcgcccgaatgaaggaagctctggcccactttactatccataccgctctggtcccttcggaggcccaggacaccccactgtttcgctacctgaatcctcaggcaagcttgtcacacacgtccgaagaggattttctccccgtggaagccgtgcgagaaggtaaggaggaaaaaaaagggggaccacctggacgtggtccccctggttggcgacgtcgggaagagctgcggcttccagacttaaaagtgctgtgctaccaggaggcaggtagtcggggtacccgggaccgtcaccattacgtttcgagttacctggctggggccacctccgctgatcgataccggatgtttctgcgctttcagaaagaggtcctcgcaaagcaggatcttctgaagaacgatttcactgggtcaaaggccgcagcaggccatgagagaaaactccagcaggagcttcagaagatctgtacctgtagcccacagcagttcaacagactgcatgtgttcggcaaggtgtttgaggacatctgtaatagctccctgatctttggtgacctgctgaagaaagtgaaggacgagtacgaactatatatggctacactgctggagtcgcagccagccgcacagtatgaagccctgctggcccagcttaaagcattgggacagcggccagtaaagaccgccgacatggatctagctcgcgaagaactgaggatgcttgtgaccgccactaaggccgcccttgaacagaatgatcggttacggagtgaactggagatggaggtcgccttgctgcagtccgccaaagagcgaagtgagagttctgagaagcacatcattgatgaaaaccggcttacactgacagagaaggttgagaaaaaaagatgtgagatcctctcaaaatgggatgagattcaggcactggaaaaagaaatcaagactacactagtacatactgggatcagtgacataactgagaatagaatcaaatccatcgaacacgaagccattcagcttgaaacggagaacatgattcttaagaagaaaatcaaaggacccctggaaatttaccaggggatctgcaagattcgtgggaatcgaaggtag

SEQ ID NO: 125334 - DNA, 741 bp, Artificial Sequence
  Description of Artificial Sequence: Synthetic coding sequence
atgtatcaagtttccggccagcgcccttccggatgtgacgccccctacggggctccaagcgcagccccaggcccagcccagaccctgagtctcttgcccggtctggaggttgtgactggttcgacccaccctgccgaggcagccccagaggaagggtctctcgaagaagcggccacaccgatgccacaggggaatggacccgggatcccacagggattggacagcaccgacctcgatgtaccaacggaggcagtaacttgtcagccccagggcaaccccttagggtgtacacctcttttgcccaacgactcagggcaccctagtgagctcggaggaactcgccgtgccgggaacggagctctggggggacctaaagctcaccggaaactccaaacacacccatctctcgcttcgcagggctcgaaaaagagcaagagctcttctaaatcaaccacttcacaaatcccgttgcaagctcaggaggattgttgcgtgcactgcatcctgtcttgccttttctgtgagttcctcacactctgtaatatcgtgctcgactgtgccacttgcggcagctgctcctcagaggattcatgtctttgttgctgctgctgcggaagtggagaatgtgctgactgtgacttgccctgtgacctggactgcggcattctggatgcttgttgtgagtcggccgattgtttggagatctgtatggagtgttgtggcctctgtttcagttcctag

SEQ ID NO: 125335 - DNA, 696 bp, Artificial Sequence
  Description of Artificial Sequence: Synthetic coding sequence
atgtaccaggtgagcggacagcgtcccagcgggtgcgacgctccttacggtgcccccagcgctgccccgggtcccgcacagacactgtcccttctgccggggctcgaggttgtgactggcagcacacatcccgcagaggccgctcctgaagaaggcagcctggaagaggccgcgacccccatgccacaaggcaatggccccggtatcccacagggcttagactccaccgacctggacgtccccactgaagccgtgacgtgtcagcctcaaggcaaccccctcgggtgcactcccttactaccgaacgattctgggcatccgtcggagctaggtgggacacggagggctggtaatggcgcccttggtggacccaaagcgcataggaaactccagactcaccccagcctggcctcacagggcagtaaaaagtctaagtcatcatctaagtccaccacctcacagattcctctgcaagcccaggaagactgctgtgtgcactgtatcctatcttgcctcttttgcgagtttctgaccttgtgcaacatcgtgttagactgcgccacatgcgggagttgctctagtgaagattcatgcctgtgttgctgctgctgcggaagtggagaatgtgccgactgtgatttgccatgtgacctcgactgcggaatcctggatgcctgttgcgagagcgcagattag

SEQ ID NO: 125336 - DNA, 642 bp, Artificial Sequence
  Description of Artificial Sequence: Synthetic coding sequence
atgtaccaagtctccgggcagcgaccatcagggtgcgacgccccttacggagctcccagcgccgcccccggtcccgctcagaccctcagtctgctgccagggctggaggtggtgacaggatcaacccatccggcagaggctgcaccagaggagggctccctggaagaggcggccacacccatgccgcaggggaacggtccgggaatccctcaaggactggacagcacggatctggatgtgcccaccgaggccgtcacctgccagccgcagggaaatccactgggttgcacaccactgctccctaatgattcaggtcatccatccgaactcgggggaactagacgtgcgggtaacggagccctggggggtcctaaggctcatcggaagttacagacacacccttccctagcaagccaaggatccaaaaagtctaaaagttcctctaagtctaccactagccagattcccctgcaggcacaggaagactgctgtgtacactgtatcctgtcttgcctgttttgtgagttcctgaccctatgcaacatcgtcctcgactgtgctacatgtggaagctgttcatctgaggactcgtgtctatgctgctgctgttgcggctcgggtgaatgcgctgattgtgactag

SEQ ID NO: 125337 - DNA, 297 bp, Artificial Sequence
  Description of Artificial Sequence: Synthetic coding sequence
atgtatcaggttagcggtcagcggccttccggttgcgatgccccttacggcgcaccatcagccgccccagggcctgcccaaacccttagtttgctccctggtttggaggtggtcactgggagtactcacccagcagaagcggcgcccgaggagggctcattagaggaagccgctacaccaatgccgcaaggtaatgggccaggtatccctcaaggccttgacagcactgatcttgacgtacctacggaggcagttacctgtcagccacaggggaatccacttgggtgtacgccttag

SEQ ID NO: 125338 - DNA, 387 bp, Artificial Sequence
  Description of Artificial Sequence: Synthetic coding sequence
atgtaccaggtgagtggtcagcggccctccggctgtgacgcaccctacggtgccccttctgctgcacccggccccgctcaaaccctgtcgcttttgcctggactcgaggtggtcaccggttctacacaccccgccgaggccgctccagaggagggttcgctcgaggaggctgctacccccatgccacagggcaatggacctggcataccacaggggcttgacagtacagacctcgacgtgccaacggaggctgtcacctgccagccccagggtaacccactggggtgcacacccctcctgccaaacgatagcggacatccttctgagcttggaggcactagacgggccggcaatggagctctaggcgggcccaaggcacacaggtag

SEQ ID NO: 125339 - DNA, 741 bp, Artificial Sequence
  Description of Artificial Sequence: Synthetic coding sequence
atgtaccaggtgtccggccaacgtcccagcggttgcgacgccccgtacggcgctccatcggctgctcccgggccggcacagaccctcagtctgttgcccgggctggaagttgtaactggcagtacacatcccgccgaagccgcaccagaggagggctcactggaggaggcagcaacgcctatgccccagggcaacggacccggcatcccgcagggccttgattccacggatctggatgtcccgactgaggctgtgacttgtcagccacaggggaatcctctcggctgtacccctctgttgcccaatgactctggtcatccaagtgagctcggtggaacccgacgggccggcaatggcgccctgggcggcccaaaagctcaccgaaagctacagacgcacccttcgcttgcctcacagggcagcaagaagagcaagtcttcgagcaaatcgaccacctcacaaatccctctgcaggcccaagaggactgctgcgtgcactgcatcctgagctgtctgttctgtgaattcttgaccctgtgtaacattgtgctggactgtgctacctgtggcagttgttcatctgaagacagctgtctttgttgctgctgttgcggcagcggggaatgtgcagattgtgatcttccttgcgatctcgattgcggcatactggacgcttgctgtgaatcggccgactgcctggaaatctgcatggagtgttgcggtctctgcttctcatcatag

SEQ ID NO: 125340 - DNA, 729 bp, Artificial Sequence
  Description of Artificial Sequence: Synthetic coding sequence
atgatgatggatttgtttgagacgggtagctatttcttttatctggatggagagaatgtcacgctccagcccctggaggttgccgaaggatctcccttgtaccctggttccgatggtacactgagcccttgtcaggaccagatgccgccagaggccggctctgacagttccggagaagagcacgtgctcgcacccccgggcctccagccacctcactgccccggtcagtgtcttatctgggcatgcaaaacctgcaagaggaaatccgcacccacagaccggcgcaaagccgctacgctgagagaaaggcgcaggctgaaaaaaattaacgaggctttcgaagctcttaagcgtcggaccgttgcaaatccgaaccaacgcctccctaaggtggaaattctccgctccgctatctcttatattgagcggctgcaggatcttctgcatcgcctcgatcagcaggaaaagatgcaagaattgggcgtggatcctttttcttataggcctaagcaggaaaacctggaaggtgccgatttcctaaggacatgctcctcccagtggccctccgtttccgatcacagtagaggtctggttattactgccaaggaaggcggcgccagcatcgattcgtctgccagttctagtcttagatgcctttcctcgatcgtggatagtatcagtagcgaagagcggaagcttccctgtgtagaagaagtagtagagaaatag

SEQ ID NO: 125341 - DNA, 1527 bp, Artificial Sequence
  Description of Artificial Sequence: Synthetic coding sequence
atgacccaaaccctgaaatatgcttcacgggttttccaccgggtgcgatgggccccagaactgggcgccagcctgggttacagagagtatcacagtgctcgccgaagtttggcagatattccgggcccatcaacaccctcctttctcgcggaactcttctgcaaaggcggattatcacgattacacgagctgcaagtgcagggagccgcgcacttcgggcccgtgtggttagcctcattcggcactgttagaacagtgtacgtggcagctccggcactcgttgaggagctcttgcgccaggaagggccaagaccggaaaggtgttcttttagcccctggacagagcaccggaggtgcagacagcgagcttgcgggctcctgaccgcagagggggaagaatggcagagactcagaagtttactcgctcccttgctgctcagaccacaggctgccgcgaggtacgcaggtacgctcaataacgtggtctgtgatctcgtgcgccggctcagacggcagaggggccggggtacgggacctcctgctctagtgagagacgtcgccggagaattttacaagttcggcttagaaggtatcgccgcggtgttattaggatcccgcctgggctgcctggaggcccaggtgcccccagacaccgagactttcatcagagctgtgggatccgtgtttgtctccaccttgctcactatggctatgccccattggctccgccacctcgtaccaggcccctggggtcgcctctgccgagactgggaccagatgtttgcttttgcacaacgacacgtggaaaggcgggaagctgaagctgcaatgcgcaacggtgggcagcctgagaaggatcttgaatcaggggctcatctgacccacttcctgtttagggaggaattgccagcacaatccatactgggaaatgtgacagaactgttgcttgccggcgtggataccgtaagcaatactctttcctgggccctgtacgagcttagccggcatcccgaggttcaaactgctctccattccgagattacagcagccttatcccctgggtccagtgcatatccttcagccacagtcctttcacagctccctctgctgaaggctgtcgtcaaggaggtattgcggctttaccccgtggtccctggcaattctagggtcccagacaaggatatccacgtgggcgattatatcattccgaaaaataccctggtgaccctgtgtcattatgccacatcgcgggacccggctcagtttccagagccgaattcattccgccccgccaggtggctgggtgagggcccaacgccccatccattcgcctccctgccgttcggcttcgggaaaaggagctgcatgggtagaaggcttgccgagctcgaactccagatggcgctggctcagattctcactcattttgaggtacagcctgagccaggagcagcccccgttcgccccaaaactagaacagtgctggtccccgagagatcaatcaacctgcaattcttggataggtag

SEQ ID NO: 125342 - DNA, 675 bp, Artificial Sequence
  Description of Artificial Sequence: Synthetic coding sequence
atggaactgtacgaaactagcccttacttctatcaggaacctagattttatgacggggaaaattacctgcctgtacacctgcaagggtttgaaccgcccggctacgagaggacggagctgaccttgagcccagaagcccccgggcccttagaggataaaggactggggacgccagaacattgcccaggccagtgcttgccatgggcttgcaaagtgtgtaaacggaagagtgtgtccgttgataggcggagggcagcaacattgagagaaaaaaggaggctcaagaaggtaaacgaggctttcgaggcactaaagaggtctactttactcaatccaaaccagagactccccaaggtcgaaatcctgagatccgcaattcagtacattgagcgcttgcaagcgctgttatctagcctgaaccaggaagagagagacctgcgctatcgtggcggtggaggaccacagcctggcgtgccaagcgagtgtagtagtcactccgccagctgctcccctgagtggggaagtgccctagagtttagcgccaatccgggagatcacctactcaccgccgaccccacagacgctcacaatctgcatagcctgactagtattgtggattcgataaccgtggaagatgtgtctgtggccttcccggacgagaccatgcccaactag

SEQ ID NO: 125343 - DNA, 465 bp, Artificial Sequence
  Description of Artificial Sequence: Synthetic coding sequence
atggggctgtccgacggggagtggcagctagtgcttaatgtgtggggaaaagtcgaggctgatatccccggacacgggcaagaagtcctcattcgactattcaaagggcatcccgaaacacttgagaaatttgacaagtttaaacacctcaagagcgaagatgaaatgaaagccagcgaggacctcaagaaacatggagcaacggtgctgactgcattgggtggcattttaaaaaagaagggccaccatgaagcggagataaaaccactcgctcagtcgcacgcaaccaagcataaaatccctgtcaaatacttagaattcatttctgagtgtatcatacaggtgcttcagtccaaacaccctggagatttcggcgcagatgctcaaggggcgatgaacaaagcactggagttattccgcaaagatatggcctccaactataaggagctggggtttcagggttag

SEQ ID NO: 125344 - DNA, 465 bp, Artificial Sequence
  Description of Artificial Sequence: Synthetic coding sequence
atgggtttgagcgatggcgaatggcagctggtactgaatgtgtggggcaaagtagaagccgatatccctggtcacgggcaggaagtcctgataaggctgtttaaggggcacccggaaactctcgaaaagtttgacaaattcaagcacctgaagtcagaggacgagatgaaagcatccgaagaccttaagaaacatggcgccacagtcctgaccgctctgggtggtatactgaagaaaaaaggccaccacgaggccgagatcaagcccctggcacaaagccatgctacaaaacacaaaatcccggtgaaatacctggaattcatatctgagtgtattatccaggttctacaaagcaagcatcctggagatttcggggccgatgcccagggtgcgatgaacaaagcgttggagcttttcaggaaggacatggcttccaactacaaggagctggggtttcagggctag

SEQ ID NO: 125345 - DNA, 465 bp, Artificial Sequence
  Description of Artificial Sequence: Synthetic coding sequence
atggggctgtctgatggcgagtggcagctcgtcctgaacgtgtgggggaaagtggaagcggatatcccaggtcatggccaggaggtgctgattcggctgtttaagggccaccccgagactctagagaagtttgacaagttcaagcacctaaaaagcgaggacgagatgaaggcttcagaggatctgaagaaacatggagcaacagtattaactgcgctcgggggcatactgaaaaaaaaggggcatcatgaggccgaaataaaaccgctcgcacaatcccacgctacaaagcataagataccagtcaaatatcttgagttcatcagcgagtgtataattcaagtgttacagagcaagcaccccggcgattttggggcagacgcacagggagccatgaacaaagctctggagttgttcagaaaggacatggcctcaaattataaggagctggggtttcaggggtag

SEQ ID NO: 125346 - DNA, 465 bp, Artificial Sequence
  Description of Artificial Sequence: Synthetic coding sequence
atgggcctaagcgatggtgaatggcagctagtactgaatgtgtggggaaaggtcgaggctgatatcccgggccacggacaagaagttcttattcgtctgttcaaagggcaccccgaaactctagagaaattcgacaagttcaagcacctcaaaagcgaggatgagatgaaagcctcagaggatctgaaaaagcatggcgccactgttctaacagccttaggaggcatattgaagaagaaaggccaccatgaggcagaaataaaaccactggctcaatcacacgctactaaacacaagattccagtgaaatatttggagttcatttcagagtgcatcatccaggtgttacagagcaaacatcctggggattttggcgccgacgctcagggtgctatgaacaaagctttagagctgtttcgcaaagacatggcctctaactataaagagttgggtttccaggggtag

SEQ ID NO: 125347 - DNA, 234 bp, Artificial Sequence
  Description of Artificial Sequence: Synthetic coding sequence
atggggctctctgacggcgagtggcagctcgtgctgaatgtatgggggaaagtggaagctgatatacctgggcatggccaagaggtcctgattcggctttttaagggtcaccccgaaacacttgaaaagttcgacaagttcaaacacctgaagagtgaggatgagatgaaggcatctgaggacctgaaaaaacatggcgcaactgtcctcacagctctggggggtatcctgtag

SEQ ID NO: 125348 - DNA, 432 bp, Artificial Sequence
  Description of Artificial Sequence: Synthetic coding sequence
atgggactgtccgatggggagtggcaactggtcctgaatgtatggggcaaggtggaagccgatatccctggccatggccaggaggtactcattaggctcttcaagggtcatcctgaaactctggaaaaattcgacaaatttaaacatctgaaaagcgaagacgaaatgaaggcaagtgaagacctgaaaaagcacggagccacagtgctgaccgcactgggcgggatcctgaagaagaagggtcatcatgaggccgagattaaaccacttgcacagtctcatgccacgaagcacaaaattcccgtgaaatatctagaatttatttccgagtgcatcattcaggtcctgcaaagtaaacatccgggcgacttcggagctgatgcccagggcgccatgaataaagctctagagttatttcggaaagacatgtag

SEQ ID NO: 125349 - DNA, 321 bp, Artificial Sequence
  Description of Artificial Sequence: Synthetic coding sequence
atgggccttagcgatggagagtggcaacttgtattgaacgtgtggggaaaggtcgaggcggacattcccggccacggccaggaagtccttatcagactgtttaaggggcaccctgaaacactcgaaaaattcgacaagtttaagcacttaaaatcagaagacgaaatgaaggcatccgaggatctcaagaagcacggtgcaaccgttcttacggctcttggaggtatccttaaaaagaaaggccatcacgaggccgaaattaagcccttagcacagagccacgccacaaagcacaaaatcccggtaaaatatctggaatag

SEQ ID NO: 125350 - DNA, 321 bp, Artificial Sequence
  Description of Artificial Sequence: Synthetic coding sequence
atgggcctctctgacggggagtggcagctcgtgctcaatgtgtggggcaaggtcgaggcagatatcccgggccatggccaggaagtcctaatacgcctctttaagggtcacccagaaaccctagagaaatttgataagtttaaacatcttaaatcagaggatgagatgaaagcttctgaagatcttaaaaagcatggggctaccgtactcactgccctgggaggtattctcaaaaagaagggacaccatgaggctgaaattaaacctctcgctcagtcgcatgcgaccaagcacaaaatccccgtgaaatatttggaatag

SEQ ID NO: 125351 - DNA, 411 bp, Artificial Sequence
  Description of Artificial Sequence: Synthetic coding sequence
atggccgtgggagctgagaggttgggggaagtcctcattcgactgtttaaagggcaccctgagaccctcgaaaaattcgataagttcaaacatctgaagagtgaggatgaaatgaaggccagcgaagacttaaaaaaacacggagccactgttttgaccgctctggggggaatactcaaaaagaagggccatcacgaggctgaaataaagccgctggctcagtcacatgctactaagcacaagatacccgtgaaatacctagaatttatcagtgagtgcatcatccaagtccttcagagcaagcaccccggtgattttggcgcggatgcccagggcgcaatgaataaggccctcgagctgtttaggaaagacatggctagcaactataaggagctcggcttccagggttag

SEQ ID NO: 125352 - DNA, 4398 bp, Artificial Sequence
  Description of Artificial Sequence: Synthetic coding sequence
atgtctctggtgacagtgcctttctatcaaaagcgtcaccgccactttgaccaaagctataggaatatccagacgcgctatctgctggacgaatatgcctctaagaagcgcgcatccacgcaggccagcagtcagaagagcttgagtcaacggtcttcaagccagagggccagctctcaaacttctctggggggcactatttgtagagtctgcgccaagcgggtgagcacacaagaggatgaggagcaagagaacaggtccaggtatcagtctctcgttgctgcttacggagaggccaaaagacagaggtttctgagtgaattagcccacctggaggaagatgtgcatctggccagatctcaagcccgggacaagctggacaaatatgcaatccagcagatgatggaggataaactcgcctgggaaagacatactttcgaagagcgtattagccgggctccggagatccttgtccggctgagatctcatactgtctgggaacgcatgtccgtgaaactgtgtttcacagttcaaggcttcccgactccagtcgtgcaatggtacaaagacggatcactgatctgtcaggcagctgagcccggtaagtataggatagagtctaattatggtgtccacactcttgagataaaccgggcggactttgacgacaccgccacctattctgctgtggccaccaatgcgcatggccaagtttctacgaatgctgctgtggtggtacggcgatttcgcggagacgaagaacctttccgaagcgtcggccttcctatcggacttcccctgagctctatgattccctacacacacttcgacgtccagttcctcgaaaaattcggcgtcaccttccgccgggagggggaaaccgttaccctcaagtgtacgatgctggtgacacctgatctgaaacgggtgcagccgagagccgagtggtacagggacgacgtcctcctgaaggagtccaagtggaccaagatgttctttggagaaggccaggcgtcccttagtttctcccacctccataaggacgatgagggattgtacaccctgaggatagtatcccgcggcggagttagtgaccactccgcctttctgtttgttcgcgacgccgacccattggtgaccggagcccctggcgcacccatggatcttcagtgccacgacgcaaacagggactacgttattgttacctggaagcctccaaacacgacaacagagtcccccgtgatggggtactttgtagatcgctgcgaagtcggcaccaataactgggttcagtgtaacgatgcccccgtgaagatttgcaaatacccggtcactggtctgtttgagggaagatcatatatcttccgggtccgcgctgtcaactctgcaggaatctccagaccctcccgagtgagtgacgccgttgccgccttggacccattggatcttagacgccttcaggcagtccatctggagggggaaaaggaaatagctatatatcaggatgatctcgaaggagacgcccaggtgcccggcccgccgactggcgtgcatgcgtctgagatcagtcgcaactacgtagtgctgtcttgggagcctcctactcctcgcggaaaagaccctttaatgtattttatagaaaagtccgtggtcgggtccggttcgtggcaacgcgttaacgctcagacggccgttagaagcccgcgctatgctgttttcgacttaatggagggaaaatcttatgtgtttcgcgttctctccgctaataggcacgggctgagcgaaccctccgagatcacatccccaattcaagcacaggacgtcacagttgttccatcagcccccggtagagtcctggcatccaggaacaccaaaaccagcgtcgtggtgcagtgggaccgcccgaagcacgaagaggatctcctgggctattatgtggactgctgtgtcgctgggaccaatttatgggagccttgtaatcacaagccaattggatacaacaggttcgttgtccatggtctgaccacgggcgagcaatatatcttccgtgtcaaggccgtcaacgccgtaggcatgagtgaaaacagccaggagtctgacgtaattaaggtgcaggcagccttgacagtgccatctcacccctatgggataactttgttaaactgcgacggacattctatgacattggggtggaaagtgcccaaatttagcggaggatcaccaatcctggggtattatctggacaagagagaggtgcaccacaaaaattggcacgaggtgaattcaagcccttcaaaaccaacaatactgactgttgacgggcttacagagggctctctttatgagtttaaaattgcggccgtgaatctggctggtattggggaaccttccgatcctagcgaacatttcaaatgcgaggcatggactatgcctgagcccggacctgcctatgacctgacgttctgcgaggtgcgcgacaccagcctggtgatgctgtggaaagcccccgtgtactcggggtctagcccggtaagcggttattttgtggatttcagggaagaggatgctggcgaatggatcaccgtcaaccagactacaactgctaaccgatatctcaaggtgtcagacttacagcagggaaaaacttacgtgtttcgggttagagccgtgaatgcgaatggagtggggaaaccatcggacacttccgaaccagtcttagttgaagcccgtccaggaaccaaagagattagcgctggagtggatgagcaggggaatatttacctcggattcgactgccaagaaatgacggacgcctcccagtttacatggtgtaagagttacgaggagatttctgacgacgaaagattcaaaattgagactgtcggcgaccactccaaattgtatctcaaaaaccctgacaaggaggacctgggcacatactctgtctccgtctccgatacagatggggtgtcgtctagtttcgtgttggatcccgaggaattggaaaggctgatggccttatccaatgagatcaaaaaccccacaattccgctgaagagcgagctggcctacgaaatcttcgataagggtagggtgcggttctggctccaggcagaacatctgtctccagacgctagctacaggtttattatcaacgatcgcgaggtgagtgactctgaaattcaccgtatcaaatgtgacaaggctaccggcatcatagagatggttatggatcgcttcagcattgagaacgaaggcacctacaccgtccagatacatgacggaaaagctaaaagtcagtcaagtctggtacttatcggcgatgcattcaagactgttctcgaggaggccgaattccagcgcaaggagttcctgagaaaacagggcccccactttgcagagtatttgcactgggatgtgaccgaggagtgtgaggtgaggctggtgtgcaaggtggctaacacgaaaaaagagacagtgtttaaatggctcaaggacgatgtgctgtacgagacggagactctgccaaacttggagaggggcatctgcgagctgctaatccccaagctgtccaagaaggatcatggggaatacaaggctacacttaaagatgataggggacaggacgtctcaatcctggagatcgccgggaaagtgtacgatgatatgatcctcgctatgtctcgggtgtgcggcaagtccgcttcccctctgaaggtgctttgtacccccgaaggtattagactccagtgcttcatgaagtacttcacagatgagatgaaggtcaactggtgtcataaggacgccaaaatttcatcatccgagcatatgaggattggaggaagtgaggaaatggcttggctgcagatttgtgaacccactgaaaaggacaagggaaagtatactttcgagatttttgatgggaaagataaccaccaacggtctcttgacctcagtggacaggcttttgatgaggcttttgccgaattccagcagttcaaagccgctgcatttgccgaaaaaaacagggggaggttgattgggggattgcccgacgtcgtgactattatggaaggcaagacgttaaacttaacctgtacggtattcggaaatccagatccggaagtgatatggttcaaaaatgatcaggacattcagcttagtgaacattttagcgtgaaagttgagcaggcaaaatacgtatccatgacaatcaaaggggtcacttccgaggacagcgggaagtactctatcaacatcaaaaataaatacggaggggaaaagatcgatgtgaccgtcagcgtctacaaacacggggaaaagattccagacatggcaccaccacaacaggctaagcccaaactgatccccgcttcggcaagcgcagcaggccaatag

SEQ ID NO: 125353 - DNA, 3420 bp, Artificial Sequence
  Description of Artificial Sequence: Synthetic coding sequence
atgcctgaacctacaaagaaagaggacgaggaagaagtaagtccgcccagcgcacttccaccggattggactctagttgaaactccacctggcgaagaacaggcaaagcagaatgccaacagccagttgagtattctctttattgagaagccccaaggtgggactgtgaaggtgggagaggatattacgtttattgcgaaagtcaaggctgaagaccttctccgtaagcctacaatcaaatggttcaaaggtaagtggatggacctggcttctaaagcaggaaaacaccttcagcttaaggagacgttcgaacgtcattcccgcgtatatacctttgaaatgcagattataaaggccaaggacaattttgccggcaactatcggtgcgaggttacttacaaggacaagttcgatagctgctcgtttgaccttgaggtgcatgaatcaaccggcaccactccaaatatcgatattagaagtgcattcaagaggtctggagagggccaggaggacgccggggaattggacttctctggccttcttaaaagaagggaagtgaagcagcaggaagaagagccacaggttgatgtctgggagttacttaagaacgcaaagccgtctgagtacgagaagattgccttccaatacggaataaccgatctgagggggatgctcaaacgcctaaaaaggatgcgccgagaggagaagaaatccgctgcatttgccaagatactggaccccgcttaccaagtggacaagggtggaagggtgaggttcgtcgtcgaactcgccgatcccaagctggaggtgaaatggtacaaaaacggtcaagaaatcaggccatctaccaaatacatctttgagcataaggggtgccagaggatactgtttataaataactgccaaatgactgatgattcagagtactacgtgactgcaggcgatgagaaatgttccactgaactgttcgttagggagcccccaattatggtaacaaaacagttggaggacacaaccgcatactgcggggagcgcgttgaacttgaatgcgaggtaagtgaggatgatgccaatgtcaagtggtttaaaaacggcgaagagatcatcccgggtcctaagagtaggtatcggatccgagtcgaagggaaaaagcacatcctgattattgaaggcgccacaaaagcagatgccgcagaatatagcgtcatgacaaccggcggtcagagcagcgccaagctgagtgtggatctcaaacctctcaagatacttacaccactaaccgaccagacagttaacctcgggaaagaaatatgtttgaagtgcgagatcagtgaaaatataccaggcaagtggaccaagaacggcctcccggttcaagaaagcgatcgcctgaaggtggtgcataaggggcgcatacataagctagtaattgctaacgctctgacggaggatgagggagactacgtgttcgctcctgacgcctacaacgtcacccttcccgccaaggtacacgtcatcgaccccccaaagataatcctggacggtttggatgctgacaacactgtgaccgtcatcgctgggaacaaactgcgacttgaaatcccaatttccggagaaccacccccaaaggcgatgtggtccaggggtgacaaggcaattatggaggggtcaggcaggattagaaccgaatcgtatccggattcctcgactctagtgatcgacattgctgagagggatgacagtggcgtctatcatataaatctgaagaacgaggcgggggaggcccacgcttcaatcaaggtgaaagtggttgactttcctgaccctcccgtggcccctaccgttacagaagtgggagacgactggtgcattatgaactgggagcccccagcttatgacggcggtagtcctattttgggctattttatcgagaggaaaaagaagcagtcttccaggtggatgaggctgaatttcgacctgtgcaaagaaacaaccttcgaaccgaaaaagatgatcgaaggagtcgcttacgaagtgaggatattcgcagtcaatgctataggtatctcaaagccctcgatgccatctcgcccatttgtacctctggcagtgacctcaccccccaccctgctcacggtggactcagtgacagacacaacagttacaatgcggtggcgaccgcccgaccatatcggagccgccggactggatggctatgtcctcgagtactgctttgagggcaccgaagactggattgttgcaaataaggacttaatcgacaaaaccaagttcaccattaccgggctgccaaccgacgcgaaaatcttcgtgagggtgaaggccgtaaatgcagcaggagccagtgaaccaaagtactattcacagccaatccttgtcaaagagatcatagagccaccaaaaataagaatcccccgccacctgaaacagacttatattagacgcgtgggtgaggccgttaacctggtgattccattccaggggaaacctcggcctgaactgacatggaaaaaagacggggccgaaattgacaagaatcagattaacatccggaattctgaaacagataccattatcttcattaggaaagccgagaggtctcactctggcaaatacgatctccaggtgaaggtagacaagttcgtcgagacagccagtatcgatatccagataattgatagacctggtccgccccagatagtgaagattgaggacgtgtggggggaaaatgtcgctctgacctggaccccccccaaggatgatggcaatgccgccatcaccggctacaccatccagaaggccgataaaaagtcaatggaatggttcactgtcattgagcactatcacagaactagcgctaccatcacagagctagtgattgggaacgagtactatttccgcgtgttttccgaaaatatgtgtggtctgtcagaggatgcaacgatgactaaggaaagtgcggtgattgctcgagacggtaaaatctacaagaatccagtgtacgaggattttgacttttccgaagcccctatgtttacccaaccgttggtcaatacctatgccatcgcaggctataatgccactttaaattgttcagtcagaggcaaccccaagcctaagataacatggatgaaaaataaggttgcaattgtcgatgacccccggtacagaatgtttagtaatcagggggtatgcaccttggaaattcgtaaaccctccccctatgatggtggaacctactgctgtaaagctgtcaatgacctgggcacggttgagatcgaatgcaagctagaagtaaagggtggtctaagtttctgtcgactcctgctgcagggggtcccccccaatatcattgacagctacttgagagacctgcattcttccaatcccgaggagtactag

SEQ ID NO: 125354 - DNA, 3522 bp, Artificial Sequence
  Description of Artificial Sequence: Synthetic coding sequence
atgccggaacctaccaaaaaggaagagaatgaagtacccgctcccgccccaccgccggaggaacccagtaaggaaaaagaggcaggcacgacaccggctaaagactggacgctcgtggaaacacctccaggcgaggagcaggcaaagcaaaacgctaacagccaactaagtattctgttcatcgagaagccccagggtggtaccgtgaaggtgggcgaagatattaccttcatcgccaaggtaaaagcggaggacctactgaggaagcctacaattaaatggtttaaagggaagtggatggaccttgccagcaaggccggaaagcacctgcaactcaaagagaccttcgagcggcattcgagagtttataccttcgagatgcaaatcatcaaggccaaggataatttcgcaggcaactaccgctgtgaggtgacttataaagataagttcgatagctgcagttttgacctcgaagtacacgaatcaactggcactacgccaaacattgatatacggagtgctttcaaacgcagcggcgaaggccaggaggatgccggcgaactggacttctctggtctgctgaaacgaagagaagtaaagcaacaggaggaggagccacaggtcgatgtgtgggagctgctgaagaacgcgaagccatccgagtatgagaaaatcgcgttccagtatggcatcaccgacctccgagggatgttaaagcgcttaaaacgaatgcgacgtgaggagaagaagtcggccgccttcgcaaagatattggatcctgcttaccaggtcgacaagggcgggcgggttcgcttcgtcgttgagctggctgaccccaagctcgaggtgaaatggtataagaatgggcaggagatcagaccctccactaaatatatcttcgaacataagggctgccagcgcattctgttcattaataactgccaaatgactgatgattccgaatattatgtcaccgcgggagatgagaaatgttccaccgagctgtttgtcagagagcctcccatcatggtcacaaaacagcttgaagatacaacggcctactgtggtgagcgagtggagctggagtgcgaagtgagtgaagacgacgctaatgtgaagtggtttaagaacggagaagaaattattcctgggccgaagtccaggtacaggatcagggtcgaagggaaaaagcatattctcattattgagggcgcaacaaaagccgatgccgcagagtactccgtaatgactacagggggccaatctagtgccaaactcagtgtggaccttaaaccccttaaaattctgacacccctcactgatcaaacagtcaacctcggcaaagaaatctgcctaaaatgtgagattagcgagaatatccccggcaaatggacaaaaaatgggctgccagtgcaggagagtgaccggctcaaagtggtgcataaaggaaggatccataagttggtgatagccaacgccctgactgaagatgaaggcgattacgtgttcgcccctgatgcctacaacgtcacccttcctgctaaagtgcacgtgatcgaccctcccaagattattttagatggcctagacgctgataatactgtaacagtcatagccggcaacaaactcaggttggaaattcccatttccggcgagccacctcccaaagcgatgtggtcccgtggtgataaggccataatggaaggatcaggccggatcaggacagagtcatacccagactcctctaccctagtgatcgacattgctgaacgggacgacagtggggtctaccacattaatctgaagaacgaggcaggcgaggcgcatgcatccataaaagtgaaggtcgtcgatttccctgatccccccgttgctcccaccgtgaccgaagtgggcgacgattggtgtataatgaattgggaaccacccgcctacgacggggggtcccctattctcgggtatttcatagagcggaagaagaagcagagctcacgctggatgcgtctcaacttcgatttgtgcaaggaaacaaccttcgagcctaaaaaaatgatcgagggcgttgcatacgaagtgcgaattttcgccgtgaacgctattggaatcagcaagccttccatgccaagtcgaccctttgtccctctggcagttacaagccctcccaccctgctgacagtggattcagtgaccgacacaaccgtaactatgaggtggcgaccccccgatcatattggagccgccggcctggacggttacgttctggaatactgctttgaaggcagcacatctgccaagcaaagtgacgagaatggagaggcggcttacgaccttcccgccgaagactggatcgtggcgaataaagatctcatcgataaaaccaaattcacaatcactggtttgccaactgatgccaagatttttgttcgagtcaaggccgttaacgcagccggcgcaagcgaacccaagtattactcacagccaatcctggtcaaagagatcatcgagccgcctaagatccggatccctcggcacctcaagcagacctacattagaagagtgggagaagctgtaaatctggtgattcctttccaggggaaacctcggcccgaattaacatggaaaaaggatggagcagaaattgacaagaaccagatcaatatcagaaatagcgagactgataccataatcttcatccgcaaagccgaacggtcgcactcagggaaatacgaccttcaggtgaaggtggataaattcgtggagactgcctccatcgacatccaaataatcgacaggcccggcccacctcaaattgtcaagattgaagacgtctggggggagaatgtagctctgacatggacacctcccaaggatgatgggaatgccgccatcacgggatataccattcagaaagctgacaagaaaagtatggagtggttcactgtaattgaacattaccacaggaccagcgcaacgatcacagaacttgtgattggcaacgaatactacttcagggtctttagtgagaatatgtgcggcctgagcgaggacgccactatgaccaaggaatctgccgttatagcaagggatggtaaaatttacaagaaccccgtctatgaagattttgatttttccgaggcacctatgttcacccaacccttagtaaacacatacgcgattgccgggtataacgcaaccctaaattgttccgtcagaggcaatcctaagcctaagataacctggatgaagaataaggttgccattgttgacgatccacggtatagaatgttttctaatcagggagtgtgtacgctagagatcaggaaaccaagcccatacgatggcggtacttactgttgcaaagccgtgaacgatctgggtacagtggaaatagagtgtaagctggaggtgaaagtgatttatcagggcgtaaacactcctggtcaaccagtctttctggagggccaacagcaagtaggctcaccttcagcagattcatcttgcaaggcctacctacagacttag

SEQ ID NO: 125355 - DNA, 3384 bp, Artificial Sequence
  Description of Artificial Sequence: Synthetic coding sequence
atgcctgagcctaccaagaaggaggagaatgaagtgccagctcctgctccccctcctgaggagccatcaaaggagaaggaggctgggacaacgcctgccaaagactggaccctggtggagacacctcctggcgaagagcaagcaaagcagaatgcaaatagtcagctctctatcctgtttattgagaagcctcagggtggaacagtaaaagtgggtgaggacattacattcatcgcgaaggtcaaggcggaggacctgctgcggaagcccaccattaagtggtttaaaggaaagtggatggatctagcttccaaagctggaaagcatctccaactgaaggagaccttcgagaggcactcgagggtgtatacattcgagatgcagatcattaaggccaaggataatttcgcgggcaactacagatgtgaagttacatataaggataagtttgactcatgtagcttcgacctcgaggtgcacgaatccaccggaaccacacctaatattgatatacggtctgccttcaagaggagggaagtaaaacagcaggaggaggagcctcaggtagatgtatgggaactcctgaaaaacgccaaaccctccgaatacgagaagattgccttccagtacggcatcaccgatctcagagggatgttgaaaagattgaaaagaatgcgaagagaggagaaaaagagcgctgccttcgcgaaaattctggacccagcgtatcaggtcgacaagggcgggcgggtgagatttgtcgtcgagttagccgaccctaaactggaggtaaagtggtacaaaaacgggcaggagattcggccctctactaagtacattttcgagcacaaaggatgtcagaggatcctgttcataaacaactgtcagatgacggatgacagcgaatactacgtgacggccggcgacgaaaagtgttccactgaactgtttgtgcgcgagccgcccatcatggtgactaagcagctggaggataccacagcgtactgtggtgagagagttgagctcgaatgtgaagtgtccgaggacgacgccaatgtgaagtggtttaagaatggagaagaaatcattccaggacccaagtctaggtaccgcattcgggtggaaggcaaaaaacatattctgattatcgagggcgccaccaaagccgacgcggcggagtattcagttatgactacaggtggtcagtcctcagccaaattgagtgttgatctgaagcctctgaaaattctgactccattgactgatcaaacggtgaatctgggaaaagagatttgtctgaaatgcgagatctctgaaaacatacccggcaagtggaccaagaatggattgccagtgcaggagagcgatcgcctgaaagtagtacataaaggtcgcattcataagctagtgattgctaacgccctcactgaggacgaaggagactacgtttttgcaccggacgcctataatgtgacactgccagctaaagtgcatgttatcgatcccccaaaaatcatcctcgatgggctcgacgccgataacacagtcacagtgatcgctggcaataaactccgtttggagatcccaatttccggggaaccccctccaaaggcaatgtggagccgcggcgataaggctattatggaaggttccggcaggatcaggacagaatcttatccagatagcagcacattggtcattgatattgcagaacgggatgatagcggcgtgtatcacattaatttgaaaaatgaggccggtgaggcacatgcctcgattaaggtaaaggttgtggacttcccagaccctcctgttgctccaaccgtgacagaggttggcgacgattggtgcatcatgaactgggaaccccccgcctatgacggaggttctccaatcctcggttatttcattgaacggaaaaagaagcaatccagtaggtggatgagacttaacttcgacttgtgtaaggaaaccacattcgagccgaaaaaaatgattgaaggggtggcatacgaggtgcggatcttcgctgtgaatgccataggaatttccaagcccagcatgcctagcagacccttcgttcctctggcagtgaccagccctccaacacttctgaccgtggacagcgtgactgataccactgtgacaatgcggtggagaccccctgatcatatcggcgccgctggactcgacgggtatgtgcttgagtactgctttgagggcactgaggactggatagttgctaacaaagacctgattgacaaaacaaaattcacaatcacaggtttacccactgatgccaagatatttgttagagtgaaggccgttaacgccgccggcgcctccgaaccaaaatattattcccagcctattttagtgaaggaaattatcgaaccacctaagatcaggattccccggcacctgaaacagacgtacatccgcagggtgggagaggccgtcaatttggtgatcccttttcagggtaaaccgcgccctgaattgacatggaaaaaggacggagcggagattgacaagaaccagataaatatcagaaacagcgaaaccgacactattatttttattcggaaagctgagcggagtcactcagggaagtatgatctgcaggtcaaggtggacaagttcgtggaaaccgcaagtatcgatattcagatcatcgatcgtcctggtccacctcagattgtgaagatcgaagacgtgtggggcgagaacgtcgctttaacctggacacccccaaaggacgacgggaacgctgcgatcactggatacacgatccaaaaggccgacaagaagtcaatggagtggttcactgtgatcgagcactaccaccgcaccagcgcaaccataacagaattagtcatcggcaacgaatattactttagggtgttcagcgagaatatgtgcggacttagtgaggatgctacaatgaccaaggagtccgctgtcattgctagagacggcaagatttacaagaaccctgtttacgaagatttcgatttcagtgaggccccaatgttcacccagccgctggttaacacatacgcgatagccggttacaatgcaaccctgaattgtagtgtccggggcaacccaaagcccaagattacatggatgaaaaacaaggtcgccattgtggatgatcccagatatcgcatgttctccaatcagggcgtgtgcacactcgagatcaggaagccgagcccatacgacggcggcacatattgctgcaaagcagtgaatgacctgggcaccgtcgaaattgaatgcaaacttgaggttaaggtgatctaccaaggtgtcaacacgccggggcaaccagtgtttctagagggacaacagcagtctctgcataacaaagacttttag

SEQ ID NO: 125356 - DNA, 3363 bp, Artificial Sequence
  Description of Artificial Sequence: Synthetic coding sequence
atgccggagcccacaaagaaggaggattggactctcgtggaaacaccgccaggcgaagaacaagcaaaacagaacgcgaatagccagctgagtatcttatttattgagaaaccgcaagggggaacagtcaaggttggagaggacatcaccttcatagctaaagtcaaggcagaagacttacttcgaaagcctacgatcaaatggttcaaaggaaaatggatggacttggcttctaaagcggggaagcatctgcagctgaaggagacattcgaaaggcactcgcgtgtctatactttcgagatgcagataatcaaagcaaaggacaactttgcagggaactataggtgtgaagtaacctacaaggacaagttcgattcttgcagcttcgatttggaggtacacgagtctacaggaaccacgcccaacatagatatccggtccgcctttaagagatccggagaggggcaggaggacgcaggcgaattggatttctctggcctactgaagcgccgagaggttaaacagcaggaagaggagccacaggtggacgtgtgggagctgttaaagaatgcaaagccctcagagtatgagaaaattgccttccagtacggaattaccgatctgcgaggcatgctgaagagactgaagcggatgagacgggaggaaaaaaagtctgccgcgtttgccaaaatcctggaccccgcctatcaagtcgacaagggtggaagggtccgattcgtggtcgaattagctgaccccaagctggaggtgaagtggtataagaacgggcaggaaatacgaccaagcacaaaatatatctttgagcacaaaggatgtcagcgaattttgtttatcaacaactgtcagatgaccgacgattcagagtactatgtaacagccggagacgagaagtgctcaacggagcttttcgtgcgagagccacccatcatggtcacgaagcagctggaggacacaactgcttattgtggggagcgcgtagaactcgagtgcgaagtctcagaggatgatgcaaatgtgaagtggttcaaaaacggcgaggagattattcctggccccaaatctagatacaggatccgtgttgaaggcaagaaacacatactgatcattgaaggggcgacaaaggctgatgccgcagagtactccgttatgaccactggtggtcagagctcagccaaattgtctgtcgacctgaaaccacttaagattctaactcctctgacagaccagacagtgaatctcggtaaggaaatttgtctgaagtgcgaaatatccgaaaatataccaggaaaatggactaaaaatggcctgcctgttcaagagtccgaccgcctgaaagttgttcataagggtcgcatccacaagttagtcatcgcaaatgctctcactgaggatgagggtgactatgtattcgcccccgacgcatacaacgtcacactgcccgctaaagtacatgtgatcgacccccctaaaataatcttggatggactggacgctgataacacagtcacagtaatagccggaaacaagctcaggctggaaatccccatcagcggggagcctccgcccaaggcaatgtggagccggggtgataaggctatcatggagggcagcggcaggatacggactgagtcctatccagattcctctaccttggtcattgacatcgccgagcgtgatgatagcggagtctaccacattaatctgaagaatgaagctggcgaagcccatgcttccattaaggtgaaggtggttgactttcctgacccgcctgtcgcccccacagtgacagaagtgggcgacgactggtgtattatgaattgggaacctcccgcctatgatggagggagccccattttgggttatttcattgagcgaaaaaagaaacagtctagccgctggatgagactaaatttcgacctttgcaaagaaaccactttcgaaccaaaaaaaatgatcgagggcgtcgcatatgaggtgcgcatttttgccgtaaacgcaataggcatctcaaaaccatctatgccttctagaccatttgtacccctggcggtgacctcacctccaacactacttacagttgactccgtgaccgatacgactgtgaccatgcggtggcgacctccagatcatattggtgctgctggcctcgacggatacgtccttgagtactgctttgaaggtaccgaagactggatcgtggcgaataaagatctgatagacaagaccaagtttacaatcactggtctgcccacggacgccaagatcttcgtcagggtgaaagcagtgaacgccgctggagccagcgaaccaaagtactactctcagcccatccttgtgaaagagattatcgaaccacctaaaatcaggatccccagacatctgaagcagacatacatccgtagggtaggggaggcagtgaatctggtaatcccctttcagggcaagccgcggcccgagctgacatggaagaaggatggtgcggaaatcgacaaaaaccagatcaacattaggaactccgaaacggataccataatatttatccgaaaggcggagcgatcgcactccggtaagtacgacctccaggttaaggttgacaagtttgtcgagactgcttccattgacattcagatcattgatcggccaggtccgccgcagatagtgaaaattgaagatgtctggggcgagaatgtggcgttgacctggactccccccaaggacgacgggaacgccgccatcactggctacacgatccagaaggcagataagaaaagcatggaatggttcaccgtcatagaacactaccacagaaccagcgccaccatcaccgagctggtgatcggcaacgagtactactttcgtgtctttagcgaaaacatgtgcgggctttccgaggatgctaccatgacgaaggagtccgcagtaatagccagggacggcaaaatctataaaaaccccgtctatgaagacttcgacttcagtgaggctcctatgtttactcaacctctcgtcaacacctacgctattgcaggctacaatgcaacactcaattgtagcgtgcggggcaatcctaaaccaaaaatcacatggatgaaaaataaagtggctatcgtggatgatcctcgttacaggatgtttagcaaccagggggtgtgcaccctggaaatacggaagccctcaccctacgatgggggcacatactgctgtaaagctgtaaacgatctcggcaccgtagagattgaatgcaagctggaagtgaaggtgatctatcagggtgtgaacaccccaggccagcccgtgtttctggaaggtcagcagcagagtctgcataacaaagacttttag

SEQ ID NO: 125357 - DNA, 3399 bp, Artificial Sequence
  Description of Artificial Sequence: Synthetic coding sequence
atgccagaacccaccaaaaaggaggagaacgaagtccctgcgcctgcccctccacctgaagattggactctggtggagacaccccctggagaggagcaggccaaacaaaacgctaactcccagctctcaatcctctttattgagaagccccagggcggaacggtcaaagttggtgaggacataaccttcatcgctaaggtgaaggccgaggatttactcaggaagccaacaattaagtggtttaagggcaagtggatggatctggctagtaaggctggcaagcatctacagttaaaggagacctttgagcgccattcccgagtgtatacctttgagatgcagatcatcaaagctaaagacaattttgccggaaattatcgctgtgaggtgacgtacaaggataagttcgacagctgttccttcgaccttgaggtgcacgagagtacagggacaacgcccaatatcgatattaggagtgcgttcaagagaagcggcgaaggacaggaggacgctggagagctcgattttagtgggctgctgaaaaggagggaagtgaagcagcaggaggaggaacctcaggttgacgtctgggagcttctcaaaaatgccaagccctcagagtacgaaaagatcgcattccaatatggcataaccgatcttcgggggatgctgaaacgccttaaaaggatgaggcgggaggaaaagaaatcagctgcatttgcgaaaatcctggaccctgcctaccaggttgataaagggggcagggtgaggtttgtcgtggagctggcagacccaaagctggaggtcaaatggtacaaaaatgggcaggaaatacgcccgtctacgaagtatatatttgagcataaaggatgtcagcggatactttttattaataattgccaaatgacagacgactctgaatattacgtgaccgccggggatgagaaatgttctaccgagctctttgtccgtgaacctccgatcatggtgaccaaacagctagaggacacaacagcctactgtggagaacgtgtggaactcgaatgcgaggtctctgaggacgatgctaacgtcaagtggtttaagaacggcgaagagatcatacctggccccaaatcaaggtaccggattagggtagagggcaaaaagcacattttaattattgaaggggcgacgaaggcagatgcagcggaatactcagtgatgactactggcggccagagctccgccaagttgtctgtggacctaaagcctttgaagatccttacccctttgaccgaccaaaccgtgaacctgggcaaagagatctgtttgaagtgtgagatttcggaaaacattcctggcaagtggaccaagaatggtctgccggtgcaggagagtgaccgactcaaggtggtccataaaggaagaatccataagcttgtgattgccaatgccttaaccgaggacgagggcgactacgttttcgcccccgacgcatataatgtcacactccccgcgaaggttcatgtcatagaccctcccaagatcatcttggacggcctggacgccgataataccgtcactgtcattgccgggaacaaacttaggctggaaattcctatatccggcgagccacctcccaaggctatgtggagcagaggtgataaagccattatggagggctcaggtaggatcaggaccgagtcttacccagacagcagcactctcgtgatcgacatagcagaaagggatgactccggtgtgtatcatatcaatttgaagaacgaggccggagaagctcatgctagcattaaggtaaaggtggtggattttccagacccaccagtcgcccccaccgtgactgaggtgggcgacgactggtgtatcatgaactgggaaccccccgcatacgacggagggagccccatcctgggatattttattgaaaggaagaagaagcagtcttctcgttggatgcgcctgaacttcgacctgtgcaaggagacgacgtttgagcctaagaagatgatcgagggagtggcttatgaggtgcgcattttcgctgtgaacgccatcggtatcagcaagccgtccatgccctcaaggccctttgttccactcgccgtgacttcgccgcctaccttgttgaccgtggacagtgtaacagacactacggtgaccatgcgctggcggccgcctgatcacattggagctgctgggttggatggttacgtcctcgagtattgttttgagggcactgaagactggattgtggccaacaaagacctaatcgataagaccaaattcacaatcactggactgcccaccgatgccaaaatttttgtgcgtgtgaaggctgtcaatgccgctggggcctccgaaccaaaatactatagccaacctattctagtcaaagaaatcatagagccccctaagataaggatccctcgacatctcaagcagacctatatccgaagagtgggggaggctgtgaacctcgtgattccatttcaaggcaagccccggcctgagctgacgtggaaaaaggatggggctgaaattgataaaaaccagattaacattagaaacagcgaaactgatacaatcatcttcattcgaaaagccgaaaggtcccattcaggcaagtatgacctgcaagtcaaagttgacaagttcgtcgaaactgcgtccatagatatacagattatagaccggccaggcccgccacagatagtgaagatagaggatgtgtggggagaaaacgttgccctgacttggacgccacctaaggatgatggaaacgccgccatcaccgggtatactatccagaaagccgataagaagtcaatggagtggttcacagtgattgagcactaccatcggacctctgcgacaatcacggagctggttataggtaacgagtattacttccgagttttcagcgaaaacatgtgtggactctccgaggatgcaacgatgactaaagagagtgcagtaattgctagggacggcaagatttacaaaaacccagtgtacgaggattttgatttttccgaggctccgatgttcacacagcctcttgtgaatacatacgctatcgctggctataatgccacgctaaactgtagcgtcaggggtaacccaaagcccaaaatcacctggatgaagaataaggtggccatcgtcgatgacccccgataccgtatgttttcgaaccagggggtgtgtaccctggagatccgcaaaccatccccatacgacggtggcacctactgttgtaaagcagtgaacgacttgggaacagtggaaatcgaatgtaaactggaagtcaaggtgatttaccaaggcgtgaacacaccgggacagcccgtgttccttgaaggccagcagcagtccttacataacaaggatttctag

SEQ ID NO: 125358 - DNA, 3822 bp, Artificial Sequence
  Description of Artificial Sequence: Synthetic coding sequence
atgccagagccaggtaagaaacctgtgtcggccttttcgaagaaacccaggagcgtggaggtggccgccggttctccagctgtgtttgaggccgaaaccgagagagcaggagttaaggtccgatggcaacgaggggggtctgacatcagtgcctctaataagtatgggctggctaccgaagggaccagacatactctgactgtcagggaagtcggccctgcagatcaagggagttacgctgtaatcgctggatcaagtaaggtgaaatttgatctgaaagtgattgaggctgagaaggccgaacctatgttggcccctgcccctgcccctgccgaggccacaggggctcccggcgaggcccctgcccccgccgcagagctgggcgagtctgccccctccccaaagggaagttccagcgcagcactgaacggccccacaccaggcgccccagacgatcctatcggactgtttgtgatgcggccacaagatggcgaggtaactgttggcgggagtatcactttttcagcacgcgttgcgggtgccagtctcctgaaacctcccgtcgtcaaatggttcaagggcaaatgggtcgacctctcctctaaggtgggacaacacctccagcttcatgactcttacgatcgggcttccaaggtgtatctgtttgaacttcacattacagacgcccaaccagcctttacggggtcttacagatgcgaagtttcaactaaggacaaatttgactgctccaactttaatttaactgtgcatgaagcaatgggcaccggagatttggatctcctgagcgcattccgcagaacatccctcgctggaggaggacgacgcattagcgattcccatgaagacacaggcatactggatttcagtagcctgctgaagaagtcctcttcattccgaacaccacgggactccaaactagaagcacccgctgaggaagacgtgtgggagattctgcgacaggccccaccgtccgaatatgaacggatcgcttttcagtatggtgtcactgacttgaggggcatgcttaaacgcctgaaggggatgagacgggatgagaaaaagtccaccgcttttcagaaaaagctggagcccgcctaccaggtgagcaagggccataaaattcggctcaccgtcgagctggccgaccatgatgctgaagtgaagtggctgaaaaatgggcaggagatacagatgagcgggcgctatatattcgaatctataggagccaaacggacccttacgattagtcagtgctcccttgctgatgatgcggcttatcaatgtgtagtagggggcgagaaatgcagcacagagctatttgtaaaagagcctccggtattgattaccagacctctggaagaccaacttgtcatggtgggacagcgcgtggaattcgagtgtgaggtgagcgaggaaggagcgcaggtcaagtggctaaaagacggcgttgaactgactagagaagagaccttcaagtacagattcaagaaggacgggcaacgccatcatttgattatcaacgaagcaatgctggaggacgccggccactacgctctctgtactagcggagggcaggctctggctgagctgatcgtgcaggagaaaaaactagaggtttatcagtccatcgccgacctgatggtgggtgccaaagaccaggccgtgttcaagtgtgaagtgagtgacgagaacgtgcgcggggtgtggctaaagaacggcaaagagctggtgcccgactcgcggatcaaggtctcacatatagggcgagtccataaactgactatagatgatgtgactcctgctgacgaggcggattattcgttcgtccccgaaggattcgcttgtaatctaagcgcaaaactccatttcatggaggtcaagatcgatttcgtgccccggcaagagcctccaaaaattcacctggactgtcccggtagaatcccggatacaatagtcgttgtcgctggaaacaagctgcgtctggacgtgccaatttcaggggacccagctcctactgtcatttggcagaaagccatcacacagggcaacaaagcacccgccagacctgcacccgacgctcctgaggacacgggggactctgatgaatgggtgttcgataaaaagctgctttgtgagaccgaaggtcgtgtcagagtggagaccactaaggatcggagtatcttcaccgttgagggggcagagaaggaggatgaaggtgtttataccgtcacagtgaaaaatcctgtgggtgaggatcaggtgaatttaacagtcaaggtcattgatgtgccagacgcccccgcagcacccaagatctccaatgtgggggaggatagctgcacagtacagtgggaaccaccggcatatgatggtgggcaacctattctgggttacatcctggagagaaaaaaaaagaagtcctacaggtggatgaggttaaatttcgacctcattcaagaactgtcacatgaggcccggaggatgatcgagggcgtggtgtacgagatgagagtgtacgcagtcaacgcgatcggaatgtccagaccttccccggccagccaaccattcatgcccatcggtccacctagcgagccgacgcacctggcggtggaggatgtcagtgatacaacagtgagtctgaagtggcgtccacccgaaagggtgggggccgggggattagatggctattccgttgagtattgtcctgagggctgctctgagtgggtggcagcccttcaggggttaactgagcacaccagcattctggtgaaggatcttccaaccggcgcccggttgttgttccgggtgagagcccacaatatggccgggcccggagcgcctgtcacgactacagagcccgtgactgtgcaggaaatccttcaacgcccacgcctccagttgcccagacacctgcggcaaaccattcagaagaaggttggtgagcccgtgaatctgttgattccgttccagggaaagcctcggccccaggtgacctggacaaaggaggggcagccgttggctggagaagaagtgtccattcgcaatagtcctaccgacactattctgtttattcgcgccgccaggcgcgtgcactccgggacctaccaggttacagtgcggatcgagaatatggaagataaagccacactggtgctacaggtcgtggataaaccgagccctccccaagatctgagagtaaccgacgcttggggactaaacgtggctctggagtggaagccaccccaggacgtgggtaataccgaactctggggttatacggtgcaaaaggcagataagaagactatggagtggttcacagtgctggagcactataggagaacacactgtgtggtgcctgaactgatcatcggaaacgggtactattttagggtgttcagtcagaatatggtcggtttctctgatcgcgctgccacaactaaagaacccgtcttcattccaaggcctggaatcacctatgagccccccaactacaaagcactggacttcagtgaggctcccagcttcacacagcctttggtcaatagatcggtgatcgccggttataccgctatgctttgctgcgctgtgcgggggagccccaagcccaaaatcagctggtttaaaaatggattagatctcggcgaagatgcacggtttcgcatgttctcaaagcagggagtgttgactctcgaaattcgcaaaccctgcccgttcgacgggggcatctacgtctgtcgagcgaccaatctacagggagaagcccgctgtgagtgccggctagaggtgcgagtgcctcagtag

SEQ ID NO: 125359 - DNA, 3825 bp, Artificial Sequence
  Description of Artificial Sequence: Synthetic coding sequence
atgccagagcctggcaaaaagcctgtttccgcattctcaaagaaaccaaggtcagttgaggtagctgccggctctccagccgtattcgaggccgagactgagcgcgctggagtcaaagtgaggtggcagagaggcggcagtgacatctccgcctccaacaagtacggcctcgcgacagaaggcactaggcatacgcttaccgttagggaagttggacccgcagaccagggtagctatgcagtgatcgccggaagctccaaagttaagttcgacttaaaagtcatcgaggccgaaaaggccgaacccatgctcgcacccgccccagccccggctgaagccaccggagcccctggtgaagcacctgcccctgctgctgagctgggagagtcagcaccctcccctaaagggtcttcctctgccgcccttaacggccctacaccaggagccccagacgaccccatcggacttttcgttatgagaccgcaggacggcgaagtcaccgtgggagggagcatcacattttctgctcgggtggctggagcgagtctgctaaaacccccggtggtcaagtggtttaaaggcaaatgggttgatctcagctccaaagtgggtcagcacttgcagctgcacgatagctacgatagggcctcaaaggtgtacctgttcgaacttcacatcacagatgcgcagcccgctttcacaggctcttacagatgtgaggtttcaaccaaggataaatttgattgcagtaatttcaacctcacggtgcatgaggctatgggtaccggtgatttagaccttctgtcagccttccgccgaacaagtctcgccggaggaggcagacgcatttctgactcacatgaggacacgggtatcttggacttctctagcttgctgaagaaatcatcctcttttcggacaccacgagactcaaaactggaagctcctgccgaggaagacgtctgggagatccttcgacaagcccctcctagcgaatatgagaggatcgcctttcaatacggtgtcaccgatcttagaggtatgctcaaacgccttaagggcatgcgaagagacgagaagaaatctacagcatttcagaagaagctggagcctgcttaccaggtttctaagggccataaaatcaggctcactgtggagttggccgaccacgatgccgaggtcaagtggctgaaaaacggtcaggaaatccagatgtccggtagtaagtacatcttcgagagtatcggggcgaaaagaacactgacaatttcacaatgttctctcgccgacgatgcggcataccagtgcgtcgtcgggggagaaaagtgtagtacggagctgtttgttaaagaaccacctgtgctgatcaccaggcctctggaagaccagctagtgatggtcggccaacgcgtggaattcgagtgtgaggtgtctgaggaaggcgcgcaggtgaagtggctgaaggatggggtcgaactgactcgggaggagacatttaagtatcggttcaaaaaggatggacagcggcaccaccttattatcaatgaagcaatgctggaggatgctggccactatgccctctgcacgtccggcggccaggctctggctgagctgattgtccaagaaaagaaattagaagtgtatcagagtattgcagaccttatggtcggcgctaaagaccaagccgtgttcaaatgtgaggtttctgacgagaacgtgcggggggtttggctcaaaaatgggaaggagttggtgcctgatagtaggattaaggtgagccatattggccgcgtgcataaattgacaattgatgacgtgactccggccgacgaagctgattactcctttgtcccagaaggattcgcctgtaatctgtctgcaaagcttcactttatggaggtgaagatcgacttcgtgccccgacaggagcccccaaaaatccacctcgattgcccgggtcgaattccagatactattgtggtggtggctggcaataaactgcgcttggatgtaccaataagtggtgatcctgcccctacagttatctggcaaaaggccatcacgcagggcaataaagcccctgctcggccggctccagacgcccccgaagatacaggagactctgacgaatgggtctttgataagaagctcctctgcgaaacagagggccgagtgcgtgtcgaaactactaaagatagatccatatttaccgtggagggtgctgaaaaagaagatgaaggagtttacacagtgactgtgaaaaaccccgttggggaggatcaggtgaatttaaccgttaaggtgattgacgtgcctgacgccccggccgcgccgaagatcagcaacgtcggagaggacagctgcacagtacaatgggaacctcccgcttacgatggcggacagcccattttgggctatattttagaacgcaagaagaagaagagctaccggtggatgcggttaaattttgatctcatccaggagctctcacatgaagccagaagaatgatcgaaggagtcgtgtatgagatgagagtctacgccgtgaatgccattgggatgtccagaccttcacccgctagccagccctttatgcctatcggtcctccatccgagcccacacacctcgctgttgaggacgtttcggatacaacagtttcgctgaaatggcgccctcccgagagggtgggagccggcgggttagacggatattcagtagagtattgccctgagggctgctcagaatgggtggcggcactgcagggactgacagagcacacctctatccttgtcaaggacctgccaactggcgcccggctcttgttcagagtgagagcgcacaatatggccggtccaggggccccagtcaccacgaccgagcccgtcaccgttcaagagatcctgcagagaccaaggcttcagttgccacgtcacctccggcagaccatccagaaaaaagttggagagccagtgaacctcttaatcccattccaggggaagcctaggccacaggtcacttggacaaaagaaggccagcccttggcgggcgaggaagtttcgatcagaaacagtcctaccgacactatactctttattcgggcagctcgcagagtccactctggcacttaccaggtgactgtcaggattgagaacatggaagacaaagcaaccctggtcctccaggtggtcgataagcctagtcctccccaggacctgcgggtgaccgacgcatggggcctgaatgttgcattagagtggaaaccacctcaggacgtgggtaacaccgagctctggggctataccgtgcagaaggccgacaagaagacaatggaatggtttacagtcctggaacactacaggcggacccactgcgtggtgcccgaactgattatcggaaacgggtattatttcagagtattctctcagaatatggtaggtttctccgaccgcgcagcaaccaccaaagagcctgtattcataccccggccaggcatcacctacgaaccccccaattataaggccctcgatttttctgaggctccatcttttacccaacctctggttaaccgctccgtgatcgccggctatacagctatgctgtgctgcgctgtgagaggctcaccaaaacctaaaatatcctggttcaagaatggtttggatctgggggaagacgcccgctttaggatgttttcaaagcaaggagttttgaccctcgagatacggaaaccgtgtcccttcgacggaggaatctacgtctgccgcgcaaccaatctgcaaggtgaagcccgatgcgagtgtcgactcgaggtccgagttccacagtag

SEQ ID NO: 125360 - DNA, 3825 bp, Artificial Sequence
  Description of Artificial Sequence: Synthetic coding sequence
atgcccgagcccggaaagaagcctgtctcagccttctcaaaaaaaccacggtcagtggaagtagccgctgggtcaccagccgtattcgaagccgaaacggagagagctggggtgaaggttcgctggcaacgaggagggtcagacataagcgcctcgaataaatacggtctggcaacggagggcacacgtcatacccttactgtccgtgaggtgggcccagccgaccaggggtcttatgccgtgatagctgggtcctcaaaagtcaagtttgacctgaaggtgatcgaggcagaaaaagccgagcctatgcttgctcctgcccccgctcctgctgaggccactggggccccgggtgaagcccctgcgcccgctgcagagctgggagaatctgcacccagccctaaaggtagcagcagtgccgctttgaatgggccgactcccggagccccggacgatccaattggactctttgtcatgcgccctcaggacggagaagtgacagtgggcggatctatcacattcagcgcccgcgttgcaggggctagccttcttaaacctcccgtagtgaaatggtttaagggaaagtgggttgacctaagctccaaggtaggccagcacctgcagctgcatgatagctacgaccgcgcttctaaagtatatctgtttgaactgcatattacagatgcccagcccgccttcacaggcagctaccggtgcgaggtgagtacaaaagataaattcgactgttcaaatttcaatctaactgtacacgaggccatgggcacaggtgacctggatctgctgtctgccttccggcgcacttccttggccggcggaggcaggagaatctctgattcccatgaggatacagggattctggatttctcatccctgctgaagaaaagggatagcttcagaactcctcgcgacagcaaattggaggctcctgccgaggaggacgtctgggagatcctgaggcaggctccacccagcgaatacgagcgtattgcctttcagtacggagtgaccgaccttcggggtatgcttaagcgactcaagggtatgcggcgtgatgaaaagaaatctactgcctttcagaaaaagctggagcctgcttaccaggtatcaaagggccacaagattaggctgactgtcgagcttgctgaccacgacgccgaggtgaagtggctcaaaaatggccaggaaatccagatgtccggcagcaagtatatattcgaatctataggagcaaagcggaccctgaccatctcccagtgttcactggccgacgatgccgcttatcagtgcgtcgtcggaggtgagaagtgtagtaccgagctctttgtgaaggagcctcccgttctgatcacacgtcctcttgaggatcaactggtaatggtgggacagagggtggagttcgagtgtgaagtgagtgaagaaggggctcaggttaagtggctgaaagatggcgtggagctgacccgggaagaaacttttaagtatcggttcaaaaaggatgggcaacgccatcacctgataattaatgaagctatgctggaggacgcagggcactacgctttatgcaccagcggcgggcaagctttagctgaactgattgtccaagaaaaaaagctggaagtctatcaaagtatcgctgaccttatggtaggagcgaaagaccaggctgtcttcaaatgtgaggtgtcggacgagaatgtgaggggtgtctggctgaaaaacggaaaggagctggtgcctgactccaggattaaggtgtcgcatatcggtcgcgtacacaagctgactatcgacgatgtgaccccagctgacgaggctgactatagcttcgtacccgaagggttcgcttgcaacctgtctgctaagctgcatttcatggaggttaagatcgacttcgtgccaaggcaagaacctcctaaaattcacctcgattgtccaggcaggattccggataccattgtggtggttgccggcaataagttgcgcttggatgttccaatcagtggagacccggcccctacagtgatctggcaaaaagctataacgcagggcaacaaagcacccgcacggccagcgcccgacgcccctgaagatacaggcgactcggacgaatgggtcttcgataagaagttgctgtgcgaaactgagggcagagtgagggtggagaccacgaaagataggagcatctttacggtggagggcgcggagaaagaggacgagggagtgtacactgtgacggttaagaaccccgtgggtgaggaccaggtgaacctcaccgtgaaagtgatcgatgtgccggacgcccccgctgcccccaagattagcaacgtcggcgaagactcatgtactgtgcagtgggaacctccagcctacgatggaggccagccaatcctggggtacattttggagcgcaaaaaaaaaaagtcctatcggtggatgcggctcaatttcgatcttatccaggagctttcccatgaagcaagaaggatgattgagggggtcgtctacgagatgcgggtgtatgccgtgaatgcgatcggaatgtcccgaccctctcccgcatctcagccttttatgccgatcggcccaccctctgaacccacccacctggccgtggaagatgtgagtgatacaacggtatccctcaagtggcggccccctgaacgtgtcggtgctggagggctggacggatatagcgtggaatactgccccgagggatgctcagagtgggttgccgctttgcagggccttacagagcacactagtatcttggtgaaggacttgcccacaggggctagattactgttcagggtgagagcacacaacatggcggggccgggcgctccagtgacgaccacagagcccgtaactgttcaggagattctacagcgaccccgcctccagttaccgcggcatctgcggcagacaatacagaagaaggtcggagagccagtgaacctgctgatcccctttcagggcaagccaagaccgcaggtcacatggactaaggagggtcagccactggccggcgaggaggtcagtattcggaatagcccaacggacactatattgtttatccgggctgcacgtcgcgttcacagcggcacctatcaagtgacggttaggattgaaaatatggaggataaggccacccttgtgcttcaggttgtggataaaccttcgcccccacaggacctgcgcgtgactgatgcttggggcctgaatgtagccctggaatggaagccgccccaggacgttggaaacacggaactctggggttatactgtgcaaaaggctgataagaagacgatggagtggttcacggtcctggagcactaccggcggacgcattgcgtcgtgccagagttgattatcggtaacggctactacttcagggtctttagccagaacatggtaggatttagtgacagggcagctacaactaaagaaccagtcttcattccgcgccccgggattacttatgagccgccaaattataaggcactggacttttcggaggccccttctttcactcaacctctggtgaatcggagcgtgatcgctggttatacagcaatgctttgctgtgccgtgcgcggctctccaaagcctaagatttcttggttcaaaaacggtttagacctaggagaggatgcaagattcaggatgttttccaagcagggagtgctgacactcgagataaggaaaccgtgtcctttcgacggagggatttacgtgtgtcgagcaactaacctgcagggagaagctcgctgcgagtgccgactggaagtaagagtgcctcagtag

SEQ ID NO: 125361 - DNA, 3426 bp, Artificial Sequence
  Description of Artificial Sequence: Synthetic coding sequence
atgccagaggccaagcccgctgcaaaaaaggcacctaaaggcaaagatgcgcctaagggagcaccaaaggaagccccccccaaagaggcgcccgccgaggccccaaaagaagcacccccggaagatcaaagtcccaccgccgaagagcctacaggcgtgtttcttaaaaaacctgacagtgtgtctgtggagactgggaaggatgcagttgtggtggctaaggttaatggcaaggagctgcctgataagccaactattaagtggttcaagggaaaatggctggagctaggatctaagagcggggccagattttcgttcaaggagtcacacaactcggcgtcaaatgtttacaccgttgaactgcacataggcaaagtggtgctcggcgatagaggttactatcgccttgaggtgaaagcaaaggatacttgtgattcctgcggctttaacatcgacgtggaggcgccacgccaggatgcctccggccagagtctggaatccttcaagcggacatccgagaaaaagagtgacaccgctggcgaattggatttcagtggtctcctgaaaaaacgagaagtcgtcgaggaggagaagaagaagaagaagaaggatgatgatgacctgggtatccctcccgaaatctgggaactgctgaaaggagcaaagaagtccgagtacgagaaaattgctttccaatatggaattaccgacctgcgaggcatgctcaaacgcctaaagaaggcaaaggtagaagtcaagaaaagcgctgccttcactaagaagttggaccccgcctaccaggtggacagaggaaataagatcaaactgatggtggagatttcggaccccgatctgactctgaaatggtttaagaacggccaggagattaaaccatcttccaagtatgtgtttgaaaacgtggggaagaaaaggatcctcacaattaacaagtgcaccctggccgacgacgccgcttatgaagtcgcagtcaaagatgaaaagtgcttcactgagctcttcgtaaaagagccccctgtcctgattgttactcccctggaggaccaacaggtcttcgtgggcgatcgggtagagatggctgtagaggtgtcagaggagggggcccaagtgatgtggatgaaggacggcgtagagctcacccgcgaagactcattcaaggccaggtaccggttcaagaaggatgggaagagacacatcctcatatttagtgatgtggtccaagaggatagaggacggtaccaggttatcaccaacggcggccagtgtgaggctgaactgatagtggaggagaagcagctggaggtgctccaggatattgcagatttgactgtgaaggccagcgagcaggccgtgttcaagtgtgaggtttccgacgagaaagtcacaggcaaatggtacaaaaacggcgtggaagtgcgaccctcaaaacgcattaccatctcccacgtcggaagatttcacaagctggtaatcgacgacgtccgccctgaggacgagggagactatacgtttgtccctgacggatacgctttgagtttaagcgcaaagctcaatttcctcgaaataaaggttgaatatgtgcctaagcaggagcctcctaaaatccacctggattgttcggggaaaacgtccgaaaatgccattgtggtggtcgcaggcaacaaactgaggctggacgttagtatcaccggagagcctccccccgtggccacatggctgaagggcgacgaagtattcaccaccacggagggacgcactcgcatcgaaaagcgtgtggactgcagcagctttgtgatcgagagcgcgcagagggaggacgaaggccgctacacaattaaggtcaccaaccccgtaggcgaagatgtggcctccatattcctccaagtcgtggatgtgcccgacccgcctgaggcagtgcgcattacaagcgtcggcgaggattgggctattctagtctgggaacctcctatgtacgatgggggtaagcccgtgaccggctacctggtcgaaagaaaaaagaaaggatcacagcgatggatgaaactgaactttgaggtctttacagaaacaacctatgagtccactaaaatgattgaagggatcctctatgagatgagagtctttgccgttaacgccatcggggtgtcacaaccatccatgaacacgaaaccatttatgccgattgccccaactagtgagccactccacctaattgttgaagacgtaactgatacaacaaccacattgaaatggaggccacccaatagaatcggggcgggggggatcgacgggtatctggtggaatattgcctggaagggtccgaggaatgggtgcctgccaacaccgagcctgtagaaaggtgcggtttcaccgtgaagaatctgcctacaggggccagaatcctgtttcgtgtggtgggagtgaatatcgctggcagatccgaacctgccacactggcgcagccagttacgattagggagatcgctgagcccccgaagatccggctgccccgccatttgagacagacctacatcaggaaagtcggcgagcagctcaacctagtcgtgcctttccagggcaagccacgacctcaggtcgtgtggactaaaggcggagctcctctcgatacaagccgtgtgcatgttcgaacgtctgattttgacacagtgttctttgttaggcaggccgccagaagcgatagtggggaatacgagctctccgtgcagatcgagaatatgaaggatactgccacaattcgaatccgggtagttgagaaagccggccctccaatcaatgtgatggtcaaggaagtgtggggtaccaatgctttggtggagtggcaggcccccaaagatgatggaaactctgaaattatgggctactttgtgcagaaggcagacaagaagaccatggagtggtttaatgtttatgagaggaataggcacacctcatgcaccgtgtctgacctgattgtggggaatgagtattatttccgagtgtacacggagaacatctgcggacttagtgactctcctggggtgtctaaaaacaccgcgcgaattctaaaaaccgggattactttcaaaccctttgagtataaggaacacgatttcagaatggcccctaaatttctcactccattgattgaccgggtcgttgttgctgggtactcggcagccctcaactgtgctgttcggggtcaccccaaacccaaggttgtgtggatgaaaaataaaatggaaattcgcgaggacccaaagttcctgattacaaattaccagggcgttcttacactcaatatcagaaggccaagtccattcgacgccggtacttacacctgccgggcagtaaacgagcttggagaagctctggccgagtgcaaacttgaagtgcgcgtcccccagtag

SEQ ID NO: 125362 - DNA, 3426 bp, Artificial Sequence
  Description of Artificial Sequence: Synthetic coding sequence
atgccagagcctactaaaaaagaagagaatgaggtgcctgcaccagcacccccccctgaggagccatctaaggagaaagaggcgggcacgactccagctaaggactggaccctcgtggaaactcctcctggtgaggagcaggctaaacagaacgccaattctcaactgtctatattgttcatcgagaagcctcagggcggcacagtcaaagtaggcgaagatataacttttatcgcaaaggtgaaggccgaggacctgttgagaaagcccaccataaagtggttcaaaggcaagtggatggacttagcgtcaaaagcaggcaagcacctgcaattgaaggaaacttttgagcgccattctagggtgtacactttcgagatgcagattatcaaagcaaaagataatttcgctggcaattatcgctgtgaggtgacgtataaagataaattcgacagttgttcttttgatctggaagttcacgagagtaccggaacgacaccaaacatagacataaggtccgcctttaaacgcagcggagagggtcaagaagacgccggggaactagacttcagtggtctactgaagcgtcgagaagtcaagcagcaggaagaggagccccaggtggacgtgtgggaacttctgaagaacgccaaaccttccgagtatgagaaaatcgcgtttcagtatgggattacagatctcaggggcatgctcaaaaggctgaagcgaatgcgcagggaggagaaaaaatcagctgcattcgctaagatcctggacccagcttatcaggtggataagggtggccgggtccgattcgttgtagagcttgccgaccccaagctggaagtcaagtggtacaagaacgggcaggagattcgtccaagtaccaagtatatcttcgaacataaagggtgccaaaggattcttttcattaacaattgtcagatgacagacgacagtgaatattacgtaacggccggggatgagaaatgcagcactgagttattcgtgagggagcccccaatcatggtgacaaaacagttagaggacactaccgcgtattgcggtgagagagtcgagctcgagtgcgaggtgtcagaagacgacgctaacgttaaatggttcaaaaacggcgaggagataattcccggccccaaatccaggtatcgtattagagtggaagggaaaaagcatattctgattatagagggtgcaactaaggccgatgctgcagaatactcggtcatgactaccggaggccagagctcagccaaactgtctgtggacttaaagccattgaagatactgacccctctgacagaccaaacagtgaatctggggaaggagatatgcctgaaatgcgaaatttcggagaacattcccggtaaatggaccaaaaacggactgcccgtgcaagaaagtgatcgactgaaagtggtgcacaagggtcgtattcataagctcgtgatagccaacgccctcactgaggacgaaggcgactacgtcttcgctcccgacgcatataatgtcactttaccagccaaggttcatgtaatcgacccacctaagattattctggatggcctagacgccgataacacggtaactgtgatcgccgggaacaaattgcggctcgagatcccaatcagtggggaaccacctcctaaggcaatgtggagcaggggggataaagccataatggagggaagcggtcgtatccgcactgagtcctacccggatagctctacattagtaatcgatattgcagaaagagatgacagcggggtataccacattaacctaaaaaatgaagctggcgaagcccacgcttccattaaggtcaaagtggtggacttcccggatcctcccgtggccccaactgttactgaggtgggagatgactggtgcattatgaattgggaacccccggcctacgatgggggatcccccattctgggatactttatcgaacgaaaaaagaaacagagctcaaggtggatgaggcttaacttcgacctctgcaaagaaacaacattcgaacctaaaaagatgatagaaggtgtggcttatgaggtacgcatattcgcagtgaacgccattgggatctcaaagccttctatgcccagccgaccttttgttcctctagccgtgacatcccctccaaccctgttaacagtcgattcagtgacagacacaaccgtcacaatgaggtggcgtccacccgaccatatcggggccgccggactggatggttacgtgctggaatactgctttgaaggtagcacttcagctaagcagtctgatgagaatggtgaggctgcatacgacctgccagcagaggattggatcgtcgcgaataaggatttgatcgacaagactaagtttacaatcaccgggctcccaacagacgcaaaaatttttgtcagggtcaaggctgtgaatgccgccggtgcttctgagccgaagtactacagtcagcccatacttgtgaaggagataattgaacctccaaagatcagaatcccgcgacaccttaaacagacttacattagaagagtcggagaagcagttaacctcgtgatacctttccagggcaaacctcgccctgagcttacttggaagaaagatggagcagagattgataagaaccaaattaacatcagaaactccgagaccgacacaatcatctttatccggaaggccgagcggtcccattccgggaaatatgatcttcaggtgaaggtggacaaattcgtcgaaaccgcctccatcgatatccagattattgaccggcctgggccccctcagatcgtcaaaatcgaagacgtgtggggcgaaaatgtcgccttgacttggacccctccaaaagacgacggaaacgcagctattaccggatacaccatacagaaggcggataagaaaagtatggagtggtttactgttattgaacactaccaccggacctcagccacaattactgaactggtaataggtaatgagtattactttcgcgtcttctctgagaacatgtgcgggttgtccgaagacgctacaatgacgaaagagtctgccgttatcgcgcgagatgggaagatttataaaaacccagtctatgaggacttcgatttttctgaggcgcctatgtttacacagcctctggtgaatacttacgctatcgcaggttataacgcaactctgaactgtagtgtgaggggtaatccaaaacctaagattacctggatgaaaaacaaggtcgccatagtggatgacccccgttacaggatgttctccaaccagggagtgtgcactctcgagattagaaaaccttccccatacgacggaggtacatattgctgtaaggcggtgaacgatctgggcacggtggaaatcgaatgcaagcttgaggtgaaggtgattgcccaatag

SEQ ID NO: 125363 - DNA, 3516 bp, Artificial Sequence
  Description of Artificial Sequence: Synthetic coding sequence
atgcccgaacctacaaaaaaggaagagaatgaggttccagcaccggccccacccccagaagagcctagcaaggaaaaggaagccggaacaacacccgcaaaggatgaagaggaagtttcacctccgtctgcccttcctccaggtctgggctctagagctctggaaaggaaagacagcgattggacactcgtggaaacccctcccggcgaggaacaggcaaagcagaatgccaacagccagctgagcatcctgtttatagagaagcctcagggggggacggtgaaggttggcgaagatattacattcatcgccaaggtcaaggccgaggatttgctgcggaagcccaccatcaagtggttcaaagggaagtggatggacctggcctccaaagcaggtaagcatctgcagctgaaggaaacgttcgagagacacagccgcgtatacacctttgagatgcaaataattaaagctaaagataattttgcaggcaattatagatgtgaggtgacttataaggacaaattcgacagctgcagctttgacctcgaagtgcatgaaagcacaggcaccacgcccaatatcgatattcgaagcgctttcaagagatctggagaaggacaggaagacgctggagagctggatttctccggcctgttgaaacgcagagaggtaaaacagcaggaggaagagccacaggtggacgtgtgggagctgttaaaaaacgccaaaccatccgagtacgaaaagattgcctttcagtatgggattacagatttacgcggtatgctgaagagactgaagcggatgaggcgagaggaaaagaaaagcgcggcatttgccaagattctcgaccctgcctatcaggtcgataaggggggcagggtgcggttcgtagtagaactcgcggacccaaagctcgaggttaagtggtataagaacgggcaggagatcagaccgtctactaaatatatatttgagcacaaaggatgtcagcgaatcctgtttatcaataattgccaaatgacggacgactccgagtattatgttacagccggcgacgagaagtgttcaacggaactgtttgtcagagagcctccgatcatggtgacgaaacagcttgaagatactacagcttactgcggggagagagtggagctggaatgcgaggtgagtgaggatgatgccaacgtgaaatggttcaaaaatggagaggaaattatcccagggcctaagtcaagatacaggattagggttgaggggaaaaagcacatcctgataatagaaggcgcaacgaaagcagacgccgccgaatattccgttatgaccactggaggacaatcttctgctaagctgtcggtcgatctcaagccactgaaaatcctaaccccactcaccgatcagacagtgaacctgggaaaagagatttgcctaaagtgcgaaatcagtgagaatatccccggcaaatggaccaaaaacggactcccagtccaggagtctgaccgactcaaggtcgtgcacaaaggaaggattcataagttggtgatcgctaatgccttaacggaggatgagggggattacgtgtttgctcctgatgcctataacgttaccctcccagcaaaagttcacgtgattgatccccccaagataatcctagacgggctggatgcagataataccgtcacggtgattgcagggaataaactgcggctggagatccccatctccggggaacctccacctaaggccatgtggtcacgcggagacaaggcaatcatggaagggtccggaaggatcaggacggaatcctaccccgatagtagtacattagtgattgatatcgccgagcgagatgatagtggcgtgtatcacatcaacctgaagaatgaagcgggcgaggcccatgccagcatcaaggtgaaggtggtcgatttccccgatcctcctgtcgcgccaaccgtaaccgaagtaggcgatgattggtgcatcatgaactgggagccgcccgcttacgacgggggcagtcctatcctgggctactttattgagcgtaagaaaaagcagagcagcaggtggatgcgtttaaatttcgatctctgcaaagaaaccacgttcgagcccaaaaaaatgattgaaggagtggcttacgaagttagaatttttgctgtgaacgccatcgggatcagcaagcccagcatgcccagccggccattcgtgccactggccgtgacatctccaccaacacttctgacagttgactctgttactgacactaccgtgacaatgcggtggaggccacccgatcacatcggtgccgctggattggatgggtacgtcttagaatactgttttgaaggaacagaggattggatagtggcaaataaagacctgattgataaaacgaaattcaccataacagggctgcccactgacgctaaaatatttgtgcgcgtgaaagcagtgaacgccgccggcgcgagcgagcctaagtactacagtcagcccattttagtcaaggagattatagagcctcctaagatcagaattcccagacatctcaagcagacatacattcgccgggtaggagaagctgtcaacctggttattcccttccagggaaagcctcgaccggaactgacatggaagaaggatggcgccgagattgacaaaaaccagatcaacattagaaactctgagacagataccatcatttttattaggaaagcagagcgctcacattcgggaaaatatgatctgcaggtcaaggtggacaagtttgttgaaacagcctccatcgatatccagatcattgatcgcccagggccgcctcagatcgtcaaaattgaggacgtctggggggagaatgttgcactgacctggactcctcctaaggacgatggaaacgccgctatcaccggctacacaatccaaaaggccgacaagaaatcaatggaatggtttacggtaatagagcattaccatcggacgtctgccacgatcaccgagttagttattgggaatgagtactactttagggtgttcagcgaaaacatgtgcggactttctgaagacgccaccatgaccaaagaatctgcggtcatagctagggatgggaagatatacaagaacccagtatatgaggattttgatttctctgaggccccaatgttcacacagcccctggttaacacatacgcaattgccggctacaatgctacattgaactgtagtgtgcgcggcaaccccaaacccaagataacatggatgaaaaataaggttgccatcgtggatgatccccgctacagaatgttctctaatcagggggtgtgcaccctggagattcggaagccctctccctatgacgggggaacatactgttgcaaagccgttaatgacctcgggaccgtggagattgagtgcaagctagaggttaaggtcatatatcagggcgtgaacacaccggggcagccagtttttctcgaaggacagcagcagtctttgcacaacaaagatttctag

SEQ ID NO: 125364 - DNA, 3447 bp, Artificial Sequence
  Description of Artificial Sequence: Synthetic coding sequence
atgccagaacccaccaagaaggaagaaaatgaagtgcccgctcccgcaccaccgcctgaggagccctcaaaggagaaagaagccggaacaacccccgctaaagatgaggaggaggtttcccctccctcagcactgccacccggcctgggcagtcgggcactagagaggaaggatagcgactggacgctagtggagactccccccggagaagagcaggccaaacagaacgctaacagtcaactttcaatcttgtttattgagaagccccaaggcgggacggttaaggtgggggaggacatcacatttatcgcgaaagttaaggccgaagacctgctgaggaagcccacaattaagtggttcaaaggaaaatggatggatttggcttccaaagctggcaagcacctgcaactgaaagagacatttgaacggcacagcagagtttatacatttgaaatgcaaatcattaaggccaaggacaactttgccggcaattataggtgcgaagttacttacaaagacaaatttgactcctgtagcttcgacctagaagtgcacgagagcaccggtactacgcctaatattgacattagatccgctttcaaaaggtccggcgagggccaggaggatgctggagagctagacttttcaggccttctgaaaaggcgggaggttaaacagcaagaagaagaaccacaggtggacgtgtgggagttgctgaagaatgccaagccatctgaatacgaaaaaatagcgtttcagtacggcatcactgatctacggggcatgctcaagaggctgaagagaatgcgcagagaggagaagaagtctgcagcattcgccaaaattctggatcccgcctatcaagtcgacaagggcggacgtgttcgctttgtcgtggagctcgccgaccccaagctggaggtcaaatggtacaagaatggccaggagattcgaccgtccactaagtacatttttgagcataagggctgtcaaagaattttattcatcaacaactgtcagatgacagacgattctgagtactacgtgactgctggcgacgagaagtgctcaacagagttgttcgtgagagaacctccgatcatggtgaccaagcaactggaggataccacggcctattgtggcgagcgcgtcgaactggaatgcgaggtctccgaggatgacgccaatgtcaagtggttcaaaaacggcgaggaaatcatcccaggccctaaatcacgttatcgcatacgagtggagggcaaaaagcacatcctcatcatcgagggcgccacaaaggccgacgcagctgagtacagcgtaatgacaactggcggtcagagctccgcgaaactgagtgtggaccttaagcccctgaaaatcctcacacctctgacagaccaaacagtcaatctgggcaaggagatttgtctgaagtgtgagatctccgagaatatacccggcaagtggactaagaacggacttccagttcaggagtcggacaggctgaaggtcgtgcacaaaggacggatacataagctcgtgattgccaacgctctcacggaagatgaaggtgattacgtgttcgcgcctgacgcatacaacgtcactctgcccgccaaggtacatgtaatcgacccgcctaagatcatactggacggtctagatgccgacaacacagtaactgtgattgccggcaacaaactgcgcctggaaattcctatctccggtgagccaccaccaaaggctatgtggtccagaggtgacaaagccatcatggagggaagtggacgtatcaggaccgagtcatatcctgacagttcgaccctggttatagacattgccgaaagagacgattctggtgtgtatcatattaacctgaaaaacgaagctggggaagcccacgcctctatcaaagtaaaagtggtggacttcccagaccctcccgtagcgccaacagttacagaggtgggcgatgattggtgtatcatgaactgggaacctcccgcctatgacggggggtcacccattctcggctacttcattgaaaggaagaagaagcagagttcacggtggatgcgcctcaactttgatctgtgtaaagagacaaccttcgagccaaaaaaaatgattgagggggtggcctacgaggtacgcatctttgccgtaaacgctataggcatatctaagccgtccatgccatcaagaccctttgtaccactggcagtgaccagccccccgacactgctaacggttgactccgtgacagacacgaccgtgacgatgaggtggagacccccagaccacatcggcgccgcaggcctcgatggttatgtgctggagtattgcttcgagggcactgaagattggatagtggccaacaaggacctgattgataagaccaagttcacgatcacaggcttgcccaccgacgcgaaaatttttgtgcgtgtaaaggccgttaacgccgctggagctagcgagcctaaatattacagccaacctatactggtgaaagagataatcgagcccccaaagattcgtataccccgtcatctcaaacaaacttatatcaggcgcgttggcgaggctgtaaatttggttatcccctttcagggaaagcccagaccagagctgacctggaagaaggacggagcggaaatagacaaaaatcagatcaatatccgtaacagtgagaccgataccattatctttatccgcaaagctgaacgctcccacagcgggaaatacgacctccaggttaaagtggacaaattcgtggagacagctagcatagacattcagataatcgacagaccggggccaccccaaatcgtaaagattgaggacgtgtggggggagaacgtcgccctgacgtggactccacccaaggatgacggcaatgctgcgattaccggatataccatccagaaggccgacaagaaatcgatggagtggtttacagttattgaacattaccacaggacttccgcaaccatcacggaacttgtcatcggcaacgagtactactttagggtcttctcggagaatatgtgcggactgtccgaagacgcaacaatgacaaaagagtctgccgtaattgcaagggacggcaaaatttataagaaccccgtgtacgaggatttcgactttagcgaggcccccatgtttacgcagcctctggtgaacacttacgccatcgctggctacaacgctaccctgaactgcagcgttcgtggtaacccgaagcccaagatcacttggatgaagaataaagtggcaatcgtggacgatcctcggtataggatgttcagtaaccaaggagtgtgcaccctcgaaattcgaaagcccagtccctatgacggcggcacatactgttgcaaagccgttaatgatctgggaacggtcgaaatcgaatgtaagttggaggtgaaggtgatagcacaatag

SEQ ID NO: 125365 - DNA, 3495 bp, Artificial Sequence
  Description of Artificial Sequence: Synthetic coding sequence
atgcctgagccaaccaagaaggaggagaatgaagtgccagcccctgccccaccccctgaggaacccagcaaggaaaaggaggcagggacgactcctgccaaggactggacattggtggaaacacctcccggtgaggaacaggccaaacaaaatgctaactcacaactctccattctgttcattgagaagccccagggcggaaccgtgaaggtgggcgaagacatcaccttcattgcgaaggtaaaagcggaagatctgttacggaaacccacaattaaatggttcaaggggaaatggatggatctcgcaagcaaagctggcaagcacctacagttgaaggagacctttgagcgccactcgagggtgtacacatttgagatgcaaattatcaaggcgaaggataactttgccggtaactaccgctgcgaggtgacctataaagacaaatttgacagttgctcctttgacctagaagtccacgagagcaccggtaccacacccaacatcgatattaggtctgcttttaagcggtcaggagagggacaagaggatgcgggcgagttagacttctcagggctcttgaaacgacgtgaggtgaagcagcaggaggaggaacctcaagtggatgtctgggagctgctcaagaatgccaaaccgtcagagtatgaaaaaatcgccttccaatacggaatcaccgatcttcggggcatgttaaaacgcctcaagaggatgcggcgggaagagaaaaagagtgcagccttcgctaagattcttgatcccgcgtaccaagtcgataaaggaggaagagtccgatttgtggtagaactggcggacccaaagctagaggtgaagtggtacaagaatggccaggagattagaccgagtaccaaatatatatttgagcataagggctgccaaagaattctgttcattaacaactgccagatgactgacgatagtgaatactacgtcacagcaggggacgaaaaatgttcaaccgaactctttgtgcgggagcccccaatcatggtgacaaagcagctggaggatactacggcctattgtggggaaagggtcgagctggagtgcgaggtgtccgaggatgacgcaaacgtcaagtggtttaagaacggcgaggagattatacctggccccaaaagcaggtatagaatccgggtggagggtaagaagcacatattgattatcgagggtgccacaaaagccgacgccgcagaatacagtgttatgaccaccggcggccagtccagtgcgaagctaagcgtcgatctcaaaccccttaagattctgacgcccctcactgaccagaccgtgaatcttggcaaggagatctgcctgaagtgtgagatatccgaaaacatccctgggaagtggaccaagaatgggctacccgtccaggagtccgacagattaaaggtcgtgcacaaaggccgcatccataagctggtaatcgcaaacgccttgacagaggatgagggggactatgtgtttgctcctgacgcctataacgttaccctcccagctaaagttcatgttatcgatcccccaaaaataatactcgatggcctggatgccgacaataccgtcaccgtcatcgccgggaataagctgcggcttgagatccctatttcgggcgagcccccaccaaaagccatgtggagcagaggagataaggcgatcatggaaggtagcggtcgaataagaactgagtcttaccctgacagttccacactagtgatcgacatagcggagcgagatgattccggcgtgtaccatatcaacctgaaaaacgaggccggggaagcacacgcttccatcaaggtcaaagtggtcgacttcccagacccgccagttgcacctacagtgactgaggtgggagacgattggtgcataatgaattgggagccacccgcttatgacgggggcagtccaatcttgggctacttcatcgagagaaagaagaagcagtcctcccgctggatgagacttaattttgacctgtgtaaagaaaccacatttgagccgaaaaaaatgatagaaggagtggcgtacgaggtgcgaatatttgctgtcaatgctatcggtatcagcaaaccaagtatgccctctaggccgttcgtcccactcgccgttacctccccccctactctgttgaccgtggacagcgtcacagataccaccgtcactatgaggtggcgtccgccagaccacatcggcgctgccgggctggatggctacgtcctcgagtactgtttcgagggctctacctctgcgaagcagagcgacgaaaatggggaagcggcctacgacctgccagcagaagactggatcgtggccaataaagacttaatcgacaagaccaagtttactatcacaggtctcccaacggatgcgaagatttttgttcgagtcaaagccgtcaatgcggctggggccagtgaacctaaatactattcgcagcctattctggttaaagaaatcatcgagcctcccaagatcaggattcctcggcacctgaagcagacctacataagaagagtgggggaggcagttaaccttgtcattcccttccaagggaagcccagacccgagctgacctggaagaaggacggggcagagatcgataagaaccagattaatattcggaactcagagacggacaccattatattcatacgtaaggccgagcgctcccacagtggtaaatatgatctacaagtgaaggtggataagtttgttgaaactgcttctattgatatccagatcatcgataggcccgggccacctcagatcgttaaaatagaggacgtgtggggtgagaatgttgccttgacttggacaccgccaaaggacgatgggaatgcagcgatcaccgggtatacaattcagaaggccgacaaaaaatctatggagtggtttacagttatcgaacattatcataggactagcgccacgatcactgaactggttatcggaaatgaatactacttccgggttttctcagagaacatgtgtggactatccgaagatgcaaccatgactaaggaatcagctgtcattgccagggacggcaagatttacaaaaaccccgtttatgaggactttgatttctcagaggcccctatgtttacccagcccctggttaacacctatgccatcgctgggtataacgccacgctcaattgctcggtccgggggaatcctaagcctaagattacatggatgaagaataaggttgctattgtggatgatccccgctacagaatgttttctaaccagggagtgtgtaccctggagattcggaagccaagcccgtatgacgggggaacatactgttgtaaagccgtcaacgatttgggcacagtagagatcgaatgtaagctggaagtgaaggtgatataccagggcgtgaatactccaggccagccagtgttcttggaaggacagcaacagagtctccacaacaaggacttttag

SEQ ID NO: 125366 - DNA, 2349 bp, Artificial Sequence
  Description of Artificial Sequence: Synthetic coding sequence
atgccggagcccactaaaaaagaagaaaacgaggtccctgcccctgcgccccccccggaggaaccttccaaggagaaagaggctgggactacaccggccaaagatgaggaagaagtaagccctcccagcgcactgcccccgggcttgggcagcagggccttggaacgcaaggacagcgactggaccctagtggaaacccctcctggcgaggagcaagctaaacagaacgccaattcacagctcagtatcctgttcatcgaaaagccacaagggggtacagtgaaggttggggaagatatcactttcattgctaaggtcaaagccgaagaccttcttaggaagccgactatcaagtggttcaagggaaagtggatggacttagctagtaaggccggcaagcacttgcaactgaaggaaacctttgaacgacactccagagtgtacacctttgagatgcagataattaaagccaaagacaatttcgctggaaattaccgatgcgaggtgacatacaaggataagttcgattcttgctcattcgatttggaggtccacgaatctacaggaacaaccccgaatattgacattagatccgcatttaagaggagtggtgaaggtcaggaagacgctggtgagttagatttcagtgggctactcaaaagacgggaagtaaagcagcaggaggaggaaccacaagtggacgtttgggagctcctaaaaaacgcgaaaccgtctgaatatgagaaaatcgcttttcagtacgggatcacagacctgcgtggcatgctgaaaagactgaagagaatgagacgggaggaaaagaagtctgccgctttcgccaaaatactggacccggcataccaggttgataaaggtgggcgggtgaggttcgtcgtggagctagccgatccaaagttggaggtgaaatggtataagaatggtcaggagattaggccaagcaccaaatacatcttcgagcacaaaggctgccagagaattctgtttatcaataactgccagatgactgatgatagtgaatactatgtgaccgccggcgacgagaagtgtagcaccgaactgttcgtgcgagaaccacctataatggtcacaaagcagcttgaggacaccacagcctattgcggggagagggtagagctggagtgtgaggtgagcgaagacgacgcgaacgtcaagtggttcaagaacggtgaagagattatcccaggccccaagagcagatatagaatacgtgtggaggggaagaagcacatactgataatcgagggagcgacaaaggccgatgcagctgagtactctgtgatgaccactggcggccaatcatctgccaaactttcagtggacctgaagccacttaaaattctcacgccattgacagaccagaccgtaaatctgggcaaggaaatatgtctcaagtgcgagatctctgaaaatatccccgggaagtggaccaagaatggcctgcccgtgcaagagagcgatcggctcaaagtcgtccacaaaggcagaatccacaaactcgttatcgctaacgccctgacagaggatgagggcgattacgtctttgcccctgatgcctataatgtcactttgcctgccaaggttcatgtaatcgatcctcccaagatcattctcgatgggctcgatgccgacaacaccgtgacagtgatcgctgggaataagctgagactggagattcctatttcaggagagcctcctccaaaggcaatgtggagtcggggcgacaaggctattatggaggggagtggaagaatccggaccgagtcttacccagactcatctacactggtcatcgatatcgccgagcgggatgatagtggcgtgtaccacattaacctgaagaatgaagccggagaagcccacgcctctattaaagttaaggtcgtggattttcctgatcccccggtggccccgactgtgaccgaggttggcgacgattggtgcataatgaactgggagcccccagcctacgatggcggctcacccattctgggctacttcatcgagagaaagaagaagcagtccagtcgatggatgcgtctgaatttcgacctctgtaaggagacaacctttgaaccgaaaaagatgattgagggcgtggcctacgaggtgcgcatctttgctgtaaacgccatcggcattagcaaacctagcatgcccagtcggccttttgtgccacttgccgtgacctcccctcctacactgctcaccgttgattcggttaccgacaccacagtcactatgcggtggagacccagaccccattggtgctcacggttccggtggttgtgcgccagggtgctactctag

SEQ ID NO: 125367 - DNA, 3426 bp, Artificial Sequence
  Description of Artificial Sequence: Synthetic coding sequence
atgcctgaacctacaaaaaaggaagagaacgaggtgcctgcacccgcgccgcccccggaggaacccagcaaagaaaaggaagctggcacaacccccgccaaagattggacactggtggagactccccccggagaagaacaggccaagcagaatgctaatagccagctttccatcctgtttattgagaagccgcagggtgggaccgtgaaggttggggaggacatcacttttatcgcaaaagtcaaggccgaagatttgcttaggaagcccactattaaatggttcaaagggaagtggatggatctagcgtcaaaagccgggaaacatttacagctcaaagagaccttcgaacgccacagtcgggtgtacacctttgagatgcaaattattaaagccaaggacaattttgcaggaaactacagatgcgaggttacctacaaggataagtttgattcgtgctcattcgatttggaggtgcacgagtccacggggacgacccctaacatcgacataaggtccgccttcaaaaggagtggggaaggtcaagaagacgctggggagctggacttctcaggtctgctgaagagacgggaggtgaagcagcaggaggaagagccacaggtggacgtctgggagctgctgaaaaacgccaagccttctgaatacgagaaaatcgcgttccagtacggtattacagacctgcggggaatgctaaagcgattgaaaaggatgcgaagagaagagaaaaagtcggccgcattcgcgaagatcctggacccagcttatcaggtggataagggcggcagggtaagattcgttgtggaactcgccgaccccaaactcgaagtgaagtggtataagaacggccaggaaattagaccgtccaccaagtatatattcgaacacaagggttgccaacgcatcctcttcatcaacaattgccagatgaccgatgactctgagtattacgtgactgccggcgatgagaaatgttcaacagaactgtttgtgcgagaaccccctatcatggtgaccaaacagcttgaagataccactgcctactgcggagaacgcgttgaacttgagtgcgaggttagcgaggacgatgctaatgtgaaatggtttaaaaacggcgaagagatcattccaggcccaaagtctcgatacagaattcgagtggagggcaaaaagcatatcctcataattgaaggagctaccaaagcagatgcagccgaatactctgtcatgactacaggaggccagtccagcgctaaattgtctgtggatttgaaacctttaaaaattctgacacctctcaccgaccagaccgtaaacctgggaaaagagatttgccttaaatgtgaaataagcgagaacatccccggcaagtggaccaagaatggactgcccgtccaggagtcggaccggttgaaggtcgtccacaaaggccgtatccacaagttggtaattgctaacgccctaaccgaggatgaaggtgactacgtgtttgcacccgatgcatataacgtgactctgccagccaaagtacatgtcattgatccaccaaaaataattctcgatggactggatgccgacaatacggtaacagttatcgcgggcaacaaactgcgcctggaaattcccatttccggcgagccaccgccaaaggcaatgtggagtcgcggtgacaaagccatcatggaaggaagtgggagaatccggaccgaaagttatccggactcctcaactttagtgattgatattgcagaaagagacgatagcggcgtgtaccacattaatcttaaaaatgaagctggcgaagctcatgcttccatcaaggtcaaagtggtggactttcctgacccacctgtggcgcccacagtgacggaggtaggggacgactggtgcatcatgaattgggagcccccagcttacgatggaggctcccccatcctgggatacttcatagaaaggaaaaagaagcagtccagccggtggatgagactgaatttcgacctctgcaaggaaacaaccttcgagcctaaaaagatgattgaaggagtggcttatgaggtgcgtatcttcgccgtcaatgctatcggaatatccaaaccaagcatgcccagccgccccttcgtgccactcgctgtgacatctccaccgactttgctgactgtcgacagcgtaaccgataccacagtgaccatgaggtggcgtccgcccgatcatatcggagccgccggactagacggttacgtattagaatattgtttcgagggatcaacatcagcaaagcaatctgatgaaaacggcgaggcagcctatgacttgccagcagaggactggatagtggctaacaaggacctgatcgataagaccaaattcacaataacggggcttccaaccgatgctaaaatctttgtgcgagtgaaggcagtgaacgccgccggtgcctcagagcctaaatactatagccaaccaatactggttaaagaaatcatcgagcctcccaaaatccggatcccaaggcatctcaaacaaacttatatacgacgtgtgggagaggctgtgaatcttgtgatcccgttccaaggtaagcctcggcctgagctgacatggaagaaagacggtgctgagatcgataaaaaccagattaatattaggaatagcgagacagataccatcatttttatcagaaaggccgagagatcccacagcggaaaatacgacttgcaggtgaaggtggacaaatttgtggagacagcgtctatcgacatccagataatagacaggcctggaccccctcagatcgtaaagatcgaggacgtctggggcgagaatgtggcgctgacctggacacccccaaaggatgatggaaatgctgctataaccggctataccattcagaaggcagataagaaatcaatggagtggtttaccgtgatagagcattatcatcggaccagtgccacgattacagaactggtcatcgggaatgagtactacttcagagtattttctgaaaacatgtgtggcttatctgaggacgcaacaatgactaaagagtcagccgtgattgcacgcgacggcaaaatttacaagaacccagtgtacgaggacttcgatttcagcgaagccccaatgtttactcaacctctggttaatacatatgctattgccgggtataatgcaacgctgaattgttcagttagggggaacccgaagccgaagattacctggatgaagaataaggtagccatcgtggatgatcccaggtatcgcatgttctcgaaccagggcgtgtgcacgctggaaatcagaaagccatctccgtacgatgggggcacttactgctgcaaagctgtgaatgatctaggcaccgtcgaaatcgagtgcaaactggaagtaaaagttatcgcccagtag

SEQ ID NO: 125368 - DNA, 3372 bp, Artificial Sequence
  Description of Artificial Sequence: Synthetic coding sequence
atgcctgagccaacaaaaaaggaggagaacgaagtccctgccccagcgccgccccccgaagagccctccaaggaaaaggaggccggcacaacccccgctaaagattggaccctggtggaaacacccccaggcgaggaacaggccaaacaaaacgctaacagtcaactctcaattctgttcatagagaagccgcagggagggactgtgaaggtgggggaggacatcacatttattgctaaagtgaaagcagaagacctcttacgaaagccaaccatcaaatggttcaaagggaagtggatggatttagcgtccaaagccggtaagcacctgcaactgaaggaaaccttcgagagacactccagggtgtacacatttgaaatgcagatcatcaaagccaaggataatttcgccgggaactatcgatgtgaagtgacgtacaaagacaagttcgatagctgcagcttcgatttagaggtccatgaaagtaccggcactacacccaatattgacattaggagcgcatttaaacgctcaggggagggccaggaggacgcgggggaactggactttagtgggctactcaaaaggagggaagtgaaacagcaggaggaagaacctcaagttgatgtctgggagcttctgaagaacgccaagcctagcgagtatgaaaaaattgcttttcaatatggcattacagacctcaggggcatgcttaagcgtttaaaacgcatgcgccgggaggagaagaaaagcgcagcattcgccaagatcctggatccagcctaccaggtggataaaggtgggcgggtgcgctttgtggtggagctggccgatcctaaattggaagttaaatggtacaaaaacggtcaggaaatacgtccttccactaagtacatcttcgaacataaaggctgtcagcgcatcttgttcatcaataattgccaaatgacagacgatagcgaatattatgtcactgccggagatgagaagtgtagcaccgagctattcgtgagggaaccaccaattatggtcacgaagcagctcgaggacacgaccgcttattgtggggaacgcgtggaattggaatgtgaagtgagtgaagacgatgcaaacgtgaagtggttcaaaaacggcgaagagatcattcctggccctaaatccaggtatcgcatacgcgtggagggaaagaaacacattctgatcattgagggtgcaacaaaggccgatgctgccgagtattctgtcatgacgactggaggtcagtcctctgccaagttaagcgttgacctgaaacctttgaaaatactgactcccttgacagatcagacagtgaacctcggaaaagagatctgccttaaatgcgaaatctcagaaaacatccccggcaaatggacaaaaaatggattgcccgtgcaggagtccgaccgactgaaggttgtgcacaagggccgcatccacaaacttgtgattgctaatgctttaactgaggatgagggggactacgtgttcgcccctgatgcttataatgtcacactgcccgccaaagtgcatgtgatcgacccacctaagattatcctggatggcctggacgcggacaatactgttacagtcatcgctgggaacaaactgaggttggaaatacctatctcaggagagccaccacctaaggcaatgtggtccagaggagataaagccattatggagggctctgggagaattcgcactgagtcctaccctgattccagcacccttgtcatagacatcgcagagagggatgactccggtgtctaccatattaaccttaagaacgaggccggtgaagctcacgccagcatcaaagtcaaagtggtggatttccctgacccacctgtggcgcccactgtgactgaagttggcgatgattggtgcatcatgaattgggagcctcccgcctacgacggggggtctccaatcctcggctattttattgaaagaaaaaagaagcagtcatcacggtggatgcgccttaactttgacttgtgtaaggagactactttcgaacctaaaaagatgattgaaggagtggcttacgaagtgcgaatttttgcagttaacgccattggcatctctaagccaagcatgcctagccgacccttcgtgccactcgctgtcacaagcccccctaccctactgaccgtggattctgtgacagataccacggttaccatgagatggaggcctcccgatcacatcggcgccgccggtctggacgggtacgtgctggagtattgttttgagggcactgaggactggatcgtggccaataaggatctcatagataaaaccaagtttaccattactgggctgcctactgacgctaagatcttcgtgagagtaaaggcagtgaatgccgcaggggcaagtgagcccaaatactactctcagcctatcctcgtgaaggaaattattgagccccccaaaatccgaattccccgacatttgaagcagacgtacatccgaagagtaggcgaggctgtgaatctcgtaattcctttccagggcaagccccggcctgagttaacctggaagaaggacggagcagaaattgataagaaccagattaatatccgtaacagtgagaccgacaccatcatctttattcggaaggccgagcgcagccactcagggaagtacgacctccaagtgaaggtcgacaagttcgttgagacagcatcaatagacatacaaatcatcgatcgcccgggtccgcctcagatcgtgaaaatcgaagacgtttggggcgagaacgtggccttaacctggactccacctaaggatgatgggaatgccgccattactgggtacacaattcaaaaagcggacaagaagtcgatggagtggttcaccgtgatcgagcactaccacaggaccagcgcgacaatcacagagctagtgatcggtaacgaatactatttcagagtgtttagtgaaaacatgtgcgggttgagcgaggacgctacaatgacaaaggagtccgcggtgatagccagagacggaaaaatttacaagaatcctgtctatgaggacttcgacttctctgaggcaccaatgttcacacagcccctagtgaatacctacgctatagccgggtacaacgcaacactgaactgttctgtgcgtggaaatcctaagccaaaaataacttggatgaagaacaaggttgccatcgttgacgaccctaggtaccgaatgtttagtaaccagggagtttgcactctagagattcggaaaccctcaccctacgacggaggaacttactgctgtaaggccgtcaatgaccttggcacagtcgaaatagagtgcaaactcgaggtaaaagtgatcgctcagtag

SEQ ID NO: 125369 - DNA, 1434 bp, Artificial Sequence
  Description of Artificial Sequence: Synthetic coding sequence
atgatggaaaaaaacacctctgagggtcccgcttgctcgcctgaggaaactgcaagcgagtcggccaaggtgccgactgcagagcctccaggcgaggtcgccgtgtctgagagcacacgcgaggaacaggtaccaaagcctcaggcacccgcccctcaggctcccacagcatctactgcaactaaaccggctccaccatcagaggatgttccctcagccccacttctgctcaccctggatgacgtatccagttccagcgttacggtgagttgggagcctcctgagagactcgggcgcttgggacttcaggggtacgtattggagttatgtagagaaggggccagcgagtgggtccccgtttcagccagacccatgatggtgacgcagcagaccgtgcggaatctcgctctgggcgacaagtttctcctgcgagtgagtgctgtgtcttccgccggtgccggaccacctgccatgctggaccagcccattcatatccgcgagaatatcgaggcacctaaaatcagagtcccacgacaccttaggcaaacctacatccgccaggtcggggagaccgtaaatctgcagatacctttccaaggcaagccgaaaccacaggcgacctggacacacaatgggcacgctctcgacagccaacgagtgtcaatgcgtaccggagatcaggacagcattctgtttattcgcagcgcccagaggtccgactccggacgctatgaactgacagtgagggtggaagatttggaagctaaagccgtgatcgacatactggtgatcgaaaaacccggaccaccttcttccattcgcttgctagatgtctggggctgcaacgccgcattacagtggacccctccccaggacaccgggaataccgagctgcttggctatatggtacagaaagcggacaagaaaaccgggcaatggtttactgtgctggagaggtatcatccgactacgtgtactatttccgatctgatcattggcaactcgtattcctttcgggttttctcagagaatctgtgcggtctctcaacatccgctacagtgacgaaggaactggctcacattcaaaaggcagacatcgcagctaaacctaagggcttcatcgaacgggatttctcagaggcaccctcctttacccagcccttagccgatcacacctctacacctgggtactcaacccagctgttctgctcagtccgagcctccccaaaaccgaaaatcatctggatgaagaacaagatggagatccagggcaaccctaaatatcgggcattgtccgaacagggagtatgtacactagaaatccgtaagcctagccctttcgattccggcgtgtacacctgtaaggctataaacgtcttgggcgaagcgtccgtagattgtcggctggaggtgaaggcctccgctgcacattag

SEQ ID NO: 125370 - DNA, 5817 bp, Artificial Sequence
  Description of Artificial Sequence: Synthetic coding sequence
atgagcagtgatgctgagatggccatcttcggtgaagctgctccataccttcgcaagccagagaaagagaggatcgaggcacagaacaggcccttcgactcgaagaaagcttgctttgtagcagataacaaggaaatgtacgtgaaggggatgatccaaacccgcgaaaacgataaagtcattgtcaaaacactagacgaccgaatgctgacactgaacaatgaccaagtctttcccatgaaccctcccaagtttgacaagatagaggatatggcaatgatgacacatctgcacgaaccagctgtgctgtacaacctcaaagagcggtatgcagcttggatgatttatacctactctggtcttttctgcgtcactgtcaacccgtataaatggttgcccgtatataaacctgaagtggtcgccgcctatagagggaagaagcgtcaggaagcaccgccccacatcttcagcatttctgataacgcctatcaatttatgctgacagaccgggataatcagagcatcctcattaccggtgagagtggagctggaaaaacagtgaatacaaaaagggtcattcaatattttgcaacgattgctgtgacaggcgacaagaagaaggaaacgcagcctgggaaaatgcagggcaccctggaagatcaaatcattcaagccaaccctctactggaggccttcgggaacgcgaagaccgtccgtaacgacaacagctccagattcggcaagttcatcaggattcacttcggggccacgggtaaactggcctctgcagacatcgagacttatttgctcgagaagtctcgagtcacctttcagctgtcttccgagcgctcataccacatcttttaccagataatgagcaacaaaaagcccgagctaatcgatctgttgcttatatccactaatccttttgacttccctttcgtaagccaaggcgaggttaccgtggcctctattgacgattccgaagaactgctggccacagacaatgctatcgacattctcggatttagctctgaagaaaaagtcgggatttacaagctgacgggagcagttatgcactacggtaacatgaagttcaagcagaagcaaagggaagaacaagcagagccggacgggactgaagtcgctgataaggcagggtacttgatgggcctgaactccgccgaaatgctcaaagggctgtgttgtccccgagtgaaggtgggaaatgaatacgtcactaagggccagaatgtgcagcaggtgacaaactcggtcggagctctggcaaaggccgtctacgagaaaatgttcctttggatggtgacgcgcattaaccagcaactggatactaaacagccccggcagtatttcatcggcgtgttggatatcgctggttttgagattttcgacttcaactctctggagcagctctgtattaacttcacaaacgagaaacttcagcagtttttcaaccatcacatgtttgttcttgaacaggaagagtataagaaagagggcatagaatgggaattcatcgattttggtatggaccttgccgcctgcattgagctgatcgaaaaaccaatggggatcttttccatactggaggaagagtgtatgtttccaaaggccactgatacatccttcaaaaataaactgtatgaccaacacttaggaaaaagcaacaattttcagaaaccaaagcctgccaaaggaaaggccgaagctcattttagcctggttcactatgctggcacagttgattacaatattgcgggctggctcgacaaaaataaggaccccctgaatgagactgtcgttggactataccaaaagagctcgctgaaactcctcagctttctgttcagcaattatgccggcgccgagactggcgacagtgggggctccaagaagggcggcaagaagaagggaagtagttttcagaccgtgagtgctgtttttcgcgagaatctaaataagttaatgaccaacttacggtccacgcacccacactttgtgcggtgtctgataccaaatgagactaaaacgcccggagtgatggaccattatcttgtgatgcatcagttaaggtgtaatggagttctcgaagggattcgcatctgccgcaaaggatttccatcccgaattctctatgcagactttaaacagaggtataggatcctcaacgcaagtgcgattcctgagggacagttcattgatagcaagaacgctagcgaaaaactgttaaacagtattgatgtggacagggaacagtttcggtttggaaacaccaaggtgttctttaaggccggtctgctgggactgcttgaggagatgagggacgagaaattagtgacccttatgacgagtacacaggcggtgtgtagaggctacctaatgagggttgagttcaagaagatgatggaacgcagagattccatcttctgtattcagtataatattcgatcttttatgaatgtgaagcactggccttggatgaatctgttctttaaaatcaaaccacttctgaagtcggcagaagctgagaaggaaatggctaccatgaaagaagatttcgagcggactaaagaggagttggctagatcagaggcccggaggaaagagctggaggaaaagatggtcagtctgcttcaggaaaagaacgacctgcagttgcaggtccaatctgagaccgagaatctaatggacgctgaggaaaggtgcgaggggttgattaagagtaagatattgctggaagccaaggtaaaggagctgacggaaaggctggaggaggaggaggagatgaacagcgagctcgttgctaagaaacgaaacctcgaggacaagtgcagcagccttaagcgtgacattgatgacctggagcttactctgaccaaggttgagaaggaaaaacacgccacagaaaataaagtgaaaaacttgtctgaagagatgaccgcattggaggagaatatcagcaagctcactaaggagaagaaatcgctacaggaggctcatcagcagacattggatgatttgcaggtcgaggaagataaggttaatggcctgattaaaataaacgctaaattagagcagcagaccgacgatctcgagggcagtttagaacaggagaaaaaactcagggctgacctcgagcgcgccaagcggaaattggagggggatctaaaaatgtcccaggagagcatcatggatctcgaaaatgacaaacagcagatagaggaaaagctgaaaaagaaagagttcgagctcagccaactccaggcaaagatcgacgatgaacaggtgcatagcctccagttccagaagaagatcaaagaacttcaggcccggatcgaagagctagaggaagagatcgaagccgaacacacactccgcgctaagatcgagaaacaaaggagcgacctggctcgtgaactggaagaaattagcgaacgcctagaagaggctagcggagctacctctgcccaaatcgaaatgaacaaaaagcgtgaggctgaattccaaaagatgagaagagatctagaagaagctacactccaacacgaagctactgccgccactctgagaaagaaacaggccgactccgtcgcggaacttggtgagcagatagacaacttacagcgcgttaaacagaagttggagaaggagaagtctgaactgaagatggagattgacgatatggcatccaacattgaagccctgagcaagtcgaagtccaacatcgagcggacctgtaggactgtagaagatcagttcagcgaaataaaagccaaggacgaacagcagacacagctcatccacgatctgaatatgcagaaggcgcggctgcaaactcagaacggggagctctcccaccgggtggaagagaaagagtccctgatctcacagctcaccaagagcaaacaggctttgacccagcagctcgaggagctcaagcgacagatggaggaggaaacaaaagctaaaaacgccatggctcacgccttgcaatcctcgcgccacgattgtgacctgctcagggagcaatacgaggaggagcaagaagccaaggcggagctccagagggccttgtccaaagcaaattccgaggttgcccagtggcgaacaaagtatgagaccgatgctatccaaaggacagaggagctggaagaggcgaaaaagaagctagcccaacgcctgcaagaggcagaagagaacactgagacggctaatagcaagtgcgcatctctggaaaaaactaaacagaggctgcagggcgaggtcgaagatctgatgcgtgacctggaacgatcacataccgcctgtgcaaccctcgacaagaagcagcgaaactttgataaggtgctggcagagtggaagcagaagctcgacgagagccaggccgagctagaagctgcccagaaagagtcacgttctcttagcaccgagctcttcaagatgaggaacgcttatgaagaagttgttgatcaactggaaaccctgagaagagagaataaaaacctgcaggaagagatctccgatctcacagagcaaatagcagagaccggaaaaaacttgcaggaggccgaaaaaacaaagaagctggtggaacaagaaaaatcagatcttcaggttgccttggaagaagtcgaaggttccctggaacacgaggagtcgaagatcctgcgtgttcaacttgaactgagtcaggtaaaatcggagctggacaggaaagtgatcgagaaagatgaggagatcgaacaattgaagaggaacagccagcgcgccgccgaagcactgcaatccgtattggacgccgagatccggtcccgcaacgacgcccttaggctgaaaaagaagatggagggggatctcaacgagatggaaattcaactagggcattcaaaccgacagatggccgagacacaaaaacatttgaggaccgtgcagggccagctgaaagactcgcagctgcacttggatgacgctcttcgctctaacgaggatcttaaggaacagttagctatcgtcgaacgaagaaacggtctgctgctagaggagctggaggaaatgaaagtggccctggagcagaccgagcggacaagacgactttccgaacaggaattgctggacgctagcgatcgagtgcagctgttgcatagtcagaacacttccctcatcaacaccaaaaaaaagctcgaggcggatattgcccaatgtcaggcggaggtggaaaactccatccaggaatctcgcaacgccgaagagaaagccaagaaagcgatcacagacgcggcaatgatggcagaggagttgaaaaaagaacaggatacctccgctcatcttgagaggatgaagaagaacctggagcagactgtcaaggatttgcagcatagacttgacgaggcagaacaactggcgctgaaaggaggaaaaaagcagatccagaaacttgagaaccgcgtcagagaattggagaatgaactcgatgtggagcagaaacggggtgccgaggcgttgaaaggcgctcataaatacgagaggaaggtgaaggagatgacttaccaggccgaggaggaccacaaaaatatccttcgattgcaggatctggtggacaaactgcaggcaaaggtgaagtcctacaagaggcaggcagaggaggcagaggagcaggcaaacacgcagctttccagatgccgaagagtacagcacgaactggaggaagccgcagaacgggccgatatcgcggaaagccaggtcaacaaattgcgagccaagtcccgtgatgttggcagccaaaagatggaggagtag

SEQ ID NO: 125371 - DNA, 6111 bp, Artificial Sequence
  Description of Artificial Sequence: Synthetic coding sequence
atggctgctgtcaccatgtctgtgccagggaggaaagctcccccgaggcctgggcctgtgccggaggcagcccagccttttctcttcacgccccgggggccctctgccggcgggggtcccggaagtggaaccagcccccaagtggagtggacagcccgacgtctagtatgggtgccgtccgagctgcacgggttcgaagccgctgccctacgagacgagggagaagaagaggccgaggttgagctcgctgagtccgggcgacgcctgcgtctgccccgggaccaaatccaacgcatgaatcctcctaagttcagtaaggcagaagacatggcagaactaacttgcttgaacgaagcaagtgtactccacaaccttcgggagcggtactacagcggactcatctacacatatagcggactgttttgtgtggtgatcaatccgtacaagcaactgcctatctacactgaggctatcgtggaaatgtaccgcggtaagaagcgccatgaggttccgccgcacgtgtacgccgtaactgagggggcatacaggagtatgttgcaggaccgagaagaccaatctattctgtgcacgggggagagtggggccggcaaaacagagaacaccaaaaaggtgatccagtatctagcacacgtcgcgagctcccctaaggggagaaaagagccaggcgtacccgcgtctgtgtcaaccgtctcctacggcgaactcgagagacaattactgcaggcaaacccgatccttgaggcttttggcaacgccaaaaccgtcaagaacgataactccagccggtttggtaagttcatccgcatcaacttcgacgtggcgggctatatcgtcggcgccaatatcgagacctacctcctcgagaaaagccgggccattagacaggccaaggacgaatgctcttttcacatcttctaccaactgctaggcggtgcgggagagcagctgaaggccgatttgctcctcgaaccctgctctcactataggtttctcaccaacggacccagttcaagccccggccaggaacgcgagctgttccaagaaactttagagagcctccgggtactcggcttttcccacgaagagatcatttccatgctgaggatggtgagtgcggtcttacagtttggaaatatagcgctgaaacgcgaacggaatactgaccaggcaacaatgcctgataacacagccgcccagaaactttgccggctgctcggcctgggagtcactgatttcagcagagcattgctgacgccaagaattaaggtggggagggactacgtgcagaaggcacagactaaagagcaggcagatttcgctctggaggcacttgctaaagctacttatgagcggctcttcaggtggctggttctccggcttaaccgcgcacttgaccgcagcccgcggcagggcgcgtcctttctgggaattctggacattgctggttttgagattttccaattaaactcctttgaacagttatgtatcaactatacgaacgagaagcttcagcagctctttaaccatacgatgttcgtgttagagcaggaggagtaccagagggaagggatcccttggacttttcttgattttggactagatttgcagccatgcatcgacctgatagagcgacctgccaaccccccaggtctattagccctgttagatgaggaatgttggttccctaaggccacagacaagtcattcgtagaaaaggtcgcgcaagaacagggcggacaccctaagtttcagcggccacgccacctgcgagatcaggccgactttagcgtactccactatgctggtaaagtggattacaaggctaacgagtggttgatgaaaaatatggatccactgaatgacaatgtggcagctttactccatcagagcacagacagattaacagccgagatttggaaagacgagcacggcggtttccagcaattttctttcctgggctcattccctccctccccgcctggttccgccgagagatgttcttcggccatctcacccccgggcgtggaaggcattgtgggcctggagcaggtgtcgtcactaggagacggacccccggggggcagaccccgccgcggaatgtttagaacagtcggacagctctacaaggaatctttgtctcggctgatggctacgctgagtaacaccaacccttcattcgtgagatgtatcgtacccaaccatgaaaagcgcgcaggtaagctcgaaccccggctagtgttagatcagctgagatgcaacggcgtgttggaaggcattcgtatatgcagacagggctttccaaatcgcattctcttccaagagttcagacagcggtacgaaatccttactccaaacgcaattcccaagggatttatggacgggaagcaggcatgcgaaaaaatgatccaagccctggaattagaccccaatctgtacagggtaggtcaaagcaaaattttcttcagggctggcgtgttggcacaactggaagaggagagagatctcaaagtcacagatatcatcgtatcatttcaggccgccgctcgagggtacctggccagacgagcttttcagaaaagacaacaacagcaatccgcattgagagttatgcagagaaactgcgctgcttacctcaagctgcgccactggcagtggtggcgattgtttaccaaggtcaagccactactgcaagtgactcgccaggatgaggtgttgcaagccagagcacaggaattacagaaagtgcaggagcttcagcagcaatctgctagggaggtcggcgaactgcaaggccgcgtggcccagcttgaagaagaacgggcacgccttgccgagcagttacgtgcggaagcagagctatgtgccgaggcagaggagacccgggggcggctggctgctcgcaagcaggaactggagcttgtcgtgtctgaactggaggcaagagtcggcgaagaggaggaatgttctcgccaaatgcaaaccgaaaagaaaagactgcagcagcacatccaagagctagaggctcatctggaggcagaagagggagcacgccagaaactgcagctggaaaaggtcactaccgaagccaaaatgaaaaaatttgaggaagacctgctgttgttagaggaccagaatagtaagctgagcaaggagaggaaactgctggaggaccgactggccgagttctcttctcaggcggccgaggaagaagagaaagtcaaatctcttaataagctccggctgaagtacgaggccactattgccgatatggaggacaggctccgaaaggaggagaagggcagacaggaactggagaagctaaaaagacgtctggatggcgagagctccgaactgcaggaacaaatggttgagcagcagcagcgcgcagaagagctgcgagcccagctgggtagaaaggaagaggaactccaggccgccctcgcgcgtgcggaggatgaaggcggggctcgcgcccaactgctgaaatcactcagagaggcacaagccgccctggccgaggcacaggaagacttagagagtgagagggtagcaaggacaaaggcagaaaaacagcgtcgtgacctgggcgaggagctggaagctctgagaggtgagctcgaagataccctggactccaccaatgcacaacaagagctccggtctaagcgggagcaagaggtgacagagctgaaaaagacactcgaggaggagacaaggattcatgaggctgccgtgcaagagttgaggcagcgccacggtcaagcactaggcgagctggccgagcagctcgagcaggcccggagaggaaagggggcctgggagaaaacccggctggcactggaggccgaggtttcagagctgagggccgagctttcaagcctacagactgcaaggcaggagggcgagcaaagaagacggaggctggagcttcagcttcaggaggtccaaggcagggccggtgatggcgaacgggcccgggccgaggctgctgaaaagcttcagcgggcccaggctgagctggagaacgtaagcggcgccctgaacgaggcagaatcaaagacaatccgcctgtcgaaggaactttctagcacagaggcccagctgcacgatgcgcaggagttacttcaggaagagacccgggctaagctggccctagggtctagagtaagagctatggaagccgaagccgccggtctgcgggaacagttggaggaggaggccgctgcccgggaaagggccggcagggagctccagactgctcaagcccaattatctgagtggagacgccgacaagaggaggaggcaggggcactagaagctggcgaggaggctcgccggcgcgctgctagggaagcagaggcgctgacccaaagattggctgaaaaaactgaaacagttgacagactcgaacgcggtcggaggcgattgcagcaagaattagacgatgctacaatggacctcgagcaacagcgccagctggtctccactttggaaaagaaacaacggaagttcgaccagctgctggccgaggaaaaggcggcagtgctgagggctgtagaggaacgagaaagggcggaagcggagggaagagaaagggaagcacgtgccctcagccttacccgggcactggaggaggagcaggaggcccgcgaggagttagagcgacagaacagagctctcagggcggaactcgaggcgttgctcagctctaaagatgacgtaggtaagtccgtgcatgagctggaaagagcatgtagggtcgccgaacaggctgccaacgatctgcgggcacaggtcaccgagctcgaagatgagctaacagccgccgaggacgcgaagcttaggctcgaggtgacggtccaggccctgaagacacagcatgagagagacctccagggcagggacgaagcaggggaggaacgtagaagacagttggccaagcaactgcgggacgcggaggtggagcgggatgaggaacggaagcagcggactcttgccgtggcagccaggaagaagctggagggggaacttgaggagttaaaagctcagatggcctctgctggccaaggcaaagaggaagcggtaaaacagctgcgtaaaatgcaagctcagatgaaagaactgtggcgtgaagtcgaggaaacaagaacttctcgtgaggagatcttctcacagaacagagaatctgagaaacgactcaaaggactggaagctgaggtgcttaggctgcaggaggagctggcggcctccgaccgggcccgaaggcaggcgcagcaagacagagacgaaatggccgacgaagttgctaatgggaacttaagcaaggctgctatcctcgaggaaaaacgccagctggagggacgcctaggacagctggaagaggaacttgaggaggagcagtccaactctgagctccttaacgaccgatacagaaaacttctgctacaggtcgagagccttactacagagctaagtgcagagcgttcattttccgctaaggctgaatctggtaggcagcagctagagagacaaatccaggaattgaggggacgcctgggtgaagaagatgccggggcacgggcacgacacaaaatgactattgctgcgctcgagagcaagttggctcaggctgaagagcagctcgaacaggaaactcgggaacggatcttatcaggtaagctggtacgcagggcagagaagcgactgaaggaagtagtgctgcaagtggaggaagaacggagagttgccgatcagctcagagatcaactggaaaaaggaaatctccgtgtaaagcagctaaagcgccaacttgaagaagccgaagaagaggcaagccgcgctcaggcagggagaagacgtctacagcgagagctggaggacgttactgaatctgctgagtctatgaatagagaagtgaccaccctgagaaacagactgcggcgcggtccactcacctttacaactcgcactgtccgccaggtttttcggctcgaagaaggtgtggcaagcgatgaagaggctgaggaggcgcagcccggttcggggcccagtcctgagcctgagggctctccccccgcgcatccccagtag

SEQ ID NO: 125372 - DNA, 5823 bp, Artificial Sequence
  Description of Artificial Sequence: Synthetic coding sequence
atgtcttcagacacagaaatggaagtgttcggcatcgcagccccctttttgaggaagtctgagaaagaacgaatcgaggctcagaatcagccattcgacgcgaagacatattgcttcgtggtcgattccaaggaagaatatgccaagggcaaaataaagtcatcacaggacgggaaggtgacagtggagactgaggacaaccggacactggttgttaagccagaagatgtgtacgcaatgaatcctccaaagttcgatagaatcgaggacatggccatgctgacacatttaaatgaacctgcagttctctacaatctcaaagataggtacactagttggatgatatacacttattctgggcttttctgcgtcaccgtgaatccttataagtggttgccggtgtataaccctgaagtggttgaaggttatcggggaaagaaacgccaggaagcacccccacatatctttagcatttccgataacgcatatcagtttatgttgacggatcgcgaaaatcaaagcattctcataactggcgagtcgggtgccggcaagactgtcaacacaaaaagggtcattcaatatttcgctactattgctgccactggcgacctcgcaaaaaagaaggattcaaaaatgaagggtacgctggaggaccagatcatcagtgctaaccccctcttggaagccttcggtaatgccaaaaccgtgcggaatgataattctagcagattcgggaaatttatccggatccatttcgggactacagggaaattagctagcgctgacatagaaacttacctgctggaaaaatcaagagtgacttttcagcttaaagcggaacgcagctatcacattttttaccagatcctgtccaataaaaagcccgagttgattgagctcctcctaattactaccaatccttacgactacccattcattagccaaggcgagatattggtggcatctatcgacgacgccgaggaactgctggccactgactccgccatcgatatcttggggttcaccccggaagagaagtctgggctttataaattgaccggcgccgtgatgcactatggaaacatgaaatttaagcagaaacaacgggaagagcaggccgaaccagacgggacagaggtcgccgacaaaaccgcttatctcatgggcctaaactcatccgacctgctcaaagcactgtgtttcccacgcgtcaaagttggcaacgagtatgttactaaagggcagacagtcgaccaggtgcatcacgccgtgaacgccctgtccaaaagtgtttacgagaagctgttcctgtggatggttacccgcatcaatcagcagttagataccaaattgccacggcagcatttcatcggtgtacttgatattgcgggctttgagattttcgagtacaattcactggagcagctgtgcataaacttcaccaatgaaaaactccaacaatttttcaaccaccatatgtttgtgttggaacaggaagagtacaagaaggaggggatcgagtggactttcatcgactttggtatggatctcgcggcctgtattgagttgatagagaagcccatgggcattttctcaatacttgaggaagagtgtatgttccccaaggctactgacacctcctttaaaaataagttgtacgatcagcacctggggaaaagtaataatttccagaagcccaaagtcgtaaagggacgtgcggaggcccacttctccctgattcactacgccgggaccgtggattactccgtttccgggtggcttgagaagaacaaggatccactcaacgaaaccgtggtcggcctgtaccaaaagtcttcaaatcggcttctggcccacctctatgcaacttttgctaccgcagatgcggattctggaaagaagaaggtcgcaaaaaagaagggaagctcgttccagaccgtttctgcgctgtttagggaaaatctgaataagctcatgtccaacttacgcaccacgcatccccatttcgtcagatgcattatccctaatgaaacaaagactcctggagcaatggagcatagccttgtgctgcaccagctgcggtgtaacggtgtgctggagggcatcagaatatgtcgtaaaggtttccccaatagaatactgtatggcgacttcaagcagcggtaccgggtactaaacgcctctgccatcccagagggccaatttatcgacagtaaaaaggcttgtgagaaacttctcgctagtatcgacatcgatcacacacaatacaagttcgggcacaccaaggtgtttttcaaggctggccttcttggaactttagaagagatgagggatgaccggttagcgaagttaatcacaaggactcaagccgtctgtcggggattcttaatgagggtcgaatttcaaaaaatggttcaaagacgcgagagtatcttttgtattcagtataatattcgcagttttatgaacgttaagcattggccttggatgaaactgttcttcaaaattaagccactcctgaaatcagctgaaaccgaaaaagaaatggcgaccatgaaagaagagttccaaaagaccaaagatgagctggcgaaatcagaggctaagcgaaaggagctagaagaaaaactggtgactctggtgcaggaaaaaaacgacctgcagctccaggtgcaggcagagtctgaaaatttactagacgctgaagagcgctgtgaccagctcattaaagcaaagttccagctggaggcaaagataaaggaggtgactgagagggctgaggacgaagaagagattaatgctgaattgacggctaaaaaacgaaagctggaggatgagtgttctgagctgaagaaggatattgacgaccttgagctcacacttgctaaagtcgaaaaggaaaagcatgctaccgaaaacaaggtgaaaaacttaactgaagagctcagcggcctggacgagactatcgctaaattgactcgagagaagaaggctctccaagaagctcatcaacaggctctcgatgacctgcaggcagaggaagacaaagtgaattccttaaacaaaactaaatctaagcttgaacaacaagtggaggacctagagagctccctggaacaggagaagaagttaagagtggacttggaaagaaataagcgaaaactggagggagatctgaaactggcccaggaaagcattctggacctggagaatgacaagcaacagttagacgagcggctcaaaaaaaaggattttgagtattgtcagctgcagtcaaaggtggaggatgaacaaacgctgggcctgcagttccaaaagaaaattaaagagcttcaggcacgcattgaagagttggaggaggagatcgaagctgaacgggctactagagctaagactgaaaaacagaggagcgactatgccagggagcttgaggagctgagcgagagactcgaagaagctggcggcgttactagcacccagatcgagttgaacaagaagcgcgaggctgagttcctgaagcttaggcgcgaccttgaggaggccactctgcaacatgaggctatggttgccgctctgcgaaagaagcatgccgattcagtcgcggaactgggcgaacaaatcgacaaccttcagcgagtgaaacagaaactggagaaggagaagagtgagtttaaactcgaaattgatgacctctcgtcgtctatggaaagcgtgtctaagagcaaggctaacttagagaagatttgtcgcacactggaggatcaactatccgaagccagagggaagaatgaggaaattcagcgcagcctctcagaactgacaacccagaagagcaggctccagacagaggctggagagttgtcgagacaacttgaggagaaggagagcatcgtctcccagctcagtcgcagcaaacaggcatttacacagcaaaccgaagaattgaagcgccagttagaagaggaaaacaaggccaagaatgccctggcccatgcactgcagagtagccggcacgattgcgacttgttacgagaacagtatgaagaggagcaggaaggaaaagctgagctacagcgggctctctcaaaggccaactctgaggtggcccagtggcgcacaaaatatgaaacagatgcaattcagcgaaccgaagagctggaagaagccaagaagaagttagcccagagactgcaggattctgaggaacaggttgaagccgtcaacgcaaagtgtgcatctctggagaagactaaacagagactgcaaggggaggtggaggacctgatggtggacgtcgaaagggctaattcactggctgctgcccttgacaaaaaacagcgaaactttgataaagtactcgccgagtggaagaccaagtgtgaggagagtcaggccgagttggaagcctcattgaaagaaagtagatccttgagcacagaactgttcaaactgaagaatgcatatgaggaggctctggaccagctggaaacagtgaaaagagagaataaaaacctggagcaggaaatcgccgatctgaccgaacaaatcgcagagaacggcaaaacgatccacgagctggagaaatctcggaaacagatcgagttggaaaaagcagacattcagctggctctggaggaagcggaagcggccctagagcacgaagaagccaagatccttcgcatccagctggagctgactcaggttaagtcagaaatagatcggaagattgccgagaaggatgaagaaattgagcagctcaaacggaactatcagcggacggtggagactatgcagagcgcactggacgcagaagtgaggtcccgaaatgaggcgattcggctgaaaaaaaaaatggagggagatcttaatgagatcgaaatccagttgtcccatgctaacaggcaggcggcagagaccttaaagcacctccgcagcgtgcaagggcaactgaaggacacacagctccacttggacgacgcattacgggggcaggaagacttaaaggaacagttggcgattgtggagagaagagcgaatctcctgcaggcggaggtcgaagagctcagagctaccttggagcaaacagagcgcgcgaggaagctggctgagcaggagctcttagattccaatgagcgcgtccagctgctccacactcagaacacatccctgattcatacgaaaaagaagctggaaactgacttaatgcaactacaatccgaagtcgaagacgcctcccgggatgcccgtaatgctgaagagaaggccaagaaggcaattaccgatgccgctatgatggctgaagaactcaaaaaggagcaagataccagcgcacaccttgaacggatgaagaagaatctcgagcagactgttaaggacctccagcatcgcctggatgaggcagaacagctggccctgaagggggggaaaaaacagattcaaaaacttgaaacacggattcgggagttggaatttgaattagagggagagcagaagaaaaacaccgagtcagtgaaaggacttcgcaagtacgaaaggagggtgaaggagcttacctaccagtcagaagaggatagaaaaaatgtgctccggctgcaggatcttgtggataagctccaggtgaaagttaagtcatataagcgccaagctgaagaagcagacgagcaagccaacgcccatctgactaaattcaggaaggctcagcacgagctcgaggaggccgaggagagagccgatatcgccgagtcccaggtcaacaagctgagagcaaagacacgcgattttactagctcccgcatggtggtgcacgagtctgaggaatag

SEQ ID NO: 125373 - DNA, 3132 bp, Artificial Sequence
  Description of Artificial Sequence: Synthetic coding sequence
atgccacttttggaggggtctgtgggggtcgaggatctagtgctgttggagccactggtggaagagtctctacttaagaatctgcaactccggtacgagaataaggagatttatacctatatcggaaacgtggtgatttcggtgaacccctatcaacagttgcccatctatggaccagagtttatagctaagtaccaggactacactttctacgaattgaagcctcatatctacgctctcgccaacgtagcctaccagagtcttcgggaccgggatagagaccagtgcattttaatcaccggggagagtgggagcggaaaaactgaggcctccaagctggtaatgagttacgtggcggccgtgtgcgggaaaggcgagcaggtgaattcagtcaaagaacagctgctccaatcaaaccctgtcctagaagctttcgggaatgccaaaaccatcagaaacaataattctagccgtttcgggaaatacatggatatagagtttgattttaaggggagtccgctgggaggggtgattactaattatttgctcgaaaaaagccgcttagtcaagcagctgaagggggaaaggaatttccacatattttaccagctcctcgcgggagccgatgaacaacttttaaaggccctgaaactcgaacgtgacacaacgggctatgcttacttgaatcacgaagtgtcaagggtggacggtatggatgatgcgtctagtttccgcgccgtgcaatccgcgatggctgttatcgggttttcagaggaggaaattagacaagtgttggaggtcacctcgatggttctgaaactggggaatgtgctggtcgcggatgagtttcaggcatctggtattcctgccagcggcattagggacggtaggggtgtgcgggagatcggagaaatggttggcctcaatagcgaagaggtagagcgtgccctatgctcccgaactatggagaccgccaaggagaaggtggtcacagccctgaacgtcatgcaggcacaatacgcccgtgacgcgctggccaagaatatatatagcagattgtttgactggatcgtgaacagaattaacgagtccatcaaggtgggtatcggggagaagaaaaaggtgatgggcgttctcgacatatacggatttgagatcttggaggacaatagcttcgagcagtttgtaattaattattgcaacgagaagctccagcaggtgtttatagagatgacactgaaagaggagcaggaagaatacaagcgagaagggataccatggacgaaagttgattacttcgataatggtatcatttgtaagttgatagagcacaatcagcggggcattctcgctatgctggatgaggaatgtctccgccccggcgtcgtgagcgacagcacatttctggcaaagctgaaccagttgttttccaagcatgggcactatgaatcaaaggtgactcagaacgcacagcggcaatacgaccacaccatgggtttgagctgtttccgcatatgccactatgccggaaaagtgacctataatgtcacctcgtttatagacaaaaacaatgatctgctcttccgggatctgctccaggccatgtggaaagcccagcacccactcctgaggagcctgttcccagaaggcaaccccaagcaggcttcgctgaaaagaccgcctacagccggtgcgcaattcaagtcaagcgttgcgatcctcatgaagaatctctattcgaaaagccccaattacatccggtgcatcaagcctaacgaacaccagcagcgggggcaattcagcagcgacctggtggcaactcaggcgaggtatctgggcctgctggagaacgtgagggtccggagagcaggatatgctcaccgccaagggtacggcccgtttctagaacgctatcggctactctctcgcagcacctggccccattggaatggaggcgatcgggagggtgtggagaaggtgttgggagagctttccatgtcctctggcgagctggcctttggcaagactaaaattttcattagaagccccaagaccttattttatctcgaggagcagcgacggctgaggttgcaacaattagccacactgatccaaaagatttataggggttggaggtgccggactcactaccagcttatgaggaagagccagatactaatttcgagttggttccgtgggaatatgcagaaaaaatgttacggaaagattaaagcctccgtgttgctgatccaggcctttgtcaggggatggaaagcacgcaaaaattacagaaaatactttagatctgaagccgccctcacactggctgacttcatctacaaatccatggtccaaaaattccttctggggcttaaaaacaacctgccctccactaatgtgctggacaagacgtggcctgcagctccctacaaatgcctgtccaccgctaatcaggagttacagcagttgttctatcagtggaagtgtaagagattccgagaccagttgtcccctaagcaggttgaaattttacgtgaaaagttatgtgcttctgagttgtttaaagggaagaaagcttcttacccacaatcagtgcccattccattttgcggcgactacattggcctccaaggtaaccctaagctgcagaagctcaagggtggcgaggagggccccgtgttgatggcggaagcggtaaaaaaagtcaaccgcggtaacggcaaaactagttcccgaatcctgttactcacgaaaggccacgtgatcctcactgacactaaaaaaagccaggccaagatcgtgattggactggataatgtggccggcgtgtccgtaaccagcctcaaagacggcttgtttagcctgcacttatccgaaatgagttctgtcggatctaaaggcgattttttgctcgtgtcggaacatgtgatcgagcttcttactaagatgtatagagccgtgctcgatgctacccaacggcagctgacggtcactgtaactgagaaattctcagtgcggtttaaagagaatagcgtggcggtcaaggtggtgcagggccccgccgggggggataacagcaagttacgctataagaagaagggctctcattgcttagaggtcactgtccagtag

SEQ ID NO: 125374 - DNA, 291 bp, Artificial Sequence
  Description of Artificial Sequence: Synthetic coding sequence
atgccactgctggaagggagcgtgggtgttgaggacctggttctgctggaacctcttgtggaagagtcactgttgaagaacttgcagctccgatatgagaataaagagatctatacctacatagggaacgtagtgatttcagttaatccttatcagcagttgccaatctacggccctgagttcattgcgaagtaccaggattacacattctacgagctgaagccacatatttacgccttggccaacgtggcctaccagtcactccgtgaccgagatcgggatcagtgctag

SEQ ID NO: 125375 - DNA, 3132 bp, Artificial Sequence
  Description of Artificial Sequence: Synthetic coding sequence
atgcctttactagaggggtccgtgggcgtggaagatcttgtcttattagaacctcttgtggaggaatccctgttaaaaaatctgcaacttcggtatgagaacaaagagatatatacgtatatcggtaacgtggtgatctcagtgaatccttatcagcagctgccgatatatggccctgaattcattgctaagtaccaggactatacgttttatgaactgaagcctcacatatacgctctggccaatgtcgcataccagagcttgcgtgatagggatcgcgatcaatgcatcctaatcaccggcgaatcaggaagtggaaaaactgaggcatccaagctggtgatgtcctatgtggctgcagtgtgcgggaaaggagagcaggtaaacagtgtcaaggagcaactcctgcagagcaaccctgtactagaggcattcggaaatgctaagactatccgcaacaacaattccagccggtttggaaagtatatggacattgagtttgattttaagggatcccccctaggaggagttatcaccaactatcttctcgagaagtccagattggtgaagcagcttaagggcgagcgtaacttccatatcttctatcagttgttggccggggctgacgagcagctgctgaaggcacttaagctggagcgtgacacaacaggatatgcctatttgaaccacgaagtttcccgcgtggatgggatggacgacgccagttcattcagagctgtccaatccgcaatggccgttataggcttctctgaggaggaaattcgtcaggtgctggaagtcacctccatggtgttaaaactgggaaacgtgctggtggctgacgagttccaagcctccggcatcccagcgtcgggaatacgtgatgggaggggcgtgagggagatcggcgagatggtcgggctaaatagtgaggaggtggaaagggcgctctgttcccgcaccatggaaacagccaaggagaaagtagtgactgccctaaacgtgatgcaggcccagtatgccagagacgcattggcaaagaacatttactcaagactcttcgattggatcgttaacagaataaacgaaagcataaaagtaggcatcggcgagaaaaaaaaagtcatgggggtcctggatatatatgggtttgagattctggaggataatagtttcgaacagtttgttattaattactgtaacgaaaaactgcaacaggtgtttattgaaatgacccttaaggaggaacaagaggagtataaaagggagggcattccttggacaaaagtggactactttgacaatggaattatctgcaagctcatcgagcacaaccaaaggggaatcctggccatgctggacgaggagtgcctccggcctggtgtggtatcagactctacatttctggccaaactcaaccaactgttttctaaacatgggcactatgaatccaaggtgactcaaaacgcacagcggcagtatgatcacactatggggctaagctgcttccgcatctgccactacgcgggaaaggtgacttacaacgtcacatcatttatcgacaaaaataatgacttgcttttcagagacttgctccaggccatgtggaaggcacaacaccccctattaaggagcttatttcctgaaggtaacccgaaacaggccagtttgaagcggccacctacagccggtgcacaatttaaaagctccgtggcaattctcatgaagaatctgtacagtaagtctcctaactatattaggtgcatcaaaccaaatgaacatcagcagagaggccagttttcttccgatttggtggccacccaggcccgctatctgggcctgctagaaaatgtcagggtgaggcgcgccggctacgcacaccggcaagggtatggcccatttctagaaaggtatagactattatcccggtccacttggcctcattggaacggtggcgatcgcgaaggagtggagaaagttctgggcgaattgtcaatgtcttctggcgagctagcatttggcaagacaaagatcttcatccgctccccaaaaacactgttttacctggaggagcagcgccggcttcgattgcagcaactggccacattgatccagaagatctaccgggggtggagatgcaggacccactatcagcttatgcggaagtctcagatcctgatctcctcctggtttcgggggaatatgcaaaagaagtgctacgggaaaataaaggcatccgtcctgcttattcaggcgttcgtgagaggctggaaggccagaaagaattaccgaaagtactttcggtcggaggctgcactgacactcgccgatttcatctacaagagcatggtccaaaaatttctgcttgggcttaagaataatcttccatccacaaatgtacttgacaagacctggcccgctgctccttataaatgtctctcaacagctaaccaggaacttcaacagctcttttatcagtggaagtgcaaacgttttcgagatcaactcagtcctaagcaggtggaaatactccgggagaagctgtgcgctagtgagctgttcaagggtaaaaaggcgtcgtacccacaatctgtccctatcccattctgtggtgattacattggacttcagggaaatcctaaattgcagaaattgaagggaggcgaggaaggtcctgtcttgatggcagaagcggttaagaaagtgaatagagggaacggtaagactagtagcagaatactgcttctcaccaaggggcacgtgattctgaccgataccaaaaaaagccaagccaagatcgtcatcgggcttgataatgtggcgggtgtatccgtgacctcactgaaagacggcctattttccctccacctgtcagagatgagtagcgtaggcagcaaaggcgatttccttcttgtctcggagcatgtgatagagctactaacaaagatgtatcgcgcggtactggatgctacccagcgccagctgacagtgaccgtgactgagaaattctctgttcgttttaaagagaatagcgtggctgtgaaggtcgtgcagggacccgccggaggggataacagcaaactccgatacaagaagaaggggtcacattgtctggaggtcaccgtccagtag

SEQ ID NO: 125376 - DNA, 2646 bp, Artificial Sequence
  Description of Artificial Sequence: Synthetic coding sequence
atggatatcgagttcgatttcaaagggtcgcccctggggggagtgattaccaattacctcctggaaaagtccaggctggtcaagcagctgaaaggagagaggaatttccatattttctatcaactgctagcgggcgctgacgaacaattgctgaaggccctcaaactggagcgcgatacaacaggctacgcttacctaaaccacgaggtgtcaagggtggatggcatggacgatgccagctctttcagagccgtgcagagtgctatggcggttattggattttcagaagaagagatcagacaagtacttgaggttacatctatggttctgaagctgggcaacgttctggtggctgatgagtttcaggcctcaggcatcccagcaagtggaattcgggacggtcggggcgtgcgagaaatcggcgagatggtgggtttgaactcagaggaggtcgagagagccctgtgcagtagaacgatggagaccgcaaaagagaaagtagtcacggctctgaacgtgatgcaagctcagtacgccagggatgccctcgctaagaatatatactccaggctgtttgactggattgtcaatcggatcaacgagagtattaaagtgggcatcggagagaagaagaaggtcatgggtgtcctcgacatctatggctttgaaatcctagaagacaacagttttgaacaatttgtcataaactactgcaacgagaagctccagcaggtgttcatcgagatgacactcaaagaggagcaggaggagtacaaacgtgagggaatcccatggactaaagtggattattttgacaatggcattatatgtaaactcatcgaacacaatcagaggggaattttagctatgctcgacgaggagtgcctcaggccgggcgtggtgagcgatagtactttcctagccaagttgaaccagctgtttagcaagcacggccattatgagagcaaggtgacacagaatgcccagcgccaatacgaccacaccatggggttgagttgctttaggatctgtcactacgccggaaaggtgacttataacgtcacatccttcatcgataagaataacgatctgctttttagggacctcttgcaggcgatgtggaaagctcaacatcctcttctgagaagcttgtttccagagggcaaccctaaacaggccagtttaaaaaggcctcctaccgctggcgcgcagtttaaaagctccgtcgccatcttaatgaaaaacctgtactccaagtcaccaaactacatcaggtgcatcaaaccaaacgaacaccagcagagaggacaattctccagtgacctggtggccacccaggccaggtatctggggttgctcgagaatgtgcgggtccggcgggccggttacgcacaccgtcaggggtacggacctttcctggaaaggtacagactcctttctaggtctacgtggccccattggaatggcggcgaccgggagggagttgaaaaagttttaggggaactgtcaatgagctctggagaactggccttcggcaaaacgaagatcttcattcggtcccccaagaccctgttctacctggaagagcagcgccgacttagactgcagcagctcgctaccctaatccagaagatatatagagggtggagatgccggacccactaccaactgatgagaaaaagtcaaattctgatatccagctggttcagaggcaatatgcagaagaaatgctacggaaagatcaaggcttcagttctcctgatccaggcatttgtccgcggatggaaggcccgaaagaactacagaaagtacttcaggagcgaggcagctctcacgctagccgattttatttacaaatctatggtgcaaaagttcctgctggggctcaagaacaaccttccttccaccaatgttttggacaaaacgtggcccgctgcgccctataagtgcctctctactgcgaatcaggagctgcagcagcttttctaccagtggaagtgtaaaaggtttcgtgatcagttgtcgcctaaacaggtggagatcctgcgagagaagctgtgcgcctctgaactgttcaaagggaagaaggcaagttaccctcagtcagtacctatccccttttgcggagattacatcggtctccaagggaatcccaaattgcagaagctgaaaggcggagaagaaggtcccgtgctgatggctgaggccgtgaaaaaagtcaatagagggaatgggaagactagcagcaggatcctgctccttaccaaaggtcatgtgatcttaaccgatacaaaaaagagtcaggctaagattgtgatcggtctcgataacgtagcgggcgtgtcagtgaccagcctgaaagacggcctgttttcgcttcacctcagcgagatgtcaagtgtcggctccaaaggcgactttctgctggtatctgagcacgtcattgaacttttaaccaagatgtaccgcgctgtactggacgccacacaaaggcagctcactgttactgtaacggaaaagttttccgtccgattcaaggagaacagcgtcgcagttaaggtcgtgcaggggcccgccggtggtgataatagcaaactgcgttacaagaaaaagggaagccattgtttggaagtcacagtacaatag

SEQ ID NO: 125377 - DNA, 3411 bp, Artificial Sequence
  Description of Artificial Sequence: Synthetic coding sequence
atggccaaaatggaggtgaagacatcgcttttggataacatgatcggcgtgggagacatggtcctgctggagcccctaaacgaggaaactttcataaacaacttgaagaaacgattcgatcactcggagatctatacatatattggtagtgttgtgatcagcgtcaacccataccggtcactacctatttatagtcctgagaaagtagaggaatacaggaatcgtaatttctatgaactctctccccacatcttcgctttgtccgatgaagcttacagatctttaagggatcaggataaagaccaatgcattttaatcaccggggaatctggagctggcaagaccgaagcctccaaactcgttatgagctatgtagctgcagtatgtggaaaaggggccgaagtcaatcaggtgaaggagcagcttcttcaatctaatcccgtcctggaggcatttgggaatgcgaagactgttaggaatgacaacagctccagattcgggaagtacatggatatagagttcgacttcaagggagaccccctgggaggggtcatttcaaattatctcctggaaaagagtagggtcgttaagcagccccggggcgaacgtaatttccacgttttctatcagctcctttccggggcctccgaggaactgctgaataaattgaaattggagagggacttcagccgctataattaccttagtctggattcagcaaaagtgaatggtgtggacgacgcggcaaacttccggaccgtccggaatgctatgcagatcgtcggattcatggatcatgaggctgaatctgtactggcagttgttgccgctgtcctgaagctgggaaatattgaattcaaaccggagtcccgggtgaacgggctcgatgaaagcaagatcaaggataaaaatgagctgaaagaaatctgcgagctcaccggcatcgatcagagcgtgctcgagcgagcatttagctttcgtactgtagaggctaagcaggaaaaagtctctactaccctgaatgtggcgcaggcctattacgctagagacgcactggcaaaaaatttatacagtcgcctctttagttggttggtgaatcggataaatgagtctattaaagcccaaaccaaagtacgcaagaaggttatgggagtgctggatatctacggcttcgaaatattcgaggataatagctttgagcaatttatcatcaattactgcaatgagaagctacagcagatttttatcgagctgacgctcaaggaagagcaggaagagtatatccgagaagatatcgaatggacacacattgactatttcaacaacgctattatctgtgatcttattgagaacaacacgaacgggatcctggccatgctggacgaagaatgtctgcggccgggcaccgtgactgacgaaacgttcctagagaagcttaatcaggtgtgtgccacccatcagcatttcgagagtcgaatgagcaaatgctctcggttccttaatgacacctctctgccccactcatgctttcgcatacaacactacgccggtaaagtcctgtaccaggtggaaggctttgttgataagaataacgacctgttgtatcgggacctttcacaagcaatgtggaaggcctcccatgcactgataaagtcattattccctgaggggaatcccgcgaaaattaacctgaagcggcccccaactgctggtagccagttcaaagctagcgtagccaccctcatgaagaatttacagacgaagaatccgaactatatcaggtgtatcaaaccgaatgataagaaagcagctcatatttttaacgaggcactcgtttgtcatcagattagatatctgggtctattggagaacgtgagggtccgcagagccggctatgcctttagacaggcgtatgaaccctgtttagaaagatacaagatgctttgcaagcagacctggccgcattggaaaggccctgctaggtctggagtcgaagtgcttttcaacgaattggagattcctgtcgaggaatattcttttggccggtcgaaaatttttatcagaaaccccagaacgctgttcaaactggaggacctgcgtaagcagcgccttgaggatctcgccactttgattcagaagatctaccgaggatggaagtgtcggacgcactttcttctcatgaagaaaagccagattgtgattgccgcctggtataggagatatgcccaacaaaaacgataccagcaaaccaaatcgtctgcacttgtgattcagagttatatccgtggctggaaagctagaaaaatactgcgagaattgaaacaccagaaacggtgtaaggaggcggtaacaaccattgccgcttactggcatggcacccaagctcgtcgggagttacgtcgcctaaaggaagaagcaaggaacaaacacgcgattgctgtgatctgggcgtactggttgggctctaaagcacggcgagaactgaaaaggttgaaagaggaggcgcggaggaagcatgccgtggccgtcatttgggcctattggctcggtctcaaagttaggagggaataccggaaatttttccgcgccaatgctggtaaaaagatatacgagtttacactgcagcgcatcgtccagaagtactttttggagatgaaaaataagatgccctcgctctctccgatcgacaagaactggccgtctcgcccctacctctttctagattccacccataaagagcttaaaagaattttccacctctggcgctgcaagaagtatagagatcagtttacagaccagcagaaattgatctatgaggagaagcttgaggctagtgaattatttaaggataagaaggccctctatcctagctccgtggggcaaccgttccagggcgcctatttagagatcaataagaatccaaagtacaagaaactcaaggacgcaatcgaggagaagattatcatagccgaagtagtcaataagattaatagagcaaatggcaagtccacaagcagaatatttctgttaaccaacaataatttactattggctgaccagaagtctggacagattaagagcgaggtccccctcgttgacgtcactaaagtcagtatgagctcccagaacgatggtttctttgctgtgcatctgaaggagggaagtgaagcagctagcaaaggcgactttttgttcagtagtgatcacttgattgaaatggctactaagctgtacagaactaccctgtcccagaccaagcagaaactgaacattgaaatttcagacgaattcctggtacagttcaggcaggataaggtttgcgtgaaatttatccaggggaatcagaagaacgggtctgtgccgacatgtaagagaaagaacaataggcttctcgaagttgcagtcccatag

SEQ ID NO: 125378 - DNA, 3237 bp, Artificial Sequence
  Description of Artificial Sequence: Synthetic coding sequence
atggccaagatggaagtgaaaacatcgctgctggacaacatgataggcgttggggacatggtgctcttggagccactgaatgaagagacattcataaataatctgaagaagcggtttgatcattctgagatctacacttacatcggaagtgtagtcatctccgtaaatccctacagaagcctgccaatttacagtcccgagaaggtcgaggaatatcgtaatcgtaatttttacgagctgagcccgcatatcttcgcgctttctgacgaagcataccgaagcttgcgtgatcaagataaggatcagtgtatcttgatcacaggcgagagcggcgcaggcaagaccgaagccagtaagctagtgatgtcatacgtagctgccgtgtgcggtaagggagcagaagtgaaccaggtcaaagaacagcttctccagagtaaccccgttctcgaggctttcggaaatgcaaagactgtacgtaatgacaattcaagccgtttcgggaagtatatggacatagagttcgacttcaagggggatccattgggtggtgtcatcagtaactatctgctcgaaaagagtagagtggttaagcaaccccgcggggagaggaatttccacgtcttctatcagttgctgtccggggctagcgaagaactgttgaacaagttaaagctcgagcgcgatttttcacgctataactacctctcactggacagcgctaaggtgaacggggtagacgatgcagcaaacttcaggacagtgcgcaacgcaatgcagatcgtgggttttatggaccatgaggccgaaagcgtgctagctgtagtggcagctgtgttgaagctaggcaatattgagtttaaacctgaatccagagtgaacggactggacgagtccaagataaaggataaaaacgaattgaaggagatctgcgaactcactggtattgaccaaagcgttctggagagagccttttcttttagaactgttgaagccaagcaagagaaggtgtctactacgctgaatgtggctcaagcatactatgccagggacgcattggccaaaaatttatactctagattattttcctggctggtgaacaggataaacgagagcattaaagcccagacgaaagttcggaagaaagtgatgggcgttttggatatctatggttttgagatattcgaggacaactcctttgagcagtttattattaactactgcaatgagaaattgcaacagatctttatcgagctcacactcaaagaggaacaggaggaatatatccgtgaggacattgagtggactcacatagactatttcaataatgccattatctgcgacctgatagaaaacaacacgaacggcattctggctatgctggatgaggaatgtctccgcccgggcacagtgaccgacgagacattcttggaaaaactgaaccaagtgtgtgctacacaccagcattttgaaagcaggatgtcgaaatgctcccggttcctgaatgacacttcactcccccactcctgctttaggatccagcactatgctggcaaggtgttgtaccaggtggaaggtttcgtggataagaataacgatctcctgtatagagacctctcccaagccatgtggaaggcttctcacgccttgatcaagtccctgtttccggagggaaaccctgccaagattaatctgaaacggcccccaacagctggctctcagttcaaggcttcagtcgccacacttatgaaaaatttgcagactaagaaccccaattatatccggtgcattaaacccaacgacaaaaaggccgctcatattttcaacgaggcactcgtgtgccaccaaatccggtacttaggccttctcgagaacgtcagggtaaggcgagccgggtacgctttccgacaagcgtacgagccttgcctcgagcgttataaaatgctgtgcaagcaaacatggcctcattggaagggaccggcgagaagcggtgtagaagtcctgttcaatgaattggagatcccggtagaggaatactcatttggccgttcaaagatcttcattcggaatccgcgaaccctatttaaactcgaggacctgagaaaacagcgcttggaagacctcgccaccttgatacagaagatttaccgggggtggaaatgccggacccacttcctcctcatgaaaaagtcccagatcgtaatagccgcttggtacagacgctacgcccaacagaaaaggtaccagcaaactaagagttctgcactggtgattcagagttacatcaggggttggaaggctagaaagatactacgggagctgaagcatcagaagcggtgtaaggaggctgtgactactatcgctgcttattggcacgggacccaggtgaggcgcgaataccgcaagtttttcagagcaaacgctgggaagaagatttatgaatttactttgcagaggatcgtacagaaatactttcttgagatgaaaaacaagatgccaagtctgtcccctatcgacaaaaattggccctctcgaccgtatctttttctggactcaacgcataaagagctgaagagaattttccacctttggcgatgcaaaaaataccgcgaccagtttacagatcaacagaagctgatttacgaagagaagctcgaggctagtgagttattcaaggacaaaaaggctctgtacccatcctcagtgggtcagcccttccagggggcttacttggaaattaacaagaacccaaaatacaagaagttaaaagatgctatcgaagagaagatcatcattgcagaggtcgtcaacaagatcaaccgtgcaaacggtaaatctacgtctcggatcttcctgcttacgaataacaatctgttgcttgccgatcaaaaaagcgggcagataaaatccgaagtgcccctggtagatgttactaaggtctccatgtcatcgcagaatgatggattcttcgccgtacacctgaaggaagggagcgaagccgcgagcaaaggggattttctgttctcatcggatcaccttattgagatggcaacaaagctttaccgaacaacccttagccaaaccaaacagaagctgaacattgagatcagcgatgagtttctggtccagtttagacaagacaaagtgtgtgtcaaattcatacagggcaaccagaagaatggctccgtgcctacttgcaaaagaaagaacaatagactactggaagttgccgtgccttag

SEQ ID NO: 125379 - DNA, 3324 bp, Artificial Sequence
  Description of Artificial Sequence: Synthetic coding sequence
atggctaagatggaagtgaagacgagcctgctggataacatgataggggtcggagacatggttctcctggaaccactgaatgaggaaacattcatcaacaacctcaaaaaaaggtttgatcatagcgagatttatacctacataggcagcgttgttatctcagtgaatccataccggtccctccccatctatagcccagaaaaggtcgaggaatatcgaaaccgcaacttttatgagctgtccccccatatctttgcactgtctgacgaagcatacagaagcctcagggatcaagataaggatcagtgtatcctcataacaggggagtccggggcgggcaaaactgaggctagtaagttggtcatgagttatgtcgccgccgtgtgtggcaaaggtgccgaagttaatcaagtcaaagagcaacttctgcagtcaaatccagttctggaggccttcgggaatgccaagaccgtgcgcaacgataatagttcccgatttggcaagtacatggatatcgagttcgacttcaaaggtgaccccctcgggggcgtaatcagtaattatctcctggagaaatcccgggtagtaaagcagccacgtggcgagcggaatttccatgtcttttaccagctgctgagtggggcctccgaggagttattgaataagttaaagctcgaaagggattttagcagatacaactacttaagtctagacagcgctaaggtgaatggtgtagatgacgctgccaactttcggaccgtcagaaacgctatgcagattgtggggttcatggaccatgaggcagaaagcgtactagccgtggttgcggctgtgctgaagttggggaatattgagttcaagcccgagagtcgcgtaaacggtttagacgaatccaagattaaggacaagaacgagcttaaggaaatctgcgaactcactgggatcgaccagagcgtcctcgagcgcgctttttctttccgcactgtggaggcgaagcaggaaaaggtgagtaccaccctcaatgtcgctcaggcttactacgctcgggacgcactcgcaaaaaatttgtactccaggctgttcagttggttggttaatcgcatcaatgaatccataaaggcccagactaaggtacgcaaaaaggtgatgggtgtgctggatatctacggattcgaaattttcgaggataactcattcgagcaatttattattaattactgtaacgaaaaactgcagcagattttcattgaactgactcttaaagaagaacaggaagagtacattcgagaggatatcgaatggacacacattgattattttaacaatgcaatcatttgtgacttgatcgaaaacaataccaatggcatcctcgcaatgcttgacgaagaatgcttgcgaccaggcactgtgactgacgagacatttctggaaaagctgaatcaggtgtgcgcaactcaccagcatttcgaatcaaggatgtccaagtgcagtaggttcctcaatgacacttccctgccacacagctgctttaggattcagcactatgcagggaaggtgctgtaccaagttgaaggattcgtagataagaataacgatctgctctaccgagatctgagccaggccatgtggaaagcaagtcatgcacttattaagtccctgtttcctgagggcaatcccgccaagattaatctgaagaggcctcccacggctgggtcccagtttaaggcctccgtggcgaccctgatgaaaaacctgcagaccaaaaaccctaactacatcagatgcatcaaaccaaatgacaaaaaagccgctcacatttttaatgaggctcttgtgtgccaccaaattaggtacctcgggcttctcgagaacgtacgggtcagacgggccggatacgcgttccgacaagcatacgagccatgccttgaacgatataaaatgctctgtaagcagacatggccacactggaaaggtccagcaaggtcaggagtagaggtgctgttcaacgagctggaaattcccgtggaggaatatagcttcggacggagtaagattttcattaggaatccaaggaccctgttcaagctggaagacctacgaaagcagcggctagaagacctagcaaccttgatacagaagatctacaggggatggaagtgtcgcacccatttcttgctcatgaaaaaatcccagattgtgattgctgcctggtaccggcgatacgcacagcaaaaaaggtaccaacagaccaagtccagcgccctcgttatccagtcttatatcaggggctggaaagcccgcaagatattaagggaacttaagcatcaaaaacgctgtaaggaagccgtcacaaccatagcagcgtactggcacgggacccaggctcgacgggagcttaagaggctgaaggaggaggctcgtcgtaagcacgccgttgctgtgatttgggcatactggttgggcctcaaagtgagacgggaatatagaaagtttttccgcgccaacgccggtaaaaagatctacgaatttactttgcagcggatcgtccagaagtactttttggagatgaagaacaagatgccgtctctgagcccaatcgataagaattggccgtctcgtccatatctttttctcgattcaacacataaagaattgaagcgtatcttccacctgtggaggtgcaaaaagtacagagaccagttcactgaccagcaaaagctaatctatgaggagaaacttgaggcttctgaactgtttaaagacaagaaagccctatatccatcaagcgtcggccagccatttcagggggcctatctggaaattaataagaatcccaagtataaaaaactgaaagacgccatcgaagagaagatcatcatcgcagaggtcgtgaacaagataaatcgagccaacggtaagagtactagtaggatatttttactgaccaacaacaacctcctcctcgccgatcaaaagagcgggcagattaagtccgaggtgcctctggttgacgttactaaggtgagcatgagctcgcagaacgatgggttttttgctgtgcacctgaaagaaggttcagaggcggcttccaagggcgacttcctgttttcatcggatcatctgattgagatggcaaccaagctttatcgcactacactgagccagacaaaacaaaaactcaatatcgagatctccgatgagttcctggtgcaatttagacaggataaagtgtgtgtgaagtttatccaaggcaatcaaaaaaacggctccgtgcctacgtgcaaacggaagaacaatcgcctgctagaagtcgccgtaccctag

SEQ ID NO: 125380 - DNA, 3411 bp, Artificial Sequence
  Description of Artificial Sequence: Synthetic coding sequence
atggccaaaatggaagttaagacaagcctgcttgacaacatgatcggtgtcggagacatggttctcctggaacctctgaatgaggagacattcattaataacctgaagaaacgattcgatcacagcgaaatctatacatacattgggtcggttgtgatctccgtcaacccttatagaagcctgcctatatatagccccgaaaaggtagaggaatatcgcaaccggaacttttacgagttgagtccccatatctttgcactgagcgacgaagcctacaggtcactaagagatcaggataaggaccaatgcatcctgatcaccggggaatcaggagccgggaaaactgaggctagcaaactagtaatgagctacgtggccgctgtttgtggcaaaggggccgaagtgaatcaggtgaaggaacaattattgcagagtaatccagttctggaggctttcggtaacgctaagaccgtaagaaacgataatagcagtaggtttggcaagtacatggacatagaattcgatttcaagggagaccctctcggcggcgtgatatccaattatcttctggagaaaagtcgcgttgtgaaacaacctcgaggagaaagaaattttcatgtgttttaccagctgttgtccggcgcttctgaggaactcctgaataagcttaaattggagcgcgacttctctcggtacaactacctttcactggacagcgctaaagtgaatggtgtcgatgacgctgcaaattttcgtacagtgagaaatgctatgcagatagtgggcttcatggatcacgaagcggagtccgtactggcagtcgtcgccgctgtgctgaagctaggcaatatagagttcaagcccgagagtcgagtaaacggcctcgatgaaagcaagatcaaggataaaaatgagctgaaagagatctgtgaactcactggcattgaccaaagcgtcctggaacgggcctttagtttccgcacggttgaggcgaaacaggagaaggtatccactacactgaacgtcgcacaggcctattacgcacgtgatgcactcgcaaaaaacctgtatagccgcctctttagttggctcgtgaacaggatcaacgagtcaatcaaggcccaaactaaagtgcgcaagaaagtcatgggcgtactggacatatatggtttcgaaattttcgaagataatagcttcgagcagtttattattaactattgtaacgagaagctgcaacagattttcatcgaacttactctgaaagaggagcaggaggagtatatacgagaggacattgagtggacccacattgactatttcaacaacgctattatatgcgatttgatcgaaaataatacaaacggcattctggcaatgctggacgaagagtgcctgcgacccggtacagtaactgacgaaacatttcttgaaaagctgaaccaggtctgcgctactcatcagcactttgaaagcagaatgtccaagtgttctaggttcttgaatgatacaagtcttccccactcctgttttcggatccagcattatgccgggaaggtcttgtatcaggtggagggtttcgttgataaaaataatgatctgctttatcgggatttgtcccaggccatgtggaaggcctcacacgccctgatcaagtcattatttccagaaggaaatccggcgaaaattaacctgaagcggcctcctactgccggatcccagtttaaggcatccgtcgccacgctcatgaagaaccttcagacaaaaaatcctaactatattcgatgcatcaagcccaacgacaagaaagccgcccacatcttcaacgaagcccttgtttgccaccagattcggtacctgggcctgctggaaaacgtccgcgttcgaagggccggatatgccttccgacaggcttatgaaccctgcctggagcgctacaagatgctttgtaaacaaacctggccgcactggaaaggccccgcaaggagcggtgtggaagtgctgttcaatgagctggaaattcccgttgaagagtatagctttggtcgatctaagatatttatccggaacccaaggactctgtttaagcttgaagatttaagaaaacagcggctggaagacctggctaccctgattcaaaagatttatcggggttggaagtgtcgtactcactttctcctgatgaaaaagtcccagatagtgattgcagcatggtaccgaagatacgcacagcagaagcggtaccagcagacaaaatctagcgcactggtgattcaatcttatatcagaggatggaaggcaagaaagattctgcgggaattgaagcatcagaagcggtgtaaggaggcagtaactaccatcgccgcttactggcacgggacacaggccaggcgggaactacgccgtcttaaagaggaagccagaaataagcatgctattgctgttatctgggcctactggcttggaagcaaggcccgaagagagttgaaaaggctgaaggaagaggcccgacggaagcatgcagtggctgtcatttgggcatattggctcggtttgaaggtgcggcgggagtatcgcaaattttttagggctaatgccggaaagaagatctacgaattcacactccagcgcatcgtgcaaaagtattttctggaaatgaaaaataagatgccttccctaagccctatcgacaaaaactggcctagcagaccatacctgttcctggattcaacccataaggagctaaaacgtatcttccacctctggcggtgtaagaaatacagggaccagttcacagaccagcagaagctcatttacgaggagaaactcgaggctagcgaactgttcaaagacaaaaaggccctgtacccctcctctgtgggccagccattccaaggagcctatttagagatcaataagaaccctaagtacaaaaaactgaaggatgctattgaggagaagattataattgcggaggtggtcaataagatcaacagggctaacgggaagtctaccagccgaatcttcctcctgacaaataataacctgctactggctgatcaaaaaagcgggcagataaagtctgaagtgcctttagtggatgttactaaggtgagcatgagcagccagaatgacggatttttcgctgttcacctgaaagaaggctctgaagccgcgagcaagggtgacttcctgttttccagcgaccacctgatcgagatggctacaaaactgtatcgaaccaccctgagccagaccaagcagaaactgaacatcgaaatcagcgatgagttcttagtgcaattcaggcaggataaagtctgcgtgaagtttatccaagggaatcaaaaaaatggttctgtgcccacctgcaaacgaaagaacaaccggctcctggaagtcgccgtgccatag

SEQ ID NO: 125381 - DNA, 492 bp, Artificial Sequence
  Description of Artificial Sequence: Synthetic coding sequence
atggctaagatggaagtgaagacttcactactagacaacatgataggcgttggggatatggtgctacttgagccattgaacgaggaaacttttatcaataatctaaaaaagaggtttgaccattctgagatatacacctacatcgggagcgtggtcatatccgtgaacccatatcgcagcctccccatctattctcccgagaaagtggaggaataccggaaccggaacttctacgagctgagcccacacattttcgcgctgtcagacgaagcatacagaagcctgcgagaccaggataaagaccaatgtatcctcatcaccggcgaatcaggcgcgggcaagaccgaggcatccaaattggtgatgtcatacgtcgccgctgtttgtgggaagggagcagaagtgaaccaggtaaaggagcagttacttcagagtaacccagtcttggaggccttcggcaatgcaaagacggtgcggaacgataactcttag

SEQ ID NO: 125382 - DNA, 252 bp, Artificial Sequence
  Description of Artificial Sequence: Synthetic coding sequence
atggccaagatggaggtaaagactagtctgctagacaacatgatcggcgtcggtgacatggttctcctggagccccttaacgaggaaacttttatcaacaaccttaaaaaacgctttgatcatagcgagatctacacatacattggctcagtggtgataagcgtcaatccctacaggtctttacctatctactctcctgagaaagtcgaagaatacagaaatcgcaacttctacgaactctcccctcattag

SEQ ID NO: 125383 - DNA, 450 bp, Artificial Sequence
  Description of Artificial Sequence: Synthetic coding sequence
atggccaaaatggaagtgaagacctccctccttgacaatatgattggcgttggcgacatggtgttactcgagccactcaacgaagaaacctttataaacaatcttaagaaacgatttgatcacagcgaaatatacacatatatcgggtccgttgtaatcagcgtgaatccgtacagatccctgccgatatactcccctgaaaaagtggaggaatatagaaacaggaacttctacgagctgagccctcacatattcgccttgagcgatgaggcgtatagatctctgagagaccaggataaggatcaatgcatcttgattacgggggagagtggggcagggaagactgaggcgtctaagctcgtgatgagctatgtggcggctgtgtgcggcaaaggggccgaagttaatcaggtgaaggagcagctgttgcagagtaaccccgtgctctag

SEQ ID NO: 125384 - DNA, 1146 bp, Artificial Sequence
  Description of Artificial Sequence: Synthetic coding sequence
atgaaaaagtcccagatcgtcattgccgcctggtatagaaggtacgcccagcagaagcggtaccagcagaccaaaagttctgctctcgtcattcagagctacatcagggggtggaaggcccgtaagatcctgcgcgagttgaagcatcagaagaggtgtaaggaggcggtgacaacaatcgccgcgtactggcacgggacccaagcccgccgtgaactaaaacggttgaaagaagaggccaggagaaagcatgccgtggcagtgatttgggcttattggctgggtctcaaggtgcgaagggaatataggaagttttttcgggcgaatgcggggaaaaaaatatatgagtttacactgcagagaatagtgcaaaagtactttctggaaatgaaaaacaaaatgccttccctctcgccaattgacaagaattggcccagcagaccttaccttttcctcgattctacccataaggagctgaaacgcatttttcatctgtggcggtgcaagaaatatagagatcagtttactgaccagcaaaaactgatttacgaggagaagctggaagcctctgaactgttcaaagataaaaaagccctataccccagcagcgtagggcagccttttcagggtgcgtacctggaaatcaacaagaatcccaaatataagaagcttaaggacgcgatcgaggagaagatcattatagccgaagtcgtgaacaagatcaatcgagccaatggaaagtctaccagcagaattttcctgctgacaaacaacaatctcctgttggccgatcagaagagcgggcagattaaatcagaagtgcctctggttgatgtgactaaggtgtcaatgtccagccaaaatgacggttttttcgccgtccatctgaaggaaggatctgaagcagcttccaagggcgacttcctctttagttccgatcacttaatcgagatggccactaagttgtatagaaccacactgtcacagaccaagcaaaaactcaatattgagatctctgatgagttcctggttcagtttcggcaggataaagtctgcgttaagttcatccagggtaatcagaagaacggatcggtgccgacatgcaagcgcaagaataatcgactgttggaggtggccgtgccttag

SEQ ID NO: 125385 - DNA, 924 bp, Artificial Sequence
  Description of Artificial Sequence: Synthetic coding sequence
atggctaagatggaagtgaaaacctccctgctggataacatgatcggcgtgggcgatatggttcttctggagccactgaacgaggagacttttatcaacaatctcaagaagagatttgaccattcagagatctacacgtatattggaagcgtcgtgatctccgtaaacccataccgctcactgccgatctattcaccagaaaaagtagaagaatacaggaaccggaacttttatgaactgtccccacacatatttgccctctccgatgaagcctaccggtcccttcgggaccaggacaaggaccaatgcatcttaatcacaggggaaagcggggctggcaagactgaggctagcaagctggtgatgtcatatgtcgccgctgtttgcggcaagggagcagaggttaatcaggttaaagaacagctccttcaatctaaccccgtcttagaagctttcggtaacgctaaaactgtccgtaacgacaattccagtaggtttggtaaatacatggatatcgaattcgatttcaagggcgacccactgggaggcgtaatatccaattatctgttagaaaaatcacgcgtggtaaagcagcctaggggcgaaagaaattttcacgtgttttatcagctgctaagcggggccagcgaggagctcttgaacaaactcaagctcgagcgggacttctctagatacaactatctaagcttagactccgcgaaagttaacggcgtggatgatgctgccaatttccggactgtacggaacgctatgcagatcgttggattcatggatcacgaagccgagagcgttttggcagtcgttgccgctgtactgaaattgggcaacatcgagttcaaaccggagtcccgagtgaacgggctcgatgagtccaagatcaaggacaagaatgagtccaagtag

SEQ ID NO: 125386 - DNA, 912 bp, Artificial Sequence
  Description of Artificial Sequence: Synthetic coding sequence
atggctaagatggaagtgaaaaccagcctattggacaatatgataggagttggcgacatggtgctgctagaaccactgaatgaggaaacattcatcaataatctgaaaaagcgctttgatcactcagagatctacacttatattggtagcgtcgttatcagcgtcaatccatatcggagccttccaatttattccccagagaaggtggaggagtacagaaatcgcaatttctatgaactcagccctcatattttcgcactgtctgacgaggcctacagatctctgcgggaccaggacaaagatcagtgtatcctgatcaccggcgaaagcggagccggcaagactgaggccagcaaactggtgatgagctatgttgctgccgtatgtgggaagggagccgaggtaaaccaagttaaggaacagctgctgcagtctaatcctgtcttggaagcgttcggaaatgccaagaccgtgaggaatgataattcttcaaggtttggcaaatacatggatatcgaattcgatttcaaaggtgatcctctgggtggagtgatctcaaattatctacttgagaaaagccgggttgtcaaacaacccaggggcgagaggaactttcatgtcttctatcagctgctgtccggggcctctgaagaacttttaaacaagttgaaactcgagagggacttctctaggtataattacctgtccctggactctgcaaaggtcaacggggtggatgatgcagcaaactttcgtacagtgcgcaacgctatgcagattgtgggttttatggatcatgaggctgaatccgttttggcggtggttgctgcggtgttaaaactgggcaacattgagttcaaacctgagagccgtgtgaatgggctggatgagtcaaaaatcaaggataaatag

SEQ ID NO: 125387 - DNA, 3192 bp, Artificial Sequence
  Description of Artificial Sequence: Synthetic coding sequence
atggctcttcaggtggagcttgtccctacaggagagattatccgggtcgttcacccacatagaccatgtaaactggcactggggtcggacggtgtgagggttacaatggaatcagcgcttactgctcgagaccgggtgggcgtgcaagatttcgtcctgctggagaacttcacgagcgaagcagctttcattgagaatctcaggcggcgctttcgcgagaacctgatctacacctacattggcccagtcctggtgagtgtaaacccataccgtgaccttcagatctacagtaggcagcacatggaacgctataggggtgtttccttttacgaagtgcctccacacttgttcgccgtggccgacaccgtttaccgggccttgcggaccgagagacgggaccaggccgtgatgatctccggggagagcggggctggtaaaacagaagcaacgaaaaggctccttcaattttacgctgagacctgccccgcccccgagcggggcggggcagtcagagataggctgttacagtccaatcctgtccttgaagccttcggaaatgcgaaaacactgcggaacgacaatagctcccgtttcggtaaatatatggatgtgcaatttgacttcaaaggggcccctgtgggtggtcacatactttcttacctgctcgagaagagccgggtggtgcaccagaatcacggcgagcggaactttcacattttttaccagctcttggagggaggagaagaggagacactccgcaggctcggcctggagcggaatccacagagttacctttacctggtaaaaggccagtgtgccaaggtgtcctccatcaacgataaatctgactggaaagtggtgaggaaggcgttaactgtcatcgattttacggaggacgaggtggaggatttactgtctattgtggcgagcgtcttgcatctaggaaacatacatttcgctgccaatgaagaatccaacgcgcaggtcaccaccgagaaccaattaaaatatctgacccgcttactgtctgtggaagggtctaccctacgagaggcacttacacaccgaaagattattgcgaagggagaggagttactgtcccctctgaatttggagcaggcagcttacgctagagatgctttggctaaggccgtctactcacgcaccttcacttggttagtgggcaagatcaatcgcagtctcgcctccaaagatgtcgaaagtccttcctggcggtcaactaccgtgctgggactcctggatatctacggattcgaagtgtttcagcataactcttttgagcagttctgcattaactattgcaacgaaaagctgcagcaactcttcatcgagctgacattgaagagtgaacaggaagagtacgaggccgaaggaatagcctgggaacccgtgcagtacttcaacaacaagattatctgtgacttagtggaagagaaatttaaaggcatcatcagcatcttggacgaggagtgcctgagaccgggggaagcaaccgaccttaccttcttggagaagcttgaggacaccgtgaaacaccacccacatttcctgacccacaaactggccgatcagcgcaccaggaaaagcctgggcaggggagagttccgacttctgcactatgctggcgaggtgacctatagcgtaactggcttcctcgacaagaataacgacctcttattcagaaacttaaaggagaccatgtgctcttccaagaatcctattatgtcccagtgcttcgataggtccgaactgtctgataagaaaaggccagaaactgtcgcaacgcagtttaagatgtcccttttgcagttggtggagatcctgcagagcaaggaacctgcctacgtgcgatgtataaagcctaatgatgccaaacagccggggcgttttgacgaggttctgattagacaccaggtaaagtatctgggcctgttggagaacctgcgcgtccgcagggccggctttgcataccgccgaaagtacgaagcattcctgcagaggtataaatcactatgtccagagacgtggccaacttgggcaggcaggccccaggatggcgtggcggtgttagtgaggcatctcggatacaaaccagaggagtacaaaatgggcagaacaaagatcttcatccggtttcccaaaactttgtttgccacagaagacgcgctggaagtgaggagacagtctctggctacaaaaatccaggccgcatggagaggatttcactggaggcagaagttcctgcgggtcaaaagaagcgctatctgtatacaatcctggtggagaggaacattaggtcgacggaaagccgctaaacgcaagtgggcagcccagacgattcggcggctgattagagggttcgtgcttagacatgcaccacgctgtccagaaaacgcattctttctggatcatgtgcggaccagttttctcttgaacctgcgtcgccagttgccgcagaatgtattggacacaagttggcccaccccgcctcccgccctcagggaagctagcgaactcctgcgggaactctgtatcaaaaacatggtgtggaaatattgtaggagtatttcccccgagtggaaacagcaactgcagcaaaaggccgtggccagtgagatctttaagggcaaaaaggataattatccccagtcagttccgaggttatttatcagcactaggctgggaactgacgagatctctcctagagtgctgcaggcgcttggaagtgaacccattcaatatgcggtgccggtggtaaagtatgacaggaagggatataaaccacggagccgccagcttttgctcacaccgaacgctgtagtgatcgtagaagacgcaaaggtcaaacagaggatcgattatgctaaccttactggcataagcgtttcgagtttatctgacagtctttttgtactgcacgtacagagagccgacaacaagcagaagggcgatgtggtgctacagagcgatcatgtgatagagactttgactaagactgccctgagcgccaaccgggtcaatagcatcaatattaatcagggttcaatcacgttcgccggaggacccggccgggacgggacaattgactttacaccgggatcagagctgctcataactaaagctaaaaatggccacttggccgtggtagcgccaaggctgaattctcgctag

SEQ ID NO: 125388 - DNA, 3087 bp, Artificial Sequence
  Description of Artificial Sequence: Synthetic coding sequence
atggagagtgcgctcaccgctagagatcgggttggcgttcaggactttgtattgctggaaaacttcacaagcgaggctgcgttcatcgagaacctccgtaggcggttccgggagaatctcatctacacatacattggccccgtgcttgtctctgtcaacccatatcgggacctgcagatatactctagacagcatatggagcggtatcggggcgtctctttttacgaggtacctcctcatctgttcgcggttgccgatacagtgtatagagcactgcggactgagaggcgagatcaggccgtgatgatctcaggcgaatccggcgccgggaaaaccgaagctacaaaaaggctgttgcagttctacgccgaaacctgtcccgcccctgaaaggggcggggcagtcagagatagactcctccagagcaatcccgttctcgaagctttcggaaatgcgaaaactcttcggaatgacaactcttcccgttttggtaagtatatggatgttcagttcgacttcaaaggggcacctgtgggtggacatatcttgagttaccttctggagaagtcccgagtggtgcaccaaaaccacggcgaacgcaatttccacattttttaccaactgctggaggggggggaagaagagacactcaggcggttgggactggagagaaacccgcagtcttatctctatttggtgaaaggccaatgcgccaaggtcagttctatcaatgacaagtccgattggaaggttgtgcggaaggccctcactgtgattgattttaccgaagatgaagtggaggacctcctaagcattgtagccagtgttctccacctaggtaacattcattttgccgcaaatgaggaatcgaatgctcaggttaccactgaaaaccaactgaaatacctgactcggctgctatccgtcgagggcagcacactccgggaagctctcacccatcgaaagatcatcgcaaagggggaagagctgctctcaccccttaatcttgagcaggcagcctatgcccgcgatgccctggctaaggccgtgtattctcgtacctttacctggctcgtgggaaagattaatcggtcacttgcaagcaaagatgtcgaatctccgagctggcgctcaaccacagtcctcggtctgctggacatctacggtttcgaggtcttccagcacaatagctttgagcagttttgcattaattactgcaacgagaagctgcagcagctgtttatcgagttgactctgaagtcagagcaggaagagtacgaggcagaaggcattgcatgggaaccggtgcagtacttcaataataaaataatatgtgacttagtagaggagaagttcaaaggcatcatcagtatacttgatgaggagtgtctgagaccaggcgaagccacagatctaaccttccttgaaaagctggaagacaccgtgaagcatcaccctcatttcttgacccataagctggctgaccagagaacccggaaaagcctgggcagaggcgagttccgcctgctgcattatgctggcgaggttacgtattccgtcaccggtttcctagataaaaacaatgaccttttgtttagaaacttgaaggagacgatgtgttcatccaaaaatcccatcatgagccagtgctttgatcgatccgaactgtctgataaaaagagaccagagacagttgccacccagtttaagatgtctctgcttcagctagtggaaatcctgcaatctaaggaaccggcctacgtgcgttgtattaagcctaatgatgcaaagcagcccgggcgatttgatgaagtgttgatcaggcatcaggtgaaatacctgggattgctagagaaccttcgcgtgaggcgggctggtttcgcctacaggcggaagtatgaggcctttctgcaacggtacaagtccttatgccctgaaacgtggccaacctgggctggacggccacaagacggggtggccgtgcttgtgcgtcacctgggatataagccagaagagtataaaatgggcagaacgaagatcttcattagattccccaaaacactcttcgcgactgaggacgcactggaagtccggaggcaaagtcttgcgacaaaaattcaggccgcttggagaggattccattggcggcagaaatttttaagagtaaaaaggagcgcaatctgcattcagtcttggtggaggggaaccctcgggagacgaaaggccgcaaagcggaaatgggctgcacagacaattcggcggctaataagggggttcgtccttcggcacgccccccggtgtcccgaaaatgcatttttcttggaccatgtcaggactagcttcctcctaaatttgaggagacagctgccccagaacgttctagatacctcgtggcccacacctccccccgctcttagggaggcctccgaactgttgcgcgagctgtgcattaagaatatggtttggaagtattgcagaagcattagtcccgaatggaagcagcaactccagcaaaaggcagtggcctcagagatctttaaggggaaaaaggacaattatccccagtctgtgccaaggttattcatatccactcgcctggggacagatgagattagcccaagagtactgcaggccctcggctctgaacccatacaatatgcggtgccagtggtgaagtacgacagaaaaggatacaagcctaggtcccggcagttgctcctcacgcccaatgctgtcgtgatcgtcgaagatgccaaagtgaaacagcgaattgactatgctaatctgacaggaataagcgtttcctccttatccgattccttatttgttttgcacgttcagcgggccgataataagcagaaaggtgacgtagtgcttcaaagtgatcacgtaatcgagaccctgactaagacagcgttatccgcgaaccgcgtgaacagcattaacatcaatcagggcagcatcacattcgccggcgggccaggccgggatggcacgattgacttcactcccgggtccgagcttctgatcaccaaggccaaaaacggccatcttgctgtggtagcacctagattaaactccagatag

SEQ ID NO: 125389 - DNA, 3135 bp, Artificial Sequence
  Description of Artificial Sequence: Synthetic coding sequence
atgcggtacagagcctccgcccttggctcagacggcgtgagggtgaccatggagagcgcactgaccgcgcgagacagggtgggggtgcaggactttgtgctgttggagaattttacctcagaagcggcttttattgagaatctcaggcggaggtttcgggagaacttgatctatacatacatcggcccagtgttagtcagcgtgaatccgtatcgggatctgcaaatatatagtcgtcagcatatggagaggtatagaggcgtgagtttctatgaagtgcccccacacctgttcgccgtcgccgataccgtctacagagcactccggacagagcgcagagaccaggctgtaatgatctcaggcgaatcaggcgcaggcaaaacagaggccactaagagactcctccagttttacgccgagacttgcccagcgccggaacggggcggcgcagtgcgggatcgtctgcttcagtccaacccggtgctcgaagcattcggaaacgccaaaaccctgcggaatgacaattcttcaagattcggaaaatatatggacgtccaattcgattttaagggcgccccagtgggcggacacattttgagctatcttctcgagaagtctagggtcgtgcaccagaaccatggcgagagaaactttcatatcttttatcagctcctggaagggggggaggaggagaccctgcggcggctcggactggagcggaatccacaaagctacctctacctggtaaaggggcagtgtgctaaggtctctagtataaacgacaaatccgactggaaggtggtgaggaaagccctgacagtcatcgatttcactgaggatgaagtggaagaccttcttagtattgtcgcaagcgtcttacacttaggtaatatccattttgccgcaaatgaggagtctaacgctcaggtgacaactgagaaccagcttaaatatcttaccaggttactgagcgtggagggttccacgctgagagaagctttgacccatagaaaaattatcgcaaaaggagaggagctacttagtcccttgaatctagaacaggcagcatacgccagagacgcgctggccaaggctgtctacagtcggacttttacttggcttgtgggaaaaattaatcgctcactagcctctaaagacgtggagtctccctcatggaggagcacaacagtgctcggcctgctggacatttatgggttcgaggtctttcagcacaattcattcgagcaattctgcataaactactgcaatgaaaagcttcaacagttgttcatagagttaaccctgaaatcagagcaggaagaatacgaagccgaggggatagcatgggagccagttcagtattttaataacaagatcatttgcgatttagtggaggagaagtttaagggtattatctccattctcgacgaagagtgcttgaggcctggagaagccaccgacctgaccttcctggagaagctggaagacactgtcaagcaccacccgcattttctgactcataaactggccgaccagcgaactcgcaagtctctcggccggggcgagttccggctgcttcattacgccggcgaggttacgtatagtgtgactggctttcttgataagaataatgatctgctgtttcgcaacctcaaggagaccatgtgctctagcaaaaatccaatcatgtcccagtgttttgacagaagcgagctgtccgacaagaagagaccagagactgttgctactcagtttaaaatgagccttttgcaattggtggagattctccagtctaaagaacccgcctacgtaaggtgcattaagccgaatgacgctaagcagcccgggaggtttgatgaagtactgattagacaccaggtgaaatacctgggactgctcgagaacttaagagtacgccgcgccgggtttgcatatagaaggaagtacgaagcatttctccaacgctataagtccctgtgccctgaaacgtggcctacgtgggctggaaggccacaagacggtgttgccgtcttggtacgacatttgggatataagccagaggagtataagatgggacgaaccaaaatcttcattaggttcccaaagacacttttcgccaccgaagatgccctagaggtaaggcgccagagcttagccacgaaaattcaggctgcctggaggggcttccattggcggcaaaagttcctccgggtgaaaagatctgcaatttgcatccagagttggtggagggggactttagggcggaggaaagccgcgaaacgaaaatgggctgctcagacgatcagacgtcttatccgcggttttgtactgcggcacgctccaagatgccctgagaacgctttttttctggaccatgttcggacaagtttcttactgaatcttaggcggcagctcccacagaatgtcctagacacgagctggcccacacctccgccagcactgagggaggcttccgaactcctcagagagctgtgcatcaaaaacatggtatggaagtattgtaggtctatctctcccgagtggaaacagcagctgcagcagaaggccgtcgcttcagaaattttcaaagggaagaaggacaactacccgcagtcagtcccaaggttgtttatctctactaggttgggcacagatgagataagtcctcgagtactccaggcgctcggaagcgagccaatccagtatgcagtgcccgtggtgaagtacgaccgaaagggctataagccgaggagtcggcagctgctgttgactccaaatgcagttgtgatcgtagaagacgcaaaagtgaagcagagaatcgactatgccaatctgaccgggattagcgtgagtagcttatctgactccctatttgtactgcacgttcagagggccgataacaaacaaaagggtgacgtcgtgctgcagagtgatcatgtgattgaaactctgactaaaaccgcgctaagcgccaatcgggtaaactctattaatatcaatcagggatctattaccttcgcgggcggacctggacgcgacggaactatcgattttacacctggcagcgagctgttgataacgaaagcaaagaacgggcacttagcggtcgttgcgccacggctaaattctcggtag

SEQ ID NO: 125390 - DNA, 2418 bp, Artificial Sequence
  Description of Artificial Sequence: Synthetic coding sequence
atggaaagcgctctgaccgcacgtgatagggttggtgtgcaggacttcgttctcctggaaaactttacctcggaggctgcttttatcgaaaatctgcgcaggagatttcgagagaacctcatttatacttatatcggccccgtcttggtgagcgttaatccatatagggacctgcagatttactcccggcaacacatggagagataccgcggcgtgtctttctatgaggtgcctccgcacctatttgctgtcgcagatacggtgtacagagccctcaggactgaacgccgagaccaggctgtcatgattagcggggagtcgggcgctggcaaaacagaggccacaaaacgactactccagttctacgctgagacctgccctgctcctgaaaggggcggggcagtccgggaccgtctcctacagtcaaatcctgtcctggaagcctttggtaacgctaagacactgaggaacgataattcttctcgctttggcaagtacatggatgttcagttcgactttaaaggggcccccgtcggagggcacatcctctcatatctattggagaaatcaagggtggtacaccagaatcatggagaaaggaatttccatatcttttatcagctgctcgagggcggagaggaagagaccctccggagattgggactcgaaaggaaccctcagagctacctgtacctcgtgaaaggccaatgcgctaaggtgtcctccataaatgataagagcgactggaaagtcgttaggaaagctctgacggtgatagatttcacagaggatgaagttgaggacttgttgagtatagtagcttcagtcctgcacttaggaaacattcatttcgctgctaacgaggagagtaatgcccaggtgaccaccgagaaccaactgaagtacctcaccagactgctgtctgtggagggatccacactgcgcgaagcacttacccatcgcaaaatcattgccaaaggagaggagttgctttcccccttgaatttagaacaggctgcatacgcacgggatgcgctggcaaaggccgtgtactctagaacattcacttggctggttggcaaaattaacagaagccttgccagcaaggatgtggagagccctagctggaggtcaaccaccgtgctggggcttttggacatctatggatttgaggtgttccagcataactcatttgagcagttttgcattaactactgcaacgaaaagctgcagcagctttttatagaactgacattgaaaagcgaacaggaggagtacgaggccgaggggatcgcctgggaacccgtgcagtacttcaataacaaaatcatctgcgacctcgtggaggagaagttcaagggcattatctcgatcctggatgaagagtgtcttcggcccggggaggctacggacctgactttcctggagaaattagaagatactgtgaaacatcacccccacttcctgactcacaagctcgcagaccagcgcacacgcaagagcttgggcaggggcgaattccggttgctgcactatgctggagaggtgacttactctgttactggctttctcgataaaaataacgacttgttatttaggaacctaaaggagacaatgtgcagttcgaagaacccgataatgtcgcaatgctttgataggtcggaactgagcgataaaaagaggcccgaaacggtcgccacccaattcaagatgagccttctgcagctggtggaaatcctgcagtctaaagaaccagcttatgtgcggtgcattaaacccaatgatgctaagcagcccggccggttcgatgaagtcttgattaggcaccaggtgaagtacttggggctcctcgagaatttgcgggtgcgaagggcgggctttgcgtaccgacggaagtacgaggccttcctccagagatacaaatcgttgtgccccgagacttggcccacttgggccggacggccccaggatggagtagcggtcctggtccgtcacctgggctacaaacctgaagagtacaagatggggagaaccaaaatttttatcaggttccccaaaacactgttcgccaccgaggatgctctggaggtgagacggcaatcgctcgcgaccaaaatccaggcagcctggcgggggtttcactggaggcagaaatttctccgtgtaaagaggtccgcgatttgtatccagagctggtggcgcggaacgctgggacgaagaaaggccgccaaagaggtgggaggaacagaccatcccgcagcccatccacgcctgcggccggcacctcgccccccactgccacgggagagattactccccggaccctgtgcgcacttgtttttcgccaagcctgaggcagctgccgcgcccgagtgccctgggcatctggtggcacacgcccccacatgccctgcatag

SEQ ID NO: 125391 - DNA, 3135 bp, Artificial Sequence
  Description of Artificial Sequence: Synthetic coding sequence
atgcgcggtcgcgctagcgcactcggctctgatggtgtgagagtgacgatggaatcagctttaactgcaagagatcgcgtgggggttcaggacttcgtcctgctggaaaactttactagtgaagccgcctttatcgaaaacctgcggcgcagatttcgcgagaatttgatttacacttacatcggtcccgtcctagtgagtgtcaacccttatcgggatctgcagatttattctcgccagcacatggagcgctataggggggttagtttttatgaggtcccaccacatctattcgccgtggctgatactgtttaccgggcgctgaggactgagcgcagggaccaagccgtaatgatttctggagaatcaggcgctggcaaaactgaagctaccaagcgtctgcttcaattttacgcagagacatgccctgctcctgagcgcggaggcgctgtccgagataggctacttcagtcgaatcccgtactggaggccttcggcaatgctaagaccctgcgcaatgataattcatctaggttcgggaaatacatggacgtgcaatttgactttaaaggtgcccctgtggggggacacatccttagctatcttctggaaaaatcccgcgtggtccatcaaaatcacggagagcgtaactttcatatcttttatcagcttctggaagggggtgaggaggagaccctgagacgactcggcttggaaaggaatccacaaagttacttgtatttggtaaaaggacagtgtgccaaagtcagctccattaatgataaatctgattggaaggtggtccgtaaggcccttaccgtgatagatttcactgaagatgaggtggaagacctcctgtcaatcgtcgctagcgtgctacatttgggaaatattcattttgcagccaacgaagagagtaacgctcaggttaccacagagaaccaattgaagtacctgactcgcctgctgagcgtggaaggttccactcttcgcgaagctctgacgcaccgaaagataattgcaaaaggagaagagcttctgagtccattgaatctggagcaagccgcttatgctcgggacgctctggcaaaggccgtctacagcagaaccttcacttggctggttggcaagattaatagatctcttgctagcaaagacgttgagtcaccctcttggaggagcacgacggtgctgggcttactcgacatctacggattcgaggtgtttcagcataatagcttcgagcagttctgcatcaactattgcaatgagaaactacagcagcttttcatcgaactgacactcaaaagcgaacaagaagagtacgaggccgaaggcatcgcatgggagccagtgcagtacttcaataataaaattatatgcgatctggtcgaagaaaagttcaaaggaattatatccatacttgatgaagagtgcttgaggccaggcgaggccacagacttaacctttctggaaaagctcgaagatacggttaagcatcaccctcattttctgacacataaactcgcggatcagagaactcggaaatctctggggcgaggcgaatttcggcttcttcactatgccggtgaggttacctattcagtgaccggcttcctggataaaaacaacgatctgttgtttaggaacctcaaagagacaatgtgtagttccaagaatcctattatgagccagtgctttgaccggagtgagctttcagataaaaagaggccagagacagtggccacacagttcaagatgtccctcctgcaactcgtcgaaattctgcagtctaaagaacctgcatacgttcggtgtattaagccaaacgacgccaagcagcctggaagattcgatgaagtgttgattcgccatcaagttaagtacttgggcttattggagaatctgcgcgtcaggcgagccggctttgcctatcggcggaaatacgaggcatttctgcagcgctacaaatccctgtgccccgaaacttggcctacctgggctggaagaccccaagacggagtcgcagtcttggtgagacatctgggctataaacctgaggaatataagatgggcagaactaagatctttatacggtttccaaaaaccttgttcgctacggaggacgccctcgaggtgcgaaggcagtccttggctacaaagatacaagccgcctggcggggtttccactggcgacaaaaattcttgcgcgtaaaaaggtccgctatatgcattcagagctggtggcgagggactctaggccgtcgaaaggcagcaaagaggaagtgggcagcgcagacaattagaagactgattagagggttcgtgcttcgacatgccccacgttgtcccgagaatgctttttttttagatcatgtgcgaacaagcttcctcctcaatctgcgccggcagttaccacaaaacgtgctggatacgagttggcccactcctcctccagctctgcgggaggctagtgagcttctgcgggaactgtgtataaagaatatggtttggaagtactgtcggagtattagccctgagtggaagcagcagttacaacagaaggctgtggcgtcagagatattcaaggggaagaaggataactaccctcagtccgtcccaaggttatttatctcaactcgtttagggacggacgagatatctcctagagtcctgcaggctttggggagtgagccgatccagtatgccgttcccgtggtaaaatacgatcgaaaagggtacaagccaaggagccgccagttactgctgacaccaaacgctgtagtgatagtagaagacgcaaaggtgaaacaacggatcgattatgcgaacctgaccgggatttctgtgagttccctgagcgattcccttttcgtgctgcatgtgcaaagggctgataacaaacagaagggggacgttgtgctgcagtcagaccatgtcatcgaaacgttgaccaagaccgccttatccgccaatagggtcaattccataaatattaatcaaggcagcattaccttcgctggcggtccgggccgggacggcacaatcgactttacacctggaagcgagctactaatcaccaaggcgaagaatggacacctggctgtcgtagcacctaggttaaatagccggtag

SEQ ID NO: 125392 - DNA, 3120 bp, Artificial Sequence
  Description of Artificial Sequence: Synthetic coding sequence
atggccctgggatccgacggcgtgcgcgtcaccatggaatctgccctgacagctagggatcgtgttggggtccaagactttgtccttctcgaaaacttcacatctgaagcagcgttcatcgagaatctgagacgtcggtttcgcgaaaacctcatctacacatacatcggtcctgtgctggtcagtgttaatccttatagagatctacagatctactcacgacagcacatggaacgataccgaggcgtctctttctacgaggtcccgcctcatctctttgcggtggccgacacagtttatcgggcacttcgcactgaaaggcgcgaccaggccgtgatgatcagcggtgaatcgggtgccggcaagacggaagccaccaaaagactgctgcaattctatgcggagacttgtcctgctcccgagcgcggaggcgcggttcgagataggctgctgcaatctaacccagtgttagaagctttcgggaacgcgaaaacgctacgcaatgacaactcaagtaggttcgggaaatatatggacgtccaattcgatttcaaaggcgcacctgtgggaggacacatcctgtcctacctccttgagaaatccagggtcgttcatcagaaccacggggagaggaattttcatattttttaccagcttttggagggcggagaagaagaaacactcagacggttgggcctggagcgaaacccgcagtcatatctctacctcgttaaaggtcagtgcgcaaaagtcagtagcatcaacgacaagtccgattggaaggtggtgagaaaggccctcactgtcatcgactttactgaggacgaggtcgaggaccttctgtccatcgtggcatctgtgttgcatctcggtaacattcacttcgccgcaaatgaagagtccaacgcccaagtgacaactgagaaccagctgaagtatctgacgagactccttagcgttgagggctctaccttgcgtgaagccttaactcatcgcaaaatcattgccaaaggcgaggagctccttagccctctgaaccttgagcaagctgcctatgcccgggacgctctagcaaaggccgtatactctaggacctttacctggcttgtagggaaaatcaatcgctcgctcgctagtaaagacgtggaatccccaagttggaggtcgacaactgttctcgggctgcttgatatttatggctttgaggtttttcagcacaacagtttcgagcagttttgtatcaattattgtaacgaaaagcttcagcagttgtttatcgagctcaccctcaagtcagagcaggaggagtatgaggctgaagggatcgcgtgggagcctgtgcaatactttaataataaaataatttgtgacctggtcgaggagaaatttaaaggtatcatcagcatcttagacgaggagtgcctcaggcccggggaggccacggatctcaccttcctggaaaaactggaagacaccgtgaaacaccatccccattttctcacccacaagcttgctgatcagcggaccaggaagagcctaggtcgcggagagtttcggctgctccattatgctggagaggtaacctatagcgtaaccgggtttttggacaagaataatgatctgttatttcgcaatctgaaagaaacaatgtgtagttccaagaacccgatcatgtctcaatgctttgacaggtcagagctgagcgataaaaaacgcccggagacagtggctactcaatttaaaatgagcctcctgcagctggttgagatattgcagtccaaggaaccggcgtacgtccgctgtatcaaacctaacgacgccaagcaacctggcaggttcgacgaggtactcatacggcatcaagtaaagtatttgggcctcttagagaatctcagggtccgtcgcgccggattcgcctacaggagaaaatatgaggcctttctccaacggtataaatcactgtgtcctgaaacttggcctacctgggcgggaaggccacaggacggggtcgcagtgttagtgcgtcacctgggatataagcctgaggagtacaagatgggccgcacaaagatatttattcggttcccaaagacactctttgcgacggaagatgccctggaagtcagaaggcagtccctggccactaagattcaagcagcctggcggggctttcactggcgtcagaagtttctgagagtgaagcgaagcgccatctgtatccaatcttggtggcggggcaccctgggcagacggaaagccgctaagaggaaatgggctgcgcagaccatccgtaggttgataagagggttcgtcctgcgccatgcaccacgttgccctgagaacgctttctttctcgatcacgtccggacaagcttcctcctaaacctgcggcggcagttaccccagaacgtcctagacactagctggcctacaccgcctcccgcactgagggaagctagcgagctacttagggagctgtgcataaaaaatatggtgtggaaatattgccggtccatttctcctgagtggaaacagcaactacagcagaaggccgtggcgagtgagatcttcaaggggaaaaaggacaattacccacagtccgtgcctcgtctgttcatttcgacaaggctcggcaccgacgaaataagccctcgagtccttcaagcactgggctccgaacccatccagtatgcggtcccggtggtgaagtacgaccgcaaaggctataaaccacggtcaaggcagctgctcctgacccctaatgccgtggtgatcgtcgaggacgcgaaggtcaagcagcgaatcgactatgccaacctcaccggaatctctgtgagctcactgagcgactccctgttcgtcctccacgtgcaaagagccgacaacaagcagaaaggcgacgtggtgctgcaatctgaccacgtgattgaaaccctgacaaagaccgctcttagtgccaaccgcgtcaattcaatcaatatcaatcagggcagcattaccttcgccggcggtcccgggcgagacggaactatagatttcactcctggttctgagcttttaattacaaaggccaagaatggccaccttgccgtagtggcgccccggctgaactccagatag

SEQ ID NO: 125393 - DNA, 3021 bp, Artificial Sequence
  Description of Artificial Sequence: Synthetic coding sequence
atggctgagcaggaatctctggagttcggaaaggctgatttcgtacttatggataccgtcagtatgccagagttcatggctaaccttcgactaaggtttgagaagggcaggatctacacatttatcggagaagtggtggtgtccgtgaatccctataagctgctaaacatctatgggagagacactatcgagcaatacaaggggagagaattgtacgaaagacccccacatctgttcgcgatagctgacgcagcatataaagcaatgaagcgacgctcaaaagacacctgcattgtcatcagcggcgaaagcggcgccggcaagactgaggctagcaagtacattatgcagtacatagccgccatcaccaacccttctcagcgggcagaggttgagcgggtaaaaaatatgttgctcaagagcaattgcgtgttggaggctttcggcaatgccaaaacaaacaggaacgacaatagctccaggtttggtaaatatatggatatcaacttcgattttaaaggcgatcctataggcggccacatcaacaactatttactggaaaagtcaagagtgattgtgcagcagcctggcgaacgcagctttcacagcttttaccaactgctacaagggggctccgagcaaatgctacggtcactgcatttacagaagtccctgtccagctacaattacatccacgttggagcccaactgaagagttctatcaatgacgccgctgaattcagagtagtggccgacgcaatgaaggttataggcttcaaaccagaagagattcagactgtatacaaaatacttgctgctatattgcacctgggaaatctcaaattcgttgtagacggagacacgcccttgattgaaaacgggaaggtggttagcattattgcggaactcctgtccacgaagactgacatggttgagaaggccctgctctaccggacggtagctaccgggcgggacatcattgacaaacaacatacagagcaggaagcatcttatggcagagacgcctttgctaaagcgatctatgagaggctcttctgctggatagtgactaggattaatgatatcatagaggtcaagaattatgataccactatccacgggaaaaatactgttatcggggtcttagacatatatggctttgagatctttgacaataacagcttcgaacagttttgtatcaattactgcaacgaaaagttgcagcagctgttcatccagttagtgctgaagcaagaacaggaggagtatcaacgtgagggcatcccctggaagcacatagattatttcaacaatcagatcatcgtcgatcttgtagagcagcaacataagggtattatagccatccttgacgatgcgtgtatgaacgtcggcaaggtcacggacgaaatgtttctggaagcactgaatagcaagctcggcaagcacgcccacttttcgagcagaaaactgtgcgcatccgataaaattttagagttcgatcgggatttccggatcaggcattatgccggggacgtcgtttatagtgtgatcgggtttatcgacaagaataaagacaccctgtttcaggattttaaacggctaatgtacaattcctcaaatccggtcttgaaaaacatgtggcccgaaggaaaactgtcaattaccgaggtcaccaaacgtcctctgacagctgctaccctcttcaaaaatagcatgatcgctcttgtcgacaacctagcaagcaaagagccttattatgtccggtgcatcaagcccaatgataagaaatctccccagatattcgacgacgagcgctgtcgtcatcaagtggagtatctcggactgctcgagaatgtgcgggtgagaagggccgggttcgccttccggcaaacatatgaaaagttcctccacagatacaagatgatctccgagttcacatggccaaaccacgatttaccatccgataaagaagcagttaaaaagctaatagagagatgtggattccaggacgatgtggcctacggcaagacaaagatctttatacggactcccagaaccctcttcacattggaggagttgcgggcccagatgcttattaggattgtgctttttctgcagaaggtttggagaggcacacttgctcggatgcgatataagcgcacaaaagcggccctcaccatcattcgatattaccgacgctataaagtgaaatcatacattcatgaggttgctagacgcttccacggcgtgaaaaccatgagagactacggaaagcacgtgaagtggccctctccgccaaaagtgctcagacgctttgaagaggccttacagactatatttaatagatggagggcctcacagctcatcaaatcaatcccagcatcggatctgccccaagtcagggcaaaagtagcggccgtggaaatgctaaaaggacagagagctgatctgggtttgcaaagggcttgggaaggcaactacttggcctctaagccagatacccctcagaccagcggtacttttgtgccagtggccaatgaactgaaacgtaaggataaatacatgaatgtgctgttctcatgtcacgtgcgtaaagtgaaccggttcagcaaagtcgaggaccgcgccatcttcgtgacagaccgacacctgtataagatggatccaaccaaacaatataaagttatgaagactatcccactttataacctgaccgggctgtccgtaagcaacggcaaagaccagcttgtagtgttccatactaaggacaacaaagatctgattgtctgcctgttttcgaaacagcctacccacgagtcgcggatcggcgaattggtgggtgttttggtgaaccattttaagagtgagaaacggcatcttcaggtaaacgttactaaccccgtccaatgttctctccacgggaaaaaatgtacagtaagtgtggagacgcggctgaaccagccacagccggatttcaccaagaatcggtctggttttatcctgagcgtgccaggaaattag

SEQ ID NO: 125394 - DNA, 597 bp, Artificial Sequence
  Description of Artificial Sequence: Synthetic coding sequence
atgctgaaaggccaaagggctgatttgggcctccagcgcgcctgggaggggaattacttagcctcaaagcccgacaccccgcaaacatctggaaccttcgtgcctgtggccaatgagcttaaaaggaaggataaatacatgaacgtgctgttttcgtgccatgtaaggaaggttaaccggtttagtaaggtggaagatcgagcgatattcgtcaccgaccgacatctgtataaaatggatcccactaaacaatacaaggtgatgaaaaccattccgctctacaacctgacggggctgtccgtatccaacggcaaggaccaactggtggtctttcataccaaagataacaaagacctaatcgtatgtctgttttccaaacagccaacccatgagagcaggataggcgagctcgttggtgtgttagttaaccactttaagtcagaaaagaggcacttgcaagtcaacgtgaccaacccggttcagtgtagcctgcacggtaagaaatgcacagtgagcgtggaaactaggctgaaccagcctcagcccgacttcacaaagaatcgcagtggctttatcctatcagtcccaggtaactag

SEQ ID NO: 125395 - DNA, 3327 bp, Artificial Sequence
  Description of Artificial Sequence: Synthetic coding sequence
atgggctctaagggcgtgtaccagtatcactggcagagccacaacgtgaagcactctggagtggacgacatggtgttgctgagtaagattacagagaatagcatcgtggagaacctgaagaagcgctacatggacgactacatttttacatatatcggtagcgtcctgattagcgtgaatcctttcaaacagatgccatatttcggggaaaaggagatagaaatgtaccagggcgctgcgcagtatgaaaatcctccacacatttacgccttagcagacaacatgtatcggaatatgatcatagatagagagaatcagtgcgtgatcatctctggcgagtctggcgcaggcaagacggtggctgcaaaatatattatgagctacatttcccgcgtgagcggcggcggaaccaaggtccagcatgtgaaggacattatcttgcagtctaaccctcttctcgaggccttcgggaatgctaagacggttcggaacaacaacagctccagattcggcaaatatttcgagatccagtttagccctggcggcgagcctgatggcggaaagatttcaaacttcctgctggagaagtcccgagtggtcatgagaaaccccggtgagagatcttttcacatattctatcagcttattgagggggccagcgccgagcaaaagcactccctgggaatcacctcaatggactattactattacctcagcctatccgggtcttacaaagttgatgacattgacgaccgccgcgaattccaggagacccttcatgcaatgaacgtaattggcatcttcgccgaagagcagactttggtgctgcaaatcgttgctggaatactacacctggggaacatcagcttcaaggaggtgggtaactacgctgcagtagagagcgaggaatttctcgccttcccggcctacctcctcggtataaatcaggataggttgaaagagaaattaaccagtcgacagatggactccaaatggggaggcaaatccgaatccattcacgtgactctgaatgtcgaacaggcctgttatactcgggacgcccttgccaaagctttgcatgcgcgcgtgttcgatttcctcgtggacagcatcaataaggccatggagaaagatcatgaagagtacaatatcggtgtgctagatatttatggctttgagatattccaaaaaaatggatttgaacagttctgtatcaacttcgttaatgaaaaattgcagcagatctttatcgaactgaccctcaaggccgagcaagaggagtacgtgcaagaaggaatacgctggacccccatcgaatatttcaataataagattgtctgcgacctgattgagaataaggtgaatcccccaggaattatgtccatcctggatgacgtgtgtgctaccatgcacgccgtaggggagggcgcagaccaaacactactgcaaaaactgcaaatgcaaatcggaagccacgaacacttcaactcatggaatcagggcttcatcatccaccactatgccggaaaagtgagctacgacatggatggtttttgcgagaggaatagggatgtgttgtttatggacttgatcgagctcatgcaatcttccgagttacccttcatcaagtcattgtttcccgagaacctacaggccgacaaaaagggcagaccaacaactgccgggtctaaaatcaaaaaacaagctaacgacctcgtctccacactaatgaagtgcaccccacactacattagatgtatcaagcccaacgagactaagaaacccagggattgggaggaaagtagggttaagcaccaagtggagtacttggggctgaaggaaaatatacgggtgcggcgggcaggctatgcctatcgccgaatttttcagaaatttttgcagagatacgccatcctcaccaaggcaacctggccctcctggcaaggcgaagaaaagcagggtgtcctgcacttgttacagtccgtcaatatggactctgatcagtttcagttaggccgctctaaggtctttataaaggcccccgaatcactgtttctactggaagaaatgcgcgaaaggaaatatgacgggtatgcccgcgttatccagaaaagctggaggaagtttgtggctcggaagaagtacgttcagatgcgcgaagaggcatccgatctcctcttgaataaaaaggagcgccggcgaaattcgatcaatcgcaactttatcggggactacattggcatggaggagcacccagagctccagcaattcgtgggcaagcgcgaaaagatcgatttcgcagatactgtgactaagtacgaccgcagatttaaaggggtcaagcgggatctgctgttgacaccgaaatgtctttatctaataggccgtgaaaaggtcaagcaggggccggacaaaggactggtgaaagaggtgctgaagcgcaaaatagagatcgagcgcattctctccgtctccctaagcacaatgcaggacgatatattcatactgcacgagcaagaatacgatagccttctcgagagtgtcttcaaaactgaatttctttctcttctagccaagcgctatgaagaaaagacccagaagcagctgccactgaagttcagtaacactctcgagttgaagctgaaaaaggaaaactggggcccatggtcggccggaggatcccgacaggtgcagttccatcaggggtttggggacctggccgtgttgaagccgtcgaataaggtcttacaagtatctataggacccggcctgccaaagaatagccgcccgaccaggaggaacaccacccaaaacactggctactcatcgggaacacagaatgctaattatcctgtacgggctgcgcctccgccccccgggtaccaccagaatggcgtgattagaaatcaatatgtcccctatccccacgctccgggcagtcagcggagcaatcaaaagagcttgtacacttccatggcccgcccacctctgcctcgacagcagtctacgtctagtgacagagtttctcagacccccgaatctttggactttctcaaggtccccgaccaaggtgccgcaggcgtgagacgccagaccacctcacggcctcccccggcaggaggacggcctaagccacagcccaagccgaagcctcaggtacctcagtgtaaagctctctacgcctacgacgcccaggacaccgacgagctctcctttaacgctaacgacattatcgatataatcaaggaggatcccagcgggtggtggacagggcggttacgtgggaagcagggcctgttccctaataattacgtgactaagatatag

SEQ ID NO: 125396 - DNA, 3312 bp, Artificial Sequence
  Description of Artificial Sequence: Synthetic coding sequence
ggcacaaaagccgggtctcccgtcaatggccagaagcagggccacgctcaggccacccccaaaatccccctaaacctgcatctccaccacgaccccttccgtagtctacaggaacccagacatcagcctccgaccatgggatccaaggagagatttcattggcagagccacaatgtgaagcagtctggggtggatgacatggtgcttctcccccagattaccgaagacgccattgcggccaaccttaggaagcgctttatggacgactatatttttacttatatcgggtcagtcctgatcagcgtgaatcccttcaagcaaatgccatacttcactgatcgagaaatagacctgtaccagggggccgcccaatacgagaatccgccccatatttatgcactgacagataacatgtacagaaacatgctgatagattgtgagaaccagtgcgtaatcataagtggcgagtcaggcgctggaaagacagtcgcagccaagtacatcatggggtacatcagcaaggtaagtggtggcggtgagaaagttcaacatgtgaaggatatcatcctgcagtctaatccattgctcgaagcgttcgggaacgcaaaaactgtcaggaataacaacagctcccgcttcggcaaatacttcgaaatccagtttagcagaggaggagaacctgacggagggaaaatttcaaacttcctattggaaaagtcaagagtggtgatgcaaaacgagaatgagcggaactttcacatttactatcaactgctggaaggggcatcgcaagaacagcgccaaaacctgggacttatgacgcccgactactattattatctcaaccagagcgacacatatcaggttgacggcaccgacgacagatccgacttcggggagacgctgtccgctatgcaggtgataggaatccccccaagcatccagcagctggtactgcaacttgtggctggtatactacatttaggcaacatttcattctgtgaggacggcaattatgctcgggtcgaatccgtagacctgctcgccttcccagcctaccttttgggcattgactctggacgattacaggagaaacttactagcaggaagatggactccagatggggcgggaggtcagagtcaataaacgtgaccctgaatgtcgagcaggcggcctatacgagagatgcactggctaaagggctgtatgcccgccttttcgatttcctggtcgaagcgatcaatagagccatgcagaaaccacaggaagaatattccataggtgtcctagatatatacgggtttgagatctttcagaaaaatggatttgagcaattttgtatcaacttcgtcaatgaaaagcttcagcagatcttcatcgagctgacacttaaggccgaacaagaggagtacgttcaggaaggaataaggtggaccccgatccagtatttcaataacaaggtagtttgtgatctgattgagaataaactgagtcccccaggcatcatgtccgttttggatgatgtgtgtgccaccatgcacgctacaggcggaggggcagatcagaccttgttgcaaaaactgcaggcagcagtgggcacccatgaacactttaattcatggagtgcaggattcgtcatccaccactacgctggtaaggtgtcctacgatgtttctggcttctgtgagagaaacagagacgtgctcttcagcgacttgatagagctgatgcaaacaagtgaacaggcattcctccggatgctgttccctgaaaagctcgacggggataagaaaggaaggccgtccacggcgggctccaagattaaaaaacaggctaacgacctcgtggccaccttgatgcggtgtacacctcattacattcggtgcattaaaccaaatgaaactaagagacccagggactgggaggagaacagggtcaagcatcaggtagagtacctgggtttgaaagagaatatccgcgtgaggagagcaggcttcgcttatcggcggcagtttgccaagttcctgcagaggtacgcgatactgaccccggagacatggcctaggtggagaggcgatgagaggcagggcgtccaacacctgctgagggctgtgaatatggagccagatcaatatcagatggggagtacaaaggtgttcgtgaaaaaccctgagtctctgtttctactcgaagaggtccgcgagcggaaattcgatgggttcgccagaacaatccagaaggcctggcggaggcatgtagcggtgcggaagtatgaggagatgagggaagaggcttcgaacatccttctgaacaaaaaggaaaggcgccgaaactcaatcaataggaactttgtaggagattacctgggattggaagagcgccccgaactccgacaatttctggggaaacgagaaagagtcgattttgcagacagtgtcacgaaatacgaccgtagattcaagccgatcaagagggatctaattctcacacctaagtgtgtttacgtgatcggccgcgagaaggttaaaaaggggccagaaaagggtcaggtgtgcgaagtactgaagaagaaagtcgacatccaggctttgcgtggcgtgtcactcagtacacggcaggacgactttttcatactgcaggaagatgcagccgacagcttcctggagtctgttttcaagaccgaatttgtgtccctgctatgcaaacgattcgaagaggccacccgaaggcccctgccactgacattcagcgacacactccagttccgagttaaaaaggaagggtgggggggcggcggaactcggtctgtgactttttcaaggggcttcggtgacttagccgtcctcaaagtgggaggaagaaccctgacagttagcgtcggcgacgggctgcctaagagcagtaaacctacccggaaaggaatggcgaaggggaagcccagacgctcaagccaggctccgacgagagccgctccagcgcctccgcgcgggatggaccggaacggtgtgcccccgtctgctaggggtggtcctctaccaggcgaccacgtgtggcgtggccatccacaggctagccctggattaaggcctcatccctgggagccagctgacgacccaggtcacgtgaggccacagagtacaacccaaaattcctctacctgtctgacacgtgcttggcccgcctgcaggggatcagcagcatggggaaacggtcaatgtcttgtgtgggccgatcccagtccctctttaggccacatggtccccggggccggcccttacacaagcacctgggcaaaaatgtggacgagctag

SEQ ID NO: 125397 - DNA, 3297 bp, Artificial Sequence
  Description of Artificial Sequence: Synthetic coding sequence
atgggcagcaaggaacgtttccactggcaaagccataacgttaaacaaagcggcgtggatgacatggtactcttaccacaaatcactgaggatgctattgccgcaaatttgagaaagagattcatggacgattacatttttacctatatcggcagcgtgcttatttccgtcaatccgttcaagcaaatgccatattttacagatagggaaattgatctctaccagggggccgcccaatacgaaaacccaccacacatctacgcattaaccgataacatgtaccgcaacatgctcatagattgtgagaatcaatgtgtcattatctccggcgagtcaggggctgggaaaacagttgccgcaaagtatatcatgggatatattagtaaggtgtcaggaggcggggaaaaagtccagcacgtgaaggatataattctacagtctaatcctctattagaagcctttgggaacgccaaaacagtgagaaacaataactcaagcaggttcggaaaatatttcgaaatccaatttagccgaggaggcgagcctgatggtggcaagataagtaattttctcctcgaaaagtcgcgcgtggtgatgcagaacgagaacgagaggaactttcatatctattaccagctcctggagggagcgagccaggagcaacggcagaacctaggtctcatgactcctgattattactattacctgaaccagagtgatacctaccaggtggatgggactgacgatcggagcgatttcggagagactctttccgctatgcaggttattgggatcccgccatctatccaacagttggtgctgcagctggttgccggaattttacatttgggcaatataagcttctgtgaggatgggaattacgcaagagtggagtctgtcgacctcctagccttcccagcatatttactgggcatcgactccggaaggttgcaagagaaacttacctcgcgcaagatggatagcaggtggggcgggcgttcggagagcattaacgttacccttaacgtagagcaggccgcttacacacgggacgctctcgctaaagggttgtatgcccgactcttcgatttcctagtggaggctatcaatcgagcaatgcagaaaccccaggaggagtattccattggagttttggacatctacggtttcgagatttttcagaagaacggattcgaacaattttgtatcaattttgtcaatgaaaaactccagcagattttcatcgagctcacacttaaagccgaacaggaggaatatgtgcaagagggaatcagatggacaccaatccagtattttaataataaagtagtttgtgacttgatcgaaaataaattatctcctcctggcataatgtcagtactggacgatgtgtgtgcaacaatgcatgccaccgggggcggagccgatcagaccctccttcaaaaactgcaggccgcggtgggcacacatgagcatttcaatagctggtctgccggctttgtgatccaccattacgctggtaaagtgtcgtatgatgtgagcggcttctgcgagagaaatcgcgatgtattgttctctgacctcatagaacttatgcagactagcgagcaggcgtttctgcggatgctctttccagagaagctagacggggataaaaaggggcgcccttctactgcgggcagtaaaattaagaaacaggccaatgacttggtcgcgacactgatgagatgcacaccccattacattagatgcattaagccaaatgaaaccaagaggccacgtgattgggaggagaacagagtgaagcaccaggtggagtacctgggcctaaaggaaaatatccgtgttcggcgggctggtttcgcctacaggcgacagttcgctaaatttctgcagaggtatgcaattctcacgcccgagacgtggccaagatggcggggcgacgaacgccagggtgtccaacacctgctcagggccgtgaacatggagcctgaccagtaccagatggggagcactaaggtcttcgtgaaaaacccagaaagccttttcctgctcgaggaagtgcgagagcgaaaattcgatgggttcgccaggactatccagaaggcatggcgccggcacgtggcggtgaggaaatacgaggaaatgagggaggaggcatctaacattttactgaacaagaaagagcggaggcgaaattcaatcaacagaaacttcgtgggggattacctgggcttggaggaacgcccagaactacgtcagtttttgggaaaacgcgagagagtagactttgcagacagcgtaaccaaatatgatcggcggtttaaaccaatcaagagggatctcatcctaacgccgaagtgtgtttacgtgataggtcgggagaaagttaaaaaggggcccgagaaggggcaggtgtgtgaggtgttaaagaagaaggtggacatccaggcgctgcgcggggtgagtctcagtacacgtcaggacgactttttcattttacaggaggatgccgcagactctttcctggagtccgtgttcaagaccgagttcgtatctttactctgtaagcgatttgaggaggccactcggagaccattaccactcacattctccgacacactgcaattcagagtgaagaaagagggatgggggggaggaggtacacggtctgtaacattcagcagaggcttcggcgatcttgccgttctaaaggtgggcggtaggactctgacagttagcgttggagacggtttaccgaagagttccaaacccactagaaagggcatggccaagggcaagccccggcgcagctcacaagctcctacccgcgcagcccctgcacccccaaggggcatggaccgcaacggcgtgccacctagcgctcgtggggggccgctcccgctagagatcatgtctggcggtggcacgcaccggcccccgaggggccctcccagcacctcccttggcgcatctcggcgcccccgcgctcggcccccgagcgagcacaatacggagtttcttaatgtcccagaccaggggatggccggaatgcaacgtaagaggagcgtgggacagcggccggtcccaggagtgggccggccaaagccacaaccccgaacacacggaccacgatgtcgagctctgtatcagtacgtcggacaggacgtggatgaacttagcttcaatgtcaatgaggttatagagattctgatggaagatccttccggatggtggaaaggccgactgcacggccaggaggggcttttccccggaaattacgttgaaaaaatctag

SEQ ID NO: 125398 - DNA, 3057 bp, Artificial Sequence
  Description of Artificial Sequence: Synthetic coding sequence
atggaggacgaagaagggcctgaatacggcaagcctgacttcgtgttgctcgaccaggtgacgatggaggatttcatgcgaaacctgcagctgaggttcgaaaaggggcgcatctatacctatattggagaggttctcgtgagcgtcaacccgtaccaggagctgcccctgtacggtcctgaggcaatcgctcggtaccaggggcgcgaattatatgagcgtcctccccatttgtacgccgtggcgaacgcagcttataaagctatgaaacacagatctagggacacttgcatagtcatctcaggagaatctggagcagggaagaccgaagctagtaagcatataatgcagtacattgcagcggtcacaaatccatcccagagggccgaggtggagagagtcaaggacgttctgctcaaatctacctgtgtactggaggcctttggcaacgcccgtacaaatcggaaccacaattcctctcggttcggaaagtatatggacataaatttcgatttcaagggggatccaataggagggcatatccattcttatctgttggaaaaaagtagggtgctgaagcagcacgtgggggaacgtaactttcacgctttttatcagcttctgcggggctccgaggacaagcaactccacgaattgcaccttgagcgaaacccagctgtgtataactttacgcatcaaggcgccggattgaatatgacggtgcactcagctctcgacagcgatgaacagtcccaccaagcagtaactgaagccatgcgcgtgatcggattttctcccgaggaagttgagtctgtgcacaggatactggctgctatcctccatctcggcaacatcgagttcgtggagactgaagagggcggcctccagaaggaggggctggccgtggccgaggaggcgctggtagatcacgtggcagagcttacggctacccctagggatcttgtgctgcggagtttgcttgccaggaccgttgcatctggtggcagggaactcatagagaaggggcataccgcggctgaagcatcctatgctagggacgcctgcgccaaagccgtgtaccagaggctgttcgaatgggtcgttaacaggattaactctgtcatggagccccggggaagagacccacgccgggatggaaaggacactgtcattggcgttcttgacatatatggtttcgaggtgttccctgtgaatagttttgaacagttctgcattaactattgcaatgagaaactccagcagctttttatccaactcatactcaagcaggagcaagaagagtacgagagggaaggtatcacctggcagtctgtggagtacttcaataatgcaacaattgtcgacctggtagagcggccacaccggggcatattggcagtcttagacgaagcttgctcttcggccggcacgataaccgacaggatctttctgcagactttggacatgcatcacagacatcatctacactacacaagcagacagctgtgccctacagataagactatggaatttggacgggacttcagaataaaacattatgcaggggacgtgacgtacagcgtcgaaggattcatagacaaaaatcgcgatttcctattccaggatttcaagcgactgctttacaattctacagaccccactttaagagctatgtggccggatggtcaacaggatatcacagaggtgacaaagagaccgctcaccgccgggacactttttaaaaacagtatggtggccctcgtcgaaaatttagccagcaaggaacctttctatgtgaggtgcatcaaaccgaatgaagataaggtcgcagggaagttagatgagaaccactgtcgccatcaggttgcctacttaggcctcctggagaacgtcagagtccggcgcgctggctttgcgagtaggcagccctacagtaggtttctcctgagatacaagatgacctgcgagtatacttggcctaatcatctccttgggtctgacaaggcagctgttagcgccctgcttgagcagcacggacttcagggggacgtagcattcggccattccaaactgttcatccggagccccaggaccttagtaaccttggagcagagccgtgcacggctaatcccaatcatcgtgctactcctccaaaaggcttggcgcggtacgctggctcgttggagatgcagacggctgcgggctatctacacaatcatgcggtggtttcggaggcacaaggtgcgagctcacctggctgaattgcaacgaaggtttcaggccgccagacaaccgccgttgtacgggcgcgatctcgtgtggcccctccctcccgctgtcttgcagccatttcaggatacctgccatgccctgttctgtcggtggcgcgctcgccagctggtcaaaaacattcctccatccgatatgccgcaaatcaaggcaaaagtagccgcaatgggtgccttacaagggctgcgccaggattggggatgcagacgggcttgggctcgcgactacctgtctagcgccactgataacccgacggcctcatccctgtttgcccagaggctgaagaccctgcaggacaaggacggcttcggcgcagtgctattttcgagccacgtccgcaaagtgaaccgcttccacaagattcgaaatcgggccctcctccttacagatcagcatctttacaagctcgaccctgaccgccaatatcgggtgatgcgagcagtgccattagaggctgtgacaggactgtcagtaacttccggcggcgaccagctggtggtgctgcacgctcggggtcaagatgacctagtggtatgtcttcacagaagcagaccaccgctcgacaatagagttggggaactggtaggcgtcttagcggctcattgccagggggaggggcgaaccctggaggtgcgcgtgtctgattgtatccctctgagtcaccgcggcgtgaggcggcttatctcagtagaacctaggcccgaacagcccgagccagacttcaggtgtgcaaggggcagctttacgctactgtggcccagtaggtag

SEQ ID NO: 125399 - DNA, 4851 bp, Artificial Sequence
  Description of Artificial Sequence: Synthetic coding sequence
atgttccccttaattggaaaaactatcatttttgataatttccctgatccttcagacacgtgggaaattaccgaaacgatcggaaaagggacttatggaaaagtatttaaggtgcttaacaaaaagaacgggcagaaagctgccgtgaagattctcgacccaattcacgacattgatgaggagattgaagctgagtacaacattctgaaggctttatccgatcacccaaacgtagtcagattctatggtatctatttcaaaaaggacaaggtgaacggcgataagctctggttggtgctggaactgtgtagtggcggatcagttactgacttagtcaaaggtttcttaaagcggggcgagcgtatgagtgaacccctcattgcttacatcctgcacgaagccctgatgggacttcagcacctgcacaacaacaaaactattcatagagacgttaaaggcaataacatccttttgactactgaagggggtgtgaaactggttgatttcggggtgtctgctcagctcacaagcacacggcacagaaggaacacctcagtggggaccccattctggatggccccagaagtcatcgcttgtgagcagcagctggacacaacttatgacgcgcggtgtgacacatggtctttaggcatcacagccatcgaactgggtgatggagatccaccacttgctgacctgcacccgatgagggccctgttcaaaatccccagaaatccccctccgaagctgaggcagcccgagctgtggtccgccgagttcaacgatttcataagcaaatgcctcacgaaagattacgagaagcgcccgaccgtcagtgagttgctgcagcataagtttattacgcagattgagggcaaagacgtcatgctgcagaaacagctgaccgaattcatcggaatccatcaatgtatggggggaacagaaaaagctcgccgagaacgcatacatacgaagaagggcaattttaaccgccctttgatttctaacctgaaggacgtggacgacttggcgacactagagattctcgatgaaaacaccgtttcagaacaactggaaaaatgttacagccgcgaccaaatctacgtctatgtgggagacattctgatcgcccttaatccattccaaagtctcggcctctactcaacgaaacattctaagctgtacatcggaagcaaacgaacagcatctccgccacacattttcgctatggcggacctgggctaccagagcatgatcacttacaattctgatcagtgcattgtgatttcaggagagtcaggagccgggaaaacagaaaacgctcatctgctggtacagcagctgaccgtgctgggcaaagcaaataaccgcacactgcaagagaaaatcctgcaagtgaataacttagtggaggcatttggaaacgcctgcacgattatcaacgacaactctagcaggtttggaaaatacctcgaaatgaagtttacttcttcgggtgctgttgtgggggctcagatatcagaatatctcctggagaaatctagggtcatacatcaagcaattggcgaaaaaaactttcatattttttattacatctatgcaggtctcgcggaaaaaaaaaagctcgctcactataaactcccagagaataagccaccccgctatctgcagaacgaccatctgcgtactgttcaggacataatgaacaactctttctataaaagccagtacgagctgattgagcagtgctttaaggtaatcggtttcaccatggagcagctgggatctatttatagcatactggccgcaattttaaatgttgggaacatcgaattttcaagtgtcgccactgagcaccaaatcgacaagtctcatatcagcaaccataccgcgctcgaaaattgcgcctcactgctgtgcataagggctgatgagctccaagaggccctcacctcacattgtgtcgttactcgaggcgagaccatcattaggcctaatacagttgagaaggccactgacgtcagggatgcgatggctaagacactctatggccgactcttctcgtggattgttaactgcattaacagcttgttgaaacatgattcatcgccatctgggaacggggacgagctgtccattggaatcctcgacatctttgggtttgagaacttcaaaaagaatagctttgagcagctgtgcattaacatcgcaaatgaacagattcagtattattacaaccagcatgtcttcgcttgggagcagaatgagtaccttaatgaagacgtggacgccagggttatcgaatacgaggacaactggcctctcctcgacatgtttctgcagaagccaatgggcttgttgtcactgttggacgaagagtctcgatttcccaaggcaaccgatcaaacactcgtcgaaaaatttgaagggaacttaaagagtcagtatttctggcgccctaaaaggatggagctctccttcgggattcatcattacgccgggaaggtgctctataatgcctcgggcttcctcgctaagaatcgggacactttaccaacagatatcgtgctgttgcttaggtcatcagataactccgttatacggcagctggtgaatcaccccctgaccaagaccggaaacctgccccacagcaagacaaagaatgtcataaactatcagatgcggacctctgagaagctgattaacctggccaaaggggacaccggcgaggccacacgccatgccagagagactactaatatgaaaacccagactgtggcatcctatttccgatattcactgatggacctactgagcaagatggttgtcggccaacctcattttgttcggtgcatcaagcccaatagtgaaagacaggcccgtaaatacgacaaagagaaggtgctcttgcagctgcgctacacagggatattagagactgcccgcattagacgcctgggtttctcacacaggatcctcttcgccaatttcattaagaggtactatctcttgtgttataagtcgtcggaggagccccgcatgtctccggacacttgcgctacgatattagagaaagcaggtttagataactgggcactcggcaagacaaaggtttttctcaagtactaccacgtggagcagctgaatctcatgagaaaagaagcaatagacaagctgatcctgattcaggcctgcgttcgggcgtttctttgctctaggaggtaccagaagatacaagaaaaaaggaaagagtctgccattataattcagagcgccgcacggggacatcttgtgcgaaaacagcgcaaggagattgtggacatgaagaacaccgctgttacaacaattcaaaccagtgatcaagagtttgattacaagaagaacttcgagaacaccagggagagcttcgtgaaaaaacaagccgagaacgccatcagcgcaaatgagcggtttatcagcgcaccaaataacaaggggtcagtgtcagtcgtcaaaacatccacattcaagcccgaagaagagacaacgaatgctgtcgaaagcaataatcgcgtctaccagaccccgaagaaaatgaacaatgtgtacgaagaagaagtaaagcaggagttctacttagtcggtccagaggtgtctcctaagcagaaatctgtgaaggatctagaagaaaattccaacctccgcaaggtagagaaggaggaggctatgattcagagctattaccagcgatacaccgaggaaaggaactgcgaggagtcaaaggccgcttacctggagagaaaggcaatcagcgagaggccttcctatcccgtgccctggctggcagagaatgaaacctctttcaagaagacactggaacccactctgtcccagcgatccatttaccagaatgcgaattctatggaaaaagagaagaagacatccgtggtgactcaacgagctccaatctgtagccaggaagagggtcggggtagactgaggcacgaaaccgttaaagagaggcaagtggaacctgtgactcaagcacaagaggaagaagataaggcagccgtctttattcagtctaagtaccgggggtacaagcggcgccagcagttgagaaaggataagatgtcatctttcaagcatcaacggattgtcacaacccccaccgaagttgccagaaatacgcataacctgtactcttacccaaccaagcacgaagaaattaataacataaaaaagaaggacaacaaggactcaaaagccacaagcgagagagaagcttgcggcctggccatatttagtaagcaaataagcaaactttctgaagagtatttcatcctccagaagaaactcaacgaaatgatacttagccagcagctgaagtctctgtacctcggtgtgagccatcataaaccgatcaacagaagagtctcttcccagcagtgccttagcggggtttgtaagggtgaagagccgaaaattttgaggcctccacgtagacctcgtaagccgaaaaccctgaacaaccccgaagattccacctactattatttgctgcataagagcattcaagaagaaaagcgcagacctagaaaggatagccaggggaaattactcgacctagaggacttttactacaaggaattcctgccaagtagatccggccctaaggaacacagcccctctttgagggagagaaggccgcaacaggaattacagaatcagtgcattaaggccaatgagcgttgctgggccgccgaaagccccgagaaagaggaagagcgggagccagccgcgaatccctacgatttccgtaggctattaaggaaaactagccaacggagacgactagtgcaacagtcatag

SEQ ID NO: 125400 - DNA, 594 bp, Artificial Sequence
  Description of Artificial Sequence: Synthetic coding sequence
atgtttcccctcattggcaagactatcatctttgataactttcccgatccatccgacacatgggaaattaccgagaccatcggtaaaggaacttacggaaaggtgtttaaggtcctcaataagaagaacggccagaaggctgcggtcaagattctggacccaatccacgacatagatgaggagatcgaggctgagtacaatatactcaaagccttgagcgaccatcctaacgtggttcgcttttacggcatttactttaagaaggacaaagtgaacggagacaaactgtggctggtgcttgaactatgtagtggggggagtgtaactgatctcgtgaaaggtttcctcaaaagaggggaacgtatgagcgagcccctcatagcctatatccttcacgaagccctaatgggacttcagcatttacataacaacaaaactatccacagagacgtcaagggcaataatatcctgttgactaccgaaggaggagtcaaactcgttgattttggcgtttctgcccagttgacatctacacgccaccggaggaatacatcagttggcaccccattctggatggctcccgaggtgcgatag

SEQ ID NO: 125401 - DNA, 744 bp, Artificial Sequence
  Description of Artificial Sequence: Synthetic coding sequence
atgttcccactcatcggcaagacaattatctttgacaacttcccagacccttcagacacgtgggagataactgagaccatcggaaaggggacctacggcaaagttttcaaggtgctgaacaaaaagaatgggcagaaggcagctgttaaaatcctggaccctattcatgacatagatgaggagatcgaggctgagtataacatcctgaaagcattgagtgaccaccctaacgttgtgagattctatggcatctacttcaaaaaagataaagtgaatggtgataagctttggttggtactggagctctgcagtggtgggagcgtgacagatcttgtcaagggtttcctgaagaggggcgaaaggatgtcagagcccctgatcgcttacattctgcatgaagcactgatgggcttacagcatctccataacaataaaaccatacacagagatgtgaaaggtaacaacatcctccttaccacagagggcggggtgaagctggttgactttggcgtttctgcccagctcactagcacccgtcaccgcagaaatacatctgtggggactcccttctggatggccccggaggtgatcgcctgtgagcagcaactggacaccacctacgatgcccggtgcgacacctggagtctcgggattaccgccattgagctcggcgatggagatcccccgctcgctgatctgcatccaatgagggcccttttcaaaatccccaggtccgatgattag

SEQ ID NO: 125402 - DNA, 1995 bp, Artificial Sequence
  Description of Artificial Sequence: Synthetic coding sequence
atgttcccactcatcggcaaaaccatcatctttgacaattttcctgatccttcagacacatgggagataaccgaaaccattgggaagggcacatatggtaaggtcttcaaggttctcaacaaaaagaacggtcaaaaagcggctgtgaagatcctggatccgatacacgatatcgatgaggagatcgaagccgagtacaatatcctgaaagccctctccgatcaccctaacgtcgttagattttatggaatatacttcaaaaaagacaaagtgaacggcgacaagctttggcttgtcctggagctttgcagtggaggctcagtgaccgacctggtcaaaggattcctgaagagaggagaacgcatgtcggagcccttgatcgcttacatcctgcatgaagcccttatgggcctgcagcacctgcacaacaacaaaacaattcacagagacgttaaaggcaacaacatattgctcacaaccgaggggggtgtcaagcttgttgatttcggcgtgtccgcccagctcacatctacacgccaccggagaaatacttccgtcggcacaccattttggatggcacctgaggtgatcgcttgtgaacagcagttagataccacttatgatgctcgctgtgatacgtggtccctcgggataactgcaattgagctgggtgacggtgatcccccgctggctgaccttcaccctatgagagcactgttcaaaattccgcgcaatcctcctccaaagttgcggcagcccgaattatggtctgccgaatttaatgattttatcagcaaatgcctgaccaaggattacgagaagcgacccaccgtcagcgagctgctgcagcacaaatttatcactcagatagaaggtaaggatgtgatgctccagaagcagctgactgaattcatcgggattcaccagtgtatgggcggtacagagaaagcccggagagagcgcattcacactaagaaagggaattttaatcgccctttgatatctaatttgaaggacgtggatgatttggcaactttagagatcctggacgaaaacaccgtgagcgagcagcttgaaaagtgttacagccgggatcaaatttacgtgtatgttggggacatcctgatcgccctcaatcccttccagtccctcggcctttatagcactaaacatagtaagctatacatcggttccaagcggaccgcgtcaccacctcacatttttgccatggccgatctcgggtaccagtccatgatcacatataacagcgatcagtgcatcgtcatttccggcgaatcaggagctggcaagacagagaacgctcatctattggtccagcagcttacagtgcttgggaaggccaataataggacgcttcaggaaaagattctgcaggtgaacaacttagtcgaggcttttggtaatgcttgcactattatcaatgataattcttctagattcggcaaatacctggagatgaagttcaccagttctggcgccgtcgtcggtgctcaaatctcagagtaccttctcgagaagtcgagagttatccaccaagcaatcggcgagaagaacttccacattttctactacatctatgcagggttggccgagaagaagaagctagcgcactataaattaccagaaaataagccccctaggtacctccagaacgatcacctgaggactgtccaggacattatgaataacagtttctacaagagtcagtatgagctgatcgagcaatgtttcaaggtgatcgggttcacaatggaagtcctcgggggaggcgagccccgagagggggggggcgaacgtgccagcagccagcccctcaggctgcaggaggctcccgcccagaatctgccagcccctgccccacgcccagctgttctgacagtccagcgaggatcccacaggcgtagaaaagcgctggagccagcgggccagcagggaccaagccgccattcaggcgctggtactagtcgtcactag

SEQ ID NO: 125403 - DNA, 3834 bp, Artificial Sequence
  Description of Artificial Sequence: Synthetic coding sequence
aaacacttatacggcttattccattacaatcctatgatgttgggtctggaatccctgcctgatcccaccgacacatgggagatcatcgagactattgggaaaggaacctacgggaaagtatataaggtgacgaacaagagagacggcagcctcgctgccgtgaagattctagacccagtgtctgatatggacgaagagatcgaagccgagtataacatcctgcagtttctcccgaatcatcccaacgttgtgaagttctatgggatgttttataaggctgaccattgtgtaggtggtcagctgtggcttgtactcgaactgtgcaatggagggtctgtaaccgagcttgtgaaggggctgctgcgctgcggacagcgactggacgaggcaatgatctcctacattttatacggtgctctcctgggactgcagcacctacacaacaataggattatccatcgtgacgtcaagggcaataacatcctgctgaccacagagggaggagtgaaactcgtcgatttcggagtgtctgcacaactgacatccacacgcttgcggagaaatacttccgtcgggactcccttttggatggccccggaagtcatcgcctgcgagcagcagtatgactcatcctatgatgccagatgtgatgtgtggtctcttggtatcaccgctattgagttgggtgatggtgacccgcctctcttcgatatgcatccagtcaaaaccctgttcaagattccccgcaatccaccccccacgctccttcacccggagaagtggtgtgaagagtttaatcactttatctcgcagtgcctaataaaagactttgaacgacggccatctgtgacacatcttctggatcaccccttcataaagggagtccatggcaaagtcctgttcctacagaagcaactggcaaaagtgctgcaggaccaaaaacaccagaaccctgtggcgaagactagacacgagaggatgcatacgcggaggccatatcacgtggaagacgctgagaaatactgtctcgaagacgacctggtgaatctagaggtattggacgaggataccattattcaccagcttcagaaaagatatgcagaccttttgatctacacatacgtgggcgacattctgatagcgctgaacccatttcagaatctttctatctatagtccccaattctcgcgcctctaccatggggtgaaaagggcctcgaatccacctcatatctttgctagtgccgacgcggcttaccagtgtatggtgactttgtctaaggaccagtgcattgtgattagcggcgaatcaggtagtggcaaaacggagtcagcccacttgatcgttcagcatcttacgttcctgggaaaggccaataatcagactctccgggaaaaaatcctgcaggtcaactcacttgtagaggccttcggcaatagctgtacagccattaacgataatagtagccgatttggcaagtatcttgagatgatgtttacccccaccggagtggttatgggggcaaggatctcagaatacttgctcgagaagtctcgggtgatcaagcaggccgcgcgagaaaagaacttccacatcttttattatatatatgctgggcttcatcaccaaaaaaagttgtcagatttccggctgccggaagagaaaccaccaaggtacatcgcagatgagaccggcagagtcatgcacgacatcactagtaaagagagctaccggagacaattcgaagccattcagcattgcttccgaatcatcggcttcacagacaaagaggtgcatagtgtctatagaattttggccggaattcttaatataggcaacattgagtttgctgccatcagcagccaacaccagacagataagagcgaggtccctaatgctgaagcgcttcaaaatgctgcaagtgttctctgcatatcccccgaggagctgcaagaagcccttacatctcactgtgtcgtaacccgtggcgaaaccatcatccgcgcaaatacagtggaccgagcggccgacgttagggacgccatgtccaaggctttatacggacggcttttctcttggatcgtgaaccgcatcaacacactcctgcaacccgatgagaatatttgctcagccggggggggaatgaatgtgggcattcttgatattttcggatttgaaaacttccaacgcaactctttcgaacagctttgcatcaatattgccaacgaacagattcaatactatttcaaccagcatgtgtttgctctggagcagatggagtaccaaaatgagggcatagatgcggtgcctgtcgaatatgaagataatcgtcctcttctggacatgttcctgcaaaaacctttgggactgttagcgctgttagatgaggagtcaaggttcccccaggctacggaccagacattagttgataagtttgaggacaatctgcgctgcaaatatttctggcggcctaagggagttgaattgtgcttcggaattcagcactatgccgggaaagtgctctacgacgcttccggcgtgcttgagaaaaaccgcgacacgctgccggccgatgtggttgtcgtgctacgcacttctgagaataagctcttacagcagctatttagcattcctttgactaaaacgggaaatctggcccagactcgcgctcggataacggtggctagcagcagtctgcctccgcacttttctgccggtaaggccaaagtggacacattagaggttatccggcatcctgaagagaccacgaacatgaagagacaaacggttgcttcttatttccgatactcactcatggacctgctcagcaaaatggtggtgggacaaccgcattttgtgcgctgcatcaagcccaatgacgacagggaggctcttcagttcagccgagagcgcgttttagcccagcttcggagtaccggcattctggaaacagtgtcaattaggaggcaaggttacagccaccggatcctgttcgaggaattcgtcaagaggtactattatttggctttcactgcccaccagactcccctcgcgagcaaggagtcttgtgttgccatcttggagaagagccggctggaccactgggtgctgggtaagaccaaagtctttctgaaatactatcatgtggagcagctgaatctgctgctgcgggaagtgatagggagagtcgtggtcctgcaggcttacaccaagggctggctgggggcccgacggtataagcgggtgcgcgaaaagcgcgagaaaggcgcgattgccattcaaagtgcctggagggggtatgacgcccgacgtaaatttaagaaaatcagtaataggcgtaacgagagtgccgcccacaaccaggctggagacacatcaaatcaatcttcagggccacattctccagtggcagcaggcactcgcggctcagcagaggttcaggactgcagcgaacccggcgaccacaaggttctccgcggaagcgtccacagacgctcacactctcaggcagagtctaacaacgggcggacccagacatcctctaactctcccgctgtcacagagaagaatggccattctcaggcgcagagtagcccaaaaggctgtgatattttcgcaggtcatgccaataaacactctgtctcaggcaccgacttgctgagtagccgcatttgccacccagcccccgaccagcaggggctctccctgtggggcgcgccccagaaacctgccttccctcattatggttgcaacttttatggatttcggaaatggtcatgtaccgaagcgagcaatacctctcctaccatgtccgccgctcagaacgccgagtag

SEQ ID NO: 125404 - DNA, 4053 bp, Artificial Sequence
  Description of Artificial Sequence: Synthetic coding sequence
atgctccagtcagcactgctctctacacgtaaacacctatacggcttatttcactataaccctatgatgctgggacttgaatccctgcctgatccaacagacacatgggagatcatagagactatcggcaaaggaacgtacgggaaggtgtacaaagtcacaaacaagagggacggaagtctggccgccgtgaaaattttagaccccgtgagtgacatggacgaagaaatcgaagccgaatataatattctgcagtttctgcctaaccatccaaacgtggtgaagttttatggaatgttttacaaggcagaccattgtgtggggggccagctgtggctggtgttagagttatgcaatggagggtctgtcactgagctagtaaaaggactgctccgatgcggacagaggctggatgaagctatgattagctacatcttatatggcgccctgctggggctgcagcatttacataacaatcggatcattcatcgcgacgtgaagggcaataacattttactgacgactgaaggcggggtaaaactagtggatttcggcgtcagcgctcagctgaccagtacgcgcctgcgacgtaacacctcggtcggcacgcctttctggatggctccggaggttatcgcttgcgaacaacagtacgattcctcatatgacgcgaggtgcgacgtgtggagcctgggcatcaccgcgatcgagcttggagacggggatcctcccctgttcgatatgcaccccgtgaagactctgtttaagatccccaggaaccccccaccgacgctgctgcacccagagaaatggtgcgaggaattcaaccacttcatttctcagtgtctgattaaagactttgagcgccggccgtctgtcacgcatctcctggatcacccttttattaagggcgtgcatggtaaagttctgtttctgcagaagcaactggccaaggtgttgcaagaccagaagcaccagaatcctgttgcaaaaacccgtcatgagaggatgcatactcgacgtccttaccatgtggaagatgccgaaaagtactgcctcgaagacgacttggtgaacctggaggtattagatgaagacaccatcattcatcagcttcaaaagaggtacgctgatctacttatctatacgtacgtgggggacatcctcatcgcccttaacccatttcagaacctttccatttacagcccgcaattttcacgcctataccacggggtcaagcgcgcatcaaatccaccccacatatttgcctctgcagacgctgcctatcagtgcatggtgaccctaagtaaagatcagtgcattgtcataagcggagagagcggaagcggcaagaccgagtctgcccatctgattgtacagcatctgacatttctggggaaggctaacaaccagacactgcgagaaaagatactgcaagtgaatagcctcgtagaggcattcggcaactcctgtaccgcaataaatgacaactcgagcagattcgggaagtacctcgagatgatgtttacacccactggcgtagtcatgggtgccagaatcagtgagtatctcctggagaagtcacgcgtaatcaaacaggcggccagggagaaaaactttcacattttctattatatttacgctggccttcaccaccaaaagaagctctccgatttcaggctgcccgaagagaaacctcctagatacatcgccgacgaaaccgggcgagtgatgcatgatataacctcgaaagaatcatatcggcggcagtttgaggcaattcagcactgtttccggataatcggctttaccgataaagaagtccacagcgtttaccggatcctcgcaggtatcctgaacattggaaatattgagttcgcagccatttcttcacagcatcagacggacaaatccgaggtccccaacgcggaagccctgcagaatgcagcttccgtcctgtgcatcagtcccgaggagctacaagaggccctgacctcccactgtgtggtgacccgaggggagactataattcgggccaataccgtggaccgggccgcggacgtaagggatgccatgagtaaagcattgtatggacgcttattctcctggattgtgaataggattaatactctcctgcaaccagacgaaaacatctgctcagccggcggaggcatgaacgttggcatcctggacatatttggatttgaaaactttcagaggaactccttcgagcaactctgtatcaacattgctaatgaacagatccagtactacttcaatcaacacgtcttcgcactggagcaaatggagtaccagaacgaaggtatcgacgcagtaccagtcgagtacgaagacaaccgccctctcctcgatatgtttctgcagaaaccgctcggtctgctcgcactattagacgaggagtccaggtttcctcaggccaccgatcaaactttggtcgacaaatttgaggataatcttcgctgtaagtatttctggagacccaagggtgtcgagctctgttttgggatccagcattatgctggcaaggtgttgtatgacgctagcggcgtgctggagaagaaccgggacacactgccagccgatgtggtggttgtcctgaggacgtctgagaacaagctgcttcagcaactgttcagcattccactgaccaagaccggaaatctcgcacaaacacgtgccagaattacggtggctagctcttctctgccccctcacttttcggcaggcaaggcaaaagttgatacccttgaggtgattcgacaccctgaagagaccactaacatgaagagacagaccgttgcaagttattttcggtacagcctcatggatttgctgagcaaaatggtggttgggcaaccacattttgtccgatgcatcaaacccaacgatgacagggaggctctgcagttctcacgggaacgcgtgctggcacagctcaggtctacgggaattctggagacagtctcaatacggcggcagggctactctcaccggatcttgtttgaggaattcgtgaaaaggtattactacctggcgtttacggctcaccagaccccacttgcctctaaagaaagttgcgtggccattctggaaaagagcaggctcgaccactgggtactcggcaagactaaggtctttttaaagtactaccacgtagaacagctgaatttgttactgagggaagtcatcgggagggtggtcgtgctgcaggcgtacactaaaggttggttgggagccagacgctacaagagagtgcgggagaagagggagaagggcgcaatcgcgatccagtcagcttggcgcggttatgatgcgcgtcgaaaatttaaaaagattagtaaccggaggaacgaatccgccgcccacaaccaagccggggatacatcgaatcagagtagcggcccacactccccggtggctgcgggtacaagagggtctgctgaggtacaagactgtagtgagcctggggatcataaggtcctgagaggatcggttcatagacggtctcattcccaggccgagtcaaataacggaagaacccagacctcgtccaacagccccgctgtcactgagaagaatggtcacagccaggcacagagctcacctaaaggctgcgatatcttcgccggtcacgctaataagcatagcgtctcaggcacagatctgttaagttcacggatctgccaccccgcacctgaccagcagggcctttccctatggggtgccccccagaagccagggtccgagaacggcctggctcaaaaacacagaaccccccgcaggaggtgccagcaacccaagatgctgtcatctcctgaggacacaatgtattataaccagttaaacggtacgctagagtaccaggggtccaagaggaagccccgtaagctcggtcagatcaaggtattggacggcgaagatgagtattacaagtccctctcccctgttgactgtataccagaggagaacaattctgcacatccctcattttttagctcctcctccaaaggcgacagctttgcccagcactag

SEQ ID NO: 125405 - DNA, 4026 bp, Artificial Sequence
  Description of Artificial Sequence: Synthetic coding sequence
atgaaacacctttacggcctattccattacaacccaatgatgttggggcttgaaagccttccagaccccactgatacctgggaaattattgagactattggtaaggggacatatgggaaggtgtacaaggtgaccaacaaaagagacgggagcctggccgctgtcaagatcctggatccagtgtcagacatggacgaagagatcgaggccgaatataacattcttcagttcctgccaaaccatccaaatgtcgtgaagttctatggcatgttttataaagccgaccactgtgtggggggtcagctatggttggtcctcgagctgtgcaatgggggtagtgtcacggaattagtgaaaggactcctgcggtgtgggcaacgcctggacgaagccatgatttcttacatactatatggagctctgctcggccttcagcatctccataataatcggatcatccatcgggatgtgaagggcaataacatcctcttgaccaccgaaggtggcgttaaactcgttgattttggagtgtcagcccagttaacttcaacccgactgagacggaacacaagcgtgggtacaccgttctggatggctccggaggttatcgcctgtgagcagcagtatgattcaagctacgacgcaaggtgtgatgtctggtctctgggtattactgcaatcgaactaggcgatggagatccccccttgttcgacatgcatccagtgaagacgttgttcaagatcccccggaatccacccccaacactgctgcatccggagaagtggtgcgaggaatttaatcactttatttcccagtgtttgatcaaagacttcgagaggaggccatcagtcacgcatctgctggaccacccctttattaagggagtgcacggaaaagtactgtttttgcaaaagcagttagccaaagtcctccaagaccagaaacatcagaacccggtggcgaaaacaagacatgaaagaatgcacactcggcggccttatcacgtcgaggatgcggagaagtactgtctcgaggacgatctggtgaacttggaagtgttagacgaggatacaattatccaccagctgcaaaaaaggtatgccgacttgcttatctacacctatgtcggtgatatcctgattgccttaaatccctttcagaatctgtctatttattcacctcagttctctcgcctgtatcatggcgtcaagcgggcttctaacccaccgcatatttttgcaagtgcagacgcagcctaccaatgcatggtgaccctgtcaaaagatcagtgcattgtcatatcaggtgaaagcggtagtggaaaaacagagagcgcccatttgatcgtgcagcatcttacatttttaggaaaggccaacaaccagactctcagggagaagatactgcaggtgaatagcctggtggaggccttcggtaactcttgtacggcgattaacgataattcctctaggtttgggaagtacctggagatgatgttcaccccaactggtgttgtgatgggcgctcgcatatcagaatacttactggagaaatccagggtgataaaacaggccgcaagggaaaaaaatttccatattttctactatatttatgctggactccatcatcagaagaaattgagcgacttcagactgccggaggaaaagccccccagatacatcgcagacgaaacaggccgcgtaatgcatgacataacaagcaaggagtcttatagacgtcagttcgaggccatacagcattgctttcggataataggattcacagataaggaggtccactctgtgtataggattctggcaggaattcttaatattgggaatatcgagtttgccgctatctcatctcagcatcaaactgataagtctgaagtgccaaatgctgaggccctccagaacgccgcatccgttctgtgcatttctcccgaagaactgcaggaggccctcaccagtcattgtgtagttactagaggagaaaccattattcgcgccaatactgtggatcgtgcagccgacgtgcgggatgccatgagtaaagctttgtacggccggcttttctcttggattgtgaaccggatcaacacgctcctgcagcctgatgagaacatttgttcagctggcggtggaatgaacgtggggatccttgatatttttggcttcgagaacttccagcgcaatagtttcgaacagctgtgcataaatatcgcgaatgagcagatccagtactactttaaccagcatgtctttgcactggaacagatggaatatcaaaacgagggtatcgacgcagtgcccgtcgaatacgaagacaacaggccactattggatatgttcttgcagaagcccctcggtctgctcgctttattagatgaggagagtaggtttccacaggctactgatcagacattagttgacaagttcgaggacaatctgcgatgcaagtatttctggcgccccaaaggggtcgagttgtgctttgggatccagcactatgctggcaaggtcttgtacgatgccagcggagttctggagaaaaaccgggacacgctccctgcggatgtagtggtggtacttcggacctccgagaacaagctcttacagcagttgttctcgattcctttgacgaagaccggaaacctggcgcagacccgggcgagaattaccgtggcgtcaagtagcttaccgcctcactttagcgctgggaaggcaaaggttgatactttggaagtgatacggcacccagaagaaacaactaacatgaagagacagacagtggcctcctatttcaggtattcgctcatggatctcctgagcaagatggtggtcggacagccgcatttcgtccgctgtataaaaccaaacgacgatcgcgaggccttacagttcagccgcgagagagtgctggcccagctcagatcaaccggcattttggagaccgtttccattagacggcaggggtattctcaccgaatcttgttcgaagaattcgtgaaacgctattactaccttgcttttacggcacatcagacaccgcttgcatccaaggagagctgtgtggcgattcttgagaaatcccggctagaccactgggtactgggaaaaaccaaagtctttcttaagtactatcacgttgaacagcttaatctgctcttgagggaggttatcggtcgagtggtggtactgcaagcttacaccaagggctggctgggtgcaagacgttataaacgggtgagagagaagcgggaaaaaggggcgatcgccatccagagcgcatggcggggttacgatgcacgaaggaaattcaagaaaatcagcaacaggaggaacgagagtgctgcccataaccaggccggtgatacctccaatcagtcttccggcccccacagcccagtggccgccggcaccagaggttcagctgaggttcaggattgcagtgaacccggagatcataaagtgctgcgcggctctgtccatcgccgatcccactcacaggccgagtcgaacaacggtaggacacagacctcatctaatagccccgctgtgacagaaaaaaatggtcatagtcaggctcaaagtagccccaaaggttgcgatatttttgcgggccacgctaataagcattccgtttccggaacggacttgttatcctctaggatttgccacccggcccccgatcaacaggggctgagtctttggggggcaccacagaaacctggctcggagaatgggttagcgcaaaagcaccgtaccccacggcggcggtgccagcaaccaaagatgctctcctcccctgaagatactatgtactacaatcaattaaatggaaccctggaataccaggggagcaaacggaagccccggaagctggggcagattaaggtgctcgatggagaggacgaatactataaatcactttcccctgtcgattgcattccggaagagaacaattctgcccatcctagcttctttagttcttcatcaaagggagatagcttcgcccagcactag

SEQ ID NO: 125406 - DNA, 3945 bp, Artificial Sequence
  Description of Artificial Sequence: Synthetic coding sequence
atgaagcatctctacggtctatttcattacaatccgatgatgctggggcttgagtccttgcccgatcccaccgacacttgggagattatcgaaactatcgggaaagggacttatggcaaggtctataaggtgaccaacaagagggacgggagcctcgctgccgtgaaaatcctggaccctgtctctgatatggatgaggaaattgaggctgaatacaatatcttacaatttctgccaaaccaccctaacgtagtcaaattctatggaatgttttacaaagcagatcactgcgtcgggggacagttatggctggtactggagctgtgtaacggtggttctgtgacagagctcgtgaaaggcctgctccgctgcgggcagcgcctggacgaggccatgatcagctatattttgtacggcgctcttctcggattacagcatttgcacaacaacagaattatccaccgggacgtcaagggaaacaacattctgctgacaacagagggaggagtcaagctggtggatttcggagtgtctgcacagttgacatcaacacggctgaggcgaaatacatcagtgggtaccccattctggatggccccggaggtgattgcatgtgaacagcagtacgacagttcatacgatgcccggtgcgatgtatggagtctgggaattactgccattgagctcggagacggcgacccacccttattcgacatgcatccagtgaagactttgttcaagattccccggaaccctcctcctacactcctgcaccctgaaaaatggtgcgaggaatttaaccattttattagtcagtgtttgatcaaggattttgaacgacgaccatccgtcacccacctccttgaccatccttttatcaaaggcgtacatggtaaggtactgttcctgcaaaagcagcttgcgaaggtgcttcaagaccagaagcatcagaacccggtggcaaagaccaggcatgaacggatgcacaccagaaggccataccacgtggaagatgccgaaaagtactgcttagaggacgatctggtaaatttggaggtgttagatgaggacaccatcatacatcagttacagaagcgttacgcagacctgctaatttacacctacgtgggagacatcctgatagccctgaaccccttccagaacctctcaatctattcccctcaattcagcaggctgtaccatggggtgaagagggcctccaatcccccacacatattcgcgagtgcagatgccgcctaccagtgcatggttacgctctctaaggaccagtgtatcgttatctccggcgagtcaggttcagggaagaccgaatctgcgcatctaatcgttcagcacctcacctttctcggcaaagctaataaccagactctacgagagaagattctccaggttaactcgctcgtggaggccttcggcaactcctgtacagcaattaacgataactcttcccggtttggcaagtacctggaaatgatgttcactccaaccggcgtcgtcatgggagcacgaatcagcgaataccttctggagaagtccagggttataaagcaagctgcccgggaaaagaacttccacatcttctactacatttatgcaggcttgcatcaccagaagaaattgagcgactttcgtctgccggaggaaaagccgccacgttacattgccgacgaaaccggcagggtaatgcacgacatcacatccaaagaatcctatcggcgtcagttcgaggcaattcaacactgctttagaattatcggatttaccgacaaggaggtgcactcggtttatcgaatcctcgctggaatattaaacatagggaacattgaatttgccgccatctcaagccagcaccagacggacaagtccgaggtcccaaacgccgaggcccttcaaaacgctgcctcagtgctgtgtatctcgccggaggaactgcaggaggccctgactagtcattgtgtagtgactcggggggaaacaattattagagccaacacggtcgatagggctgcagacgtacgcgacgctatgagcaaagccctgtatgggcggctgttctcctggatcgtcaatcgtatcaataccctgttgcaaccagatgagaatatctgcagtgccggtggtggcatgaatgtgggcatcctcgacatctttgggttcgaaaactttcagaggaacagctttgagcagctgtgtatcaacatagcaaatgagcagatccagtattattttaatcagcacgtttttgcactggaacagatggagtatcagaacgaaggaattgacgcagtgcctgtcgaatatgaggacaaccgacctttgttggacatgttcttgcagaaaccacttggactgctggcattactagacgaggagagtcgcttcccacaggccaccgaccaaaccctggtggataaatttgaggataacttaagatgtaagtatttttggcgccccaaaggcgtggaactgtgcttcggaatccagcattatgcagggaaggttctgtacgatgccagcggcgttctcgagaaaaatcgggatacactgcccgcagacgtggtggtggtcttgagaacctccgagaataaactgctccagcagctgttctcaatccctcttaccaagacaggaaacctggcccagacccgtgcacgcatcacagttgcttcaagcagcctccccccccacttcagcgcagggaaagccaaggtggataccctcgaggtgattagacatccagaggaaacaaccaatatgaagagacaaacagtagctagttacttcaggtactctctcatggacctgctctcaaagatggtggttggacaacctcactttgtccgatgcatcaagcctaatgacgatcgggaggcgcttcaattttcaagagaacgggtgctggcacaattacgcagtacaggaatcttagagacagtgagtatccgacggcagggttactcccaccggatcctgtttgaagaattcgtcaaaagatactattatctggcgtttacagctcatcaaactccactcgccagcaaggagtcctgcgtggccattctagagaagtcaaggttggaccactgggtcctcggcaagacaaaggtgtttctgaaatattatcatgtggagcagctcaatctgctgttgcgtgaagtcataggccgggttgttgtgctgcaggcctacaccaaaggctggcttggagcacggcgctacaaacgggttcgcgagaaaagagagaagggtgccattgctatccagtctggcgataccagcaaccagtcaagcggacctcattcgcctgtggctgctggcacaagagggagcgctgaagtgcaggattgctccgagcctggagatcacaaagtgcttcggggatctgtgcaccggcggtcccacagccaggcggaaagcaataacggaagaacccagacctccagcaattcgccagccgtgactgagaaaaacgggcactcacaggcgcagagctctcccaaggggtgcgacattttcgccggacatgcaaataagcatagtgtatctggcaccgatctgctgtcctcgcggatttgccacccagcacctgatcagcagggtctaagtctgtggggggctccccaaaagcccggctccgagaatgggctggcccagaaacaccggacccccaggaggaggtgtcagcagcctaagatgctgagctcacccgaggatacgatgtactacaatcaacttaacggcaccctggagtatcagggtagtaagagaaaaccgagaaaactgggacagataaaagtattagacggtgaggatgaatactataagtccctgagccccgtggactgcataccggaggagaacaactcagcgcatccttccttcttctcatccagttccaagggcgatagctttgcacagcactag

SEQ ID NO: 125407 - DNA, 3390 bp, Artificial Sequence
  Description of Artificial Sequence: Synthetic coding sequence
atgaacataaacgacggagggcgcagaagattcgaagacaacgagcataccctccggatctatccaggagccattagtgaaggcactatctattgccctatcccagcccggaaaaacagcactgctgcggaggtgatcgagagcctgatcaacaaattgcacctggacaaaaccaagtgttatgttctcgccgaagtgaaggagttcggtggagaggagtggatattgaatccaactgactgcccagttcagcgcatgatgctatggccgaggatggctctggaaaaccggctgagtggcgaagactacagattcttactgagagagaaaaatcttgacggctcgattcattacgggtccctccagtcctggctgagggtgactgaggaacgccgtagaatgatggagcgaggcttcctgccacagccccagcagaaggactttgacgacctgtgctcactgcctgacctgaatgaaaagactcttttggagaaccttcgaaaccggttcaaacatgagaaaatatacacgtatgtgggcagtatcctgattgtgataaacccgttcaaattccttccaatatataaccctaaatacgtgaagatgtacgacaatcaccagttagggaagctcgagccccacatctacgctgtggctgacgttgcctaccacgctatgctgcagcggaaaaagaatcagtgcattgtgatctccggagaaagcgggtcgggcaaaacccagagtaccaatttcctgatacaccatctcacggctctgtcacagaagggttttgctagcggcgtcgagcagatcatcttaggggctggtccggttctcgaagcttttggaaacgccaagactgcacataacaataattccagccgttttggtaagtttatccaggtgaactaccaggaaaccgggaccgtgctgggggcctacgtggaaaagtacctgctggagaagtccagactcgtctatcaggagcataatgaacgaaattaccatgtattctactatctcctagccggagcgtccgaggacgagcggagcgccttccatcttaagcaacctgaggagtaccactacttaaatcaggattgctttacagtggaaggagaggatctcagacacgatttcgaacggctccagctcgctatggagatggtgggcttcctccccaagacccgtagacagatttttagcttgctgtccgctattctgcacctggggaatatttgctataaaaaaaagacttacagggacgactctatcgatatctgcaatccggaggtcctgcctatagtctcagaactgctcgaggtgaaagaggaaatgctgtttgaggcccttgtgacacgaaagaccgtgaccgtgggcgaaaagctcatcctgccgtataaactggccgaagcagtgaccgtgcggaacagcatggcgaagtcactgtatagcgccctttttgactggatagtcttcagaataaaccacgctcttctgaacagtaaagatttagaacacaataccaagaccctttctatcggcgtcctcgacatcttcggctttgaggactatgaaaataatagttttgaacaattctgcattaattttgccaacgagaggttacaacactacttcaatcagcatatcttcaagcttgaacaagaagagtaccgaaccgaaggaatctcttggcataatattgattacatagataacacatgctgcattaatttgatttccaagaagcctacggggctactgcacctgcttgatgaggagtctaactttccacaggccaccaatcagacgctgcttgataaattcaaacatcaacacgaagataactcttacatcgagttccctgccgtgatggagcccgccttcattattaagcattatgctgggaaggtcaagtatggagtcaaagattttcgagaaaaaaacacagaccacatgcgccctgacatcgtcgccctcttgagatcctctaagaatgccttcattagcgggatgatcggaatagaccctgtggccgtgttcaggtgggcgatcctgcgggcattttttcgcgcaatggtcgcttttcgtgaagccggtaagcgcaacatccacaggaaaactggccatgatgatacagctccttgtgctatattgaagtctatggactctttttctttcctacagcaccccgtccatcaaaggtctttggaaatcctgcagagatgcaaagaggaaaagtactcgattactcgaaaaaatcctcgcacccccctctctgacttacaaggaatgaatgccctgaatgagaagaatcagcatgacacgtttgacatcgcctggaatggtcgcaccggcatcaggcagtcccgcctgtcttcaggaacaagcctccttgacaaagatggcatttttgccaactctacaagtagtaaattgcttgaacgggcacacgggatcttgactcgcaacaagaattttaaaagcaaacctgccttgcccaaacacttgctggaagtgaactccttaaaacacctgaccaggctgaccctacaggataggatcacgaaatctctcttacatctgcataaaaaaaagaaacccccatctatatcagctcaattccaggcttccttatctaagctaatggagactctgggccaggccgagccgtacttcgtgaagtgtattaggtccaatgccgagaagttacctctcagattcagcgatgtgttggtgctcaggcaacttcggtatacaggtatgttagaaaccgtgaggatcagacagtcgggctacagctccaaatacagttttcaggactttgtgtctcactttcatgtgttgctcccccgcaatataatccccagcaaatttaatatacaagactttttccggaaaatcaatttgaatcctgacaactatcaggtcggcaaaacaatggtattcctcaaagaacaggagcggcaacatttgcaggatttactccatcaggaggtcctgaggcggattattctgcttcaacgctggtttcgggttttgttatgcagacagcattttctgcaccttcgacaggcttctgtcatcatccagaggttttggagaaactatctgaaccaaaaacaggtgcgcgatgctgcagtgcagaaggatgccttcgtaatggccagtgctgcggcgcttcttcaggcttcttggagggcacaccttgaacgccaaaggtatcttgagctgcgggccgcggccatagtcatccagcaaaagtggagagactattacagacggcgtcacatggcagccatctgcatacaggccaggtggaaggcttatcgtgagtcaaaacgttaccaggaacagagaaagaattatccctttgctattaatatgtag

SEQ ID NO: 125408 - DNA, 7647 bp, Artificial Sequence
  Description of Artificial Sequence: Synthetic coding sequence
atgaacatcaatgatggcggccgacgccggttcgaagataacgagcatacactgcgcatctaccctggggcgatttctgaggggacaatatactgtcccatccctgctcggaagaactcaacggcagcagaagtgattgaaagcctcatcaacaagctgcatttggacaagaccaaatgttacgtgctggctgaagttaaagagtttggaggtgaagagtggatactcaacccaacagattgcccggtccagcgcatgatgctgtggcctcgtatggcacttgaaaatcggctgagcggagaggattacagatttctgctgcgggaaaagaatcttgacggctctatccattatggcagcctgcagagctggttgcgggtgactgaagagcgcaggcggatgatggagcgtgggttcctgccacagccacagcagaaagacttcgatgatctgtgtagcttgcctgatttgaacgaaaaaaccctactggagaatctcaggaaccggttcaagcatgagaagatctatacgtatgtaggttccatcctcatcgtcataaatccattcaaattcttgcctatctacaaccccaaatatgtcaaaatgtatgataaccaccagttgggaaagctggagccccacatatatgcagtcgctgacgtcgcttatcacgctatgctgcagcggaagaaaaaccagtgcatcgtgatatctggtgagtcaggcagcggtaaaacgcaatccactaacttcctgatacaccacctcaccgcgctaagccagaaaggattcgcgagcggggtggaacagattatcctgggggctggacccgttctggaggcctttggcaatgctaaaactgcccataataataactcatctaggtttgggaagttcattcaggttaactaccaggagacaggaactgtgctgggggcttacgtggaaaagtatctgttggaaaagagtcgcctggtgtatcaggaacataatgaacggaactaccatgtattctattacttattagcaggcgccagcgaggatgagcggagtgctttccatctgaaacagcctgaggagtatcattatctaaaccagataacaaagaaaccactcagacagtcctgggacgactattgttacgactcggagccggactgctttacggttgagggagaggatttgcgccatgactttgaacgtctgcagctggccatggagatggtgggattcctcccaaagacacgaaggcagattttctccctcttgtccgccattttgcacctagggaatatctgttataaaaagaagacctacagagatgacagcattgatatttgtaatcccgaggtgctgcctatcgtgtccgagctcctggaggtgaaggaagagatgctgttcgaggccctcgttacaagaaagacagtcactgttggtgagaagctgatactaccctacaagctggcagaagcagtaacggtgagaaactctatggctaagagcctttactccgctttatttgattggatcgtgtttcgaattaatcatgctctgctgaactctaaagacttggaacacaataccaagacattgagtatcggagtgctcgacatcttcggttttgaagactatgagaacaacagctttgagcaattttgcataaattttgccaatgaaagattgcaacattacttcaaccagcatatcttcaagctcgaacaggaagaataccggaccgagggaatttcctggcacaatatagactatatcgataacacctgctgcatcaacctgatatccaaaaagcctactgggctgttgcacctgctagatgaagagtccaacttccctcaggcgactaaccagacactcctggacaagttcaaacaccagcacgaagataattcctacattgaattccccgctgttatggaacctgccttcataattaaacattatgccggcaaagtgaaatacggcgtaaaggactttagagagaagaatactgatcatatgcggcctgatatcgtagccctactgaggtcttcaaagaatgccttcatctccgggatgattggaatcgatccggtcgctgtctttcgttgggccattctccgcgcctttttcagggctatggtcgccttccgagaagcgggtaagcgcaacattcacaggaaaactggccacgatgacaccgccccttgcgccattttaaagtcaatggactcattctcctttcttcagcacccggtgcatcagcggtcattggaaatcctacagaggtgtaaggaagagaaatacagtataacccgcaaaaatcctaggaccccattgtcagacctgcaggggatgaatgccctgaacgagaaaaaccagcacgatactttcgatattgcgtggaacggacggacaggcatcagacagtcaagactaagcagcggcacctcgctgctggataaggatggcatcttcgccaactccacttcaagcaagctgctggaacgtgcccacggcatcctcacccggaacaagaattttaagtccaaaccagctcttccaaaacacctcctggaagtgaatagtctaaagcaccttacccgcctcactcttcaggatagaatcactaaatctctgctgcacctgcataaaaagaagaaacccccgagtatttcagcccagttccaagcatctctaagtaagttgatggagacgcttggccaagcagaaccatactttgttaaatgtatcaggagcaacgcggagaaactgccgctgaggttctcggatgtgcttgtcctcagacagctcaggtatactggcatgctggagacagttaggatccgccagagcggatactcctctaaatactcgttccaagattttgtgagtcatttccatgtattactgcctagaaatataattccttcgaagtttaatatacaggatttcttccgcaagataaacctcaatcccgataactaccaggttgggaagaccatggtgtttctgaaggagcaggaaagacaacatttgcaggacctgctgcatcaggaggtgctcagaaggatcatactgctccagagatggttccgcgtcctgttatgtaggcagcatttcttacacttgcgccaggcaagcgtgatcattcagcgattttggagaaactatctcaaccagaaacaggtgcgtgatgccgcagtccagaaagatgcctttgtgatggcatctgcagctgcactcctgcaggcaagttggcgggcccatctcgaaagacaaaggtacctcgaattgcgcgcagctgcaatcgtgatacagcaaaaatggcgagactactaccggcgaagacacatggcagcgatatgcatccaggccagatggaaagcataccgggaatccaaaaggtatcaggaacagcggaaaaagatcatactgctgcagtcaacatgtagagggttccgggctagacaacgcttcaaggcgctgaaggagcaacggctgagagagactaaaccagaggtaggcctggttaatattaaaggctatgggtccttagaaattcagggctctgaccctagcgggtgggaggactgctcgttcgataatcgcatcaaagccatcgaagaatgcaaatcagttattgaatcaaacaggatctcccgtgaatcttctgtcgactgcctgaaagaaagtcccaacaaacaacaggaaagagctcaatcgcaaagcggtgtcgacctgcaggaggacgtactcgtgcgagagcggcctaggagcctggaagacctccaccagaagaaggtcggacgcgccaaacgggaaagcagaaggatgagggaactcgagcaagccatcttttcactagagctcttaaaggttcgatccttaggagggatctccccgtctgaagacagacggtggagcacagagctggtgccggaaggtctgcagagccctaggggaactcccgactcagagtcaagtcaaggctcactcgagctcttgtcttatgaggaaagtcagaagtccaagctcgagtctgtgatctctgatgagggcgacctccagtttcctagcccaaaaatttcttcatcacccaagtttgatagtagggacaatgccctgtccgcaagtaacgaaactagttccgcagaacatcttaaggacggaaccatgaaggaaatggtcgtctgtagcagcgaatccataacctgcaaacctcagctgaaggactcctttatctctaatagtttaccaacgtttttttacattcctcagcaggaccctctcaagactaatagccagctcgatactagcatacagaggaacaaactgctggaaaacgaagatacggctggggaggctctcacgctggacataaatcgggaaaccaggaggtatcattgttctggtaaagatcaaatcgtaccctcactgaacaccgaaagttccaatcccgtcctcaaaaaactggaaaaattaaataccgaaaaggaagaacgacaaaaacaactgcagcagcagaatgagaaagaaatgatggagcaaatcaggcagcaaacagacattctcgagaaagagaggaaggcctttaagaccattgagaagccgcgaatcggtgagtgcttggtagctcctagctcctaccagagcaagcagagggtggaacgcccaagctcactgttatccttgaacacctccaacaagggagaacttaatgtcctgggaagcctctctcttaaggatgcggccctcgcccagaaagatagcagctccgcgcatctgccccctaaagacaggcccgtgaccgtgtttttcgagcgcaaaggctccccatgccagagttccacagttaaggagctaagtaaaactgatcgcatgggaacccaactgaatgtcgcctgtaaactgagcaataaccgaatctccaagcgcgagcacttccgcccaacccagtcatatagccataattctgacgacttaagcagagaaggcaatgctcgcccaatctttttcacaccgaaagataacatgtctatccccctggtgagtaaagaggcactcaactcaaaaaatcctcagcttcacaaggaagacgagcccgcgtggaagcctgtcaagctcgcaggacctgggcaacgggagacatctcaacgtttctcttctgtagatgaacaggcaaaactgcacaaaactatgtctcagggtgaaattacgaagcttgcagtgaggcagaaagccagcgattcagatatccgtccccagagggcaaagatgcgcttctgggccaaagggaagcagggcgagaagaaaactacacgggtcaaaccgaccacacaatcagaggtttctcctctctttgccggcacagacgttattcccgcacatcagttccccgacgaattggcggcctatcatcctaccccaccactgagtcccgagttacccggctcgtgcagaaaggaattcaaggaaaacaaagagcctagtcccaaggcgaaacggaaaagatctgttaaaataagtaatgtcgcactagactctatgcactggcagaatgactctgtccagatcatcgcctccgtatccgacttgaaatctatggatgagttcctgttgaaaaaagtcaatgacctggataacgaggattccaaaaaagatactcttgtggacgttgtgttcaaaaaagcactgaaggaattccgacaaaacatcttttccttttacagtagcgccctcgccatggacgacggcaagtctatccggtacaaggacctctatgcacttttcgaacagatccttgagaagactatgaggctcgaacagcgagattctctgggagagagtcccgttagggtctgggtgaataccttcaaggttttcctagatgagtatatgaacgagttcaagacttccgactgcaccgccactaaggtccccaagacagagcggaaaaagaggcgcaaaaaggagaccgacctggtagaagaacataacggccacattttcaaagctacacagtacagtatacccacatactgtgaatattgtagctccttgatttggatcatggaccgagcatctgtctgtaaactgtgcaagtacgcctgccacaagaagtgctgtctaaaaactaccgcgaagtgtagcaagaaatacgaccccgagctgagtagcaggcagttcggggtcgagctgagcagactgacaagcgaagaccgaacagtgcctttggtggtcgagaaactgatcaattatattgaaatgcatggcttgtatacagaaggcatctaccgcaaatccggctctaccaataaaattaaagagctcagacagggacttgacactgatgccgagtctgtgaacctagatgactacaacatacatgtcatagcgtctgtgttcaaacagtggctgcgcgatctccccaaccctttaatgactttcgagctttacgaggagttcttgcgggctatgggtttgcaagagcgaaaggagaccatccgcggagtttattccgtgatagaccagctgtcccggacacatctgaacaccttggagagattaatcttccatctggtgcggattgcactccaagaagacaccaacaggatgtctgctaatgcgctggccattgtatttgctccttgtatactgagatgtccagataccaccgacccactgcagagtgtacaggatattagcaagactactacctgcgtagaactgattgtggtggagcaaatgaacaagtacaaggcccggctgaaagatatatcctctcttgagttcgcagaaaacaaggctaaaacacggttgtcgctcatcagacgctccatggggaagggaagaatacgacgcgggaactacccgggcccttcatctccggtggtagtacggcttccgagcgtgagcgacgtcagcgaggagacgctaacgagtgaggctgcaatggaaacagatattaccgaacagcagcaagctgctatgcagcaggaggaaagagtcctcactgaacaaatcgaaaacctccagaaagaaaaggaagaactgaccttcgagatgctggtgctggaaccgcgcgcttctgatgacgagactctggagtccgaagcgtctatagggaccgctgacagctctgagaacctcaacatggagtcggaatatgctatcagtgaaaagtccgagcgcagtctggcactgtctagtttaaagacagctggtaagtctgagccctccagtaaactgaggaagcaactgaagaagcagcaggattctcttgacgtggtggacagctcggtcagctccctctgcctttcaaacactgccagttctcacggcaccaggaagcttttccagatttactccaagtctccgttctatagagcagcttcaggcaacgaggccctgggcatggaaggacccctcgggcagaccaagttccttgaggacaagccccaattcatcagtcggggaacgttcaatcctgaaaaaggaaaacaaaaactgaagaacgttaaaaacagtccgcagaagaccaaggagacgcccgaggggactgtgatgtctggcaggagaaagacagtggacccagattgcacctccaatcagcaactagccctgttcgggaacaatgaatttatggtgtag

SEQ ID NO: 125409 - DNA, 7860 bp, Artificial Sequence
  Description of Artificial Sequence: Synthetic coding sequence
atgaatatcaatgacgggggccggagacggtttgaggataacgagcacactttgcggatttaccccggagccatctccgaagggacgatctattgtcccattccagcccgtaaaaacagcacagctgccgaggttattgagagcctcatcaataaactgcacttggacaagacaaagtgttacgtgctcgccgaagtcaaggagtttggcggggaggagtggatcctgaatcccacggactgccccgtccaacgtatgatgctgtggcctaggatggctctagagaatcgtctgtccggggaagactaccgattcctccttagggagaaaaatctggatggatccatccattatggctccctccagtcttggctccgtgtgaccgaggagcggcgcagaatgatggagcgtggtttcttaccccaacctcagcaaaaagattttgacgacctttgctcactgcccgacctgaacgagaagacgttgcttgagaacctcaggaatcggtttaagcatgagaagatctatacatacgtgggttcaatcctcatcgtcatcaacccttttaagtttttgcctatctataaccccaagtatgtcaagatgtatgacaatcaccaacttggaaagttagagccccacatttacgcagtcgcggatgtggcctaccatgccatgctgcagaggaagaaaaatcagtgtattgtgatctcaggagaatcaggcagcgggaagactcagtccacaaattttttaatccaccacctgaccgcactctctcaaaagggatttgcctccggtgtagagcagatcatattgggagctggccctgtgcttgaggcatttggcaatgcaaaaacagcccacaacaataattcctcgcgctttggcaagtttattcaagtgaattatcaagaaaccggaacagtccttggagcttatgtagagaaataccttctcgagaaatccaggctggtgtatcaagaacataatgagcgcaattatcacgtcttttattatctactggcaggtgcctctgaggacgaacggtctgccttccacctgaaacaaccggaagaatatcactatctgaaccagattacaaagaaacctttgcgccagagctgggatgattattgctatgactcagagccggattgtttcaccgtcgaaggtgaggacctgagacatgatttcgaaagactccagcttgcaatggaaatggtgggctttctacctaagactcgccgacaaattttttctctgttgtcagcaatcctacatctggggaacatttgttacaagaaaaaaacatatcgggacgattcaattgacatctgcaacccggaggtgcttccaatcgtttctgagctgctggaggtgaaagaagagatgctattcgaagcgctggtcactcgaaagaccgtaactgtgggggagaaactcatcttgccctacaaacttgcagaagctgtgacagtccgtaactcaatggccaaatcactctattcagccttattcgactggatcgtattccgcataaaccatgctttactcaatagcaaggatctggagcacaacaccaagaccctgtccatcggagtgctcgatatcttcggatttgaagattacgagaacaatagcttcgaacagttctgtattaatttcgctaacgaacgcctccagcactacttcaaccagcacattttcaagctcgagcaagaagaatataggacagaaggcatctcttggcataatattgactacatcgataacacttgttgcattaaccttatctctaaaaagccaactggccttcttcatcttctggatgaggaaagcaatttcccgcaggcgaccaaccagacccttttggataaattcaaacaccaacacgaggacaattcctatatcgaattccccgctgtgatggaaccagcctttatcatcaagcattacgcgggtaaggtgaaatacggagtcaaggatttccgagagaaaaacactgatcacatgcgacccgacatcgtagcactcctgcggtcgtctaagaacgcattcatttctgggatgattggtatagaccccgtcgccgttttcaggtgggctattctgagagcgttcttcagggccatggtggcattccgggaggcgggaaagcgcaacatccaccgaaagacggggcacgatgacacagcaccctgtgcaatcctaaagagcatggacagcttttcgtttctgcagcacccagttcaccagcgctcacttgaaattctccagcggtgcaaggaggaaaagtatagcattactaggaagaaccccaggactcctttgagcgacctgcaaggcatgaatgctttgaatgagaaaaatcagcatgatacgttcgacattgcgtggaacggcaggacaggtatacgccagagtcgcctctcgagcggaactagtctcctggacaaagatggtatctttgcgaatagtacctcttcgaaactactggagcgagctcatgggatcctgacgaggaataaaaactttaagagcaagcccgcgcttcccaagcatctgttagaggttaattctctgaaacatctgacacgccttaccctccaagataggattactaaaagccttttacatttgcacaaaaagaagaagcctccatccatatcagctcaattccaggccagcttgagcaagctaatggaaactttgggacaagcagaaccttacttcgtgaaatgcatacgttctaatgccgagaaactccccctcagatttagcgatgtcctcgttcttaggcagctacgatatactggaatgctcgagaccgtcagaattcggcagtccgggtattcttctaaatatagctttcaagacttcgtgagtcatttccacgtgctgctgccaaggaacattataccatctaaatttaacattcaggatttttttcgcaagattaacctgaaccctgacaactatcaagtcggcaaaaccatggtctttctcaaggagcaggagcgccaacacttgcaagacttacttcaccaggaagtgctccggcgcatcatcttgctgcagcgctggttccgggttttgttatgccgtcagcactttctccacctgaggcaggccagtgtgatcattcagaggttctggaggaactacctgaatcagaaacaggtgcgcgacgccgcagtccagaaggacgcatttgtaatggcttccgcggccgcactgctacaggcatcctggcgagcacacctcgagagacagagatacctcgaactgagggctgcggccatcgtcatccagcaaaagtggcgagactactatcgtcggcgccatatggccgctatttgcatccaggctcgctggaaggcatacagggagtcaaagcgctaccaggagcagaggaaaaaaataattctcttacagtccacatgtcgcggattcagggccagacaacgattcaaggccttgaaggaacagagactccgggaaacaaaaccagaggtggggctggtaaacatcaaggggtacggcagcctggagatccaaggaagtgacccttctggctgggaggactgctcatttgataatcgcataaaagccattgaggagtgtaaaagtgtcatcgaatccaatagaataagtagagaatcttccgtcgattgtctgaaggaatcacccaataaacaacaagagagggcccagtcacaaagcggcgtggacctccaagaggacgtgctggtgcgcgaacgacctaggtccctggaggatctccaccagaaaaaagtgggtagggctaagcgcgagtcaagaaggatgcgagagctggagcaggctatcttcagccttgagttactgaaggttaggtccttgggcgggatctcgccctctgaggaccgcagatggagtacagaactggtgccagaaggtctgcagtcaccacgcggaacccccgattccgaaagcagccagggttctttggagctgcttagctacgaggaatctcagaagtcaaagttggagtctgttatcagcgacgagggcgacctgcaatttccatctcccaaaatcagtagttcaccaaaattcgattcccgagataacgccctgtcagcttctaacgagaccagttccgccgagcatctcaaagatggcaccatgaaggagatggtggtatgctcctccgaatccattacatgtaagccgcagctgaaagactcctttataagcaatagtctacctacgttcttttacatacctcagcaggaccctttaaaaaccaacagtcaactggacaccagcatccaacggaacaagctcttagagaacgaggatactgcgggggaagccctcacactggatataaacagagagactcggcgatatcactgtagtggcaaggatcagatcgttccatcactcaacaccgaatcctctaatcctgtgttaaaaaaactggaaaagctgaacacagaaaaggaagaacgccagaagcagctgcagcaacagaatgaaaaggaaatgatggagcagatcaggcaacagacagatattctagagaaggaacgaaaggctttcaagaccatagagaaacctcgcattggagagtgcctggtcgcccctagctcataccagtcaaaacagcgcgtcgagcgcccctcatcgctgctcagtttaaataccagcaataagggtgagctcaatgtgctcgggagtctgtccctgaaagacgctgcactcgcccagaaagattcctcatccgcccaccttcccccaaaggataggccagtgacagtgttcttcgagcgcaagggttctccttgccagtcgagcacagtgaaggaacttagcaaaacagacagaatggggacacaactaaatgtggcttgcaagttgagcaataatagaatctctaagcgcgaacactttcgtccaactcagtcctactctcacaacagcgatgatctgtcgagggagggtaacgcacgacccatcttctttactccaaaggacaatatgagcattcccctcgtctcaaaagaggctctgaactccaaaaatcctcagctgcacaaggaagatgaacccgcttggaaaccagtgaagctggcgggtccaggtcaaagggaagtggcaagacccgcccataaaaagaaagcccgtatggcccggacaagatccgactttcttacacgcggcacctttgcagacggggaaggagacactgaggaagacgattacgatgacattatcgaacccctgctgagccttgatcaggctagccactgtgagttgggacccgctccaagtctgggtcaggcctcacattccgatagtgagatgacctctcaacgattttccagcgtggatgagcaggctaagttacacaagacaatgtcccagggagagatcactaaactggccgtacgccagaaggccagcgatagcgacatccggccccaacgggccaaaatgagattttgggcaaaaggtaagcagggggagaagaaaacaacccgcgttaagccgactacgcagtccgaagtgtcccccttatttgcgggaactgatgtgatccctgctcaccagttcccagatgaattagcggcatatcatcctacgcccccacttagtcctgaattgccaggttcatgtagaaaagagttcaaggagaataaggagccatcacccaaggccaaacggaagcggtcagtgaagatctccaatgtggctctggattctatgcactggcagaacgattcagtccaaattatagcatcagtgtctgacctcaagtcaatggatgagtttcttctgaaaaaagtgaacgacctggataacgaagattccaagaaggacaccttggtggacgtggtgttcaagaaagccctcaaggaatttcggcagaacatcttctctttctactcttctgctctggccatggacgatgggaagagcattcgctataaagacctgtatgctttgttcgagcaaattctggagaaaacaatgcgcctcgagcagcgggatagcttaggcgaatctcctgtccgagtgtgggttaacacatttaaagtcttcctcgacgagtatatgaatgagtttaagaccagtgattgcaccgcgacaaaggttcctaagaccgagaggaaaaaaagaagaaagaaggaaacagatcttgtcgaggagcacaatgggcacatcttcaaggcgacacagtattccatcccaacatattgcgaatactgtagttcactgatctggatcatggaccgcgcttccgtctgcaaactgtgcaagtacgcttgccataaaaagtgctgcctgaaaaccacggctaagtgttccaaaaagtacgacccagagctgtcatcacggcaattcggggtagaactgagcaggctcaccagcgaggacaggactgtcccactcgttgtggaaaaactgatcaattatattgaaatgcacggactctacactgaagggatttaccgtaagtcaggtagcactaacaaaatcaaagagctccgtcaaggtcttgataccgatgctgagtcagttaacctggacgactacaatatacacgtgatagcttctgttttcaagcagtggctcagggatctgccaaaccctctcatgacctttgagttatacgaagaatttctgagggctatgggactccaggaaagaaaagaaactatccgaggtgtgtattctgtgatagaccagctgagtagaactcacctcaacactctggaaaggttgatcttccacctggtgcgcatagctctgcaggaggatactaacaggatgagcgctaacgctcttgcgatcgtgtttgccccatgtattctgcggtgccccgatactacagatccactgcagagcgtgcaggatatctccaagactaccacttgtgtcgaattgatagtggttgagcagatgaacaaatataaagctaggctgaaagatatcagctcactggagtttgccgagaataaggctaagacaaggctgagtctgattcggcggagtatgggcaaagggcgtattcggcgaggaaactatccagggccgagcagcccagtcgtggtgcggctgccttccgtgtcagacgtgtcggaagagacattgacaagtgaggcagctatggaaaccgacattactgaacagcagcaggcagcgatgcaacaggaggagagggtgctgacagagcagatagaaaatctccagaaagaaaaggaagagttgaccttcgagatgttagtgctggagccccgggcctccgatgacgagacattggagtcagaggcgtcaattggaaccgcggactcttcggaaaacctgaacatggaatccgagtacgccatctccgagaaaagtgaaaggtcacttgctctgagctctctcaagacagcaggcaagagcgaaccatccagcaagcttcggaaacagctgaagaaacaacaggacagtctggatgttgtggattctagcgtgagttccctttgtctcagcaataccgctagtagccacggtactagaaaactgttccaaatctattctaagagtccattctatcgggccgctagtggtaacgaagctcttggcatggagggtcctttgggtcaaactaaatttttggaagacaagccacagttcatctcgcgcgggacctttaatcctgagaaggggaagcagaagctgaaaaacgtgaaaaattcaccccaaaagacaaaagaaacacccgaggggactgtcatgtctggcagacggaagactgtcgatcctgactgcacctctaatcaacagctcgcactattcggaaacaacgagtttatggtctag

SEQ ID NO: 125410 - DNA, 7590 bp, Artificial Sequence
  Description of Artificial Sequence: Synthetic coding sequence
atgaatatcaatgacggtggacgccgcaggtttgaagataatgaacataccctcaggatttaccctggcgccatcagcgagggaaccatttactgtcccatccccgcccgcaagaattctacagcggcagaagtaattgaatccctcatcaacaagctccatctcgacaagactaagtgctacgtactcgccgaggtaaaagagttcggcggcgaagagtggattctcaatccaactgactgccccgtgcagcgaatgatgctgtggccccgaatggccctcgaaaacaggctgtcaggagaagattacagattcctgcttagagagaagaatttggacggctctatccattacgggagccttcaaagctggcttcgggtaaccgaagagcgacgtcggatgatggagagaggctttttaccccagccacagcagaaagactttgacgatctgtgctccctgccagatttaaacgagaaaaccttgcttgaaaatttaagaaaccgtttcaaacatgaaaaaatttacacgtacgtgggttccattttgattgtcattaatccttttaaattcctccccatttataatccaaagtatgtgaaaatgtatgacaaccaccagctcggtaaattggagcctcatatttatgctgtggcagacgtcgcctatcacgctatgctgcagcgcaaaaagaatcagtgcatcgttatatccggggagagcggttcgggaaagacacaatcaaccaacttcctgatccatcacttgactgccctgtctcaaaaggggttcgcttccggagttgagcagattatccttggagcaggccctgtgttggaagcctttggtaacgccaagactgctcataataataattccagccgcttcggtaagttcatccaggtgaactatcaagagacagggaccgtgctgggcgcttatgtcgaaaaatatctccttgagaaaagccgcttagtgtatcaagaacacaacgaaaggaactaccatgtcttctattatctcttggcaggagctagcgaggatgagcgaagcgcctttcatttaaaacagcccgaggagtaccactacctcaatcaagactgctttaccgttgagggtgaagacttgaggcacgactttgagagactccagctggccatggaaatggtgggctttttacctaaaacacgacgccagatcttcagcttgctgtcggccatcctccatcttggcaatatatgctacaaaaagaagacataccgagacgattctatcgacatatgtaaccctgaggtccttcctatcgtgtcggaattactcgaagtcaaggaggagatgctgtttgaagcgctggttactcgaaagactgttactgtcggcgaaaaattgatcctgccatacaagctcgccgaagctgtaacggttagaaactcaatggccaagtccctgtattcagcgctcttcgactggattgttttcaggatcaaccatgccctgctaaactctaaggatcttgaacacaacactaaaaccctgtccataggcgtgctggacatattcggttttgaagattacgaaaacaactctttcgagcagttctgtatcaatttcgccaacgagcggctgcagcattactttaatcaacacatttttaagcttgaacaggaagaatacaggacagagggcataagttggcataacattgactacatcgacaacacctgctgtataaacctgattagtaagaaacccacagggctattgcacctgctcgatgaggagtccaattttccccaagccacaaaccagacactattggataaatttaagcatcagcacgaagataactcgtacatcgagttccccgccgtgatggaacccgcctttatcataaagcactacgctgggaaagtgaagtacggtgttaaagattttcgagagaaaaacactgatcatatgcggcctgacattgtggccctcctgcgaagcagcaaaaacgcattcatctctggcatgattggtatcgaccccgtagctgtctttcgctgggccatcctgagggcttttttcagggccatggtggcttttcgggaggctgggaagcgcaatatccatcgaaaaaccggacatgatgataccgctccctgcgctattctcaagagcatggactctttcagtttcctgcagcatcctgttcaccagagaagcctcgagatacttcagagatgcaaggaggagaaatactctattacacggaaaaatcctcgcaccccgctgagtgacctgcagggtatgaacgccctgaatgagaaaaatcaacatgacacgtttgacatagcctggaatggccgtacgggaattcggcagtcacggctttccagcggcacctcactgctggacaaggacggtatcttcgccaattcgacatctagcaaactcctggagcgggcccacggcatcctcaccaggaataagaattttaagagtaagccggcgctcccaaaacacctgcttgaagttaactcactgaagcatcttacacggctgacactgcaggaccgaatcacaaaatcgctcctccatttgcataagaaaaaaaaaccgccttccatcagcgctcagttccaggcgtccctcagtaagctgatggagactctcgggcaggccgagccttactttgtgaagtgtattagatccaatgcggaaaagctgcccctgcggttctccgatgttttggtgctgagacaactccggtatactgggatgctcgagacggtccggatcaggcaatctgggtattcctctaaatactctttccaggacttcgtgagccattttcacgtattattgccccggaatataatcccctcaaaatttaacatccaggacttctttaggaaaatcaacctgaacccagataattatcaggtggggaaaactatggtatttcttaaggagcaggagcggcagcacctgcaggacctacttcaccaggaagttcttagacgcattattctgctacagaggtggttcagggtcctcctttgccgccagcattttctccatttgcgtcaggctagcgttatcatccagcgcttctggcgtaactatctcaaccaaaaacaggtccgcgatgctgccgtacagaaagatgcttttgtgatggcatccgcggccgcactgctccaagctagctggcgagcacacctggagaggcagcggtatctggagttgcgtgccgcagcaattgtcatacagcagaagtggagagattactatcgccgacgccacatggctgccatctgtattcaagcacgatggaaggcttatagggagtcaaagcggtaccaggaacaacgtaagaagatcattctactgcagtccacctgccgggggttcagagcaagacagaggtttaaagcattgaaggagcagcggctaagagaaaccaagcccgaggttggtctggtcaacatcaagggctatggatctctcgagattcaggggtctgatccatcagggtgggaagactgctcttttgacaacagaatcaaggcaatcgaagaatgtaaatctgtcattgagtcaaataggattagcagagagagttccgtcgactgcctgaaggagtcacctaataaacagcaagagagggcgcagagtcaatcaggcgtagacttacaggaggacgttcttgtcagagagaggccccgatctttggaagacctgcaccagaaaaaagtcggacgggcaaaaagggagtcccggagaatgagagaactcgagcaagctattttcagcctcgaactgctgaaggtccgaagtcttggtggcattagcccatccgaagaccgccgatggtcgactgaactggtgcccgagggtttgcagtctccccgaggaacaccggatagtgaatctagccagggatctttagaattactgagttatgaggagtcgcagaagtcgaaactggaaagcgtgatcagtgatgagggcgacttacaattcccgtcacctaaaatcagtagctcccccaagtttgattccagggataatgcattatcagccagcaacgaaactagtagcgccgagcacctcaaagatggcacaatgaaggagatggtcgtctgttcctccgaaagcatcacatgcaaaccccagctcaaagattcttttatctccaatagcctacctacattcttctatatcccccaacaggacccccttaaaactaactcacaactcgacacttccatccagcggaataagctcctggagaacgaggataccgccggcgaagccctaactctggacattaatcgggagacgcgacgttaccattgcagcggaaaggatcagattgtgccatcactgaacacagaatccagtaacccagtcctgaagaagctcgaaaaactcaacacagagaaggaggagaggcagaaacaactccagcagcagaatgaaaaagaaatgatggaacagattcgacagcagaccgacatactggaaaaagagaggaaggccttcaaaactattgagaaaccacgcatcggagagtgtcttgtcgcaccaagcagctatcaatccaagcagagggtggaaagacctagttccctgctttccctcaatacatccaacaaaggggagctaaatgtcttgggcagcctgtccctgaaagatgccgctctggctcaaaaggattctagcagcgctcacctgcccccaaaagacagaccagtgactgtgttctttgagcgaaagggttccccttgccaatctagcaccgttaaagagttgtccaagaccgacagaatgggtacccagctaaacgtggcctgtaagctgagtaacaatcgaatctccaagcgagagcactttagaccaacccaaagctattctcataattctgatgacctgtctcgagagggtaatgcgcgtcctattttttttacaccgaaggataacatgtctattcctttagtttccaaggaggccttgaactccaagaatccccagcttcataaagaggacgagcccgcttggaagccagtgaagctagccggcccgggacagagagagacttcacaaaggttcagttcagtcgatgaacaggcgaaacttcacaaaaccatgagtcagggagaaatcacaaaactggcagttcgacaaaaggcctccgactccgacatccggcctcagagggccaagatgcgcttttgggccaaaggaaaacagggggagaagaagacgacacgtgtaaagcccacaacacaatctgaggttagcccccttttcgccggtaccgatgtcattcctgcccaccagttcccagacgagctggcagcctaccacccaacccctcctctgtctccagaactacctggtagctgtagaaaagagtttaaggaaaataaggaacctagccccaaagccaagcggaaacgaagcgttaagatcagcaatgtggcccttgatagcatgcattggcagaatgattcagtgcagattatagcatctgtctctgacctcaagagtatggacgaattcctcctcaaaaaggtgaatgatctggacaatgaggatagcaagaaagataccctagtggatgttgtgttcaagaaagcactcaaggaattccgccagaatattttctccttctattcctccgcgctcgccatggatgacgggaaaagtattagatacaaggacctgtatgccctgttcgaacagatcttggaaaaaaccatgcgtttagagcagagagattccctcggtgaatcaccagtgcgggtatgggtcaatacctttaaggtttttctggatgaatatatgaatgagtttaaaacatctgattgcaccgcaaccaaagtgccaaaaacggagaggaaaaaaagacgcaaaaaggaaaccgatctcgtagaggagcacaatggacacatctttaaggccacccaatatagcatccctacatactgtgagtactgtagtagcttgatttggattatggaccgggctagtgtgtgcaaactctgcaagtatgcctgccacaagaagtgttgcctgaagactaccgccaaatgctctaaaaagtacgaccccgaacttagtagcaggcaatttggagttgaactaagcagactgacctcagaagatcgcaccgtgcccctcgtcgtggagaaactaatcaactacatcgagatgcatgggctttacaccgaggggatttataggaagtccgggagcactaacaaaatcaaggaactgcggcaaggtctagacaccgacgccgagtcggtgaatctcgacgactacaacattcacgtcatcgcgtctgtttttaagcaatggctgagagatctccccaaccctctgatgacctttgagttgtacgaggagttcctgcgggccatgggcctccaggaaagaaaagagaccatccgtggggtctacagcgtgatcgaccaactttccagaacgcacctgaacaccctggaaaggctaattttccacttggtgaggatcgcactgcaggaagacactaataggatgtcagctaatgctttagcaatcgtgtttgccccctgtatcctcaggtgccccgatactaccgacccccttcagtccgtgcaggatatctccaaaacaaccacttgtgttgagctcattgtggtagagcagatgaacaagtataaggcccgacttaaagacatttcaagcctagagttcgcagagaataaagccaaaactcggctgtcgctcatcagaagaagcatgggaaagggacgaatccgaagaggtaactatcctggaccttccagcccagtggtggtgcggctcccgtcggtcagtgatgtttcagaagaaacccttacctcagaggctgcaatggagacggacattactgagcagcagcaggcagccatgcagcaagaagagagagtccttactgagcaaatcgagaacctccaaaaggagaaggaggagctgaccttcgaaatgctcgtcctggagcctagggccagcgatgacgagactttagaaagtgaagcttccatcggaactgctgattccagtgaaaaccttaacatggaaagcgaatatgcgatttctgaaaagtccgagagatcgttggccttaagttctctgaaaaccgccgggaagtccgaaccgtcaagtaagctgagaaagcagctcaaaaaacagcaggatagtttggatgtagtcgatagcagcgtatcatctctctgcctgagtaacaccgcctcgagtcacgggacgcggaagttatttcaaatctattctaagtcacctttttaccgagcggcttctggtaacgaagctctcggcatggaagggcctctgggtcagactaagttcttggaggacaagcctcagttcatctcacgagggacgtttaaccccgagaagggtaagcagaagctcaagaatgtgaagaattcacctcagaaaactaaagaaacaccggagggaaccgtgatgtctggtcgccgcaaaactgtggatcctgattgcacctccaaccagcagctggctttgtttggaaacaatgagttcatggtgtag

SEQ ID NO: 125411 - DNA, 2190 bp, Artificial Sequence
  Description of Artificial Sequence: Synthetic coding sequence
atgaatatcaacgacggcggacggcgtcgttttgaagacaacgaacatacactgcggatctatcctggagcaatcagtgagggaaccatttactgtccgatcccagcacgtaagaactctaccgctgccgaggttattgaaagtttaattaacaagctgcatctcgataaaaccaagtgctacgtcctggctgaagttaaagagttcggaggggaagaatggattttaaacccgaccgactgccccgtccagagaatgatgctatggcctcggatggcgcttgaaaaccgcctcagcggcgaggattatcgttttttactgcgagagaagaatctggacgggtcgattcactacgggagcctgcaatcttggctacgtgtgacggaagagcgacggaggatgatggaacgaggctttcttccccagccccaacaaaaggacttcgatgacctctgcagcctaccagatctcaacgaaaagacccttttggaaaatctcaggaacaggttcaagcatgaaaagatttacacttatgtcgggtccattctgatagttatcaaccctttcaagtttctcccaatttacaatccaaaatatgttaagatgtacgataatcaccaactgggcaaactagagccccatatttacgccgtagctgatgtggcataccatgcaatgctgcagcgcaaaaaaaaccagtgcatcgtgataagcggcgaatctggttcaggcaaaacccagtccacaaatttcttgattcaccatctcacggcactgtcccagaagggctttgcaagcggcgttgagcagatcatcctcggggccggtcctgtattggaggcttttggaaatgccaagaccgcacacaacaacaactcttcccgcttcgggaagtttatccaagttaattaccaagagacaggaaccgtgcttggcgcctacgtagaaaagtacctgttagaaaaaagccgcttagtgtatcaggaacataatgaaaggaattaccacgtcttctattacctgcttgcaggcgcctctgaagatgaacgctccgcattccacctaaagcaacctgaggagtaccattatctgaaccagatcacaaaaaagccattgcggcagagctgggatgactattgctacgactccgagccagattgctttaccgtggagggcgaagacctgaggcacgattttgaacggctgcaactcgctatggaaatggtgggcttccttccaaaaacgagacgccagattttctccctcctgtcagccatcttgcatctgggaaacatctgttataaaaagaaaacatatcgggacgattcaatcgacatctgtaatcctgaggtccttcccatagttagcgaactcttagaagtgaaggaggagatgctatttgaagcactcgttaccaggaaaacagtgacagttggtgagaagctgattctgccatataaattggctgaggccgtcacagtacggaatagtatggccaaatctctctacagcgctcttttcgattggattgtttttagaatcaaccacgccctgctaaactctaaggacctagaacataataccaagactctgtcaatcggggtcctggatatcttcgggttcgaagactatgaaaataatagctttgagcaattctgtattaatttcgccaatgagcggctccagcattattttaatcaacacatcttcaagttggagcaggaagagtacagaacggaggggatttcttggcacaacatcgactatattgacaacacctgttgcatcaatttaatctccaagaagccgactggattgttacatctgttagatgaagagtctaattttccccaagctacaaaccagactctgctggataagttcaaacatcagcacgaggacaacagctacatagagtttcctgctgtgatggagcctgcctttattatcaagcactatgcaggtaaagtgaaatacggggtgaaggattttagagagaagaataccgaccatatgaggcctgatatcgttgctcttttgcgcagctccaagaacgcctttatctctgggatgatcggaatcgaccctgtcgcagtatttcgatgggccattttgcgtgcattttttagagccatggtcgcattcagagaggcaggaaagcgcaacattcacaggaaaacaggcaagtag

SEQ ID NO: 125412 - DNA, 1509 bp, Artificial Sequence
  Description of Artificial Sequence: Synthetic coding sequence
atggataaggctctgttatgctccgtttgtaaaatgacatgccataaaaagtgcgtgcacaaaattcaaagtcactgcagttacacctacggacggaagggagagccaggagtagagcctggccactttggagtgtgtgtcgactccctgacttctgacaaggcttcagttcccattgtcctcgaaaaactgctcgagcacgtggagatgcacgggctctacaccgagggtctgtaccgcaaatctggcgccgccaacaggactagagagctgcggcaggctctccagacggaccctgctgcagtgaagctcgaaaacttccctatccatgccatcacaggagtcctaaagcagtggctgcgagaacttccggaacccctgatgacgtttgctcagtacggggactttttacgagctgtggaattacctgagaaacaggagcagctcgcagctatctacgccgtcttagagcacttgccagaggccaatcacaactctcttgaacgactgattttccatctgctcgctgtcgctctcctcgaagatgtgaatcgcatgtcccccggcgcgctggccattatttttgccccatgtcttcttaggtgtcccgacaattctgatcccctcaccagcatgaaagacgtgctcaaaattacaacttgtgtagaaatgctgatcaaggagcagatgcgtaagtacaaggtcaaaatggaagagatttcccagctggaggctgccgagtcgattgcgtttcggagactgagcctcctgcgtcagaacgcaccgtggccactaaagctggggtttagctccccatacgagggcgtcctaaataaaagtccgaagaccagggacatccaggaagaagaactcgaggttttactggaggaggaggctgcaggaggcgatgaggatcgggaaaaagaaatcctgattgagcgaatccagtcaattaaagaggagaagcaagatataacttataggctgcccgagctcgacccaagaggcagtgatgaggagaatctggattctgagacaagcgctagtaccgagtcactcttagaagaaagggccggccggggggcctccgaaggccccccagcccccgctttaccctgccctggagccccaactccatcccctctgcccaccgtagccgcgccccctaggcgtcgccctagcagttttgtgactgtgcgcgtcaagacacccaggaggaccccaataatgcccactgctaacataaagctgcctccgggtctgccaagccatctgcctcgctgggctcctggagcccgagaggccgccgctcctgttcggcgtcgcgagcccccagcccggagacccgatcagatccactcagtctacattaccccaggcgcagaccttcctgtgcagggggcccttgagcctttagaagaagacggtcagccaccaggagccaagcgcagatacagcgatccgccaacctattgcctcccgccagcctctggacagacaaatgggtag

SEQ ID NO: 125413 - DNA, 6069 bp, Artificial Sequence
  Description of Artificial Sequence: Synthetic coding sequence
atgtcagtcaaggaggctggctctagcgggagacgggaacaggctgcctatcacctccatatttatccacaactgtcaactactgagagccaggcgagttgcagggtcacagccaccaaagacagtactacatcggacgtgattaaggacgcgattgccagtttgcgcttagacgggacgaaatgttacgtcctggtggaagtaaaggagagcgggggcgaggaatgggtcctggatgcaaatgactcccccgttcacagggtcttactatggcccaggagagctcaagacgagcacccacaggaggatggctattacttcctcctccaggaacggaacgcagacggcacaattaagtacgtccacatgcagctagtagctcaggccacagccacccggaggctcgtggaacgagggcttctgcccaggcagcaagccgactttgacgatttgtgcaacctacctgaacttactgaaggaaacttgctgaaaaacctgaaacacagattcttacagcagaaaatctatacgtacgccggctcgatcttggtggccatcaatcctttcaaattcttgcctatatacaatccgaagtacgtgaagatgtacgaaaatcaacagctggggaaactggagccccatgtgtttgcgctcgccgatgtagcttactataccatgcttagaaaaagggtgaaccagtgtatcgtcattagcggcgaatccggttccggaaagacgcaatccaccaatttcttaatccattgtttgaccgcacttagtcaaaaaggatatgctagtggggtggaaaggactatccttggtgcaggcccggtattagaagcatttggaaacgccaaaacagctcataataataacagcagtcgttttggcaagtttatccaggtgtcttacctggagtctgggatcgttaggggcgctgtggtggaaaaatatttacttgagaagtcgaggttggtttctcaggagaaagacgaacggaactaccatgtcttttattacctgctgctcggggtttctgaagaggaacgacaagagtttcagcttaaacagccagaggactatttctatctcaaccagcataaccttaaaattgaagatggagaagacttgaaacacgattttgagaggttaaagcaggcaatggagatggtaggcttcctgcctgccaccaaaaaacagatctttgccgtactgtcagccattctgtacttaggaaatgttacctacaaaaagagagctactggaagggaggagggattagaggttggcccaccagaggtgctggacacattgagtcagcttctcaaggttaaacgcgaaatccttgtggaggtgctcaccaaacgaaagaccgtcactgtgaatgataagctcatccttccttacagcctgagtgaggcaatcaccgctagagactcgatggccaagagtctctatagtgctctgtttgattggattgtgctcagaataaaccacgctctgcttaacaaaaaggatgttgaggaagcggtgtcttgtcttagtatcggagttctggacatattcgggttcgaagactttgagcggaattcctttgagcagttttgcatcaactacgcaaatgagcagctccagtattacttcaaccaacatatctttaaactggagcaggaagagtaccagggagagggcatcacctggcacaacatcgggtatacggataacgtaggctgtattcatctgatatctaaaaaacctacaggcctgttctatttgcttgacgaagagagtaatttcccgcacgcgacgtcgcagactctcctggctaagttcaaacagcagcatgaagataataaatacttcctcggaactccagtaatggaacctgcattcatcatccagcacttcgctggaaaagtgaagtaccagattaaagactttcgagagaaaaacatggactacatgcgaccggacatcgtggcactattaaggggatcggactcttcctacgtgagggagctgatcggaatggatcctgtggccgtttttcgatgggctgttctgagggcagccatccgcgctatggccgtgctgagggaggcgggcaggctgcgggctgagagggcggagaaagccgccggcatgtctagtcccggagctcaatctcacccagaagaactcccccgcggagcctccacaccctctgaaaagctttaccgagatctgcacaatcagatgattaaaagcatcaaggggctgccctggcagggggaggacccccgatcccttctgcagtccctgtcaagattacagaagcctcgcgcctttattctcaaatcaaaaggcatcaagcagaaacagataatcccgaagaatcttcttgatagtaagagtctcaagttaattatctccatgactctgcatgatagaaccacaaagtctttactgcacctccacaaaaagaagaaacctcccagtatcagcgctcagttccagaccagccttaacaaactgttagaggccctcggtaaagctgagccatttttcattagatgtattcgcagcaatgccgaaaagaaagagctgtgtttcgatgacgaacttgttctccaacagttgcgctacaccgggatgttggagacagtcagaattaggcggtctggatacagtgcgaagtatacctttcaggactttacagagcaattccaggttttgctgccaaaagacgcccagccctgtagagaagtgattagtacactcctggaaaaaatgaagatagacaagaggaattaccagattggcaaaaccaaagtgttccttaaagagaccgagaggcaggcacttcaagagactttgcaccgggaagtcgtacggaaaattcttctgctgcagtcttggttccgaatggtcctggagcggaggcactttttacagatgaaaagggcggccgtgacaattcaggcgtgttggcggagctatagagtgcgacgtgcgctggagagaacccaagctgcggtatacctgcaggctagctggcgtggatattggcagaggaaactctacaggcaccaaaagcagagcatcattcggttgcaatccctttgcaggggacacttgcagaggaaatctttctcccagatgataagcgagaagcagaaggccgaagagaaggagagagaggcgctcgaagcagctcgtgctggtgcagaggaaggggggcagggtcaggccgctggaggtcaacaggttgccgaacaggggccagaacctgcagaggacggcgggcacttggcatccgaacccgaggtacagccgagcgacaggtctcccctcgagcatagctccccggagaaggaagctccaagccccgagaaaactctgccaccacagaagactgtagcagctgagagtcatgaaaaagttccatcaagtagggaaaagagggaatcccggagacaacgcgggctggagcatgtgaaattccagaacaaacacattcaatcctgtaaagaggaaagcgctctgagggaaccttcccgcagagtaacacaggagcagggagtgagtttactcgaagacaaaaaagagtccagggaggacgaaactctcctggtggtcgaaactgaggctgaaaatacttctcagaagcaacctaccgaacaaccccaggccatggcagtcggcaaagtgagtgaagaaaccgaaaagaccctcccaagcggctcccccaggcccggacagctcgagaggccaacctcattggccctggattcacgcgtcagcccacccgccccaggcagtgcacccgagactcctgaagataagtctaaaccttgtgggtcccccagagtgcaggaaaagccagactcgccagggggctccacccaaattcagaggtatctagacgcagaacggctggcctctgccgtggagctgtggaggggcaaaaaactggtggccgctgcgtctccgagcgctatgctgagtcagtccctggatttgtcagacagacaccgtgcaaccggcgctgccttgacccccacagaggagagacggaccagcttttcgacttcggatgtttccaaattgctgccgagcttggctaaagcccagcccgctgcggagaccactgacggagaacggtctgctaagaaacccgctgtgcagaaaaaaaagccaggcgatgccagctctctcccagacgctggattgtcacctgggagccaggttgatagtaaatcaactttcaagcgcctcttcctgcacaagacaaaagataagaagtactccctcgagggggcagaggaacttgaaaatgccgtgtccggccacgtcgtcctggaggccacaacaatgaaaaagggtctcgaagcccccagtggacagcagcatcgccacgccgccggagagaaaagaacaaaggagccgggggggaagggaaaaaagaatcggaatgtgaagatcggtaaaattacagtgtccgagaaatggcgggaatcagttttcaggcagataaccaatgcaaacgagctgaagtatttggacgagtttctcctaaataaaattaatgatctgagatctcagaagacacccattgaaagcttgttcatcgaggcgactgagaaatttaggagcaacatcaagacgatgtacagtgttcctaatgggaaaatccacgtcggatacaaagatctaatggagaactaccagattgtggttagcaatctggctactgagcgaggccaaaaagatactaaccttgtgctaaatctgtttcaatctctcctggatgaattcacgcggggatacacaaagaacgactttgagcctgtgaagcagagcaaagcacaaaaaaagaaaaggaaacaagaaagggcggtccaggaacacaatgggcatgtgtttgcctcataccaagtaagcataccacaatcttgcgaacagtgcctgagctatatctggctgatggacaaggctttgctctgcagcgtctgcaaaatgacgtgccacaaaaaatgcgtgcataagattcagtctcattgttcttatacttatgggcggaaaggtgagcctggggtggagcccgggcactttggggtctgcgtggacagcttgacttcagataaagccagtgtaccaattgtgctcgagaaactactagaacatgtggagatgcacggattatacaccgaaggtctgtataggaagagcggcgcagcaaaccgcactcgggaactcagacaggctttgcagaccgatccagccgcggtcaagctggaaaatttcccaatccacgcgattaccggagttttgaagcagtggttacgcgagctgcccgagccgttaatgactttcgctcagtacggtgatttcctgagggctgtggaactcccagaaaagcaagaacagctggcggctatttacgccgtgctggagcatctaccagaggccaatcacaactcgcttgagcggctcattttccacttggtaaaagtcgccctgttagaagacgttaacagaatgtctcctggcgctcttgccatcatcttcgcaccgtgtctcctgcgttgtccagataatagtgacccactgacttcgatgaaagatgtgctgaaaataaccacctgtgtggagatgcttataaaggaacaaatgcgaaagtacaaggtcaaaatggaagaaatcagccaactcgaagccgctgagagtatcgcgttccggcgactgtcgctattgcggcaaaacgcaccatggcccctgaagttgggattttccagcccatacgagggcgtgttaaacaagtccccaaagaccagggacatccaggaagaagagctggaagttctactggaagaggaggccgctggtggtgatgaagatcgcgaaaaagagatcctcatcgagcgcatccagtccatcaaagaagagaaagaggacatcacctacaggttgccagagcttgaccctagaggctcagatgaggagaacctggactccgagacctccgccagcacagaaagcctgttggaggaacgagcaggcagaggagcttcagaagggcagtactag

SEQ ID NO: 125414 - DNA, 6069 bp, Artificial Sequence
  Description of Artificial Sequence: Synthetic coding sequence
atgagcgtcaaggaggctggaagcagcggccggagagaacaggcagcttatcacctccatatatatcctcaactttccacaacagaaagtcaggcaagctgcagggtgaccgccactaaagattctacgacaagtgatgttataaaggacgctatcgcttctctgagactggatgggaccaaatgttatgtcttggtggaagtcaaagagtccgggggcgaagaatgggtcctggacgcaaacgattcacctgttcaccgggttctcctgtggccgaggcgtgctcaggacgaacatccacaagaggatggttactatttcctgctacaggaacgaaatgctgacggaactatcaagtatgtgcacatgcagctggtcgcccaagcaaccgccactcgtcgcctggttgaaaggggtctgctacccaggcaacaggctgatttcgacgacctgtgcaatctgcctgaactgaccgagggcaatctgctgaaaaatctgaagcaccggtttctgcagcagaagatctatacctatgcagggagcattctcgtcgccattaaccccttcaaattcctaccaatatacaaccctaagtatgttaaaatgtacgaaaatcagcagctgggtaagctggagccacacgtgtttgccttggcggatgtggcctattatactatgcttagaaagagggtcaatcaatgcatcgttatatccggggagtctggcagtgggaagacacagagtacaaactttctgatacattgtctgacagccctgtcgcagaaggggtatgcaagtggtgtagagcgaacaatcctgggggccggccccgtgctagaggccttcggaaacgcgaagaccgcacacaacaacaactcttctcgatttggcaagttcatccaggtgagttacctggagagcggcatagtgagaggcgcggtggttgagaagtatctgctggaaaaatccagattagtttctcaggagaaggatgaaaggaattaccacgtcttttattatctcctgctgggggtttccgaagaggagcgccaggaatttcagctcaaacagccagaagactatttctatctcaatcagcacaacttgaagattgaagacggcgaagaccttaaacacgactttgagcgattgaaacaggctatggaaatggtggggttcctgcctgccactaagaaacagatcttcgcggtgttgtccgcaattctctacctgggaaatgtaacgtacaagaaacgtgctacagggcgggaggaaggactggaggtcggacctcctgaagtgctggacaccctctcccagttgctcaaggtcaagagagaaatcttggtggaggtgttaacaaagagaaagaccgttacagtgaatgacaaactaatactgccgtacagcctttccgaagccataacggcccgagactccatggccaagagtctgtatagcgcactctttgactggatcgtgctgcggatcaaccacgctctactcaataaaaaggatgtggaagaggccgtaagctgcttaagtatcggggtgttggacatttttggattcgaggatttcgagagaaacagctttgaacagttctgcatcaactatgccaatgagcaactccagtattactttaaccagcatatctttaagctcgagcaggaggagtatcagggcgagggtattacatggcataacatcggctacacggataatgtgggatgtatccacttgatctctaagaagcccaccggactgttttacctcctggacgaagagtcaaacttcccccacgcaacctcccaaacccttcttgccaagttcaagcaacaacacgaggataacaagtacttcctggggacacccgtgatggaacctgcctttattatccagcacttcgccggtaaagtgaaatatcagatcaaggactttagagaaaagaatatggactacatgcgccccgacattgtggctctgcttcgcgggagtgactcctcctacgtaagggagcttataggtatggaccccgtcgcagtatttagatgggccgtgctcagagctgctattcgagccatggctgtgcttagagaggctggcagattaagggcagaacgagccgagaaagcagccggcatgtcctcacccggggcccaatctcacccagaagagctgccgagaggggcctcaacaccaagcgagaagttatacagagacttgcataaccaaatgataaagtccataaagggcttaccttggcaaggtgaggacccgcggtccctactacaatccctttcccggcttcagaagcctcgagcgtttattctcaaatccaaaggcattaaacagaagcagatcatccccaagaatcttttagattcgaagtcccttaagctgatcatctcaatgacacttcacgatcgtaccactaagtctctgctccatctgcacaaaaaaaagaagccaccgagtattagtgctcaattccagaccagcctgaataagcttctcgaagctcttggaaaggcagagccgttcttcatcagatgtattcgctccaacgccgagaaaaaagagctgtgcttcgacgatgagctggtgcttcagcaactgcgatacactggtatgttggagacagtgcgcattagacgcagcggctattcggcgaaatatactttccaagactttaccgaacagtttcaggtactgcttccgaaagatgcccagccttgccgggaggtcatttctactctgttggagaagatgaagatcgacaagcggaattaccagattgggaagactaaggtgttccttaaggagacggagaggcaagctctccaagaaaccctccatcgcgaggtcgttcgtaagatactgctgctgcagtcttggttccgtatggtcctcgagcgaagacacttcctgcaaatgaaaagagcagccgtgacaatccaggcgtgctggcggagctatcgggtcagacgagctctggagaggacccaggctgctgtgtaccttcaggcttcgtggagaggctactggcagaggaagctgtaccgccaccagaaacagtcaataattcgtctccagagtctttgccgggggcacctgcaacgcaagtcgttcagtcagatgatctctgagaagcagaaggctgaggagaaagaacgcgaagccctcgaggccgcccgcgccggggcggaagaggggggccagggccaggctgccggcggccagcaggtcgctgagcagggcccggaaccagcggaagatgggggacacctcgccagtgaaccggaggttcaaccctccgacaggagcccactcgaacattcctctcccgaaaaagaggcacctagcccggaaaagacacttccacctcagaaaacggtggccgctgaaagtcatgagaaggtgccctcctccagggaaaaaagggaatccaggcgccagcgggggctggaacacgtcaaatttcagaacaagcacattcagagctgtaaggaggagtccgctttgagagagccctcaaggcgagttacccaggagcagggcgtcagcctgctggaagataaaaaagagtcccgggaagatgagaccctgctggtggtcgaaaccgaggcagaaaacaccagtcagaagcagccaacagaacaaccccaggccatggctgtgggtaaggtgtcggaagagactgagaagacactgccatctggcagtccccgcccaggccaactggaacggccgacctcactcgccctcgacagccgagtgtcacctccagctccaggctcggctccagagacccccgaggacaaaagcaaaccctgcgggtcccctagggtccaggaaaagcccgacagtcccggcggctcaacccaaattcagagatacctggacgccgagcggctggcctccgctgttgaactttggagggggaagaaactggtagctgcagcaagcccgtcagcaatgctcagtcaaagcctggatctgtcagatagacatcgagccactggagctgccctgacacccacggaagaaaggcggacgagtttctccactagtgacgtttccaagctgctcccctccttagcaaaagcccagcccgcggccgagaccacagacggagagcggtcagccaagaaaccagccgttcagaagaaaaaaccgggtgatgccagctccctgccggatgccgggctgtcccctggatcacaggttgatagcaagagcaccttcaaaaggctcttcttacataaaaccaaggacaaaaagtactccctggaaggggcagaggaactggaaaacgctgtcagcggtcacgtggtcctggaggctactacgatgaagaaagggctggaggctccctccggccagcaacacaggcatgctgcaggcgaaaagcggacgaaagaacctggtggcaagggtaagaagaacagaaacgttaaaattggaaaaattaccgtgagcgagaaatggcgtgaatcagtctttcgacagattaccaacgcaaatgagctcaagtatttggacgagttcctgctcaataagattaatgatcttcgatcacagaagacgcccatcgagagtttattcatcgaggccacagagaaatttaggtccaatataaaaaccatgtattcggtgcccaatggcaagatccatgtcgggtacaaggatctgatggagaattaccagattgtggttagcaacctcgcaaccgagcggggccagaaggatacaaacctcgtgctaaatctttttcagtctctgctagatgagttcactcgggggtatactaagaatgattttgaaccggtgaagcaatctaaagcccaaaagaagaagcgtaagcaggaaagagcagtgcaggagcataatggacacgtgtttgctagctatcaggtgtctattccccagtcatgcgagcagtgtctcagctacatctggttaatggacaaagccctgttatgttccgtttgcaagatgacatgtcacaaaaagtgcgtccacaaaattcagtcccactgttcatatacttatggcagaaaaggggaaccaggcgtggaaccagggcacttcggtgtgtgtgtggattccctcacatcagataaggcctctgtacccatcgtgctggagaaactgctcgagcacgtagaaatgcatggtctgtacaccgaaggcctttaccgcaaatctggtgccgcaaatagaacaagagagctgaggcaggccctgcagaccgatccggcggccgtgaaactggagaactttcccattcacgccataacaggagttctgaaacagtggctcagagagctgcctgaaccccttatgacattcgcccagtatggggactttctgcgcgcggtcgagctgccggagaagcaggagcagctggcagccatctacgcagtcctggagcatttgcctgaggccaatcacaatagcctcgagagactcatctttcaccttgtgaaggtcgccctactggaggacgtcaataggatgtcacccggggctttggcgatcatttttgcgccatgcctgctacgatgcccagacaactcagatcctctgacctccatgaaggatgtcctgaagatcacaacctgtgtggagatgctcataaaagagcagatgcgtaaatacaaggttaaaatggaagagatcagccagctggaggccgcagagtcaattgcatttcgtcgcctgtccctgttaagacagaacgctccctggcctctcaagttaggcttctccagcccatacgagggcgtgcttaacaagagcccaaagactcgcgacatacaggaggaggagctggaggtattgcttgaggaggaagccgctggaggagacgaggaccgggagaaagagattttgatcgaacgaattcagagcatcaaggaggaaaaggaagacatcacctacagattgcctgagctggatccacgagggtctgacgaggaaaatctggatagtgaaactagcgcttctactgaatctcttcttgaagagcgagcaggacggggggccagcgaggggcaatattag

SEQ ID NO: 125415 - DNA, 519 bp, Artificial Sequence
  Description of Artificial Sequence: Synthetic coding sequence
atgagcagtaaaaaagcaaaaactaagaccacgaaaaagcgcccacagcgcgcaacatcaaacgtgtttgcaatgttcgaccagagccaaatccaagagttcaaagaggcctttaacatgatcgatcagaaccgagatgggttcatcgacaaggaggatttgcatgacatgttggcttcactgggtaaaaatcctaccgatgcatacctggacgccatgatgaacgaagccccaggacccatcaatttcacgatgttcctcaccatgttcggggaaaagctgaatggcacagatcctgaagacgtcatccggaacgcatttgcttgcttcgatgaagaggcgacggggacaattcaggaagactacttacgggagctgctcactactatgggagatcggtttacggacgaggaagtggatgaactgtacagagaggctcctatcgacaaaaaggggaatttcaactacattgaatttactaggatcttgaaacatggtgctaaagacaaggatgattag

SEQ ID NO: 125416 - DNA, 1791 bp, Artificial Sequence
  Description of Artificial Sequence: Synthetic coding sequence
atggctacagaaaacggcgccgttgaattgggcatccaaaaccctagtaccgacaaggcccctaagggaccaacaggtgaacgccccctcgccgctggcaaggaccctgggccccccgatccgaaaaaagcaccagaccctccaacgcttaagaaggatgcgaaagcccccgcttccgaaaaaggggatgggaccctggcacaaccaagcacgtcgtctcagggccccaaaggtgagggggacaggggaggaggaccagcggaggggtccgctggaccacctgccgccctgcctcagcaaaccgctactccagagaccagcgtgaagaaaccgaaggcggaacagggcgcctcaggctctcaggacccaggcaaacctcgggtaggtaagaaggccgctgaggggcaggccgccgccagaaggggctcgccagcattcctgcacagtccctcatgtcctgctatcataagttctagcgagaaactgctcgccaagaaaccccccagtgaagcaagcgaactaactttcgaaggcgttcctatgactcacagcccgaccgatccgaggccagctaaggcagaagagggcaagaacatcttagccgagtcacagaaagaggtgggcgagaagacacccggtcaagcaggacaggccaagatgcaaggagatacaagcagagggatcgaatttcaggccgtgcctagcgaaaaatccgaggtagggcaggcactgtgcctcacagcacgggaagaggactgctttcaaatcttggatgattgtccacctcctcctgctccctttccccatagaatggtggaactccgtacagggaatgtaagctccgaattttccatgaatagtaaggaggcccttggaggaggcaagttcggggcagtgtgcacttgtatggagaaagcgaccgggctaaagctagccgctaaggtgatcaagaaacagacccccaaggataaagaaatggttttgctggagattgaggtgatgaatcagcttaatcaccgcaatctgatccagctctatgcagctatagaaaccccacacgaaatcgttctttttatggagtatatcgaaggcggggagttattcgagaggattgttgacgaagactaccacctgaccgaagtcgatacaatggtgtttgtgcgccaaatctgtgacggaattttgtttatgcacaaaatgcgagtgctgcacctggatctcaagccagagaatattctgtgtgtcaacacaacgggacacctcgtcaaaattatcgactttggtctggcccggcggtacaacccaaatgagaagctaaaggtgaacttcggtacacctgagtttctgagcccagaagtggtgaattatgatcagattagtgataaaactgatatgtggtctatgggcgtaatcacatatatgctcttgagcggtctctctcccttcttgggtgacgatgacacggagacactgaataacgttttatctgggaactggtattttgatgaggagacattcgaggctgtctcagacgaagccaaggattttgtttccaacttaatcgttaaggaccaaagagcacgcatgaatgccgctcagtgtctggcccatccgtggcttaacaatctcgcagagaaagctaaacgttgtaaccgacgcctaaagtcacaaatcctgcttaaaaagtacctcatgaagcggcgttggaaaaaaaatttcattgctgtgtcagctgctaacagatttaaaaaaattagtagttctggtgccctgatggcgcttggggtgtag

SEQ ID NO: 125417 - DNA, 1791 bp, Artificial Sequence
  Description of Artificial Sequence: Synthetic coding sequence
atggcgactgagaatggtgcagtggaactgggtattcagaatcctagtacagacaaagctcccaagggtcctactggcgagcgtcccctggcggcagggaaagaccccggtccaccggaccctaagaaggcgccagatcctccgactctgaaaaaagatgctaaagcgcctgcgagtgagaagggagatgggacactagcccagccatctacatcaagccaaggccccaaaggggagggagacagaggcggcggtcccgccgaaggcagtgctggccctccggctgccttgcctcagcagactgctacaccggaaaccagcgtgaagaagccaaaggccgagcagggagcctccggttcccaggacccaggaaagccccgggtcggcaagaaagccgcggaaggtcaggcagccgcccggcgtgggtcacccgcctttcttcacagtcccagctgtccagcgatcatcagctcttctgagaaactcctggctaaaaagccgcctagcgaagcctctgaactgaccttcgaaggggtgcccatgacccactctcccactgacccaaggcccgcgaaagccgaggagggtaagaacatactcgcagagtctcaaaaagaggtaggtgaaaagacgcctgggcaggccggccaggcaaagatgcagggcgatactagcagagggatcgagtttcaggcagttcctagcgagaagtccgaggtcggacaggcactctgcctgaccgccagagaggaagattgctttcaaattctcgatgattgccctccaccccccgccccgttccctcataggatggtggaactgaggaccggcaacgtgtcctcagagtttagcatgaattcaaaagaggctcttggcggtggcaaatttggcgcagtttgtacttgcatggaaaaggccactggcctgaaactggcagccaaagtgattaaaaagcagacacctaaggacaaagagatggtgctgctcgaaatagaggtgatgaatcaattgaaccatcgcaaccttatccagctgtacgccgccatagaaaccccccatgagattgttttatttatggaatatatcgaggggggcgaactgttcgagcggatcgtggacgaggactaccacctgactgaagttgacaccatggtatttgtgcgacaaatttgtgacggaatcttgttcatgcacaagatgcgcgttctgcacctcgacctgaaacctgagaatattctctgcgtaaatactaccggacatctggtgaagatcatagactttggactggctcggagatataatcccaacgagaaactcaaggtcaacttcggaactcctgaattcctctctccagaagtggtgaactacgatcagatttccgacaaaaccgacatgtggagcatgggggtgatcacctacatgctgctgtccggcctgtcccccttcctgggagatgacgacacagagacactaaacaacgtgctctcgggcaattggtactttgatgaagagacttttgaggcagtttcagatgaggccaaggattttgtatccaacctaatcgtgaaagaccagagggcccgtatgaacgccgcacagtgtttggctcacccatggttgaataacctcgccgaaaaggctaaaaggtgcaatagaagacttaaatcccagatcctactgaagaaatacctgatgaagaggcgctggaagaagaattttatagccgtgtcagcagcaaataggtttaaaaaaatctcatcatctggcgctctgatggctctgggggtgtag

SEQ ID NO: 125418 - DNA, 2460 bp, Artificial Sequence
  Description of Artificial Sequence: Synthetic coding sequence
atgagcgggacttcaaaagagtctctgggtcacggaggactccccggacttggcaagacatgtctgacaactatggacactaaactcaacatgctcaatgaaaaggtagaccagctattgcatttccaggaagatgtcacagaaaaactacaaagcatgtgtcgcgatatgggccacttggagcggggcctccaccggttagaagcttcgcgtgcaccaggccccggaggagccgatggcgtgcctcacatcgacacccaggcaggatggcctgaggtgctcgaactcgtgagagccatgcaacaggatgccgcacagcatggagcacggctggaggcactgtttaggatggttgcggccgtggatcgtgctatcgcactggtaggcgctaccttccagaagtccaaagttgccgacttcctgatgcaaggccgagtgccctggagaagagggtccccaggagacagtccagaggaaaacaaagagcgagtcgaggaggaaggtgggaagcctaaacacgtccttagcacctccggcgtgcaatccgatgctcgcgagcccggggaagagagccaaaaggcagatgtacttgaaggtacagccgagcggctcccccccatccgcgcttccggactcggggccgatccggcccaagctgtggtgtcacctggtcagggtgatggtgtcccagggcccgcccaagccttccctggccatctgcccttgcctaccaaagttgaagcaaaggcacccgagacaccaagtgaaaacttgcggaccggtttggagctggccccagctcccggaagggtaaatgtcgtttcgccctcactggaggtggcccccggagcaggtcagggcgcaagctcatcccgtcccgatcccgagccactggaggagggtacgaggctcactccaggtcctggtcctcagtgccctggcccccctggactgccagcccaagctagggcaacccatagcggaggggaaaccccccccagaatctccatccatatccaggagatggatacacctggcgagatgttaatgacgggtagaggctcccttggtcctacgttgacgacggaggccccagccgcggcccagccaggaaaacagggtcctccgggaacaggtcgatgcctgcaggcacccggcacagagcccggcgagcagaccccggagggggctcgggaactgtcccccctgcaggagtcctccagtccaggtggggtgaaggccgaggaagaacagagggcgggcgccgagcccggcacccgccctagtctcgcccgcagcgacgacaacgaccacgaagtaggagctctcggacttcagcaaggaaagtccccaggagcagggaatcctgagccagagcaggactgcgccgccagagctccggttcgcgccgaggctgtacgtagaatgccaccaggcgcggaggctggaagcgttgttctggacgattcgcctgcacccccagcaccatttgagcacagagttgtgagcgtgaaggagacaagcattagcgctggctatgaagtctgtcaacacgaggtgctggggggcggacgcttcgggcaggtgcaccggtgcaccgaaaagtccaccggactccctctggctgcaaagatcatcaaggtcaaaagtgcaaaagacagggaggacgtgaaaaatgagatcaacattatgaatcaattaagtcacgtgaatctgattcaactgtacgacgcatttgagagtaagcactcctgtaccctcgtcatggaatatgtcgatggaggtgaactgtttgaccgaataacggatgagaaatatcatctgactgagctggacgtggtattgtttacaagacagatttgcgagggcgttcactacctgcatcaacattacatactgcacctggatttgaaaccggagaacattctctgtgtcaaccagacaggtcaccagatcaagatcatcgattttggattagctagacgctataaaccaagagagaagctcaaggtgaatttcggtacgccggagttcctggctccagaagtggtcaactatgagttcgtttcattccccaccgacatgtggagcgttggggtgattacttacatgcttttgagtggcctgtcccccttcctaggggaaaccgatgccgaaaccatgaactttatcgtcaactgctcctgggactttgatgcagatactttcgaagggttgtccgaggaagccaaggatttcgtaagtcgcctcctggttaaagagaaatcctgtcgtatgagcgccactcagtgcttgaagcatgagtggttaaacaatctgcctgctaaagctagcaggtcaaagactagactgaagtctcagctcctgctgcagaaatacattgcacaaagaaagtggaagaaacacttctatgtggtgacggctgctaacaggcttagaaagttccccacgagcccgtag

SEQ ID NO: 125419 - DNA, 1437 bp, Artificial Sequence
  Description of Artificial Sequence: Synthetic coding sequence
atggatacacctggagagatgctgatgacaggccgaggatcccttggacccaccctgactacagaggctccagcagccgctcaaccaggcaaacaaggccctccaggcacaggcagatgcctgcaagccccgggtactgagcccggagaacagacgcccgagggcgccagggaattgagtcccttgcaggaatcctccagcccagggggggttaaggccgaagaggagcaacgagccggtgccgaaccagggacgcgacccagtctggcacggtcggacgacaatgatcatgaggtaggcgctctgggcctgcagcagggtaaatcccccggggccggcaatcctgagcctgagcaagactgcgccgcgagggctccagtgagggccgaagctgtacgcagaatgccgcctggtgccgaggccggcagcgtcgtactcgacgattccccagccccccccgctcctttcgagcacagggtggtgtcagtcaaagagacctcaatctccgccggatacgaggtctgtcagcatgaagtcctagggggtggacgatttggacaggtgcaccggtgtacagagaaaagcactgggctgcccctggccgcgaagataatcaaagtcaaatctgccaaagaccgggaagacgtcaaaaacgaaatcaatataatgaaccagctgagccacgtgaatcttatccaactgtacgatgcttttgaatccaaacactcttgcacactcgtcatggaatatgtagacgggggcgagctgtttgataggatcacggacgaaaagtaccacctgaccgaacttgacgttgtcctatttacaaggcagatctgtgagggggtccactacctgcaccaacattacattctgcacctggacctcaagcctgagaatattctgtgcgtaaaccagacaggccatcaaattaaaattattgattttgggctggctcgtcgatacaaaccaagggaaaaactgaaggtcaatttcgggacgccagagttcctggcacctgaagtggttaattacgaattcgtgtctttccccacggatatgtggtctgttggggtgataacctatatgcttttgagcggactaagtcctttcttaggggaaaccgatgcggagactatgaatttcatcgtgaattgctcatgggattttgacgcagataccttcgagggattatcagaggaggcgaaagactttgtgtcgcgcctcctggtaaaggagaagagctgccgaatgtccgccactcagtgcctcaaacacgagtggctaaataatttgcctgccaaagccagtaggtccaaaacccgcctgaagagtcagctccttcttcagaagtacattgctcagcgcaagtggaaaaaacacttttacgtcgtaaccgccgccaatcgtctgcgtaagtttccaaccagcccatag

SEQ ID NO: 125420 - DNA, 4212 bp, Artificial Sequence
  Description of Artificial Sequence: Synthetic coding sequence
tgactcctgctggaaagttgcgagaaggaaaaacaagcactactccaaaacctgaaagaggtggaggacaaggcatctgcatacgaggatcagttgcagggccaagcgcaacaggttgaaactctgcagaaagagaagctgtcagccacatttgaggggtctgaacaggtgcaccagctcgaagagcagctggaagccagagaggcctccgtgagacggttggcagagcacgttcagagtctatgcgatgagagggacctgcttcggcaacgatttcaggagctgaccgagagggtcgccaccagcgacgaagatgtggccgaattaagagagaaactaaggcgtcgcgaagcagataatcagagcctagaacattcctaccagagggtctctagccagctgcagtccatgcacaccctcctccgtgaaaaggaagaggaactggagcgcatcaaggaagcccatgagaaggtattagaaaagaaagagcaggacctgaatgaagctttggtgaaaatggtggcccttgggtccagcctcgaagagacggagatcaaactgcaggctaaggaggagatcctcagaaagttcgcaagtgagtcacccaaagacatggaagaacccagaagcacaccggaggagaccgagagggatggaactcttctgccaggtcaacccgttcaggctacgagagctcccctcggccttccccacacgcgattggaggatgaggacgaggacttgggtgccccacctggggaagagtacggtgatggaagtccttctcgtgaggattccatggtgcccccaaagtccgttgaagtattggatcgcgaagggcaccaacagggcaccgcaaaattggaccagggcgcccctggcgtgaaacgccagaggattaggtttagtacaatccagtgtcagcgttatatccatcccgaaggttcagagaaaacttggacatcgtcaacctcctcagacacaagccaggaccgctccccatctgaggagagcatgtcttctgagcctgccccctccgtgttaccagctaccggagactcagacacatatttatcaatcatccattcgctcgagacaaagctgtacgtgactgaagaaaagttaaaggacgtgacagtgcgactcgagtctcagcagggccagtcccgggaggctctgctagctctgcatcaccagtgggctggcaccgaagcccaactgagagagcagctgagagcgtccttgttgcaggttggtgctctggcaagccaactggagcaggagcgccaggagcgcgccaggagagttgaaggccacgtgggcgagctcggggactttcaggtgaaaaattcacaggcgctgatgtgcttggagaactgccgtgagcagttgcgttcactgccccgggcgtctcaggaagatgagcaggacgctcgtgccgcctctctggccagcgtcgaaagtgctctggtttctgccatccaggcattacagcactggcctgcccctgcccatggcggggcacgggcacagctggagaccggcgggaccgaggagaacgggaaaccagcctcattacaacagtgcagccagtctgagctgaccgaacaagaacaggtgaggttattgtcggaccagattgctctcgaggcttccctcatctcacagatcgcagattccctgaagaataccacatctgatgtaagcagaatgcttcacgagattagttggagcggccagccgcctatggaatccgccggggcccctgttgatacctgggctcgaaaagtactggtagacggcgaattttggtcacaagttgagagtttgcggaaacaccttggtacactcggtggagaggctgtaggcgcctctggcgatggacagcagagcatcccccagggcctggctcctatactggccaatgctacatgggtgcgcgccgagctgagctttgccacacaaagtgtgagggaatcattccatcggagactgcagtccatccaggaaaccctgagaggaacgcagaccgccctccggcagcacaagtgtctgctccgggaaatcctcggcgcttaccagacaccggacttcgagcgcgtgatgcagcaggtcttggaggctctgcgactgcccgcgggacatgaggacggtgtccagctgagctgggacctgagcccccttggagaggtgctaggcagggactccgattcatcccaggagccctttgatgtttcagaccagtctccaggagcttttgtggctatccaggaagaacttgcccagcagctgaaagaaaaggcttccctactggaggagatagctgcagctcttccttccctccctcctgtggaatccctgagagattgccagaaactcttacaggttagccagtccctctcttataatacttgcctgggcggattgggccagtattcatcccttttggtgcaggacgctattattcaggctcaggtgtgctacgctagttgccgcattagactggaatacgagaaagagcttcaactgtgcaaggagtcctggcagacccgtgagccatcgtgcagtgagcaggctcaggcagcccgtgcactgagagaggaatatgaagaattgctcaggaagcagaagtcagagtacttggacgttatcgctatagtggagagggagaacgccgagctgaaggccaaggcagcacagctggaccatcagcaacaatgtttggaggacgcagagtccaagcacagcatgtccatgttcacactgcgcgggcgctatgaggaggagatcagatgtgtggtggaacagttgaccagaacagaatcaaccctgcaagccgaacgatcccgcgtgctgagtcagttagacgctagcgtgcgcgacaggcaggatatggagcgccaccatggagaacagattcagaccctcgaagataggttccagttgaaagtgagagaactccagacgatacacgaagaagagctgaggacccttcaggaacactattctcaatcgctacggtgtcttcaggacactttatgcctgcatcaagggccccatccgaaggccctcccagcccccgccccaaattggcaagccacccagggggaggcagacagcatgaccggcttgcgtgagaggatccaggaattggaagcccagatggacgttatgcgggaggagctcggacataaggacttagaaggtgacgcagccacactcagagagaagtaccagcgagaccttgagagcctaaaagccacctgcgagcgtgggttcgccgccatggaagagacccaccagaagaagattgaagatctccaacggcagcatcagcgtgagcttgagaaactgagggaggaaaaagatagactgctggccgaggagaccgcagctaccatctcagccattgaagccatgaagaacgcacaccgagaggagatggagagagagctggaaaagtcacagagatctcagatttcctccgtgaactctgacgtggaggcactgcggaggcagtacctggaggaacttcagagcgtccagcgggaactggaagttctctccgaacaatacagtcagaagtgcctcgagaatgcgcatttggcacaggcattggaggccgagcgccaggccttgagacagtgccagcgagagaatcaggaacttaatgctcacaaccaggagctcaacaatcgcctggctgcggaaattacaaggctgagaacactgctcactggagatggcgggggagaagccaccgggtctcccctggcacagggtaaagacgcctacgagctcgaagtactcctgagggtgaaagagtctgagattcaatatctgaagcaggagatttctagcttaaaagatgagctgcagacggctttgcgcgacaaaaaatacgcttctgataagtacaaggatatctatacagagctgagcattgccaaagctaaagcagattgtgacatcagcaggctcaaagagcagctgaaggccgcaactgaagctctgggagaaaagagtcctgattccgctacagtgtcaggctatgacatcatgaagagcaaaagcaacccagacttcctgaaaaaagaccggtcttgcgtgacacggcagctgcgcaacatcaggtctaagtccctcaaagagggcctgactgtacaagagagactaaagttgtttgagagcagggacctgaaaaaggactag

SEQ ID NO: 125421 - DNA, 3078 bp, Artificial Sequence
  Description of Artificial Sequence: Synthetic coding sequence
atgtcagccgcgaaagaaaacccttgccgtaagtttcaggctaatatctttaacaaatcaaaatgtcaaaattgcttcaaaccacgcgagtcgcatctgctgaatgacgaggacctaacacaggccaagccaatctatggtggatggctcctcttagccccggacggtactgattttgacaaccctgtgcatcgttctagaaaatggcagcggcgcttcttcattctgtatgaacatgggctgctgcgttacgcgttggatgaaatgccgacaacactgccacagggtacaattaatatgaaccagtgcaccgacgtggttgacggcgaagggaggaccggccagaagttttccctgtgcattctgacacccgagaaagagcatttcattcgtgccgagacgaaagagattgttagtggatggctagagatgctgatggtgtatccacgaactaataaacagaatcagaaaaaaaagcgaaaggtcgaacctcctacaccccaggaacctggccctgccaaggtggccgtgacttctagtagctctagttctagcagttcgtcaagtataccatcagcagagaaagttcctacaactaagagcactctgtggcaggaagaaatgcgcactaaggatcaacctgacggaagcagcttgagtccggctcagagtccttctcagtcacagccccctgccgcatcctccctcagagaaccaggccttgaatcgaaggaggaagagtctgccatgtcctcggaccggatggactgcggtaggaaagtcagggtggaaagcggctacttctcacttgagaagacaaagcaggatctcaaggccgaagaacagcagttaccgccacccctatccccccctagcccttctactcccaaccataggaggtcacaagtcatagaaaaattcgaagccttagacatcgagaaggccgagcacatggaaaccaatgctgtcgggcctagcccatctagcgacacacgacagggcaggtccgagaagcgtgcgttcccccggaaacgtgatttcaccaacgaggcccccccggccccactcccagatgccagcgcatcgccactttcaccacacagaagagctaagagcctggataggcggtcaacagagccaagcgtgacacctgatctactgaatttcaaaaaggggtggcttaccaaacaatatgaagatgggcaatggaagaaacattggtttgtgctggcagaccagtcgctgagatactatagggacagtgtagctgaggaggccgcggacctggacggagaaattgatcttagcgcatgctatgacgtgactgagtaccctgtgcagagaaactatggattccaaatccacacgaaggagggtgaattcactctgtcagccatgacatctggtatccggagaaactggatccaaacaatcatgaagcatgtgcacccaacaactgcccctgacgtgacttccagcctaccagaggagaaaaataagtccagctgttcgtttgaaacctgtccaagacctaccgaaaaacaggaagcagagctgggggagccggaccctgaacagaaaagatcccgcgctcgggagaggagacgggaagggcgaagtaaaactttcgattgggcagaattcagaccgatccagcaagcattggctcaggagcgggttggcggcgtgggacccgcggacacacacgagccacttcggcccgaggctgagccgggggagcttgagagagaacgcgcaagacgcagggaggagcggaggaaacgctttgggatgttagatgccactgacggcccaggtacggaggacgccgcactgcgaatggaggtggacaggtcacccggacttccaatgtccgacctaaagacccataatgtacacgtcgagatcgaacaaagatggcaccaagtggaaacgacgccactgagggaagagaaacaggtcccgatcgctcctgttcacctgagcagcgaagatggcggggaccgattatcgactcatgagctgacaagcctgctggagaaagaactggaacagtctcagaaagaggcttctgaccttctggagcagaataggctgctgcaggaccaactgcgggtggccctgggccgcgagcagagcgcaagagaggggtatgttctgcaagccacatgcgaaaggggatttgccgcgatggaggagacccaccagaaaaagatagaggatctgcagcggcagcaccagcgggaactggagaaactccgagaggagaaggacaggctgctggccgaagaaaccgcggcaacaatctccgcaatcgaagccatgaagaatgcccacagggaagagatggagagggagcttgaaaaatcgcagcgcagccagatcagtagcgtgaactcagacgtggaagctctacgaagacagtatcttgaagaattgcagtcggttcagcgcgaattggaggtcctgtctgaacagtactctcagaagtgcctggaaaatgcccacctggcacaggcccttgaggccgagcggcaggctttgcggcagtgtcagagggagaatcaggagttgaatgctcacaaccaggagttgaacaacagactcgctgctgaaattactagactgagaaccttgttgacgggagatgggggtggagaagcgaccggatctccactggcccagggcaaggatgcttatgaactggaggttttgcttagagtaaaggagtccgaaattcagtatctcaaacaagagatcagtagcctgaaggacgagctgcagaccgctttacgagacaaaaagtatgccagcgacaaatataaagatatttacactgaactgtctattgccaaggccaaagctgattgcgacatcagtagactgaaggaacagttgaaggcagccacggaggcactgggcgaaaaatcacctgactctgcaactgtaagcggttatgacattatgaaatcgaaatccaatcccgacttcctgaaaaaagatcgaagttgtgtgacacggcagttgcgtaacattcggtcaaaatctgttatcgagcaagtgtcttgggacacttag

SEQ ID NO: 125422 - DNA, 3078 bp, Artificial Sequence
  Description of Artificial Sequence: Synthetic coding sequence
atgagcgccgctaaggaaaatccatgcagaaagtttcaagctaacattttcaataagagcaaatgtcagaattgtttcaagccccgagagagtcaccttctcaacgacgaagacctcactcaggccaaacctatctatgggggctggctcctgctggctccagatggaaccgacttcgacaatccagtgcatcgaagccgcaaatggcagcgccggttttttatcctgtacgagcatggcctgctaaggtacgcccttgacgagatgcctacgacactgccccagggcacaattaacatgaatcagtgcaccgatgtcgtcgacggggaggggagaaccggtcagaagttttctctctgtatcctcactcccgagaaggagcatttcattcgggcagagactaaggagatcgtctcaggctggctggaaatgttgatggtctacccccgaacaaacaagcagaatcagaaaaaaaagcgtaaagtggagcctcccacgccccaggaacccgggcccgccaaggtagccgtcaccagctcatcttctagcagctcctcttccagcagcattcctagtgccgagaaggtgcctacaacgaagtctactctctggcaggaggaaatgcggacaaaagaccaacccgacggaagctccctgtcgcccgcccagtcccctagccaatcccagcctcctgccgcctccagcctcagggagccaggtcttgagagcaaagaagaggagtcggccatgtcatctgatcgcatggactgcgggcggaaggtgagggttgagagcggatatttttcactggaaaagacaaaacaggacctgaaggctgaggaacagcagctgcctccaccactctcccctccatccccttctacacccaatcatcggcgcagccaggtgatcgagaagttcgaggccctggatatcgagaaagcggaacatatggagactaacgctgtcggaccctctccatccagtgataccagacaaggaaggtcagagaagagagccttccctcgcaagagggacttcactaacgaggctccccctgctccactgccagatgccagtgcaagtccactctcgccccaccggagagcgaagagcctggatcgacggtctactgaaccttccgtgactcctgacctgttgaatttcaagaaaggttggctgactaaacagtatgaggacggacagtggaagaagcactggttcgtgctggccgaccaatctttacgttattacagggacagtgtcgccgaagaagccgccgaccttgatggggagatcgacctttccgcctgctacgacgtcactgaatacccagtccagaggaactatggattccagatacacactaaagagggcgagttcaccctgtctgccatgacaagcggcatacgacggaactggatccagacgattatgaagcacgtgcatcctactacggctcccgatgtgacgtccagtctacccgaggagaaaaacaagtcatcatgcagctttgagacttgcccaaggcccaccgagaagcaggaggcggagttgggtgaacctgatccggaacagaaacgttcaagagcacgcgagcgcaggcgggagggccggtcaaagacctttgactgggcagagtttcgcccaatacagcaagcactggcccaagagcgagtgggaggggtgggacccgcagacacacacgaacctctgagacctgaggctgagccaggcgagctggagcgggagcgtgcacgtaggagggaagagcgacgcaagaggttcggaatgttggacgcgacagacggccccgggacagaagatgccgctttgcgcatggaagttgaccggtcacccggcctgccaatgtccgacctcaaaacccataacgttcacgtcgagatcgaacagcggtggcatcaggttgaaactacaccccttcgggaggagaagcaggtgccaatcgccccggttcacctctcttcagaagatggaggagaccgtctttcaacacatgaactaacctctctgcttgagaaggaactggaacagtcccagaaagaagccagcgatctccttgaacagaaccgactgctgcaggaccagctgcgcgtggctttgggtagggaacagagtgctagggagggttatgtgcttcaggctacctgtgagagggggttcgccgccatggaggagactcaccaaaagaagatcgaagatctgcaaagacagcatcagagggagctggagaaattgagagaggaaaaggatcgcctgttggcagaagagaccgcagccaccatttccgccattgaggctatgaagaatgcccacagggaagaaatggagagggagctcgaaaaatcacagcggagccagattagcagcgtgaattcagatgtggaggcgttgagacgccagtacctggaagagctgcagtcagttcagcgcgagctggaagtactatcagaacagtatagtcaaaaatgtctggagaacgcacacctggctcaggcactagaagccgaaaggcaggccctgcgccagtgccaacgtgagaatcaggaactgaacgcacacaatcaggagcttaacaatcgactggcagccgaaataacgaggttgcgcaccctgctaactggcgatggaggtggggaggctaccggatcccctctggctcagggaaaggatgcatacgagttagaggtgctgctacgtgtgaaagagtcagagattcagtatttgaagcaagaaatttcctctctgaaggacgagctacagactgccctacgcgataagaaatacgccagtgataagtacaaagatatctacaccgaactttcaatagcgaaagctaaggcagactgtgatatatccagacttaaagagcagttgaaggcagcaactgaagccctcggggaaaagagtcctgacagcgccactgtttcaggttatgatatcatgaaaagcaaatctaaccccgactttctcaaaaaggacaggtcatgcgtaacacgccagctaagaaacattcgcagcaagagtgttatcgaacaggtaagctgggacacctag

SEQ ID NO: 125423 - DNA, 192 bp, Artificial Sequence
  Description of Artificial Sequence: Synthetic coding sequence
atgtccgcagcaaaggaaaatccctgtcggaaatttcaggccaacatttttaacaaatccaaatgtcaaaattgctttaaaccgagagaaagccacctcctcaacgacgaagatttgacacagcagaatacgcacccattggaaatgaagagaggtgcccacatttatgacgcccgcatgttcagttgttag

SEQ ID NO: 125424 - DNA, 282 bp, Artificial Sequence
  Description of Artificial Sequence: Synthetic coding sequence
atgtcggcggccaaggaaaacccatgtcgtaaatttcaagccaacatcttcaataagagcaagtgtcagaactgttttaaacctcgcgagtcacatctgctaaatgatgaggatctcacacaggccaagccaatctacggagggtggctcctgcttgctcccgatggaaccgacttcgataatcctgtgcacaggagcagaaaatggcagagacggttttttatcttgtacgagcacggccttctcaggtatgcattggatgagatgatgtcatcccagtag

SEQ ID NO: 125425 - DNA, 3117 bp, Artificial Sequence
  Description of Artificial Sequence: Synthetic coding sequence
atgagtgccgcaaaagaaaacccttgtcgtaaatttcaagctaacatctttaacaagagcaagtgtcaaaattgctttaaacccagggaaagccacctcctgaatgatgaggacctgacacaggcaaagccaatttatggtggatggctactgctggccccggatggaacagatttcgataatcccgtccacaggtcccgcaagtggcagcgcagattctttatactttatgaacacgggcttcttcgatatgctcttgacgagatgcctaccactttaccccagggaacaattaacatgaaccagtgcacggacgtggtggacggcgaagggagaacaggacagaaattttcactgtgcatcctaacccccgaaaaagagcactttataagggctgaaacaaaggaaattgtttctggatggttggaaatgctcatggtttacccaagaacaaacaaacaaaaccagaagaaaaagcgcaaggtggagccacctactccacaagaacccggcccagcgaaagtggctgtgacatcaagtagttcaagttcgtcctcatctagcagtataccaagcgccgagaaagttcctaccactaaaagcaccctgtggcaagaggaaatgcgcacaaaggaccagcccgatgggtcttcactttccccagctcagagtccctcgcagtcccaaccacccgccgcatcatcgcttagagaacccggactggaatccaaagaggaagagagtgccatgtctagcgatcgcatggattgcggaagaaaggtgagggttgaaagcggctacttcagtctggagaagaccaagcaggacctaaaggctgaagaacagcaacttccacctcctctgtctccgcctagtcctagtacacctaaccacagaagaagccaagtcattgaaaaatttgaggctctggatatcgaaaaggcagagcatatggaaaccaacgcggtgggccctagcccttccagtgacacaaggcagggcaggtccgaaaagagagccttcccaaggaagcgggacttcactaacgaagcaccgcctgcaccactaccagacgcatctgcatcccctcttagtccacaccggagagccaagagcctggacagaagatctaccgaaccctcagtaacgcctgatctactcaattttaaaaaaggatggctgaccaaacagtacgaagacggacagtggaagaagcactggtttgtgctggctgaccagagtctgcgctactacagagacagtgtggcagaagaagcggccgatcttgacggggagatagacctcagtgcatgttatgatgtgacagaataccctgtgcagaggaactacggatttcagattcacaccaaagagggtgagttcacattatcagccatgactagtggaattcgcaggaattggattcaaaccatcatgaaacacgtgcaccctacaactgcaccagacgtaacttctagtctccccgaagagaagaacaagtcttcttgttctttcgaaacttgcccaagacccactgaaaaacaggaagcggagttaggagagccagatcctgagcagaagcgatctcgcgcaagggagagacgtagagaaggtagaagcaaaacattcgattgggcagagtttcggccaattcagcaggccctggcccaggagagggtcggtggtgtggggcctgccgacacccatgagcctttgaggcccgaagccgaaccaggtgagctggagagggagagggccaggcggagagaggagcgtagaaaacggtttggtatgctggacgccaccgacggtcccggaacagaagacgccgcactgcgaatggaggtagacaggagtcccgggctaccaatgtccgatctgaagactcataacgtgcacgtggagatcgagcagaggtggcaccaagtagaaaccacccctctccgggaggaaaagcaagtgcccatcgcaccagttcacctgtctagtgaggatggaggtgatcggctctcgacacacgaactgacctccctgcttgagaaggagctggagcaatcacagaaggaggcatctgacctgcttgaacagaaccggctcctgcaggatcaactaagagtggcgctcgggcgcgagcagagtgcacgagaggggtacgtgcttcaggctacatgcgagcgcgggttcgcagctatggaagagacgcatcagaagaaaatagaggacctccagaggcagcaccagcgggaactcgagaagctgcgtgaagagaaggatcgactcctcgcagaagaaacagcagcaactatcagtgctatcgaggctatgaagaacgcccatcgcgaggaaatggagcgcgaacttgaaaagagccaaaggtctcagataagctctgtaaactcggatgttgaggccctccgcaggcagtacctggaggagctgcagtccgtgcaacgcgagctggaggttttaagcgagcagtacagccagaagtgtctcgagaacgctcaccttgcccaagctctggaggctgaaaggcaagcacttcgccaatgccagcgcgaaaaccaggagctgaatgcgcataatcaggaactcaacaaccgattagccgctgaaattacacggctccgaaccctgctgacgggcgatggaggtggggaagccactggaagtccccttgcccagggaaaggacgcctacgagctggaggtgctcctgagggtgaaggagtcggagatccaatatttgaagcaggaaatttcatccttgaaggatgaacttcagaccgctttaagggacaagaagtatgcctctgacaagtataaagatatttacacggagctttccatcgcaaaggccaaggcggattgtgatatctcgagactgaaggaacaattgaaagccgctaccgaggccctgggggaaaaatctccagactcagccactgtgagcgggtacgacattatgaaaagtaagagcaatccagactttctgaagaaggatcggagctgtgtcaccaggcagttacgtaacatacgcagtaagtccctcaaggaaggcttaacggtgcaggaacgcctcaagctgtttgagtcccgggaccttaagaaggattag

SEQ ID NO: 125426 - DNA, 3276 bp, Artificial Sequence
  Description of Artificial Sequence: Synthetic coding sequence
tagcgattctcgactatccagtgccaacggtatatccaccccgaggggtccgagaaaacatggacttctagtacaagttcggatacaagtcaagacaggagcccttctgaggaaagcatgagtagtgagcccgccccatccgttctgccagcaactggggactccgatacatatctaagcatcattcactccctcgagacgaaattgtatgtgacggaggagaaactgaaggacgtaaccgtacgcctggaaagccagcagggccagtccagggaggcactgctagcgctacaccatcagtgggccggcaccgaggcccagctgagagagcagctgagagcctctcttcttcaggtgggggccctggcctctcaactggaacaagaacggcaggaaagagcccgcagagtagagggtcatgtgggtgaacttggagattttcaggtgaagaattcgcaagcattaatgtgcctggagaactgtcgtgagcagctcagatcactgccacgcgcatctcaggaagatgagcaggacgcacgggcagcgagtctggccagcgtggagtcagcgttggtttcagctatccaggccctgcagcactggccagccccagcccatggtggagctcgtgcccagttagaaacgggcggtaccgaggagaacggcaagcccgccagcctgcagcagtgtagccagtccgagctgacagaacaggagcaggtgcgccttctgtccgaccagatcgcactagaagcatctctgatttcgcaaattgctgattccctgaaaaataccacttctgatgtgagccgaatgctgcatgaaatctcttggagtgggcaaccaccaatggaatctgccggagcaccagtggacacatgggccagaaaagtactcgtcgatggtgaattctggagccaagtggaaagcctgcggaagcaccttggtactctggggggcgaagcggtaggagcaagtggcgacggacagcagtcaatcccacagggattggctcctattcttgcgaacgctacctgggtacgcgctgagttgagcttcgctacccagagtgtgcgggagtcttttcatagacgcctgcagagcattcaggagaccctaagggggacacagactgctctgaggcaacacaaatgccttttgcgcgaaatcctgggcgcctaccagactccagattttgagagagttatgcagcaagttctggaagccctgaggctgccagcaggccacgaggatggcgtgcaactttcatgggatctgtccccactgggagaggtccttgggcgagacagcgatagcagccaggaaccctttgatgtgtccgaccagtcccctggtgccttcgtggccatccaggaggaactggcgcagcaactaaaagaaaaagcttccttgcttgaggagattgcagcagcactgccaagtcttccacccgtcgaatcattacgtgactgccaaaagttgctgcaggtgtctcagtctctatcatacaatacttgtctcggaggactgggccaatacagcagcctccttgttcaggacgctattattcaagcccaggtatgctacgccagctgcaggataaggctggagtatgaaaaagagctgcagctctgcaaggaaagctggcagacacgggaaccctcttgctccgaacaagcccaggcagcaagagcactgcgcgaggagtatgaggagctgctgaggaagcaaaagtcagagtatctcgacgtgattgccatcgttgaacgggaaaatgccgagctgaaagcaaaagctgcccagctggatcatcagcagcagtgccttgaagatgccgagtctaaacacagcatgagcatgttcaccctccgaggccgctatgaggaagagatccgctgcgtcgtcgagcagctgacaaggacggagtcaacgctacaggccgaacgttcgagggtcttgagtcagctggacgcttcagtgcgcgatcgacaggacatggaacgccaccatggagaacagattcaaacactagaggatcgcttccagcttaaagtacgagagctgcaaacgatccacgaagaggaactgcggacattgcaagaacactatagtcagtcccttcgctgtctgcaggacacgctttgccttcaccaaggccctcatccaaaggcactgcccgctccagcccctaactggcaggccacacagggggaagctgactcaatgacggggctgagagagaggatacaggaactggaggcacagatggacgtcatgagggaagagctcggacacaaagacttggagggcgacgccgctaccctgagggagaagtatcaaagggatctggaaagccttaaggcgacctgtgaacgggggttcgctgccatggaggagacacaccagaagaagatagaagacctgcagagacagcaccagcgggaactcgaaaagctgcgggaggagaaagacagattacttgccgaagaaacggctgctactattagcgccatagaagctatgaagaacgctcacagggaggagatggagcgcgagctagagaaaagtcagcgttctcagatttcctctgtgaactcagatgttgaggcacttcggaggcagtacttggaggagctgcagtccgtgcagcgcgagcttgaggtcctatctgagcaatactcccagaagtgtttggagaatgcccacctggctcaagcactcgaggctgagaggcaggccctcagacagtgccagcgcgagaaccaggaattgaacgcccacaaccaagagttgaataaccggctggccgccgagatcacgcggctgaggacgctgcttacaggcgatggaggtggtgaagctaccggctctcctctagctcaggggaaggacgcctatgaacttgaagtcttactaagggtgaaggaatccgagattcagtacctgaagcaggaaatcagctccttaaaagacgagctgcaaaccgccctgcgcgataaaaagtacgcttctgataaatacaaagacatctacacagagctgtccattgcaaaggccaaggccgattgcgacatctcgagattaaaggagcaactcaaggcagccactgaggccctcggcgagaagagccctgattcagcgacagtcagtggctacgatatcatgaaatcaaagtccaatcctgactttcttaaaaaggatagatcttgcgttacgcgccagctgcggaacatcaggagtaaatctgtaatcgaacaagtgtcgtgggacacctag

SEQ ID NO: 125427 - DNA, 840 bp, Artificial Sequence
  Description of Artificial Sequence: Synthetic coding sequence
taacaagaagccgagctgggtgagcccgatccagagcaaaaacgttcgcgtgcccgggagcgtcgacgtgaggggcgttccaaaacgttcgattgggctgagttcagacccattcagcaggccctggctcaggagagggtcggcggggtgggtcctgccgacacacatgaacctctacggccagaagcagagcctggtgaactggaaagagaacgagccagaaggagggaggaacgacggaaacggttcggaatgcttgatgcaaccgacgggccaggaactgaggatgccgctttaaggatggaggttgatcgcagcccagggctgcccatgtccgatctgaagacccacaatgtccatgtggagatagaacaaaggtggcaccaggtcgagacaactccattgagagaagagaaacaggtgccgattgcgccagtgcatctatcctcagaggacgggggagataggttatccacccacgagcttactagtcttcttgagaaggaattggaacagtcccaaaaggaggcaagcgatctgctggaacagaatcgcctgttgcaggatcagctcagagtggccctaggtagggagcaatctgcacgcgagggttacgtgctccagaccgaggtggcagcttctccatcgggcgcttggcagcgcctgcacagggtgaatcaagatctgcagtccgagttggaagcgcagtgtcagcgacaggaacttattacacaccagatccagactctcaaacgatcctatggagaggctaaggataccattcgccaccatgaggcagagatacgaagtctgcaggcacgcctctccaatgcagcctag

SEQ ID NO: 125428 - DNA, 585 bp, Artificial Sequence
  Description of Artificial Sequence: Synthetic coding sequence
ctgagacaacagactgtggaagaattacaatcagtgcaacgggaactggaggttctgtccgagcagtactcacagaaatgcctcgagaatgctcacctcgcccaggcactcgaagccgaacgccaggcactcaggcagtgccagagagagaatcaagagttgaatgctcataatcaggtgttactacgggtaaaggaaagcgaaatccagtacttgaagcaggagatcagctctctaaaggacgagctgcaaaccgcattgcgtgataaaaaatatgcgtccgataagtacaaggacatttataccgaactgtcaatagcaaaggcaaaggccgattgtgacatctctcgattaaaagagcagctgaaggcagcgacagaagcgcttggcgaaaaaagcccagatagtgccacagtcagtggctacgatattatgaaatcaaagtcaaaccctgatttcctgaagaaggacagaagttgcgtcactcgtcaactgagaaatataaggagcaagtccctgaaggaaggtttaacagtacaggaacgcttgaagctgttcgaaagcagggacctgaaaaaggattag

SEQ ID NO: 125429 - DNA, 3003 bp, Artificial Sequence
  Description of Artificial Sequence: Synthetic coding sequence
atgtccgctgcgaaagagaatccgtgccgaaagtttcaggctaatatattcaataagtctaagtgtcagaattgttttaagccccgcgaaagccatttgctgaatgatgaagacctcacacaagctaaaccaatttatggcggatggctgctgctggcgcccgacggcacagattttgacaatccagtgcaccgttcgcggaagtggcagcgccgcttttttatcctgtacgagcacggactgttgcgctacgctttagatgagatgcccacaactttaccccaggggaccatcaacatgaaccagtgcacggatgtcgtggatggggaaggaaggaccggtcagaagttctcgctttgtatcctcacgcctgaaaaagagcattttatacgggctgagacgaaagagatcgtttctggctggctggaaatgcttatggtctatcccaggactaacaaacagaatcaaaaaaaaaaaagaaaggtggagccaccaactccacaggagccgggtccggctaaggtggcagtcaccagctcttctagctcgagttccagctcttcttctattcccagcgctgagaaggtgccaacgacgaaatccaccctgtggcaggaggagatgcgcaccaaggaccaacccgatggctcatcgctgtcacctgcccaatcaccttctcaatctcagccccctgctgcaagcagcctgagggaacccggattggaatctaaagaagaggagagcgctatgtcgagcgatagaatggattgtgggcgtaaagtaagggtagagtctggctatttctcccttgaaaagactaagcaggatctcaaggctgaagagcagcaacttccaccaccactcagtcctccttcgccttccacacccaatcaccggcgctcgcaggttatcgaaaaattcgaagcactggatattgagaaggctgaacacatggagactaacgctgtcggcccttctccttccagtgacaccaggcagggccggagcgaaaagagggctttccctagaaagcgccctgatcttctcaactttaagaaaggctggctcacgaaacaatatgaggatggacagtggaagaaacattggtttgtccttgctgatcagagcctgcggtactacagggattcagttgccgaggaggcagctgatctggatggcgagatcgatttgtcagcctgctatgatgtcaccgagtatcctgttcagcgcaattacgggtttcagatccatacgaaagagggcgaatttaccttgagcgctatgacatccgggatccgtagaaattggatacagacaatcatgaaacacgttcacccaactacagcccctgacgtcacatcatccctgccagaagaaaagaataagtcaagttgcagctttgaaacttgcccgagacccaccgagaagcaagaagccgagttaggggagcccgatcccgaacagaagagatctagagcccgcgaacgaagacgggaagggcgttccaaaacattcgactgggcagaattcaggcctattcagcaggctttagcacaggagagagttggtggagtcggacccgccgatacccacgagcccttgcgccctgaggcggagccgggtgaattggagagagagcgagccaggagacgcgaagagcggcgaaagagatttggaatgttggatgcaactgatggtcctggtaccgaggatgcagccctccggatggaagttgaccgatctccaggcctgcctatgagcgacctaaagacacataatgtgcacgtggaaatagaacagagatggcaccaggtggagactacaccactacgcgaagagaagcaggtgcccatcgcccctgtgcacctaagtagcgaggatggtggggaccgtctgtccactcacgagctgacatctctgctcgagaaagagttagaacagtcacagaaggaagcaagcgaccttttggagcagaatcgtcttctccaagaccagctgagagtggcgctgggaagagagcaatctgctcgcgaaggctatgttctccaggctacatgcgaacgtgggttcgccgcaatggaggagactcaccagaaaaagattgaagatctccagcgacagcaccaacgggagctggaaaagctccgcgaggagaaagatagattattggcggaggagacagccgccactataagcgctattgaggctatgaagaacgcccacagggaagagatggaaagagagttagaaaagagtcagagaagccagatcagctctgtcaatagcgacgtcgaagctttaaggagacagtatttggaggagctacaatccgtccagagagagctcgaagtactgagtgaacaatatagccagaaatgtttagagaatgctcatcttgcccaggctctcgaagctgagcggcaggcgctgcgccaatgccagcgggaaaatcaagagttgaacgcgcacaatcaggagctgaataacagactcgccgctgaaatcacgagattgaggaccctcctgaccggggacggtgggggcgaggccacaggctccccactggctcagggaaaggatgcctacgaactcgaagtcttattaagagtgaaagagtccgaaattcaatacctgaaacaggagatctcctcacttaaggacgagcttcagacagcactaagagacaaaaagtatgccagtgataagtataaagacatatataccgagctgagcattgcaaaggccaaagctgactgtgacatatcaagactaaaggagcaactgaaggcggccactgaggctctaggcgaaaaaagccccgattccgccacagtctcaggctatgacataatgaagtcaaagagcaacccggactttctgaaaaaagatcggtcatgcgtgacaagacagcttcggaatatcagatccaagagcctgaaggaggggctcaccgtgcaagagcgcttaaagctgttcgaatcccgggacctgaagaaggattag

SEQ ID NO: 125430 - DNA, 795 bp, Artificial Sequence
  Description of Artificial Sequence: Synthetic coding sequence
atggagaactatggaatagagtggcacagcgtgcgtgatagcgagggccaaaaactactaatcggcgtgggaccagaagggatctctatttgcaaggatgacttttctccaatcaatagaattgcgtatcccgttgtgcagatggccacacagagtgggaaaaacgtgtatctcactgttactaaggagtcaggaaattctattgttttgctgttcaaaatgatctcgactcgggccgccagtggactgtaccgggccattaccgagactcatgcgttctatcgatgtgacactgtaacgagcgctgtcatgatgcagtatagcagagatcttaagggccatctggccagtctattccttaacgaaaacattaatctgggcaaaaagtacgtctttgacattaagcgaacctccaaagaagtctacgaccacgcgagaagggccctgtacaatgcaggagtggtggaccttgtgagtaggaacaatcagagtccaagccattccccgctcaagtcctcggaatcctccatgaactgctcctcctgcgaaggcttatcctgccagcagacccgcgttctccaggaaaagctgcgcaagttgaaagaggcaatgttgtgtatggtatgctgtgaggaggaaatcaactctacattctgtccttgcggtcataccgtgtgctgcgagtcttgtgccgcccaactacagtcatgccccgtgtgccgcagtcgggtagagcacgtgcagcacgtgtaccttccgactcatacttccttgcttaatctcacggtgatctag

SEQ ID NO: 125431 - DNA, 1338 bp, Artificial Sequence
  Description of Artificial Sequence: Synthetic coding sequence
atgctgtgctatgtgacacgacccgacgctgtcctcatggaggtggaggtggaggctaaagccaatggtgaggactgcctgaatcaggtgtgccggaggctgggaattatcgaagtggactacttcggactgcagttcaccgggtctaaaggagagagtctgtggctgaacttacgtaatagaattagccaacaaatggacgggcttgccccttacaggctgaaactgcgggtaaaatttttcgtagaaccacacttgatcctccaggaacaaactcgacatatctttttcctccacattaaagaggcgctccttgctggtcacttgctatgcagtcctgagcaagcagtcgagctgagcgcgttgttagcccagactaaattcggcgattataatcagaataccgctaaatacaattatgaggaactttgcgccaaagaactgagctccgctactctaaatagcatagtggccaagcacaaagaactagagggtactagccaggcatctgctgagtatcaggtcctgcagatcgtatccgccatggaaaactacggcatagagtggcattccgtccgagattcagaggggcagaagttattaattggagttggacctgagggcatttccatttgcaaggatgacttttcccccattaatcgcattgcataccccgtagttcagatggcaactcagtcaggcaaaaacgtgtatttgaccgttacgaaagagtcgggtaacagcattgtgctgttgtttaaaatgatcagtacaagagccgcgagcgggctctaccgagctataactgaaactcacgccttctataggtgcgacacagtgaccagcgcggtgatgatgcaatatagtcgagatttaaaaggccacttggcgagcctgttcctcaacgagaacattaatctcggtaaaaaatacgtctttgacattaagcgcaccagcaaggaggtatatgaccatgctagaagggcactctacaacgccggtgtggtggatctcgtgtccaggaacaaccaaagtcccagtcactctccactgaagagcagcgagagcagcatgaactgcagctcttgtgagggactgtcatgccagcaaacgcgcgtattacaagaaaagctgagaaagctgaaggaggcgatgttgtgtatggtgtgttgcgaagaggagataaactcaaccttttgtccatgtggccacactgtttgttgtgagagctgcgctgcccaactgcaatcctgcccggtatgccgctcccgggtcgagcacgtacagcatgtatacttgccaactcacacaagtcttttgaacctgacagttatttag

SEQ ID NO: 125432 - DNA, 5487 bp, Artificial Sequence
  Description of Artificial Sequence: Synthetic coding sequence
atggcggcatctgaactgtacacaaagtttgcccgcgtctggatccccgatcccgaggaggtgtggaagtccgccgaactcctcaaggactataagcccggggacaaagttttgctcctgcacctggaggaggggaaggatctggaatatcacttggatccaaaaactaaggaactgccccatcttagaaacccggatatcttggtgggcgaaaatgaccttaccgctttatcttacctgcatgaaccggcggtgctgcataatcttcgggtgaggtttatcgacagtaagttaatttacacctattgcggcatagtccttgtggctatcaacccatacgagcagctgcccatatacggggaggatattatcaacgcatattcaggccagaacatgggagacatggacccgcatatctttgccgtggctgaggaggcctacaaacagatggctagagatgagcggaatcagtccattatagtgtcaggcgaatctggcgccggcaaaacagtgtccgcaaaatatgctatgcgttattttgccactgtgtctggtagtgctagcgaggctaatgtcgaagagaaggttcttgccagcaaccctatcatggagagtatcgggaatgcgaagacaaccagaaacgataattcctcccgatttgggaagtacatcgagataggctttgataagcggtaccgaattataggcgccaatatgcgcacctatttgctcgagaagtctcgcgtggtttttcaggcagaagaggagcggaattaccatatcttctatcagctctgtgcatctgctaagctgcccgaatttaagatgctgaggcttggtaacgctgacaattttaactacacgaagcagggaggtagcccggtcattgagggcgtggacgacgccaaagaaatggcccacactaggcaagcctgcacgcttctgggaatctcagagtcacaccagatggggattttcaggatactggcagggatcctgcatcttggaaatgtgggttttaccagcagggacgcggactcctgcaccatcccacccaaacatgagcctctgtgtatcttttgtgagctcatgggggtggactacgaagagatgtgtcattggctgtgccatcggaaactggccactgccacagaaacgtacatcaaacctatcagtaaactgcaggccacaaatgcccgcgatgctctcgccaagcacatatacgcaaaattgtttaattggatcgtggacaatgtcaatcaagccctgcacagcgcagtaaagcagcattcttttataggcgtcctcgatatctatggtttcgaaactttcgaaattaacagctttgagcagttctgcatcaattatgcaaatgaaaagcttcagcagcagttcaatatgcacgtgtttaaactggagcaagaggaatacatgaaggagcaaatcccctggaccttgatcgacttctacgacaaccagccatgcattaatcttatagaatccaaactgggtattctggacctattggacgaggagtgtaagatgcccaaaggcacagatgatacatgggcccagaagctttacaacactcatttaaataaatgcgcattatttgagaagcccagattaagcaacaaggcattcatcatacagcacttcgcagacaaggtcgaataccaatgcgagggcttcctggagaagaacaaagatacagtcttcgaggagcagattaaggtgctaaaaagctcaaaattcaagatgctaccggaactcttccaagacgatgagaaggctattagccccacatctgcgacctcatcaggccggaccccattgacacgcacccccgctaaaccaacaaaggggagacctggacagatggccaaggagcacaagaagaccgtggggcaccagttccggaactctctgcacctactgatggagacgctcaacgcaacaactccgcactatgtgagatgtattaagccaaatgattttaaatttccttttacgtttgacgagaagagggccgttcagcaacttagggcctgtggcgtgctggagaccatcagaatttcagcagcaggatttcctagccgctggacctaccaagaatttttctcacgatacagagtgctaatgaagcagaaggatgtgttgagtgatcgcaagcagacctgcaagaatgtattagagaagctgatcttagataaggataagtaccagttcgggaaaaccaagatttttttcagagcaggacaagtggcatacttggaaaagctgagagccgacaagttgagagctgcctgtatcagaatccaaaaaaccatcagaggctggctgctgcgcaaaaagtatttgcgcatgcggaaggctgcaatcaccatgcaacggtacgtccgcgggtaccaggcacgctgttacgcaaagttcctgcggcgcaccaaggctgcgaccatcatccaaaagtactggcgcatgtacgttgtccgacgacggtacaagatccgccgcgccgccaccatcgtgctgcagtcttacctgagagggttcctggctcggaaccggtaccgcaagattctgcgcgaacataaagcagtaatcatccaaaagcgggtccgtgggtggctagcaagaacccattataagcgatccatgcatgctataatctacctccaatgctgctttcggcgtatgatggctaagcgggaattgaagaaactaaagattgaggcccgcagcgtcgaacgctacaagaaactccatatagggatggagaataaaatcatgcaacttcagcggaaggtcgacgagcaaaataaggactataagtgtttggtagaaaaactaactaacctagagggcatctacaatagcgaaacggagaagcttagatccgatctcgagaggctgcagctatctgaggaagaggccaaagtggcaacaggacgggtgctgtcccttcaggaagagattgcaaaactcaggaaagacctcgagcagacccgcagcgagaagaagtgcatcgaggaacatgccgaccgatacaaacaggagaccgagcagcttgtcagtaatctgaaagaagaaaacaccctactgaagcaagaaaaggaggccctgaatcatcggatcgttcagcaagccaaggaaatgacagagacaatggagaagaagcttgtggaagaaaccaaacagctggagcttgacctgaacgatgaaagattgaggtaccagaatctgttaaatgagttcagtcggctggaggagcgctatgacgatctcaaagaggagatgactctcatggtgcatgtgcccaagcctgggcacaagcgtacagactcaacgcatagctccaacgaaagcgagtatatctttagtagtgaaattgcagagatggaagatattccttccaggacagaggagcctagcgaaaagaaagtgcctttggatatgagtctcttcctgaagctccaaaaaagagtgactgagctggagcaggaaaaacaagtgatgcaagatgaattggacagaaaggaggaacaggtgctacgaagcaaggctaaagaggaggagcgaccccagatacgcggggcagaacttgaatatgagtccttaaagagacaggagctggagtccgaaaacaagaaacttaagaacgagctcaacgaactccggaaggccctgtccgaaaagtcggctccagaggtgacggcacccggggcaccagcttaccgtgtgcttatggagcaactcaccagcgtgtcagaggaactggatgtgcgaaaggaagaggtcttgatcctgcgcagtcaactggtgtctcagaaagaggctatacagcccaaagatgataagaatactatgaccgactctacaatcctgctggaagatgtgcagaaaatgaaagataaaggcgagatagctcaggcctatataggcctaaaggagacaaatcgcctgctcgagagtcagctacagagtcagaaacgatcacatgagaatgaggctgaagcactgaggggcgagattcagagcttaaaagaggagaacaataggcaacaacagctcctggcccagaacctacagttacctccagaagctcgaattgaagcttccctccaacacgagatcacaagacttacaaacgagaacctcgatctgatggagcagttggaaaaacaggacaagaccgtccgcaagctgaagaagcaacttaaagtatttgcaaagaaaattggggagcttgaggtagggcagatggagaatatcagtcctggccagatcatagacgagccaatcaggccagttaatatccctaggaaggagaaggatttccaaggaatgctcgagtacaaaaaggaggacgagcagaagctggtcaagaatctgatattggaactaaagccccgcggcgttgctgtcaatctgatcccaggattgcctgcgtacatcctgtttatgtgtgttaggcatgccgactatttgaacgatgatcagaaagtgagatcgctgttgacttccaccattaatagcattaaaaaggtgttaaagaagagaggcgacgatttcgagactgtttccttctggctgtcaaacacgtgtaggtttttgcactgcctcaaacagtactcgggcgaagaagggttcatgaagcacaatacttcccgccagaatgagcactgcctgactaacttcgacctcgctgaatatcggcaagtgctgtcagacctggccatccaaatataccaacagctcgtgcgggtgcttgagaacatactccaacccatgattgtgtctggtatgctggagcatgaaacaatccagggcgtgagtggcgttaagccaactggcctccggaaacgaacaagctctatcgcagatgaggggacttacaccctggatagtatactaagacagctgaattcttttcactcagtcatgtgccagcacgggatggacccggagctcattaagcaagtggtcaaacagatgttctatatcatcggagccattactctgaacaatctcctgttgagaaaagatatgtgttcatggagcaagggcatgcagatccgctacaatgtcagccaactggaggagtggcttagggacaaaaacttaatgaacagcggcgccaaagaaaccctcgaacccctcatccaggccgcccagctgctgcaggtcaagaagaagactgatgatgacgcagaagccatctgttccatgtgtaatgcactcaccaccgcccagatcgtgaaggtcctcaatctttataccccagtaaatgagttcgaggagcgggtcagcgtgtccttcatccggacaatacagatgcggcttcgggatagaaaggattcccctcaactgttgatggatgccaagcatattttccccgtgacctttccatttaacccctcgagcctggcgctagaaactatccagatacctgcgagtttaggactgggctttatctctcgtgtgtag

SEQ ID NO: 125433 - DNA, 5643 bp, Artificial Sequence
  Description of Artificial Sequence: Synthetic coding sequence
atgaagtcctccagcctcgaaaccatgttcgcaagagtgtggatcccagatcccgaagaagtttggaagagcgcagagctgctgaaggattacaaacctggggacaaagtgctcctgttgcacctcgaggaaggaaaggatctggaataccacttggaccctaaaaccaaggaattgccccacctgaggaaccccgacattctggtgggggaaaatgacctgaccgcactgtcatatctgcacgagccagccgttctccataatctgagagttcgcttcattgattcaaaactgatttatacctactgtggtatcgttctggtggcaattaacccttacgaacagttgccaatctatggcgaagacatcattaacgcttactcgggtcagaacatgggggacatggatcctcatattttcgccgtggccgaggaggcgtataagcaaatggcccgggatgaacgaaaccaaagtatcatcgtcagcggggaaagcggggctgggaagaccgtctccgcaaagtacgccatgagatattttgcaactgtgtccggctccgcctccgaggccaacgttgaggaaaaggtcctggccagtaatccaatcatggagtcaattggcaacgctaaaacaacccgcaacgacaattcgtctagattcgggaaatacatcgaaatcggtttcgataagcgatatcggatcattggagccaacatgagaacatatctactcgagaaatcacgagtcgtgtttcaggctgaggaagaaagaaactatcacatcttctatcaattatgtgcgtcagctaagttgccagaatttaagatgctgaggttagggaatgccgacaatttcaattatactaaacagggggggtcccccgtgatagaaggcgttgatgacgccaaggaaatggcccacacgcgccaagcctgtaccctcctcggcatttcagagtcgcaccagatggggatttttagaattctcgctggtatcctgcatctcggcaatgtcgggtttacgtcccgcgatgctgattcttgtactattccgccgaagcatgagcctctgtgcatcttttgtgagctgatgggcgtggactacgaggaaatgtgccactggctatgccaccgtaaactcgccacagcgaccgaaacctacatcaagccaattagtaaactgcaagccacgaatgcacgggacgctctggcaaaacatatctatgcaaagttgttcaattggattgtggacaatgttaaccaggctctgcatagcgctgtgaaacaacacagcttcattggcgtgctggacatctatggcttcgagacctttgaaattaatagcttcgagcagttttgtataaattatgctaacgaaaagcttcaacagcagttcaatatgcatgtttttaagctcgaacaggaggagtacatgaaggaacagataccctggacattgattgatttctacgataaccagccatgtataaatcttatcgagtccaagctgggaattctggatctgctcgatgaagagtgtaagatgcccaaagggactgacgatacttgggcccaaaaactctataacacccatttaaacaaatgcgctctgttcgaaaagccccggctgagcaacaaggcattcattattcaacacttcgctgataaggttgaatatcaatgtgaaggattcctggaaaaaaataaagatactgtttttgaagaacagatcaaagtgttgaaatctagtaagtttaagatgcttccagagttgttccaggatgacgagaaagccatcagtcccacctctgcaacaagcagcggccgcacgcccctgacacggacccccgccaaacctaccaagggcagaccaggtcagatggctaaggaacacaaaaagactgttggccatcagttcaggaatagcctgcatctcctgatggagacgctgaacgccacaaccccacactatgtacgatgcataaagcccaacgacttcaagttccctttcacatttgacgagaagagagcagtccaacagctcagggcctgcggagttttggagaccattcggatttccgccgcaggattccctagccgatggacctatcaggagtttttctcacggtatcgtgtgctaatgaagcagaaggatgtgttgtctgaccgcaagcagacttgcaaaaacgtcctggagaagttaatcttggataaagacaaatatcagtttgggaagaccaagatattcttccgggctgggcaggtggcctacttagagaaactgagagccgataagcttcgggccgcttgtattagaattcaaaagaccatccgaggctggctgttgcgcaagaagtacctgaggatgcgtaaggctgcaattacaatgcagcggtacgtgaggggataccaggctcgatgctatgccaaattcttacggcggaccaaggccgccacaatcatccagaagtattggcggatgtatgtcgtccgaaggcggtataagattcgccgcgctgccacaatcgtgctccagtcatatctgcgggggttcctggcccgcaacaggtaccggaaaatccttcgcgagcacaaagccgttataatccagaagagggtcagaggctggctagccagaacccactacaaacggtcaatgcatgcaattatttacctacagtgctgtttcagacgaatgatggcgaagcgcgagctgaaaaagctgaagattgaggcccgctcagtggaacgctacaagaagttgcacatcggaatggagaacaagatcatgcagcttcagcgaaaggtcgatgaacagaacaaagattacaaatgtctggtggagaaactaacaaatctggaaggcatctataattccgaaactgagaaactaaggtccgacttggaacggctccagctttcagaagaagaagcaaaggtggctacagggagggtcctgagcctccaggaggaaattgccaagctacggaaggacctggaacagacgcgctccgagaaaaagtgcattgaggaacatgcagaccgttataagcaggagaccgaacagctcgtcagtaaccttaaggaggagaatactcttctgaaacaagagaaagaggctctcaaccaccgcatagtgcagcaagcaaaagagatgaccgagactatggaaaagaagcttgtcgaggaaactaagcaattagaactggacctgaacgatgagcgtctgaggtatcagaacctgctgaacgaatttagtagactggaggagagatacgatgaccttaaagaggaaatgactttgatggtgcacgtgccgaagcccggccacaaacggaccgactcgacacatagtagcaatgaaagtgaatatattttttcctcagagatcgcagagatggaagatattccgagccgtactgaagaaccgtccgagaagaaagtacccctggacatgtccctttttctgaagctgcagaagcgcgtgacggaattagagcaggaaaagcaagtgatgcaagacgaactggaccgaaaagaagagcaggtgctgcggagcaaggcaaaggaggaagaacgaccacagatccgaggtgcagaactcgagtacgagtcacttaaaaggcaggagctggagtctgagaataagaaattaaagaatgagttaaacgagctgagaaaagctttatcagagaaaagtgcacccgaagtaacagccccaggcgcacctgcataccgggtgctaatggagcagctgacctcagtgtctgaggaattggatgttagaaaagaagaggtgctcatccttcggtctcaactggtgagccagaaagaggccattcaacccaaactccacgaaaataccatgactgactccacaattctcctggaagatgtacagaagatgaaggacaaaggcgaaattgcacaggcatacatcggccttaaggaaactaatcggtcatcggcactagattaccacgagttgaatgaagacggcgagctgtggctagtttatgaaggacttaaacaggcaaatcgcttattggagagccagctccaatcccaaaagcgcagtcacgaaaacgaagcagaggctctcagaggcgaaattcagtccttgaaggaggaaaacaaccggcagcagcagcttctcgcccaaaacctgcagctcccaccagaagcgagaatcgaagcgtctcttcagcacgaaatcactcgcttaactaatgagaatctgtattttgaggagttgtacgcagatgaccccaaaaagtaccaatcttaccgtatctccctgtataagaggatgatcgatctgatggaacagctcgaaaagcaggacaaaacagtgcgcaaattaaaaaagcagctcaaggtgtttgccaaaaagatcggcgaactcgaggtggggcagatggagaatatctcccctgggcagataattgacgagcccataagacccgttaatattccacgaaaggaaaaagacttccaaggtatgctcgagtacaaaaaggaagatgaacagaagctagtaaaaaatcttatactggagctgaagccacggggggtggcagtgaaccttattccaggcctacccgcctatattttattcatgtgtgtgcggcacgccgactacctgaatgacgatcaaaaagtacgcagtctattgacatctactattaacagcataaagaaggtgcttaagaaacggggggacgactttgaaacagtgagcttctggctgagcaatacatgccggttcctgcattgtctgaagcaatacagcggcgaggagggcttcatgaaacacaacacatcccggcagaatgagcattgtctcactaacttcgatctggcagagtaccgccaggtattgtctgatctagccatacagatttaccagcagctggtcagggtgttggagaatatccttcagccgatgatagtgtcggggatgctggaacacgaaacaatacaaggcgtgtctggcgtgaaacccaccggtctcaggaaaagaacctccagcatcgcagatgaggggacctacaccctggacagcatcttgcgccaactgaactcctttcattccgttatgtgccagcacggcatggatcctgaactgatcaagcaagtggtgaagcaaatgttctatatcatcggcgccatcactctcaataacctgttgctgagaaaggatatgtgctcatggtccaagggcatgcaaatcagatacaacgtatctcagcttgaggagtggctgagggataagaatctgatgaattcaggcgccaaagagactctagaacctctgattcaggctgcccagttgttgcaggttaaaaagaaaacagatgacgacgcagaggccatctgctcaatgtgcaacgcactcacaaccgcacaaatcgtcaaagtgttgaacttgtacacaccagtcaatgagtttgaggaaagggtctctgtaagtttcatccgcacgatccaaatgcgacttagggatcggaaggattctccccaattgctgatggacgccaaacatatcttccccgtgacattcccatttaacccatcatctctcgcccttgaaaccatccagattccggccagtcttggattagggtttatcagcagggtctag

SEQ ID NO: 125434 - DNA, 4089 bp, Artificial Sequence
  Description of Artificial Sequence: Synthetic coding sequence
atgcatgtgttcaagttggagcaggaagagtatatgaaagagcaaatcccctggaccttgatcgacttctacgataatcagccatgtattaatctaatcgagtctaagctgggcatcttggacctgctggacgaagagtgcaagatgccaaaggggacagacgacacctgggctcagaaactgtacaacacacacctgaacaaatgcgcactttttgagaaaccccggctttctaataaggcctttatcatccagcacttcgccgataaagttgagtatcagtgcgagggcttcctagaaaaaaacaaggatactgtgtttgaggaacaaatcaaggttctgaagtcttctaaatttaagatgctgcccgaactcttccaggacgacgagaaagcgatctcccccacttcagctacatcctctggacgcaccccactaacacgaaccccagccaaacccaccaagggccgacctggtcaaatggccaaggagcataagaagacagttggtcaccagttcagaaacagcctgcacttgctgatggaaactctcaatgccactacgccacactacgtgcgatgtattaaaccaaatgacttcaaattcccttttactttcgatgaaaaacgagcagtccagcagctgcgcgcttgcggtgtgctggagacgattcggatctccgctgctgggttcccaagcaggtggacatatcaagagttcttttcacgctatagagtgctgatgaaacagaaggatgtgcttagcgaccgtaaacaaacatgtaagaacgtgctggaaaaactgatcctagataaggacaagtaccagtttggaaaaacaaagatttttttcagagctgggcaggttgcgtatttagagaaactacgggccgataaactgcgagccgcctgtattcgcattcaaaagaccatcagagggtggttacttaggaaaaagtacctacgtatgaggaaggcagcaatcacaatgcagagatatgtccgcggctatcaggctaggtgctacgccaagtttctgagaagaactaaagcagctacaataatacagaagtactggagaatgtatgtggtgagacgccgttataaaattaggcgcgcagccactatcgtacttcagtcatacctccgggggttcctggcaagaaacaggtatcggaagatactgagggagcacaaggctgtgatcatccaaaaaagggtccgcggatggcttgcaaggacacattacaaacggagcatgcatgccattatttatctgcagtgttgtttccgaagaatgatggcaaagcgtgagctgaagaagcttaaaatagaggcacgcagcgtcgagaggtacaagaagctccacatcgggatggagaataaaattatgcagctgcagcgtaaggtggacgagcaaaataaggactacaaatgcctggtggagaaattgacaaatctggagggtatttataatagtgagactgagaagctgcgtagtgatttggaaagactgcagctgtccgaagaagaagctaaagtggccacagggcgcgtgctctctttgcaggaggaaattgcgaagctccgaaaggacctggagcagacccggtcggagaagaagtgtatcgaggaacacgcggatcgatacaaacaggaaactgagcagctggtcagcaatctcaaagaagagaacacactcctgaagcaggagaaagaggccctcaaccatcgcattgtacagcaggccaaggagatgacagagacaatggaaaagaaacttgtagaagagacaaagcagttagagctcgaccttaacgatgaaagattgcgctaccagaacctgctgaacgagttcagcagattggaagagagatacgatgacctgaaggaagagatgactctgatggtccacgtgcccaaacccggccacaagcggaccgatagcactcactcatccaacgaaagtgagtacatcttttcaagtgaaatcgccgagatggaggacatcccatcacgcacagaggagccaagcgagaagaaggtccccttggatatgtcactgtttctgaagttgcagaagcgggtgactgagctggagcaggagaagcaggttatgcaggatgaactcgatcgcaaagaggaacaggtgctgcggtcaaaggccaaggaagaagagaggccacagattagaggggcagagctggagtatgagtctttaaagagacaggagttagagtccgagaataaaaaattgaaaaatgagctgaacgagctgagaaaggccctgtccgaaaaatctgctcctgaagttactgctccaggtgcacctgcctacagagtactcatggaacaattaacctccgtctccgaggagctcgatgtgaggaaggaggaagttctgatcctgcgcagccagctcgtgagccaaaaagaggccatccagccaaaagatgataagaacactatgacggactccacgatccttcttgaagatgtgcagaagatgaaggacaagggggaaatcgctcaagcctacatcgggctgaaggaaaccaaccgactccttgagtcccagctgcagagccagaagcgcagccacgagaatgaggcagaggctttgcggggcgagatccagagtctgaaagaggaaaacaaccgtcaacaacagttgttagcccagaatctgcagctgccgcctgaggccagaatcgaggcatccctccagcatgagatcacgcgcctcaccaacgaaaacctggatctgatggaacagctcgaaaaacaggacaaaaccgttagaaaactgaaaaagcagttgaaggtattcgctaaaaagatcggtgagctggaggttgggcaaatggaaaacatcagccccgggcagattattgacgagcccatcaggcccgtgaatatccctagaaaagaaaaggactttcagggaatgttggagtataaaaaggaggatgaacagaaactcgtcaaaaacctcattcttgagttgaaacccagaggcgtggccgtgaatctaatacctggcctgccagcctatattctttttatgtgcgtgcgtcacgccgactacttaaacgacgaccaaaaggtgaggagcttgctcaccagcacaatcaacagcattaagaaagtgctaaagaaaagaggtgatgacttcgaaactgtgtcattctggctcagcaatacttgcagatttctgcattgccttaaacaatacagcggtgaagagggctttatgaagcataatacttctcgacagaatgagcactgcctaactaatttcgacctagcagaatatagacaggtcctgtctgacctggctatccagatctatcagcagttggtaagagtcctagagaatattctgcaaccgatgatcgtaagcggaatgttggagcacgagactattcagggagttagcggtgtaaagcccacaggcctgagaaaacgcacaagtagcattgccgacgaaggtacttacacactggatagcatactgcgacagctgaattccttccatagcgtaatgtgccagcacggcatggacccagaactgataaagcaggttgtgaaacagatgttttatatcattggagccatcaccctgaataacctcctcctgcggaaagacatgtgctcatggagcaaaggcatgcaaatacgctacaacgtgtctcagttggaggaatggctgcgagacaagaatttaatgaattcgggcgccaaggaaaccctggagcctctgatccaggcggcgcagctgctacaagttaagaaaaagaccgatgacgacgctgaagccatctgcagtatgtgtaatgctcttacgacggctcagatcgtaaaagtgcttaatttgtatacaccagtgaacgaattcgaggaacgggtgagtgtaagtttcatcaggacgatacagatgagactgagagatcgtaaagactcccctcagctgctcatggacgccaaacacatcttccccgtcacctttccgttcaacccatcttctttggcacttgaaacaattcaaatccctgcatctctaggtctcggatttatttcccgagtctag

SEQ ID NO: 125435 - DNA, 5568 bp, Artificial Sequence
  Description of Artificial Sequence: Synthetic coding sequence
atggccgcgagcgaactctacaccaagtttgcaagagtgtggattcctgatccagaagaagtgtggaaatccgccgagcttttaaaggattacaaacctggtgataaagtacttctgctccatctcgaggaggggaaagatctggagtaccacctcgaccccaagaccaaggagcttccgcacctgcgaaaccctgatatcctggtgggagaaaatgatcttaccgcactatcttatctgcacgagcctgccgtgctccacaacctgcgcgtgcggttcattgactcaaaacttatttacacatattgcgggattgtccttgttgctataaacccctatgagcagctacctatctacggggaagatataattaatgcctactctgggcagaacatgggagacatggatccccatatcttcgccgtagccgaggaggcgtacaaacagatggcccgcgacgaaaggaatcagagcataattgtctcgggggagtcgggagccggcaagactgtgtccgccaagtacgccatgcgttacttcgcgactgtttccgggtccgccagcgaggctaacgtggaggaaaaagtcttggcctccaatcccatcatggagtcgattggaaacgcgaagaccactcgcaatgacaattctagccgcttcggaaagtacatagaaattggattcgacaagagatacagaattatcggtgcaaacatgcgcacttatttgttggagaaatcgcgcgtggtctttcaggcagaagaggagcggaactatcatatattctatcagttgtgtgcctcggccaaactgccagagtttaaaatgcttaggctgggcaatgccgataactttaactacaccaagcagggagggtccccggtcattgagggggtggacgacgcaaaggaaatggcccatactagacaagcttgcacactgttgggaatctccgaatcacaccagatgggcatctttcgcattctcgccggcattctccacttaggtaatgtgggcttcacctctagagacgctgactcttgtaccatcccgcccaaacacgagccactgtgcattttctgtgagctcatgggcgtggactatgaggagatgtgtcactggctgtgtcacaggaaactagccacagccacagagacctatataaagcctatttctaaactgcaggcgacaaatgctcgagatgcattggcaaagcatatttacgcaaagctgttcaattggatcgtggataatgtgaatcaagctctacacagtgccgtgaagcagcattcctttatcggggtcctggatatttatgggtttgagaccttcgaaatcaacagttttgagcaattttgcatcaattatgccaacgagaagctacagcagcaatttaatatgcacgtgttcaaactggaacaagaagagtatatgaaggagcagatcccttggactctgatcgacttttacgacaaccagccttgtatcaatcttatcgaatccaaacttggcatcctagacctcttagacgaggaatgcaagatgcccaagggtacagatgatacatgggcccaaaagctgtataatacacacctcaacaagtgtgccctgtttgaaaagccccgcctgtccaacaaagcattcatcatacagcattttgccgacaaagtcgagtatcagtgtgaggggtttctggaaaagaacaaggatacggtcttcgaagagcaaatcaaagtgttgaaaagcagtaagttcaaaatgttacccgagctgttccaagacgacgagaaggctatctcccctacaagcgccacttcttccgggaggacacccttgacaaggacccccgctaagccaaccaaaggtcgaccggggcagatggccaaggagcacaagaagaccgtggggcaccagttcagaaacagtctccacctcctgatggaaaccctgaacgcgactaccccccattatgtgcggtgcattaagcctaacgacttcaagttcccctttacgtttgacgagaagcgagccgtgcagcagttgcgggcctgtggagtactcgagacaattagaattagcgctgccggctttccctctcgatggacttatcaggagttcttttctcgctatagggtcttgatgaagcagaaggacgttctgtccgataggaagcagacctgcaagaacgtattggagaaacttattctggacaaggataaatatcaattcggcaagacaaagatattcttcagagctggtcaggtggcctatctggaaaagctccgggcagataaactgagagccgcttgtattcgcatccaaaagacgatcaggggatggttgctcagaaaaaagtacctccgtatgcggaaagcagctattactatgcagcggtacgtccgagggtaccaggctagatgttatgccaaattcctgaggagaacgaaggctgcaacaatcattcaaaaatattggcggatgtacgtcgtgcggcgtaggtataagattcggcgcgccgccaccatagtgctacaatcttatctgcggggtttcttggcaagaaacaggtatcgtaaaattttacgagaacataaggctgtgattattcagaagagagtgagggggtggctagcaagaactcactataagagatctatgcatgccataatctacctgcaatgctgctttcgacgcatgatggccaagagagaactgaagaaactaaaaattgaagcaagaagcgtcgaaagatacaaaaagctccacattggcatggagaacaagattatgcagttacaacggaaagtggacgaacagaacaaggactataaatgcctggtggagaagcttaccaacttggaaggaatctataactcagaaactgaaaaactgcgatccgatcttgagaggctgcaactcagcgaagaagaagcaaaggtcgctactggtagggttctgtcactgcaagaggaaattgccaagctgaggaaggatctggagcagacccgttccgagaaaaaatgtatagaggagcacgccgaccgatataaacaggagaccgagcaattagtctccaatcttaaggaggaaaacacactgctaaagcaggaaaaagaggcactaaaccatagaattgtgcaacaggcgaaggagatgaccgaaacaatggagaaaaagctggtagaagagaccaagcaactcgaactggatttgaatgatgagagactgcgttaccagaatctcttaaatgagttcagccgccttgaggagcgctacgacgacctgaaggaggagatgactctgatggtgcatgttcccaagccagggcacaagcgtaccgactccacccacagctctaacgaatcagagtatattttttctagcgaaattgcggagatggaggatataccgtctcggactgaggagcctagcgagaagaaagtgccgcttgatatgtctctcttcttgaaattacaaaaacgggttaccgagctggaacaggaaaagcaggtgatgcaggatgaacttgacaggaaagaagaacaggttctgcgttccaaggcgaaggaggaggagcggccacagatccgaggcgctgagctcgagtatgagtccctaaaacgacaggagctggagtccgagaacaagaagctaaagaacgagctcaatgagctcaggaaggcactgagtgagaagtcagcccccgaagtgaccgctccaggggcaccagcgtacagggtccttatggaacagctgacatccgtctcagaagagcttgatgtgcgaaaggaggaggtgttgatactgcggtcacagctagtgagccagaaggaagccattcagccaaaggacgacaaaaacacaatgactgatagcacaatattattagaggatgtccagaagatgaaggacaagggtgagatagcacaagcctatataggcctgaaggagactaataggtcctccgcccttgattaccatgagctgaacgaagacggagagctgtggctcgtgtatgagggtctcaaacaggctaatcggcttctcgagagccaactgcaaagtcaaaaaagaagtcatgagaacgaggctgaggcattgcgaggggagatccagagcctcaaagaagaaaacaacaggcagcagcagttgctggctcagaaccttcagctccctcccgaagctcgcatcgaagcctctctgcagcatgaaatcactcgactaacaaatgagaacctcgatctgatggaacagctggagaaacaggataagaccgtgcgaaaactgaagaaacaacttaaagtgtttgcaaagaagatcggagagctggaagtcggccagatggagaacatctcccccggccagatcatcgatgagcccattagaccagtcaacatccctaggaaagagaaagactttcaagggatgctagagtacaagaaggaagatgaacaaaaactggtgaaaaaccttatactggagctcaagccgcggggcgtggccgtaaaccttatccccggtctccccgcttatatactctttatgtgtgtgcgacacgccgattacctgaacgacgaccagaaggtcagatccctgctgacttctaccataaattcaatcaagaaggtgctaaagaaaagaggcgacgattttgagaccgtaagcttttggctgtctaatacttgcagattcctgcactgtcttaaacaatattcgggagaagaaggctttatgaagcacaatacgtccaggcaaaatgagcactgtttgaccaactttgacctggctgaatacaggcaggttttgtctgatcttgctatccaaatctatcaacagcttgtgcgggttctggaaaacattctccagcctatgatcgtgtccggcatgctggaacacgagacgattcaaggagtgagcggagttaagccaacaggcctaagaaaaaggactagcagcatcgccgatgaggggacatatacgctggactcaatcctgaggcagctgaactcctttcatagtgtgatgtgccagcacggcatggacccagaactgataaagcaggtggtgaaacagatgttctacattattggggctatcaccctgaacaatctgttactgagaaaagatatgtgtagctggagcaaaggcatgcaaatcagatataatgtgagccagttggaggaatggctccgagataagaacttgatgaattctggagccaaggagacccttgaaccactgattcaagccgcccagctgttgcaagtgaagaaaaaaacagatgacgatgccgaggccatctgtagcatgtgtaatgctctgactacagcccaaattgtgaaagtgctcaatctctacactcccgtcaacgaatttgaggagcgtgtgagtgtgtcctttatacggacaattcagatgaggctgagggacagaaaggacagtccccagctactcatggatgccaagcatatattccccgtaaccttcccattcaatcccagctccctggccctcgagactatccaaatccccgcctccctcggacttggctttatctcacgcgtgtag

SEQ ID NO: 125436 - DNA, 5559 bp, Artificial Sequence
  Description of Artificial Sequence: Synthetic coding sequence
atggctgccagcgagctatacactaaattcgcacgagtctggatccctgaccctgaagaggtatggaagtccgccgaattgctgaaggactataagcctggagacaaggtcctgctcctccatttagaggagggtaaggatttggagtaccatctggatcccaagaccaaggaactgcctcatctgagaaacccagatattctcgttggcgagaacgatttgaccgctctgagctatctgcatgagcccgccgtactgcataacttgagggtaaggtttatagactcaaagctgatttacacatactgtggcattgtgctggtcgcaattaatccgtatgaacagctaccaatctatggcgaggatataatcaacgcctactcgggacagaacatgggagatatggacccacatatattcgcggtggcagaggaagcctataaacaaatggcacgggatgaaagaaatcagtctattatcgtatccggagagagcggggcggggaaaaccgtgagtgcaaaatacgctatgagatacttcgctacagtctctggtagcgctagcgaagccaacgtcgaggagaaggtgcttgcttccaacccaatcatggagagcattggcaacgccaaaacaacgcgcaacgataacagttcacggtttggcaaatatatcgaaattggctttgataaacgatacaggattatcggcgccaacatgcggacctaccttctcgagaagtcccgcgttgtgtttcaggccgaggaggaacggaattaccacatcttttaccagctgtgcgcttccgccaagctccctgaatttaagatgctgcgcctcggaaacgccgacaattttaattacacaaaacagggtggatctccagtgatagaaggagtagatgatgcgaaggaaatggcacatacgaggcaggcctgtacgcttctgggcatctcagagtcgcatcagatgggaatttttcgcatcctcgctggcattcttcacctgggcaatgtggggttcacatccagggacgcagactcgtgcacaatcccacctaaacatgagcctctgtgcattttttgtgagctaatgggcgtcgactacgaagaaatgtgtcactggctttgccaccggaaactggcaacagcaactgagacctacattaagccaatatcgaagctgcaggccactaacgcccgcgatgctctcgccaaacacatctatgccaaactgttcaattggattgtcgacaatgttaaccaagcactgcattctgcggtaaagcaacattctttcatcggagtcctggacatctatggcttcgaaactttcgagatcaatagctttgagcagttttgcatcaactacgcgaacgagaaactgcagcagcagttcaacatgcatgtgttcaaactggaacaggaggagtacatgaaggagcaaattccttggacactgatcgatttttatgataatcagccatgtatcaatctgatcgagtcgaagctcggtattttagaccttctggatgaagagtgcaagatgccgaagggcacagacgacacgtgggcccagaagctttacaacactcacctgaacaagtgtgcgttattcgaaaagcctcgcctttctaacaaagcattcatcattcaacacttcgccgataaggtcgagtaccagtgcgagggattcctcgagaagaataaggataccgtgttcgaggagcagattaaggtgctgaaatcctctaagttcaaaatgctgcctgaactgttccaagacgacgaaaaagccatcagtccaactagcgcaacaagctcaggccgcacaccattaaccaggacaccagctaaacccaccaagggtcggccagggcaaatggctaaggagcataagaaaactgtcggtcatcagtttagaaattctctccatctgctgatggaaacactgaacgctactactccgcactacgtgaggtgtatcaaaccgaacgattttaagtttcctttcacatttgacgagaagcgtgctgtgcagcaactgcgagcttgcggtgtgttagagacaattagaatttccgctgcgggcttccccagcagatggacctatcaggagttctttagtcgctatagggttctcatgaaacagaaggacgtcctatctgaccgcaagcagacctgcaagaatgttctggaaaaactgattctggataaggataagtatcaatttggaaaaactaaaatcttctttcgagccggccaggtggcctaccttgagaagttgcgggcagacaagctgcgggccgcctgtatcagaatccaaaaaactataagaggttggctgttgcggaaaaaatatttacggatgcgtaaggccgccataactatgcagcgttacgttagaggttatcaggctcgctgctatgccaaatttctgagacggacaaaagcggccacgataatccagaagtattggcgcatgtacgtagtgcgccgccgttacaagataaggagggcagctaccatagttctgcagtcttatcttagaggcttcctggcccgcaacagataccgcaagatcctgagggagcacaaggccgtcattatacaaaaacgcgtccgaggatggctggcaagaacacattacaaaagatcaatgcacgccattatttacctgcaatgctgtttccgcaggatgatggccaagcgcgaacttaaaaaactgaaaattgaggctcggagcgtagagcgctataagaaactgcacatcgggatggaaaataagatcatgcagctacagcggaaagtcgacgaacaaaataaagactataaatgcctagtcgaaaagctcactaatctggaaggtatttacaattcagaaacagagaaactacgctccgatttagagcgtctacagcttagcgaggaggaggccaaggttgccacgggaagagtgctgtcgctccaggaggagatcgctaagctcaggaaggacctggaacaaactcgttccgaaaaaaagtgtattgaggaacacgctgatcgatacaagcaggaaaccgagcagctagtgagcaatctgaaagaagagaacacactgctgaagcaagagaaggaagcactgaatcataggattgtacagcaggcaaaggagatgacagagactatggagaagaagctggtggaagaaacaaagcagttggagctcgatctcaacgacgaaaggcttcggtaccagaatctgttgaatgagtttagcagacttgaggaacgctatgacgatttgaaagaggagatgactctgatggtgcatgtgcctaagccaggccacaaacggaccgacagtacgcactcgtccaatgaatcagaatatatcttcagttctgagatcgccgagatggaagacattccatcccggactgaagagcccagcgaaaagaaggtgcctttggacatgagtctgttccttaagttgcaaaagcgtgtgacagagctggagcaagagaagcaagtaatgcaggacgagcttgataggaaagaggaacaggtcctgcggagcaaggccaaggaagaagaacgcccccaaattaggggtgccgagctggagtatgaaagtctgaaacgccaagaattagagagcgagaataaaaaactgaaaaatgagctgaatgagctgaggaaagctctgagcgaaaaatcagcacccgaggtcacggcgcccggcgctcctgcttaccgggtgctgatggaacagctcacgtcagtttcagaggagttggacgtgaggaaggaagaggtcctgattctgcgaagccaattggttagtcaaaaggaggcgatacagccaaagaataccatgaccgactccaccatcctgttggaggatgtgcagaagatgaaggacaagggcgagatcgctcaagcatatatcggactgaaagaaacaaaccggagttctgcgctggactaccacgagcttaacgaggatggcgagttgtggctggtgtatgagggcctgaagcaggccaaccgcctgctggagagccagctccaaagccagaagcgaagtcacgaaaatgaagcagaggccttaagaggagaaatacaaagcctgaaggaggaaaataatagacaacagcagctgctggcccagaacctccaactaccgccagaagcgcgtatcgaggccagcctgcagcatgagataaccagactgaccaatgagaacctagacctcatggagcagctcgagaagcaagacaagactgtcagaaaactgaaaaagcagctcaaagtgttcgccaagaagattggcgaactcgaggtgggacagatggaaaatatttcacctgggcagataatcgacgagcccattcggcccgtaaacatcccgagaaaagagaaggactttcagggaatgctcgaatataagaaggaggatgaacagaaactggtgaaaaatttaattctcgagcttaagcccaggggcgtggccgttaacctgatcccaggcctcccagcttacatcttgttcatgtgtgtacgtcacgcagactacctaaatgatgatcagaaagttagatctttgctaacctcaacaattaacagcatcaagaaagtcctgaagaaacgaggcgacgattttgaaacagtcagtttttggctgagcaacacctgtaggtttcttcactgcttgaagcaatattcaggagaggagggatttatgaaacacaacacaagtcggcagaacgagcactgcctcaccaacttcgatctggccgagtataggcaggttttaagtgacctggcaattcagatctatcagcaattagtccgagtgctcgaaaatattcttcagcccatgatagtatcaggcatgcttgaacacgaaaccattcagggcgtctccggggtgaagcctacaggactgaggaagaggacctcaagcatagccgatgaggggacttatacactggattccatcctgcgccagctaaattcctttcattctgtcatgtgccagcatggaatggatccggagctgattaagcaagtggtcaagcagatgttttatatcattggcgctatcaccctcaacaatctgttactgcggaaagacatgtgctcctggtcgaagggcatgcagatccggtacaacgtgtcgcagttagaggaatggctgagggataagaacctgatgaattctggcgctaaggaaaccctcgagccgctcatccaagcagcgcaactccttcaagtgaagaagaagacagacgacgatgccgaggcgatttgcagcatgtgcaacgccctgaccacagctcagatcgtgaaagtcttaaatctctacactcctgtaaacgaatttgaggagcgggtcagcgtgtctttcatacggacgatccaaatgcggctccgggaccgcaaggatagtccccaattgttgatggatgctaagcacatcttccccgtcacctttccattcaatccctctagcctggccctggagaccatccagattcctgcaagtctgggactgggctttatctccagggtttag

SEQ ID NO: 125437 - DNA, 4377 bp, Artificial Sequence
  Description of Artificial Sequence: Synthetic coding sequence
atgtgtcattggttatgccataggaagctggcaacagctaccgaaacgtacattaagccaatctccaagttacaggccacgaacgctagggatgcgttggctaaacacatttatgctaagcttttcaactggattgtcgacaatgtaaatcaagcgctccacagcgccgtgaagcagcactcgtttatcggagtcctagacatctacggttttgaaacttttgagattaactcttttgaacagttctgtatcaactatgcgaatgaaaaattacagcagcagttcaatatgcatgttttcaaactggaacaggaagagtacatgaaagaacaaatcccgtggaccctgatcgacttctacgacaatcagccgtgcattaacctgattgagtccaagttaggcattttagacctccttgacgaggagtgcaaaatgccgaagggtaccgatgatacatgggcacagaagttgtacaacacccacctaaataagtgtgccctgttcgaaaaaccaagactgtccaataaggcttttatcattcaacattttgccgataaagtggaataccaatgtgaaggattccttgagaaaaacaaggatacggtctttgaggaacagatcaaagtgctgaaaagctccaaatttaagatgctgcccgaactcttccaggacgatgagaaggccatcagtcccactagtgccacatcttctggtcgcactccactcaccagaacaccagctaaacccactaaggggcggcccgggcagatggccaaagagcacaaaaagaccgttggtcatcagttcagaaacagcctgcatcttctgatggagaccttgaacgcgaccaccccccactacgtccgctgtataaaacccaacgacttcaaatttccattcacgtttgacgaaaagcgggccgttcagcagctacgcgcctgtggcgtgctagagacaattcggattagcgccgcaggatttccttcccgctggacatatcaggagtttttttcccgctatcgtgtcctaatgaaacagaaagatgtgctcagcgacagaaagcagacctgtaagaatgtgctggaaaagctgatcctggataaggacaagtatcagttcgggaaaaccaaaatctttttcagagcaggccaggtcgcctatctggagaaattgagagcggataaacttcgtgctgcgtgcattcgcatccagaagacaatccggggttggctactgcggaagaaatatcttcgcatgaggaaagcagccatcaccatgcagagatatgtgcgcggctaccaggcaagatgttacgccaagtttctgagacgtacaaaagcagcgaccataatccagaagtattggagaatgtacgttgtgagacgcagatataaaataagaagggccgcaacaattgtcctacagagctacttgcggggcttcttggcaaggaaccgctatcgaaaaattctgcgagagcataaggctgttattatccagaaacgagtgaggggatggctggcccgcactcactacaagaggtcaatgcatgccataatttatctgcagtgctgtttccgccggatgatggccaagagagagctgaaaaaattgaagattgaggctagaagtgtcgagcgctataagaagttgcacattgggatggagaacaagatcatgcaacttcaacggaaggtggatgagcagaacaaagactacaagtgcctggtcgagaagctcacaaatttagaggggatttataatagcgagaccgagaagcttaggagcgatttagagaggctgcagctgtcagaggaagaagcaaaagtggcgaccgggagagtgctgtctctgcaagaagaaatagccaagctgcgtaaggaccttgagcagacccgatcagagaaaaagtgcattgaggagcatgcagacaggtacaaacaagagaccgagcagctggttagcaatctcaaagaggagaataccttgctcaagcaagaaaaagaggctcttaatcaccgaattgtacaacaggcaaaagagatgacagagacaatggagaagaaactggtcgaagaaactaaacagctcgagcttgatttaaatgatgaacggctcaggtatcaaaatctgctgaacgagttctcaagactggaagaaaggtatgacgacttaaaggaagaaatgacacttatggtccatgtacctaagccaggccacaaaagaaccgacagcactcatagttccaacgaatctgagtatatttttagcagcgaaatcgccgaaatggaggacatcccaagtaggactgaggagccaagcgagaagaaggtccctctcgacatgtcgctcttcctgaaactccagaaaagagtgaccgaactcgagcaggaaaaacaggtaatgcaagacgaattagacagaaaggaggaacaggtgctgagatctaaggccaaggaagaagagcgcccacagatccggggagccgaacttgagtacgagtcactgaaacggcaggagttggagagtgaaaataagaagctgaaaaacgagctgaatgagctgcgaaaagcactttctgaaaaaagtgccccggaggtgaccgcaccaggcgctcctgcctatcgtgtccttatggagcagctaaccagcgtcagcgaagagttggatgtgagaaaggaggaggtccttattttgaggtcccagctggtgtctcagaaagaggccattcagcctaagctccatgagaacacaatgactgacagcactatcctgctcgaagatgttcagaagatgaaagacaagggcgagattgcccaggcatacattgggctcaaagaaactaaccgcctgctggagtcccagttgcagtcacagaaacgatctcatgagaacgaagccgaagccttgcgaggggagattcagagtctgaaggaggagaacaatcggcagcagcaactcctggcccagaacctccagctccccccagaggcccgtatagaagcaagcctgcagcatgagatcaccagactcaccaatgaaaatctagatcttatggaacagctagaaaagcaggacaagactgtccgtaaactgaaaaaacaactcaaagtcttcgctaaaaaaataggggagttagaggtgggacagatggagaatatttcaccagggcaaattatagacgagccgatcaggccagtgaacatccccagaaaagaaaaggatttccagggtatgctggaatataagaaagaggacgaacagaaactagtcaaaaacctcattctggaactcaaaccaagaggcgtggccgtgaacctgatccccggccttccggcttatatcctgtttatgtgcgtgagacacgcggactacttgaatgatgaccagaaagtcagaagtctactcacaagcacaattaatagtataaagaaggtgcttaaaaagaggggagacgatttcgaaacagtctcgttctggctgtcaaacacctgtcgctttctgcactgtctcaagcagtattctggtgaagaagggttcatgaaacacaataccagccgacagaacgagcactgtttaactaactttgacctggccgaatataggcaggtcttgagtgacctggctatccagatctatcagcagctggtgagagtcctggaaaatatcctgcagccgatgatcgtctctggtatgctggaacatgaaaccatccaaggagtgtccggagtgaaacctactggtcttcgaaaaagaacctccagcatagcagatgagggcacctacacgctcgactccatcctgagacagctgaactcattccattcagtgatgtgccagcacgggatggacccagaacttatcaaacaggttgtgaaacaaatgttctacataatcggtgcgattaccttgaataatctgttactgaggaaagatatgtgctcgtggtccaaggggatgcagattcgatataacgtgtcacagctggaagaatggttaagggataagaatctgatgaacagtggggccaaggagacattggagcccttgattcaggcggcgcaactcctgcaggtgaaaaagaaaactgacgatgacgcggaggcaatctgtagcatgtgtaacgcgctgacgacagcccaaatcgtgaaggtcctgaacctctacaccccagtgaatgagtttgaggagcgcgttagcgtatcatttatcagaacaattcagatgagactccgggatcgcaaggatagccctcagctgctcatggacgctaaacatatatttccggtgacctttcccttcaatccctcttccttggcattggagaccatccaaattccagcatcgctgggactcggattcatatcgcgcgtttag

SEQ ID NO: 125438 - DNA, 5562 bp, Artificial Sequence
  Description of Artificial Sequence: Synthetic coding sequence
atggccgcctccgagttatatacaaagtttgctcgcgtgtggatccctgatccagaggaagtctggaaatctgcggagctgctcaaagattacaaacctggcgacaaggtgctgcttctgcatctggaagagggtaaagatctggagtaccacttagaccccaaaaccaaagaactgccacacttgaggaacccagatatcctggtgggggagaacgatttgactgcgctaagttacctccacgaacccgcagtgctacataatttgagggtaagattcatcgacagtaagctcatttacacgtactgtgggattgtgctggtggcaatcaatccatatgagcagcttccgatttacggtgaggacataatcaacgcatattccggtcagaacatgggagacatggatccacacatctttgccgtggctgaagaagcctataaacagatggcccgcgatgagcgcaatcagtcgatcatcgtcagcggtgaatccggcgccggcaagaccgtgtcggccaagtatgctatgagatactttgctactgtttccggctcagctagcgaggccaatgtggaggagaaagttctggcctccaaccccatcatggagtctatcggaaatgcaaaaaccaccagaaacgacaattcttcaagattcggtaagtatatcgagataggattcgacaaaaggtacagaatcattggcgccaacatgagaacatacctgcttgaaaaatcccgagtcgtttttcaggccgaagaagagcgcaactaccacatcttttatcagctctgcgcgtcagcaaagctgcctgagttcaaaatgctcagattgggaaatgccgataactttaactacacaaagcagggcggctctccagtgattgaaggggtggatgacgctaaagaaatggcccacacacggcaggcttgcaccctgctgggcatctctgaaagtcatcagatgggtattttcaggattctggccggaatcctccatctgggcaatgttggattcacgtcacgcgatgcagatagctgtaccatacccccaaaacatgaacctctgtgcattttttgcgagctcatgggcgtggattacgaggaaatgtgtcattggctctgccacaggaaattggcgacagctaccgagacttatatcaaacctatctcaaaactgcaggccacgaatgcccgtgacgcgctcgctaagcatatttacgccaagttatttaactggattgtggataatgtgaatcaggcattacactccgccgttaaacagcactccttcatcggagtgcttgacatttatggtttcgaaacatttgaaattaacagctttgagcagttctgtattaattacgcgaacgagaaactccagcagcagtttaacatgcacgtttttaaactggaacaggaagaatacatgaaagagcagataccttggactctgatagacttttacgacaatcagccctgcattaacctgatagagagcaagctggggatcctggacctgctggacgaagaatgcaagatgcccaaaggaacagatgatacctgggctcaaaagttgtataatacacacctcaacaaatgtgctctgtttgaaaaacctaggttgagtaacaaagccttcattattcaacacttcgccgacaaggtggaataccaatgtgagggtttcctggagaagaataaggacaccgtgtttgaagagcagattaaagtgctgaaatctagcaagttcaagatgttaccagagctgttccaagacgatgaaaaggcgatcagcccaacaagtgctacgtccagcggaaggactcctttgaccagaacgcccgccaagcctacgaagggacgcccaggccaaatggctaaggagcacaaaaagaccgtgggccatcagtttcggaactcattgcatctgttgatggagacattgaacgccacgacaccccactacgttagatgcatcaaaccaaatgacttcaagttcccgttcacattcgacgagaaacgcgccgtgcagcaactgcgggcatgtggggtgctggagaccatccgaatcagcgctgccggatttccctccaggtggacctaccaagaattcttctcccggtatagggtgctgatgaaacagaaagatgtgctgagcgaccgaaaacagacctgcaagaacgtgttagagaagctgattctggacaaggataagtaccagtttggaaaaactaaaatatttttccgcgccggccaggtcgcctatctggagaagcttagagccgacaaactccgagctgcgtgtattcgtatccagaagaccattcgtgggtggctacttagaaagaagtacctgcgcatgcggaaggcagcgatcacaatgcaaaggtacgtgcgaggctaccaggcccgttgctacgctaaatttctgagacgcactaaggcagcaacaatcatacagaaatattggagaatgtatgttgttcgcagaaggtacaaaattcgccgcgctgcaacaatcgtcctgcagtcatatcttcgcgggtttctggcccggaatagatatcggaaaatactcagagagcacaaagcagtcataattcaaaagcgggtgaggggttggctcgcacgaacacattacaaaagatcaatgcacgctattatctacctccagtgttgctttcgacggatgatggctaagagagaattgaaaaagctgaagattgaggcacggagcgtggaacggtacaaaaagcttcatattggcatggaaaacaagatcatgcagctgcagcgcaaagtggacgagcaaaacaaagattataaatgcctcgtagagaaactcaccaacctggaaggtatctataactcagaaactgagaaattacgtagcgatctggaacggctgcagctctctgaggaagaagcgaaggtggccactggccgcgtcctatctctacaggaagaaatcgcgaaactccgtaaagacctagagcagacgagatctgagaagaagtgcatcgaggaacatgccgacagatacaaacaggagacagaacagctggtctccaacctcaaagaagaaaatacattgctcaaacaggaaaaggaagcactcaatcaccggatagttcagcaggccaaagagatgactgaaacaatggaaaaaaagctggtcgaggaaaccaaacagctggagctcgatctgaatgacgagcgtttaaggtaccagaatttgcttaacgagttctctaggttagaagagcgttatgacgatcttaaggaggagatgactctgatggttcatgtgcctaagccggggcacaaacgcaccgatagcacacacagttctaacgaatccgaatatattttctcgtctgagatcgcggaaatggaagatattccaagccggaccgaggagcccagtgagaaaaaggtaccactggacatgagtctctttctgaagctgcagaagcgggtgactgagctggaacaggagaagcaggtcatgcaagacgaactggatagaaaagaggagcaggtccttagatccaaggcaaaagaggaagaaaggcctcaaatccgcggggccgagctggaatatgaatcgcttaaaagacaggagctggagtctgaaaataagaaattgaagaacgagcttaatgagttaaggaaagcattgtccgaaaagagcgcacctgaagttacggccccaggcgcacctgcctacagagtcttgatggaacaactgacctcggtctcggaagagttagatgtgcggaaggaggaggtactcatcctgaggtcccaactggtgagccagaaggaagctattcaaccgaaggatgacaagaacactatgaccgattctaccatactgcttgaggatgtgcaaaagatgaaggacaaaggagagattgctcaggcttacatcggcctgaaagagacgaacaggctactggagagccaattgcagtcacagaaaagaagtcatgaaaatgaagcggaggcactgagaggagaaattcagtctctaaaggaagagaacaatcggcaacagcaattgctggctcagaacttacagctccctccggaagctcgtattgaagcttcactgcaacacgagattactcggttgactaacgaaaacttgtattttgaagagctgtacgctgatgatcctaaaaagtatcaaagctacagaatctccctgtacaaacgcatgatcgatctaatggagcagcttgagaagcaagataaaaccgtgcgaaagctgaaaaagcagcttaaggtttttgcaaaaaagatcggcgagctggaagtgggacagatggagaacatctcaccgggccagattatcgacgagcccatcagacctgtaaacattccaaggaaggaaaaagacttccagggaatgttagagtataaaaaagaggatgagcaaaaattagtgaagaacttgatcctggaattaaagcctcggggagtggcagtaaacctgattcctggtctgcccgcctatattttatttatgtgcgtgcgccacgcagactatctcaatgatgatcagaaagtgagaagtctgctcacctctacgataaactccattaaaaaggtactgaagaaaaggggtgatgatttcgaaacagtctcgttctggctttccaacacctgtagattcctgcattgcctcaaacagtacagtggcgaggaagggttcatgaagcacaacaccagtcgtcagaatgagcactgcctcacaaacttcgacctggctgaatacagacaggtccttagtgacttagccatacagatctaccagcagctcgtgagggtgcttgagaacatccttcaacctatgattgtatctggtatgctcgagcacgaaactatccagggcgtctccggcgtcaagccaacaggattacgcaaacggactagctcaatagcagacgagggaacctatactctcgattctatcctgcggcagcttaatagctttcattccgtgatgtgtcaacacggcatggatcctgagctgatcaagcaggtggttaagcagatgttttacatcattggcgctattactcttaataatctgctgctccggaaggatatgtgcagttggtctaagggaatgcagattcgctacaacgtgtcacaactggaagagtggctgagggataagaaccttatgaactctggcgccaaggagactttagaacctctaatccaagctgctcagctcctccaagtgaaaaagaagacggacgatgacgcagaggcaatctgcagcatgtgtaacgcgctaactacagctcagatagtgaaggtgttgaatttgtacacaccagtcaatgaatttgaggagcgggtcagcgtgtccttcatacgcaccattcagatgcgactgcgcgatcgtaaagatagccctcagctacttatggatgctaagcacattttccctgtcacttttccgttcaatccatccagtctcgcacttgagacaattcagatccccgcttctctcggcctgggttttatcagtcgggtctag

SEQ ID NO: 125439 - DNA, 5547 bp, Artificial Sequence
  Description of Artificial Sequence: Synthetic coding sequence
atgtctgtcggggagctttactcccaatgcacccgtgtctggattcctgatccggacgaagtctggaggtcagcagagctgaccaaagactataaagaaggcgataagagcctgcagctgaggttggaggatgagaccatcctggaatatcctattgacgtgcagcgtaaccagctgccgtttctgcgaaatccagacatcctagtgggcgagaacgatttgaccgccctatcatatcttcacgagccagcggtgttgcataacctcaaggtgagattcctcgaatcaaaccacatctacacctactgcggaattgtgttggtggccatcaacccttatgagcagctgcccatatacggccaggacgtgatctatacgtattcaggtcagaatatgggtgatatggatccccatatatttgccgtggccgaggaagcatacaagcagatggcccgggacgagaagaaccagtccatcatcgtctctggagaatctggtgctggcaaaacagtatctgccaaatatgctatgcggtatttcgccaccgtcgggggatcggcatccgagactaatattgaagaaaaagtgctcgctagttcgccaattatggaggctatcggaaatgctaaaaccacccgtaacgacaatagcagccggttcggaaaatacattcagatcgggttcgacaagcggtatcacattatcggggccaatatgagaacctacctccttgagaagtcccgcgtagtctttcaggcagacgacgaacggaattatcatattttctaccagttatgcgctgccgctggactgccggagttcaaggaactcgcacttacttctgccgaggatttcttctacacatcccaaggaggcgatacctctatagagggggtcgatgacgccgaggattttgagaaaacaaggcaggccttcactctgttaggagtcaaggaatctcatcagatgtctatatttaagatcatcgcaagcattttacacctgggaagcgttgcaatacaggctgagcgagatggggacagctgttcaatcagcccacaggatgtctatctctccaacttctgcaggctgctgggcgtcgaacactcgcagatggagcactggctgtgtcacaggaagctcgtcaccacatccgaaacttacgttaagactatgtctctgcaacaggtgattaatgcccgaaacgcgctggcgaagcacatatatgcacaactattcggatggatcgtcgaacatattaacaaggcactgcatactagcctaaagcagcactcatttatcggcgtgctggacatttacggattcgaaacatttgaggttaatagctttgagcagttttgtattaactacgctaatgaaaaactgcagcagcaatttaatagtcacgtgtttaagctggagcaggaagagtacatgaaggagcagataccctggactctaattgatttctatgataaccagccttgcatcgatcttatcgaagctaaactgggaatattggatctcctcgacgaggagtgcaaggtgcccaagggtaccgaccagaactgggcccaaaagctctacgataggcattctagcagccaacactttcagaagcctcgcatgtccaacaccgcctttattatcgtgcatttcgccgacaaggtggaatacttaagcgatgggtttctagagaagaatcgcgatacagtgtacgaggagcagattaatattttaaaggcctcaaagtttcctctagtagcagacctctttcatgacgataaggatcctgtgcccgccaccactcctgggaaaggcagcagcagcaagatctctgtcagaagcgctcggccacctatgaaggtcagtaacaaggagcacaaaaagaccgttggtcaccagttccggacctctttgcatcttttgatggagactctcaacgccactacaccccattatgtgagatgcatcaagccaaatgacgagaagttaccttttcactttgaccctaaacgtgcagtgcagcagttgcgcgcatgcggagtgctagagaccatccgtatatccgccgccggctatcccagccggtgggcttaccatgacttttttaaccggtaccgcgtgcttgtgaagaagcgtgaactcgccaacacagataagaaagccatctgtagatctgtcctggagaacttaatcaaagacccggataaatttcagttcgggcggacaaagatcttttttcgagcagggcaggtggcctatcttgagaaactgcgggctgacaaatttcgcacagccactattatgattcaaaagacggtccgaggctggcttcaaaaagtgaagtaccatcggctcaagggagctactctcaccctgcagcgatactgccgtgggcacttggccaggcgattagccgaacacttgaggcggatccgcgccgccgtagttctgcagaagcattaccggatgcagagggcccggcaggcctaccagcgcgtgcgaagggccgccgtggttatccaggcatttactagggccatgttcgtcaggcgaacataccggcaagtcctcatggaacacaaggccacgacgatccagaaacacgtgcgcgggtggatggctcgccgccatttccagcggctgagggacgccgccatcgtcattcagtgtgccttccgcatgctgaaagccaggcgggagctgaaggcgctaaggattgaagctagatcggccgagcacctcaagcgccttaatgtgggaatggagaacaaggtggtccagctccagcgaaagattgatgaacagaacaaggaatttaagactctctcagagcaattgagtgttaccactagtacatacacgatggaagttgagcgactgaagaaggaattggttcactatcaacagtcccctggagaagacacctccctgaggctccaggaggaggtcgaatctttgcgcacggagctccaacgagctcactctgaacgtaagattctggaagacgcccattcgcgcgagaaagacgagctaaggaaacgcgtggccgatctggaacaagagaatgccctgctgaaggacgagaaagagcaactgaacaaccagatactgtgccagtccaaggatgaattcgcccagaacagcgtgaaagaaaatctcatgaaaaaagagctggaagaagagcgaagcaggtaccagaatctggtgaaagaatattcccagctcgagcagagatatgacaatcttcgggacgagatgacaattataaagcagaccccaggacatagaagaaaccccagtaaccaaagctcgctggagagcgacagcaattacccaagcattagcacatccgaaataggtgacacagaagacgccctgcagcaggtcgaggagatcgggctggagaaagcagccatggacatgaccgtgtttctgaagttgcagaagcgggtccgcgaattagagcaagaacgcaaaaaactgcaggtgcagctcgagaaacgtgaacaacaagactccaaaaaagtgcaggcagagccgccccagaccgacatagatctagaccccaatgccgatctagcctacaacagtctgaagaggcaggagcttgagtcagagaataagaagctgaaaaacgatttaaacgagctccggaaagccgtggcagaccaggctacccagaacaacagtagccacggctcacccgatagttacagcctgcttctcaatcagttaaagttagctcacgaggagctggaagttcgtaaagaagaagtgctcattctgagaacacagatcgtgtctgctgaccagcggaggcttgccggtcggaacgccgagccgaatattaacgctcgatcctcttggcctaattctgaaaagcacgtcgaccaggaggacgctatcgaggcttatcacggtgtgtgccaaacaaactccaagacggaggactgggggtatctcaatgaagatggagagctgggcctcgcttatcaaggtcttaagcaagttgcaaggctgctggaggcacaactgcaggcacaaagccttgagcacgaggaggaggtcgaacatctgaaggctcagctcgaggctttgaaagaagagatggacaagcaacaacaaactttctgtcagacactgctgctcagtcccgaggcccaggtagagtttggagtccagcaggagatcagcagactgactaatgagaatctcgacctcaaggaactggtcgaaaagttggagaaaaatgagaggaaattaaagaaacaacttaagatctatatgaagaaagcccaggacctggaggctgcccaggcattggcccaaagtgagcgcaagcggcatgaactgaatagacaggtgacggtgcagagaaaagaaaaagactttcaaggcatgctggagtaccataaagaagatgaagcccttctgatacgtaacctcgttaccgatctcaagccacagatgctgtctggcaccgttccatgcttgcccgcatatatcctctatatgtgtattaggcacgctgattatactaacgatgacttaaaggtacactcgcttctgacatcaacaattaacgggattaagaaggtactgaagaagcataatgacgacttcgagatgacctcattctggttgagcaatacctgcagactgctccactgcttgaagcagtacagtggcgacgaaggctttatgactcagaacacagccaagcagaacgaacactgtcttaaaaacttcgatctcacggaataccggcaggtgctgtcagatctgagcatccagatctatcagcaattgattaagatcgctgaaggtgtgctccagcccatgattgtctcagccatgctagaaaacgaaagcatccaggggttgtctggtgtgaagcctacagggtatcggaaaagatcttcaagcatggctgacggtgacaattcttattgtttggaagcaattattaggcagatgaacgctttccataccgtgatgtgcgaccagggattagaccctgaaataattctacaggtgtttaaacagctgttctatatgattaacgctgtgacactcaataacctcctgctgagaaaggatgtgtgctcttggtcaacgggaatgcagctaaggtataatatctcacagctggaagagtggttaagggggagaaacctccaccagtctggtgccgtgcagactatggagcctcttatccaggccgctcagcttctacagctcaagaaaaagactcaagaggacgctgaggcgatctgctcactgtgtacctcattaagtacccagcaaattgtgaagattctcaacctgtacaccccgctcaacgaattcgaggagagggttaccgtcgcatttatccgaacaatccaggctcagctccaggaaaggaacgaccctcagcagctgcttctcgatgcaaagcatatgttccctgttttgtttcccttcaacccttccagcctgaccatggactccatccacatccctgcatgcttgaacctcgaatttctgaacgaagtctag

SEQ ID NO: 125440 - DNA, 2892 bp, Artificial Sequence
  Description of Artificial Sequence: Synthetic coding sequence
atggaacacaaggcaaccaccattcagaagcacgtgcgcggatggatggccagacggcatttccaacggctcagggacgcagcaatagtcattcagtgtgcgtttaggatgttgaaagctcgacgggagctcaaagccttgagaatcgaagccagaagcgcagagcacctaaagcggttgaacgtaggcatggagaacaaggtggtgcagctgcaacgaaagatcgacgagcagaacaaagagttcaaaactctctctgagcagctgagtgtgacaacatcaacctataccatggaggtggagagactaaaaaaggagctcgtgcactaccaacagtctcccggggaagataccagcctgaggcttcaagaggaggttgaatccctaagaacagagctgcagcgcgcccatagcgaacggaagattctggaagacgcccacagtagggagaaagatgaattgcggaaacgcgtggccgaccttgaacaagaaaacgctctactgaaggatgaaaaagagcagctgaacaaccagatactttgccagagcaaagacgaatttgcgcagaattcagtgaaagagaacctcatgaagaaggaattggaggaagagaggagccgataccagaatctggtgaaagagtacagtcagctggagcaaaggtacgacaacctacgtgacgaaatgaccatcatcaaacagactcccggccatcgccgtaacccctcaaatcagtctagtttggagagcgactccaactatccttctattagcacaagcgaaattggagatacagaggacgccctgcagcaggtcgaggagatcgggcttgagaaggcagccatggacatgaccgtgttcttaaagttgcaaaagcgagtacgggagcttgagcaggagcgcaagaagcttcaggtccagctcgagaagcgagaacagcaagattcaaagaaagtgcaggcagagccaccccagactgacatcgatctggatccaaatgcagatctcgcttacaacagcttaaagcgacaggagctagagagtgagaacaaaaagctgaagaacgatcttaacgaactgaggaaggcggtagccgatcaggcaacccaaaacaactcaagccacgggtcacctgactcgtacagtttgttactgaaccagctcaaactagcgcacgaggagcttgaagtgcggaaggaggaggtgctgatcctgcgtacacagattgtatccgccgaccaacgtcgactcgccggccgcaatgccgaacccaatatcaatgcccggtcttcttggcccaactccgaaaaacacgttgaccaggaggacgcgattgaggcttaccatggagtgtgccaaacaaacagactccttgaagcgcagctgcaggctcagtctctggaacatgaagaagaggtcgagcatcttaaagcgcagctcgaagctctgaaggaagagatggacaaacagcagcagactttctgccagactcttctgctgtctccggaagctcaagttgagttcggcgtccagcaggagattagtcggttaaccaatgaaaatttggatctaaaagaacttgtggagaagctggagaaaaacgagcggaagctcaagaagcagctgaagatttacatgaaaaaggcccaggacctggaggccgcccaggctttagcccagtctgaaagaaaacgccacgaactgaacagacaagtgacggtccagcggaaagagaaggattttcagggaatgttggaataccacaaggaggacgaagcactcttaattcgaaatttggtgactgatttgaagccccagatgctctccggaactgtgccctgcctgccggcgtacatcctctatatgtgcatcaggcacgctgactacaccaacgatgacctgaaagtgcatagcttactgacctcaaccatcaatggaatcaagaaggtgctgaaaaagcacaatgatgatttcgaaatgacatcattttggttgtccaacacctgtcgcctactacattgtttgaagcagtactctggcgacgaaggcttcatgacccaaaatacagccaagcagaacgagcattgcttaaaaaacttcgacctgacagagtatcgacaggtgcttagcgacctgagtatccagatttaccagcagttgatcaagatagcggagggggtattacagcccatgatcgtgagtgcaatgctcgaaaatgagagtatccagggcctaagcggcgtgaagccaaccggatatcgtaaaagatccagttctatggccgatggggataattcttattgcttggaagctatcatcaggcagatgaatgcttttcatactgtgatgtgcgatcagggactggatccggagatcatcctccaggtgtttaagcagctgttctacatgattaacgcagtcactctcaataaccttctcctcaggaaggacgtctgttcatggagcacaggcatgcagctacggtataacatctcacagcttgaggagtggcttcgcggaaggaacttgcaccaaagcggtgctgttcagacaatggagcccttgattcaagcggcacaactgctgcaactgaaaaaaaaaacacaggaagatgctgaagctatctgctcactctgcacctctctcagcacgcagcagattgtgaagatactgaacctgtacacccccctcaatgagtttgaagagcgcgtgacggtggcgttcatccgaacaatccaagcgcagttgcaagaaaggaatgacccacagcaactgttgctggacgctaagcacatgttccccgtgttgtttccctttaatccctccagcctgaccatggactctatccacatccctgcctgcttaaatctggaatttctgaatgaagtctag

SEQ ID NO: 125441 - DNA, 2163 bp, Artificial Sequence
  Description of Artificial Sequence: Synthetic coding sequence
atgcactggcccgtgacccgggagtgcacacgcgtgtggataccagatccagacgaggtgtggaggtctgccgaactaaccaaggactataaagagggcgacaagtcgctacagttgcggttggaggatgagactatcttagagtatccaattgacgtgcagcgaaaccaactgcccttccttagaaatcccgatattctcgtgggggagaacgacctcaccgccctttcgtatttacacgagcctgccgtgcttcataatctgaaagtgcgatttctcgaatctaatcacatttacacatattgcgggatcgttctggtggccattaatccttacgaacagttgcccatttatggccaggacgttatctacacgtactctggtcaaaatatgggcgacatggacccacacatcttcgctgtggccgaggaggcttacaagcagatggcccgtgacgagaagaaccaatccatcatcgtaagcggggaaagtggagccgggaagaccgtttccgcaaagtacgcaatgcgttacttcgctacggtgggcggttctgcgtctgagactaatatcgaagaaaaggtacttgcctcctcacccataatggaggccatcggtaatgccaagactaccaggaatgacaattcctctaggttcggaaagtatatccagatcggtttcgacaaaagatatcatatcatcggagcaaacatgagaacgtatttgctggagaagtcccgcgttgtgtttcaggccgacgacgagcgtaattaccacatcttttatcagctgtgcgcagctgccggactccccgagtttaaggagctggctctaacttccgctgaggactttttctatactagccagggcggcgatacgtcgatcgagggagtggacgacgcagaggactttgagaaaacgagacaggcgtttactctcctgggagtgaaggaatctcaccagatgtccatctttaagatcatcgcgtccatcctgcacctcggtagcgttgcaatacaggccgaacgggatggggattcatgttccatatctccccaggacgtgtacctatcaaacttctgccggctgttaggcgtggagcacagccaaatggaacattggctgtgtcaccgaaaactggtgacgaccagtgaaacatacgttaaaaccatgagtctgcaacaagtgatcaacgcgagaaacgcgcttgccaaacatatctatgcacagttgttcggttggatagtcgaacatattaataaagcactccacacatctctgaagcagcatagcttcatcggagtgctcgacatctatggcttcgaaactttcgaggtgaactcctttgagcaattttgtattaattacgccaatgagaagttacagcagcagttcaacagccatgtctttaagctcgagcaggaagaatacatgaaagaacaaatcccctggaccttgatcgatttctacgataaccagccttgtattgacctgatcgaggcaaagctgggcatccttgacctcttggacgaggaatgcaaagtgcccaaggggaccgaccagaattgggcacaaaaactgtacgaccgtcactcgtcgagtcagcacttccagaaacccagaatgagcaacacagcgttcatcattgtccattttgctgacaaagtggagtacttaagtgacggctttttggagaaaaatcgggacactgtgtacgaggaacagattaacatacttaaggcttcaaaatttccactggttgctgacttgttccatgacgacaaagatccagttcccgccacaacccccggcaagggatcatcctctaagatttcagttaggtcagccaggcctcctatgaaggtgagcaacaaggagcacaagaagactgtgggccaccagttccgaacctctcttagtactcagcagatcgtgaaaattctcaacctgtataccccactgaatgagtttgaggaacgagtgaccgtggcatttatccggaccattcaggctcaattgcaggagcgtaacgatcctcaacagctcctgttagacgccaaacacatgttccctgtcctctttcctttcaacccttcttcattgacgatggactccatccacatccctgcctgcttgaatctggaattcctcaacgaggtctag

SEQ ID NO: 125442 - DNA, 5229 bp, Artificial Sequence
  Description of Artificial Sequence: Synthetic coding sequence
atggccgttgcagagttgtatactcagtataatagggtctggattccagaccccgaggaagtttggaaatctgccgaaatcgcaaaagactacagggtgggggacaaggtcctgcggttgctgctggaagacgggacagaattggattactcagtgaatccagaatccctgccgccactcagaaatcctgacatcctcgtgggcgagaatgatctaacagccctttcttaccttcacgagcctgctgtactgcacaacctgcgaattcggtttgcagagagtaaactgatttacacctacagtggcatcattctggtggccatgaatccctacaaacaactgccaatatacggggacgccatcatccatgcctactccggtcagaatatgggcgacatggaccctcatattttcgctgtggctgaagaagcctacaagcagatggccagaaacaatcggaaccagtccattatcgtctctggcgagtccggcgctggaaagaccgtctctgcccggtatgcgatgcggtactttgccactgtgtccaaaagcggctcaaatgcccatgtagaagacaaggtcctggccagtaatccaatcaccgaggccgtcggtaacgccaagaccactcggaacgacaatagctcacgattcgggaaatatacagagatttctttcgacgaacagaaccaaatcattggggctaacatgagcacctatctgttagaaaaatcacgggtggtgttccagtccgagaacgaacgtaattaccacatcttctaccagctttgtgcatccgcacagcaatcagaattcaagcatcttaagctgggcagcgcggaagaatttaactacacacgcatgggaggcaacacagtgatcgagggtgtaaacgaccgtgccgagatggtggagacacaaaagacattcacgctgctaggatttaaagaagatttccagatggatgtctttaaaattttagccgccattctgcacctggggaatgtccaaatcactgcagtgggcaacgagcgctcctcggtcagcgaggatgacagtcacctgaaggtgttctgcgagttgcttggattggaaagcgggagagtagcacagtggttgtgcaatagaaagatagtgacatcaagtgagaccgtagtgaagcccatgactaggccccaggccgtgaatgctcgggatgcactcgctaaaaaaatatacgctcacctcttcgactttatcgttgaaagaattaatcaggctcttcaatttagcggaaagcagcacaccttcataggggtgctggacatctatggttttgaaacatttgatgtgaactctttcgaacagttctgtatcaattatgccaacgagaaactgcagcagcagttcaacatgcacgtttttaagcttgagcaggaagaatacatgaaggaggacatcccctggacgctcattgatttctacgataaccagcctgttatcgatctgatcgaggctaagatgggaattctggagcttctggacgaggaatgtctcctccctcacgggaccgatgaaaactggttgcaaaaattgtacaataatttcgtgaatcgaaacccattgtttgagaagccgaggatgagcaacacatccttcgtcatacagcacttcgccgataaggttgagtacaagtgcgaaggtttccttgaaaagaatagagacactgtttacgatatgttggtggagattcttagggcctccaagttccatctgtgtgctaatttcttccaggaaaaccctacccctccctccccatttggcagtatgatcacagtgaagagcgctaagcaggttattaagcccaacagtaaacacttcaggactactgtagggtccaagtttcgcagttccttatacctcctgatggaaactctgaatgcaactaccccccattatgttcggtgcatcaaacctaatgatgagaaattgccttttgagtttgacagcaagcgaatcgtgcaacagctccgcgcctgtggggtactcgaaactatccgtatctccgctcaaagctatccaagccgctggacgtatatcgagttttactctcgatacggcattcttatgactaaacaagagttgtcgtttagcgataagaaagaagtgtgcaaagtggttctgcatcgcctgattcaggattcgaatcaatatcagttcggaaaaactaagattttctttagagccggacaggtcgcctatcttgaaaaattgaggctggataaattgcgccagagttgcgtcatggtgcagaaacatatgagaggatggttacagcgcaaaaagttcctgagagaacgaagggcggctctgattattcagcagtactttcggggacaacagacggtgagaaaagctattaccgcagtggctctcaaagaggcttgggcagccattattatccagaagcactgccgcggatacctcgtccgctcactttaccagctgatcagaatggcaacgattaccatgcaggcctattcccgcggctttctggcccgaaggcgatatcgcaagatgctggaagaacataaggctgttattcttcagaaatatgcacgggcctggctggcgcgtagaagattccagagtattcgccgctttgtgcttaatattcagctcacatacagggtccagcgactgcagaaaaaactcgaagatcagaataaggagaatcacggcttggttgagaaactaaccagccttgccgcactccgagccggggacgtcgaaaagatccagaagctggaggcagagctcgagaaggcggccacccacagaaggaactatgaggaaaaaggcaagcgctaccgagacgccgttgaagaaaagcttgccaaactccagaaacacaacagcgagctagagacgcagaaagagcagatccagctaaagctgcaagaaaagacagaagaactaaaggaaaaaatggataacctgacgaagcagctctttgatgatgtgcagaaggaagagcgccagcggatgttattggagaaaagcttcgaactgaaaacacaagactacgagaaacagatccaatcactgaaggaggaaataaaggcgctgaaggacgaaaagatgcagttacaacacctggttgagggagaacatgtgactagtgacggccttaaggccgaagtagctagactcagtaaacaggtcaagaccatatctgagtttgagaaagaaatcgagctcctgcaggctcagaagatcgatgtcgagaaacacgtgcagtcacagaaacgggaaatgcgagagaagatgagcgaaataacaaaacagcttttggaatcctatgacattgaggacgtgaggtctagactctcggtggaggaccttgagcacctgaatgaggatggggaattatggttcgcttacgaaggactgaaaaaagcaactagagtccttgaatcccatttccagtcacagaaggactgttatgagaaggaaatcgaagcactcaacttcaaggtggtacatctcagtcaggagatcaaccacctccagaagctgttcagagaagagaacgatatcaatgagtctattcggcatgaggttacacgactgacatccgaaaatatgatgatccccgacttcaagcagcagatcagtgagctggagaagcagaagcaggatttggagataaggctgaatgagcaggcagagaagatgaagggaaaacttgaagagctgtccaatcaactgcacaggtcccaagaagaagagggcacccagcgaaaggccctggaagcgcagaatgaaattcacacaaaggaaaaggagaaattaattgacaagatccaggagatgcaggaggccagcgatcatcttaagaaacaatttgagaccgagagtgaggttaagtgtaactttaggcaggaagcctcacgtttgacactggaaaacagggatctagaggaggagttggacatgaaggacagggtgattaagaaactgcaggaccaggtgaaaaccctatcaaagacgatcggcaaagcgaacgacgtgcattcgtcctccgggccaaaggaatacctcggcatgcttcaatacaagagagaggacgaagccaaactcatccaaaatctcatcctagatcttaagccccgcggggttgtggttaatatgatacctggcttacctgctcatattttatttatgtgcgtcagatacgccgatagcttaaacgatgccaacatgttaaaatccctcatgaactccacgatcaacggtatcaaacaggtggtgaaagaacatctggaagattttgagatgcttagtttctggttaagcaacacatgtcacttcttgaactgtctgaagcagtactccggggaagaggaattcatgaaacacaattcacctcaacagaacaagaactgcctgaataacttcgacctgagcgaataccgccagattttgtcagatgtcgccatcagaatttaccaccaatttattataatcatggaaaagaacatccagcccattatcgtgcccggtatgctggagtatgagagcctgcaaggaatttccgggctgaaacccaccggctttcgcaagcgcagttcctccatcgatgacaccgacggctatactatgaccagtgtcctgcagcaactgtcctatttttacaccactatgtgtcagaacggcctcgatcccgaactcgtgaggcaggccgtgaaacagttattttttctcattggcgctgtgaccctgaactccctgttccttaggaaggatatgtgctcttgtcgaaaaggcatgcagatccggtgtaacatctcatacctggaggaatggctcaaagataagaacctgcagaattccttagccaaagagacattggagcctttgtcacaggcggcatggttgttgcaggtgaaaaaaaccacagatagtgatgccaaggagatatatgaacggtgtaccagcttgtctgcagttcagatcataaaaattctgaacagctatacgcccatcgatgacttcgagaagcgagtgacccccagcttcgtgcgcaaggtacaagccctgttaaattcacgggaagacagctcccagctaatgctagacacaaaatacttgttccaggtgacattccctttcaccccttctcctcacgcgttagagatgatccagatcccttccagctttaaactgggattcctgaatcgactctag

SEQ ID NO: 125443 - DNA, 1122 bp, Artificial Sequence
  Description of Artificial Sequence: Synthetic coding sequence
atgcccagtagcacacctactgcagggagaacatgggcaatttggactcacacctatctcccctggcagaaaaggcacacctctcggtggcctgacgggaagagtgaagcccaggacctggacctgctgacgctgtatctgaacttgtactgtataactcctgcagccgccccagagctcccacctctatacgtgttcgtgtgcgagttagacagtcagcgcgctcctatccctgggtctgatgcctacaatgaaggagccgggggcgcctacatgcgcaacaatcgcaatcaatctatcattgtatccggggaaagtggcgcaggaaaaacagtgtcggcgcggtatgccatgcgctactttgccaccgtcagcaagagcggcagcaacgctcatgtggaggataaggtgcttgcatctaatcctataacggaggctgttggaaatgctaaaacaaccaggaacgacaacagctcaaggtttgggaaatatactgaaatctcctttgatgagcaaaatcagatcattggagcgaatatgtccacctacctcttggagaagagccgcgtggtgttccagtcagagaatgagcgaaattatcacatattctaccagctatgtgcctctgcacagcaaagtgagtttaaacatttgaaactgggaagtgctgaagaatttaactatacgcggatggggggcaacaccgtgatagaaggcgtaaatgacagggccgagatggtggaaactcagaaaactttcacattactggggtttaaggaagactttcaaatggatgtgtttaagattctcgccgccatcctgcacctggggaatgtacaaatcactgcggtggggaacgaacggtcttctgtgagtgaggacgatagccaccttaaggtattctgcgagctcctcggactcgagagtgggcgcgtggcccagtggctgtgtaacagaaagatcgtaacttcctctgaaacagtggtgaagcccatgacacgtccccaggctgtgaacgctagagacgctttggccaagaaaatttatgcacacctgtttgacttcatcgtcgaaaggatcaatcaggccctgcagttctcagttcttaaacctctgatgtag

SEQ ID NO: 125444 - DNA, 321 bp, Artificial Sequence
  Description of Artificial Sequence: Synthetic coding sequence
atgaatccctataaacagctgccaatttatggcgacgcgataattcatgcttactccgggcagaacatgggagacatggacccacatatcttcgcggttgctgaagaggcttataagcaaatggcaagaaacaatcggaaccagtccatcatcgtgagcggcgagtccggggcaggcaagacagtctccgcgaggtacgccatgcgctacttcgcaactgttagcaagtccggatctaatgcccatgttgaggataaggtgttagctagcaacccaatcaccgaagccgtgggcaatgctaaaacaactagaaacgactag

SEQ ID NO: 125445 - DNA, 1293 bp, Artificial Sequence
  Description of Artificial Sequence: Synthetic coding sequence
atggcggtggccgagctgtacactcagtacaacagggtctggattcctgacccagaggaggtgtggaagtccgcggagatcgctaaagattacagagtcggtgataaggttctgcggctcctgctggaagatggtaccgaactcgactactccgtcaacccagagagtcttcctccacttcggaaccctgatatactggttggcgagaacgaccttacagcgctctcttaccttcacgaacccgccgtgcttcataacctaagaatacgattcgctgagagcaaactcatttacacctactctggcattattctcgtcgctatgaacccgtataagcagctccctatttatggtgatgctatcattcacgcgtacagcggtcagaatatgggagatatggatcctcacattttcgcagttgcagaagaagcatataaacaaatggcgaggaataacagaaaccagtcgattatcgtgtctggggagagtggcgctgggaaaactgtatccgcccgctatgcgatgcgatactttgccactgtgagcaaaagcggcagcaacgcccatgtcgaggataaggtgctggcttcaaatcccatcacggaggccgtgggcaacgcaaagactactcgcaatgacaacagctcccgatttgggaagtatactgaaataagctttgacgagcagaaccagatcattggcgccaatatgtctacttacttgctcgaaaaaagccgcgtggtgttccagtccgagaacgaacgtaactatcacatcttctaccagctgtgcgcctctgcccagcagtctgagtttaagcacctgaaactaggcagtgctgaggaattcaattacacccggatgggcgggaataccgtgatcgagggcgtgaatgacagggcagagatggtggaaacacagaagacctttaccctgctgggttttaaggaggacttccagatggacgttttcaaaattctagccgcgatcttgcacctaggaaatgtgcagataaccgccgtgggaaatgagaggtcctcggtctcagaagatgactctcatctgaaagtcttctgtgagctcctcggcctcgagtctggccgagtcgcccagtggttatgtaacagaaaaattgtgaccagtagtgaaacagttgtgaagcccatgacacgcccccaggctgtgaacgcccgggatgcgctggccaaaaagatctatgctcatctgttcgatttcatcgtggagcgaattaatcaggctttgcagtttagtgtgctaaagcctttgatgtag

SEQ ID NO: 125446 - DNA, 810 bp, Artificial Sequence
  Description of Artificial Sequence: Synthetic coding sequence
atggctgttgccgagctgtacacacaatataatcgggtgtggattcccgaccccgaggaagtctggaaaagtgccgagattgctaaggattaccgggtgggtgataaagtactaaggctacttctagaagatggaacagaacttgattactcagttaatcccgagtctctgccccctctccgaaacccagacatactggtgggagagaatgacctgaccgcgttaagctaccttcatgagccagctgtgcttcacaacctgcgcattaggtttgccgaatccaagctgatttacacttattccggtatcatactggtagccatgaatccctacaaacagttacccatctatggcgatgccatcatccatgcatacagcggacaaaacatgggtgatatggatcctcatattttcgccgttgctgaggaagcttacaagcaaatggcccgaaacaatcgcaatcagtccattattgttagtggcgagtccggagccggtaaaacggtgtccgcccggtatgcaatgagatacttcgccacggtgtccaagtcaggctctaacgcccatgtggaggataaggttttagcatccaaccctatcaccgaggccgttgggaatgccaaaactacgagaaacgacaatagcagtcgatttgggaaatacacagagatttcatttgacgaacagaatcaaattattggagctaacatgtccacctacctactcgaaaagagccgcgtcgtttttcagggtgtcccaaagaacttgattattcaggaatgggaggcaattttgagtctaagagtttag

SEQ ID NO: 125447 - DNA, 3762 bp, Artificial Sequence
  Description of Artificial Sequence: Synthetic coding sequence
atggaggacggaaagccagtgtgggcccctcaccccacggatgggtttcagatggggaatatcgtggacattggacctgattcactgacaatcgagcccctgaaccagaaagggaagacttttctcgctttaatcaatcaggttttcccggcagaagaggattccaagaaggacgtagaggataattgtagcctgatgtatctgaatgaagccacactgctccataacatcaaggtgcgttattcgaaggaccgcatatatacatacgtggctaatatcctgatcgctgttaacccttatttcgatatccccaagatttattcctccgaagcaattaaatcctaccagggcaagtcgctggggaccaggccccctcacgtgttcgccatcgctgataaagcgttcagggatatgaaagtgttgaagatgagccaaagcatcatcgtgagtggggaatcaggggctggcaagactgaaaatacgaaatttgtgctgaggtatttaacggagagctacggtacaggacaggacatcgacgacagaattgtggaagcgaatcccttacttgaggcgtttgggaacgccaagaccgtcaggaacaacaacagtagcagatttggaaaattcgtggaaatccacttcaacgagaaaagtagcgtggtgggcggatttgtgagtcactacctgttggagaaaagtcgaatctgtgttcagggaaaggaagagcggaattaccacattttctaccgcctgtgtgctggcgccagcgaggacattcgtgaaaaattgcacctgagtagccccgacaacttccgttacttgaatcggggctgcacacgatactttgctaacaaggaaacagacaagcaaattctccaaaatcggaagagcccggagtatctgaaggccggctccatgaaggatccgctgttggacgaccatggcgattttatccggatgtgtactgctatgaaaaagatcggactcgatgacgaggagaagctggacctgttcagggtagtcgccggcgtgctgcatcttggcaatattgacttcgaggaagctggcagcacctctggggggtgtaacctgaaaaacaagtctgcccaatctctggagtactgtgctgaactcctgggactcgaccaggacgacctgagggtgagtctgaccactcgtgttatgttgaccactgccggagggaccaaggggacagtaattaaagttcctctcaaagtggagcaggccaacaacgcgcgagacgctttagctaagaccgtgtactcccaccttttcgaccacgtcgtcaacagagtcaatcagtgttttccgtttgagacaagtagttacttcatcggcgttctcgacatcgcaggcttcgaatatttcgaacacaattctttcgaacagttctgtataaactattgtaacgaaaaactccagcagttctttaacgaaaggatactcaaggaggaacaggaactgtatcagaaagagggcctcggcgtgaacgaagttcattacgtggataatcaggattgtattgacctgatcgaagcgaagttagtagggatcctagatatcctggatgaagagaacaggctaccccaacccagtgatcagcactttactagcgccgtgcatcagaaacataaggaccacttcagactgaccatcccacgtaagtcaaagcttgccgtgcaccgcaatataagggatgacgagggattcatcatacgccacttcgcaggcgctgtgtgttacgaaactacgcagttcgtcgagaagaacaacgatgcgcttcatatgagcttggagtctctgatctgcgaatcgcgggacaaattcatcagagagctgttcgagtcctccaccaacaacaacaaagacaccaagcagaaggcgggcaagcttagctttatctcggtggggaataagttcaaaacccagttgaaccttctcctggacaagttgcgatctactggagcatccttcatcagatgcattaagcccaacctgaaaatgacgagtcaccactttgaaggagcccagattttgtcccagctgcagtgcagtggaatggtttcagtgctggatctgatgcaaggcgggtacccatccagggcgtccttccatgagctctacaatatgtacaagaaatacatgcccgataaactcgcgcgtttagaccctaggctgttttgcaaggcgctcttcaaagccttgggcttaaatgagaacgattataagttcggccttaccaaagtttttttccggccaggcaagttcgcagaatttgaccaaattatgaagagcgacccagaccatctggcagagcttgtgaagagggtcaatcattggttgacatgtagccgatggaaaaaagtgcagtggtgcagtctgagtgtcattaaactgaagaacaagataaagtacagagcagaagcttgtataaaaatgcagaaaaccattcgtatgtggctctgcaagagaagacataagcctcgaatcgacgggctggtgaaagtgggcacgctcaagaagcggctcgacaagttcaatgaggtcgttagcgttctgaaggacggcaagcccgagatgaataagcaaattaagaatctcgagatttccatcgatacattgatggccaaaattaagtcgaccatgatgacccaggagcagattcagaaggagtatgacgcactggtgaagtcgtcggaagaattactatccgctctgcaaaagaagaaacagcaggaggaagaggccgaacgcctgcgcagaatccaagaggagatggaaaaggagaggaagcgcagggaagaggatgaaaaacgccggcggaaggaggaggaggagcggcgcatgaaactagaaatggaagctaaacgaaaacaggaagaggaagagaggaaaaaacgtgaagacgacgaaaaaaggattcaggccgaagtggaggcccagctggcacgccaaaaagaagaggaaagccaacagcaagccgttctcgagcaagagcgaagagaccgcgagcttgctcttcggatcgctcagtccgaggccgagctgatcagtgacgaggcgcaggccgacctcgcactccgtcgtggcccagcagtgctggcaaccaaggccgctgccggcactaagaagtatgacctgagcaaatggaaatacgctgagctgagagacacaataaacacctcctgtgacatcgaactgctggctgcgtgtcgggaagagttccaccggagacttaaggtgtatcacgcctggaagtccaagaacaagaagaggaacacagagaccgagcagagagccccaaagagtgtcactgattacgcccagcagaatcccgctgctcagatccctgcacggcagcgagagattgaaatgaatagacagcaacggttttttcggattcctttcattaggcctgccgaccagtacaaggacccccagagtaagaagaagggctggtggtatgcccactttgacggcccatggatagccagacagatggaactacacccagataaaccacctatcctgcttgtggcaggtaaagatgatatggagatgtgtgaactaaaccttgaggagactggcctcacacgcaagcgtggggcggagatcctcccgcgacagtttgaggaaatctgggaacggtgtggtgggatacagtatctacagaacgcgatcgagagtcgccaggctcgcccaacttacgctaccgccatgctacaaagcttgctgaaatag

SEQ ID NO: 125448 - DNA, 3858 bp, Artificial Sequence
  Description of Artificial Sequence: Synthetic coding sequence
atggaagacgggaaaccagtatgggccccccatcctactgatggatttcagatgggaaatatcgtcgacatagggccggatagcttgacaatcgaacctctcaatcagaaggggaaaaccttcctcgccctaattaaccaggttttcccggccgaagaggactccaagaaggatgtggaagacaactgttcactcatgtacttaaatgaggcgaccttgttgcataatattaaagtgaggtacagtaaggacaggatttatacctacgtggctaacattctgatcgctgtgaacccttattttgatatccccaaaatttactcctcggaggccataaagagttatcagggaaaaagtctcggaacaagaccccctcacgtcttcgccatagctgacaaagcatttcgtgatatgaaagtcctgaagatgtcccaaagcattatagtctctggggagtcaggggctggaaagacagaaaatacaaaattcgttttgcgataccttactgagtcatacgggactgggcaggatatagacgataggatcgtggaggcaaatccactactggaggccttcggaaacgccaagacggtacgcaacaacaactcgtccagattcggcaaattcgtcgaaatacactttaatgaaaaatccagcgtagtcggaggctttgtgtcacactaccttctggaaaagagtcgcatatgcgtccaaggcaaggaggaacgcaattaccacatcttttataggctgtgtgccggagcttcagaagacataagggagaagctgcatctgagttcccccgacaattttcgttatcttaatagaggatgcaccaggtacttcgccaacaaagaaactgacaagcagatcttgcagaatcgtaagagtcctgagtatctgaaagccggatctatgaaagacccgctgctagatgaccatggcgattttatccggatgtgtacggccatgaagaaaattggtttggatgacgaggagaagctagacctgtttcgggtggtggccggcgtgcttcatctggggaacatcgactttgaagaggccggatcaacttcgggcggttgcaatctcaagaataaatccgcccagtctctcgaatactgcgccgaactgttgggcttggaccaagatgatcttagggtttcactgacaaccagggtgatgcttactacggcaggaggtacgaaaggcactgtgattaaggtgcccctgaaggtggagcaggcaaacaacgccagagatgctctggcaaagactgtgtacagtcacctcttcgaccacgttgtcaatcgggtgaatcagtgctttccctttgaaacatcttcttattttataggagttctcgacattgcgggattcgagtattttgagcacaattctttcgagcagttttgtataaattactgtaatgaaaagcttcagcaatttttcaatgaaagaatactgaaagaagaacaggaactgtaccagaaagagggcctcggcgtcaatgaggtccattacgtcgataatcaggattgtattgacctcatcgaggccaaactcgtgggtattctcgacatactggacgaggaaaaccgccttccccagccctccgaccagcatttcacaagcgccgtccaccaaaaacataaggatcacttcagactgaccatcccccgcaaaagcaagctagctgtccaccggaatatccgagacgacgagggttttattatcagacattttgcaggggcagtctgttatgaaaccacacaatttgtagaaaaaaataacgacgcattacacatgtctctggaatccctgatttgcgagtctagggacaagtttatccgggaactgttcgagagcagtacaaataataacaaagacacaaagcagaaagctggcaaactatcattcatctcggtgggaaacaaattcaaaacacagcttaatctcctcctagacaaattgcgatctacgggagcttctttcattaggtgcatcaagccaaatctcaaaatgacgtcccatcactttgaaggggcccagattctaagtcagctccagtgttccggcatggtgtcagtactggatttaatgcagggaggctatccctctcgcgcgtctttccatgaactgtacaatatgtataaaaaatatatgcctgacaaattagcacgcctggatcccagacttttttgtaaagcactgtttaaggcactgggcctcaatgaaaatgactataagtttggcctgacgaaggtattctttcgcccagggaaattcgcagagtttgatcaaatcatgaaaagtgatcccgaccatctggcagagcttgtgaaaagagtaaatcattggctgacgtgctccaggtggaagaaagtacagtggtgcagtctttctgtgatcaagctcaagaataagattaagtaccgggcagaagcttgcatcaagatgcagaaaaccatccggatgtggttgtgtaaaagaaggcacaagccccgaatcgatgggctggtgaaggtggggacactgaaaaagaggttagataaatttaatgaggtggtgtctgtgcttaaagatggaaaacccgaaatgaacaaacaaataaaaaatttggaaatctcaatcgatacgttaatggcaaagatcaagtccactatgatgactcaagagcagattcagaaagaatacgacgcgctggtaaagagctccgaggaactcctgagcgcactccaaaaaaaaaaacagcaggaggaggaggcagagagactgagacgaattcaggaagagatggagaaggaaaggaagcggcgcgaggaggatgaaaagagaaggagaaaagaagaagaggagaggagaatgaagctggaaatggaggccaagaggaaacaggaggaggaggagcgtaagaagcgcgaagatgatgagaaaagaatccaggctgaggtggaagcccagctggcaagacagaaagaggaagagtctcaacagcaggccgttctggagcaagagaggagggatagagagctggccctgaggatagctcagagcgaagcagagcttatatcagacgaggcccaggctgacctagcattgaggcggaatgatgggactaggcccaaaatgactccagaacagatggcgaaggagatgtcagaatttctcagcagaggccccgccgttttagctaccaaggcggctgccggtaccaagaaatatgatctctccaaatggaaatatgccgagctaagggatacgattaatacttcctgtgatatcgaattgctagccgcctgcagagaggagtttcatcggcgcctaaaagtgtatcacgcctggaagtcaaagaacaagaagaggaatacggagactgagcagagggcccccaaatcagtcactgactatgactttgcacctttcctgaacaactctccccagcagaatcctgctgcgcagataccagctaggcaacgcgagatagaaatgaacagacagcaacgattttttcgcataccctttatcaggcctgccgaccagtacaaggatccgcagtctaagaaaaaaggctggtggtacgcgcactttgacggtccctggatcgcacgccagatggaactgcacccggataaacctccaatacttctcgtagctggaaaggatgacatggagatgtgtgagctcaatctggaggagaccggtctgacccgcaagagaggagccgaaatcttgcctcggcaattcgaggaaatctgggagagatgtggcggaatccagtacctgcagaatgctatcgagtctcgtcaagcgcggccaacttacgccacagccatgttacaatcacttctgaaatag

SEQ ID NO: 125449 - DNA, 3861 bp, Artificial Sequence
  Description of Artificial Sequence: Synthetic coding sequence
atggaggacggcaaaccagtctgggccccacacccaaccgacggatttcagatgggtaatatagtcgacatcgggccagattcactgacaatagagcccctgaaccagaaagggaaaactttcctggctctcattaaccaggtcttccccgccgaggaagatagtaaaaaagacgttgaagacaactgcagtctgatgtacttgaatgaggccactctcctccacaacataaaagtacgatacagtaaggataggatttacacctatgtggccaacatcttgatcgccgtaaatccctattttgatattccaaaaatttactcatccgaagccatcaaatcataccagggaaagtcactggggactcgacctcctcacgtgtttgccatagctgataaggcattccgcgatatgaaagtgctaaagatgtcacagtccattatcgtgtctggcgaatcgggagcaggcaagactgagaatacaaagttcgtgctaaggtacctgaccgaatcttacggcaccggccaagacatcgatgaccgtattgttgaggctaaccctctcttggaggccttcggaaatgccaaaaccgtgcgcaataataatagttcgcggttcggcaagtttgtagaaattcactttaatgagaaatcgtcagtcgtgggaggattcgttagccactatcttttagagaaaagccgaatttgtgtgcaggggaaagaggagcggaattaccacatcttttaccgactatgcgcaggggcttcagaggatatccgcgaaaagcttcatctgtctagtccagacaactttcgatatttgaacagggggtgcactcgatatttcgccaataaggaaacagataagcaaatccttcagaatcgcaaaagccccgagtacttgaaagctgggagcatgaaagatcctctactggacgaccacggtgatttcataaggatgtgcactgcgatgaagaaaataggattagacgatgaagagaaacttgaccttttccgagtggtcgctggcgttcttcacctcggaaacatagattttgaagaggctggatccacttccggcgggtgcaacctgaagaataagtcagcacaaagccttgagtactgcgccgagcttctgggactagatcaggatgacttgcgggtatcacttaccacccgggtaatgcttaccacagccggcggaactaaggggacagtgataaaagtaccactgaaggtggaacaggccaataatgctagggacgccctggctaaaactgtttacagccacttgtttgaccatgtagtgaatagggttaaccagtgcttcccatttgaaacctcatcctatttcatcggggtgctcgatatcgctggcttcgagtattttgaacacaacagtttcgagcagttttgcatcaactactgtaatgagaaactgcagcagtttttcaatgaaagaatcctaaaagaggaacaggagctatatcagaaggaaggcctgggggtgaatgaggtgcattatgtggataaccaggattgtatcgatctaatcgaagccaagctcgtaggcattcttgatatcttggatgaggagaatcgcttacctcagcccagcgatcagcatttcacaagcgccgtgcatcaaaagcataaagaccattttaggctgaccatcccccgcaaaagtaaattggctgtgcatcgcaatatccgcgacgacgaagggtttatcattagacactttgctggagccgtctgctatgagaccacgcaatttgtagagaaaaacaatgatgctctccacatgtctctggagtccctgatttgtgaaagcagagacaaattcattagggagctgtttgaatcaagtactaataataacaaggacaccaagcagaaggcagggaaactgtcctttatttcagttgggaataaatttaagactcaacttaacctcctgctggataagctacgatccacaggcgcttctttcattcggtgcattaagcctaatctcaagatgacatcccaccactttgaaggcgcccagatcctgtctcaactgcaatgtagtggcatggtatctgtgctcgatctgatgcaggggggatacccctcccgagcgtcttttcacgagctctataatatgtacaaaaagtatatgccggataagctggcgaggctggatccgcgattattctgtaaagcacttttcaaggcactcgggcttaatgaaaatgactataagttcgggcttaccaaggtctttttcagacccggcaagtttgctgaatttgaccagatcatgaagtccgaccctgaccacttggcagagctggtaaagagggtcaatcattggctgacatgtagcagatggaagaaggttcaatggtgctccctgagcgtaatcaaacttaagaacaaaataaaatatcgggcggaggcatgcatcaaaatgcagaagactatcagaatgtggctttgcaaaagacgacataagccacggattgatggcctggtcaaggtggggaccctgaagaagcgacttgacaagttcaatgaagtggtgagtgtgcttaaagacgggaagccagagatgaacaagcaaataaagaacctcgagatttctatagacaccttgatggccaagatcaagagcactatgatgacacaagagcagattcaaaaggagtatgatgctctggttaagtccagcgaagagctgctgagtgcacttcagaagaagaaacagcaagaggaagaggccgaacggctgagaaggattcaagaggagatggagaaggagcgtaaacgccgcgaagaggacgagaaacggcgccggaaagaggaggaggaaagaagaatgaagctggaaatggaagcaaagagaaaacaggaggaggaagaaaggaaaaaacgcgaggatgacgagaagcgtatacaggcggaggtagaggctcagctggcccgtcagaaggaggaagagtcccagcagcaggccgtgctggaacaggaaagaagggatcgcgagctggcgttgcgcatagcccagtccgaagccgagctcattagcgacgaagcccaagctgatttggctcttcggaggtacctcgactcttacccagtcacctctaagaacgacggcacccggccgaagatgacccccgagcaaatggccaaagagatgtcagaatttctgtcaaggggaccagctgtcttagctacaaaagcagccgctggaacaaagaagtatgacttgtccaaatggaagtatgcggaacttagagacactatcaacacctcctgcgacattgagttgttggccgcatgtcgggaagagttccatagaaggttgaaagtgtaccacgcatggaagtccaaaaacaaaaaacggaatacggaaacggagcagagggcacctaaatcagtgaccgactatgcccagcaaaacccagcagcccagattcccgcgcgccagagggaaatagaaatgaaccgacaacagcgcttcttccggattccctttatacgacctgctgatcagtataaggatccgcagtcaaagaaaaaaggatggtggtacgctcacttcgacgggccatggatcgccagacagatggagctgcaccccgataagccccccatcctcctggttgctgggaaagacgatatggaaatgtgcgagctgaacttggaggaaacaggcctgacccgaaagaggggtgccgagatcctcccccgccaattcgaggagatctgggagcgatgcggcggcatccagtacctacaaaacgctatcgaatccagacaggcaaggccaacatatgcgacagctatgttgcagtctcttctgaaatag

SEQ ID NO: 125450 - DNA, 3789 bp, Artificial Sequence
  Description of Artificial Sequence: Synthetic coding sequence
atggaagatggcaagccagtgtgggcacctcatccaacagacggctttcagatgggcaacatcgtagatattgggcccgacagcctgacaatcgaacccctgaatcagaagggcaagaccttccttgctctgattaatcaagtttttcccgccgaggaggactcaaagaaggacgtcgaggataactgcagtctgatgtatcttaatgaggcgacccttctccacaatattaaggtccgctattctaaggaccgtatttacacctacgtagctaacattttgatcgctgtcaacccttattttgatatccccaaaatctattcttctgaggccattaaatcctaccaaggaaaatctttaggaaccagacctcctcacgtttttgccattgccgataaggccttcagagacatgaaagtgctcaaaatgtcccagtccatcattgtttctggcgaatctggtgcaggcaagacagaaaacacaaagttcgtgttgaggtacctgacagagtcctatggaaccggacaggacatcgatgaccgaatagttgaagctaacccattgctcgaggcttttgggaacgcaaagacggttcgcaataacaattccagcagatttggaaaattcgtcgaaatacacttcaatgaaaagtcatccgtggtgggcggatttgtcagccactaccttttggagaaatcacgaatctgcgtccagggaaaagaggagcggaactatcacatattttaccgactctgtgccggcgcatctgaggacataagggagaaactacacctttcctccccagacaattttaggtacttaaatagaggttgcacccggtattttgccaacaaagaaaccgacaagcagatcctgcagaataggaaatctcctgagtacctcaaagctggttcaatgaaggatccattgcttgacgaccacggtgatttcattagaatgtgtactgctatgaagaagatcggcctggatgatgaggagaagctggatttatttcgcgtggtggcaggagtgctccaccttggcaatatcgatttcgaagaggccggttctaccagcggaggctgcaacctgaagaataaaagcgcgcaaagcctggaatattgtgcggaactgctcgggctagaccaagacgatctccgggtgtccttgacgacccgagttatgctgaccacagccgggggcactaagggcaccgtaatcaaggtgcccctgaaagttgagcaggccaacaacgccagagacgccctggctaagacagtgtactcacacctctttgaccacgttgtgaatcgtgttaatcaatgctttccattcgaaactagtagttacttcatcggcgtgctggatatcgctggtttcgaatatttcgagcataattcatttgagcagttctgtatcaattactgcaacgagaaattgcagcagttctttaacgagcgaatcctcaaggaagagcaggaactgtaccagaaagaaggtcttggagttaacgaggtacactacgtggacaatcaggactgcatcgacctaatcgaagcaaagctcgtgggaatcttagatattcttgatgaagaaaatcgactgcctcagccatcagatcagcatttcaccagtgccgttcatcagaaacataaggatcactttcggctcacaattccaaggaaaagtaaacttgccgtccaccgaaatattcgagacgatgagggctttatcatcagacactttgccggggccgtctgctatgagaccacccaatttgtcgaaaaaaataacgacgctcttcacatgtctctcgaatcactgatatgcgagagccgggataagtttatccgggagctgttcgagtcctccaccaacaacaacaaggatacaaagcagaaggccggaaagttgagtttcatcagtgtcggcaataagttcaaaactcaactgaatctcctgcttgacaaattgaggtctaccggggcaagctttatcaggtgtataaagcccaacttaaagatgacctctcaccatttcgagggagctcagatcctgagccagttgcagtgtagcggaatggtatctgtgctggaccttatgcagggtggatatcctagccgggcatcgttccacgaactttacaacatgtataaaaagtatatgccggataaactggccaggcttgacccacgcctcttttgcaaggctcttttcaaagcattgggtttaaacgagaatgattacaaattcggactgacaaaggtcttttttaggcccggcaagttcgccgaatttgaccagatcatgaaaagtgatccagaccacctggctgaactagtaaaacgcgtgaatcactggctgacatgtagccgctggaaaaaagtccagtggtgcagcctaagtgtgatcaaattgaagaacaaaatcaaatatagggcggaggcttgcattaagatgcagaagaccattcgcatgtggctgtgtaagagacggcacaaacctagaatagatggactggtgaaagtagggacactcaagaaacgcctagacaaatttaacgaggtggtgtccgttctgaaggacggcaaaccggaaatgaacaagcagatcaaaaatcttgagattagtatcgacaccttgatggcaaagatcaagtctaccatgatgacgcaggagcagatccagaaagaatacgacgccttagttaagtcatcagaggaactcttgagcgctctccagaagaaaaaacagcaggaggaagaggctgaaaggctacgacgaattcaagaggagatggagaaagaacggaaaagacgggaggaggacgaaaagaggaggcggaaagaagaggaagaaaggagaatgaagctagaaatggaagcaaagagaaaacaggaggaagaagaaagaaagaaacgtgaggatgacgaaaaacgaatccaggccgaagtcgaggcgcagctggctagacagaaggaggaggaatcacagcagcaggcggtcttagagcaagagcggcgcgatcgcgagctcgccctgcggatcgcccagagcgaagccgaactcatctctgacgaggcccaagccgacctggctctgcgccggggtcccgcagtgctggctactaaagccgctgcaggcacaaagaagtatgacctgagcaagtggaagtacgcagagttgagggatactattaacacctcatgcgatatcgagctgttggccgcatgcagggaggagtttcaccgacggctgaaagtctatcatgcatggaagtcaaagaacaaaaaacgtaataccgaaacggagcaacgggcacccaagtcagtgacggactatgacttcgccccctttctaaacaacagccctcagcagaatcccgcagcacaaattccagccaggcagagggaaattgaaatgaacaggcaacagagattctttaggatcccattcattagacctgccgaccagtacaaggatcctcagagcaaaaagaagggctggtggtacgcacacttcgatggaccctggattgctagacagatggaactgcaccctgacaagcctcccatccttctcgtagcaggtaaggatgacatggagatgtgcgaactgaatttggaggaaactggtctgacacgcaagcgaggtgccgagatactgccacgacagtttgaagagatctgggagagatgcggaggcattcagtatctgcagaatgcgattgagagcagacaggcaaggcctacttatgcgacggcgatgctgcaatctctgctgaagtag

SEQ ID NO: 125451 - DNA, 3888 bp, Artificial Sequence
  Description of Artificial Sequence: Synthetic coding sequence
atggaagatggaaagcctgtctgggcccctcatccgactgatggatttcagatggggaacattgtggacattggcccggattccctcacaatagagcccttaaaccaaaaaggaaagacgttcctcgcgctgataaatcaggtgttcccagctgaagaggatagcaaaaaagatgtagaggacaattgctccctcatgtatttgaacgaggcaaccctcctccacaatattaaggtgcgatactccaaagataggatttacacttatgtggcaaacatacttatcgcagtgaacccttatttcgatattccaaagatatacagctccgaagccattaagtcctaccagggcaaatcactcggcaccagaccgccacacgtattcgccatcgctgataaagccttcagggatatgaaagtgctgaaaatgagccagtcaattattgttagtggcgagtcgggagcgggcaaaaccgaaaatacgaaatttgtattgagatatctgacagaaagttatggtaccggtcaggacatcgatgatagaattgtggaggctaacccacttctggaagcattcgggaacgcgaaaactgttagaaataataatagttctcggttcggaaagtttgttgagattcactttaatgagaagagcagtgtcgtgggggggtttgtaagtcattatctcctcgagaaaagcaggatctgtgttcagggtaaagaggaaaggaactaccatatcttctatagactgtgcgctggcgcgtccgaagatataagggagaagctgcacctttcctctccggacaactttaggtacctcaaccgaggatgtacgcgctatttcgcgaataaggagacagacaagcagatcctccaaaacaggaaaagccccgagtacctgaaagctggatctatgaaagatccactgttggatgaccacggtgacttcatacggatgtgtactgccatgaaaaaaattggactcgatgatgaagagaaactggatttgttccgagtggtggcaggggtgctacacctgggaaatatcgacttcgaagaagctggcagtacaagtggggggtgtaacctcaaaaataagtctgcacagtctctggagtactgtgctgagctgttgggacttgatcaggacgaccttcgcgtatccctgaccacccgcgtgatgttaactactgcagggggtaccaaaggcacagtcatcaaagtgcctctgaaggtggagcaggccaacaatgcccgcgacgccctcgcaaagacagtgtacagtcacctcttcgatcatgtggttaatagagtgaaccaatgcttccccttcgaaaccagttcttattttatcggagttctggatatcgcaggttttgaatacttcgagcataattccttcgaacagttttgcattaactattgcaacgaaaagctgcaacaattcttcaacgaacgaattctcaaggaagagcaggaactctatcaaaaagagggccttggggtgaacgaagtgcattatgtggataaccaagactgcattgatttgatcgaggctaaactggttgggattctcgacattctggacgaggagaacagactaccacagccaagcgatcaacacttcacctccgccgtccatcagaagcataaagatcacttcaggctgaccatcccacgtaagagtaagctcgccgtgcacaggaatattcgggacgatgaagggtttattatccgccactttgccggggctgtgtgctacgaaacaacccagttcgtggaaaagaacaacgacgcacttcacatgagcctagaatccctgatatgcgaatccagggataaatttatcagagagctgttcgaatcttccacaaacaacaataaggacacgaagcagaaagccggcaaattgtctttcatcagtgtggggaataagttcaagacccaactgaacctcttactcgacaagctgagatccacaggagccagtttcattaggtgtattaaacccaatctaaagatgacttcacatcacttcgaaggagcgcaaattctgtcccagctgcaatgttctgggatggtgagtgtgcttgatctcatgcagggtggctacccttctcgggcaagcttccacgagttatacaatatgtacaagaagtatatgcccgataaactagcccgcttggacccccgcctgttttgtaaagccctttttaaggcactgggcctgaacgagaacgactacaaattcggcctaactaaagtgtttttcagaccaggcaaatttgcggagtttgatcaaattatgaagtccgaccctgatcacctcgctgaactcgtaaaacgagtgaaccactggctaacctgttcaagatggaagaaggtccagtggtgctccttatctgtcattaaattaaagaacaaaattaaatatagagccgaggcctgcatcaagatgcagaaaaccatacgcatgtggctctgcaagcggcgtcacaagccgaggatcgacggccttgtgaaggtgggcaccctgaagaaacgccttgataagttcaatgaagtggtgagtgtcctgaaggacggtaagcctgagatgaataaacagatcaaaaacttggaaatcagcattgacacactgatggcgaagataaaatcaaccatgatgacgcaggaacagattcagaaagagtatgacgccctggtgaaatcctcagaagaactgttatccgctctgcagaaaaagaagcaacaggaggaggaagcagaaagattaaggaggattcaggaggaaatggagaaggagagaaagagacgagaggaagatgagaagcgccgacggaaggaggaagaggagcggagaatgaaattggagatggaagctaaaagaaagcaagaagaagaagaaagaaaaaagcgcgaagacgacgaaaaacgcatccaagcagaagtggaagcccagctggcgagacaaaaagaggaggaaagccagcaacaggccgtgctggagcaagaaaggagagatcgggaactcgcactacgaatcgcccagagtgaagccgaactgataagcgatgaagcacaggcagatctggctctgagaaggtatctggatagttaccctgtgacctccaaaaatgacggcacccgacccaaaatgaccccagaacaaatggcgaaagagatgtctgagttcctcagtcgcgggcccgccgtgcttgcaaccaaggccgccgccgggactaagaagtacgatctgagcaaatggaagtatgccgagcttagggacactatcaacacgagctgtgacatcgagctgttggccgcttgcagggaagagttccatagacggctcaaggtgtatcacgcgtggaaatcaaagaataagaaacggaatactgagacagagcagagggcacctaagtccgtgacagattacgattttgcccctttcctgaacaattcacctcagcagaaccccgcagctcagatacctgcccgacagagagagatcgaaatgaataggcaacagcgattctttcgcattcccttcattcggcccgctgaccagtacaaggacccccagtctaagaaaaagggatggtggtacgctcacttcgacggcccgtggattgcccgacagatggagctccacccagataagcctcccatactgttggtggcaggaaaagatgacatggagatgtgcgagctgaatcttgaggaaactggcctgacccggaagcggggggcagagattctaccacgacaattcgaggagatttgggagagatgcggcgggatccagtacttgcagaacgctatcgagtcacggcaggctcgtccaacgtatgccacagccatgctgcaatcccttcttaaatag

SEQ ID NO: 125452 - DNA, 525 bp, Artificial Sequence
  Description of Artificial Sequence: Synthetic coding sequence
aagcggagggaggaggacgaaaagcgccggagaaaggaggaggaggaaagacggatgaaactcgagatggaggccaaaagaaaacaggaggaggaggagaggaagaaaagagaagacgatgagaagaggatacaggctgaggtggaagcccagctggctcggcagaaagaggaggagtcccaacagcaggcagtgctcgaacaggaacggcgtgatagggagctggccctccgtatagcgcagtctgaggcagagctgattagcgacgaggctcaggcagatctggccttgcggtctctggatagctaccccgtaaccagtaagaacgatggcactcgaccaaaaatgactcctggccctgcagtcctggcgaccaaggctgctgcagggactaaaaagtacgacctgtccaagtggaaatacgcagaactgagagacaccatcaacacctcctgcgacattgagctcttggccgcctgccgggaggagtttcaccggcggctgaaagtctatcatgcttggtag

SEQ ID NO: 125453 - DNA, 6276 bp, Artificial Sequence
  Description of Artificial Sequence: Synthetic coding sequence
gcccttcttcagaagggcgaccacgtttggatggacctccggctggggcaggagttcgatgtcccaatcggggccgttgttaagctttgcgactcaggtcaggtgcaagtggtggacgatgaggacaacgagcattggatcagtccccagaacgcgacgcacataaagccgatgcaccccacttcggtacacggggtagaggatatgatccgcctgggagacctgaacgaggctggcattctgcgcaaccttctgatccggtatcgcgatcacctgatctacacctacacaggaagcatactcgttgcggtaaacccctaccagctgctatctatttacagtccggaacatatcaggcagtacacaaacaaaaagatcggggaaatgcccccccatattttcgccattgcagataattgctatttcaacatgaagaggaactctagagaccagtgttgcatcatatcaggggagagtggggctggcaagacggagagcactaaactcattctccagtttttagctgccatctccggccagcattcttggattgagcaacaggtcctagaagctacccctattctggaggcgttcggcaatgccaaaacgattcggaacgataactcatctaggtttggtaaatatattgacatccattttaataaacgcggtgcaattgaaggcgccaaaattgagcagtatcttctggaaaaatctcgagtgtgcaggcaggcactggatgaacgcaattaccatgtgttttattgcatgttggagggcatgtctgaggaccagaaaaaaaagttggggctgggacaggctagcgactataactatctcgccatggtcaatccaccagatctgatgagctgtttgacaagcaggaccctcataacaagaggggagaccgttagcacaccccttagccgcgagcaggcattggacgttcgagacgcattcgtgaaggggatctacggcaggctttttgtgtggatagtggataagattaatgccgccatctacaagccaccttcccaggatgttaagaactcacgacgaagtataggcctgttggatatctttgggtttgagaatttcgccgtgaatagcttcgagcagctgtgtatcaattttgcaaacgagcacctgcagcagttcttcgtgaggcacgtgtttaaactcgaacaggaggaatacgacttggagtccattgactggctgcacatcgagttcacggacaatcaggacgctctggatatgattgcaaacaaacccatgaacattatttctctgattgacgaggaatctaaattccccaagtttctggagaagaatagggatacattgcatggggacatcatccagctagttcactcatcccgcaacaaattcattaaacagatctttcaggctgacgtggcaatgggagcagagacacggaagaggtccccaacccttagctcccaattcaaacgcagtctagagttgttaatgcgcacgctgggcgcgtgtcagcccttctttgtgcgctgtatcaaaccgaacgaatttaagaagcccatgctgtttgataggcatctgtgtgtacgccagcttagatactcgggaatgatggaaaccataagaatccgcagggcaggatacccgatccgctacagttttgttgaattcgtggagcgatatagagtactccttccgggcgtgaagcccgcttataagcagggcgacctccggggaacctgccagaggatggccgaagctgttctcgggactcacgacgactggcaaattggaaagaccaagatattcttgaaagatcaccatgatatgctgctggaagtcgagagggataaggccatcaccgatcgggtgatactgttgcagaaggtcattcgcggctttaaggataggtccaattttcttaagttgaaaaatgccgcgacgcttattcaaaggcactggaggggacacaattgtagaaaaaactatggcctgatgcggctaggcttcctccgcctgcaggccttgcatagatcgcggaaattgcatcagcagtaccgtcttgctagacagcgcattattcagttccaggcgaggtgccgagcatacctggtgcggaaggctttcagacatagactctgggcagtcctcacagtacaggcttacgctcgaggtatgatcgcacgtcggctccatcagcggttgagggccgagtatttatggagactcgaggccgaaaaaatgagactcgccgaggaagagaagctgcgcaaggagatgtccgcaaagaaggccaaagaagaggcagagcgcaaacaccaggaacgtctggcccagcttgccagggaggatgcagagagggaattgaaagagaaagaggcagctcgccggaaaaaagaacttctggagcagatggagcgggcgaggcacgagcctgtaaaccactctgacatggttgataagatgttcgggttcctcgggacttccggcggtctgcccggtcaagagggccaggcacccagtggattcgaagacctggagagaggacggcgtgaaatggtagaggaagaccttgacgctgctttgcccttacctgacgaagacgaggaggatctcagtgaatataagttcgctaagttcgccgcgacttacttccagggcacaacaacgcatagctatacacggagaccgctgaagcagccactactctatcatgatgacgagggggatcagttggccgcccttgcagtgtggattactattctgaggttcatgggagacctcccagaacctaagtaccacaccgctatgtccgacggttcagagaagatacctgtaatgaccaagatttacgagacgttaggcaagaagacctacaagcgggagctgcaagcattgcaaggcgagggggaagcacagcttccggagggacagaagaaatcgagcgtgcgtcacaaactggtgcatctgacgctgaaaaagaaatccaagctcaccgaagaggtaacaaagcgccttcacgacggggagtccaccgtgcaaggtaactcaatgctcgaggatcggcctacaagtaatctggaaaaactccatttcataattggtaacggtatcctaagaccagcactgcgggatgagatctattgccaaatctccaagcagctcacgcacaatccctccaaaagcagctacgcgagagggtggatactagtatcactgtgcgttggctgctttgccccttcagaaaaatttgtgaagtatctcagaaatttcatccacggtgggcctcccggatatgctccgtactgtgaggagagactgagaagaacctttgtgaatggaacccgtacacagccccccagctggctcgagctgcaagccaccaagtcaaagaaacccattatgcttcccgtcacctttatggatgggaccactaaaactctgctcaccgacagcgccacaactgctaaggaattgtgcaacgccctggccgataagatctcgcttaaggatcgattcgggttctcgctctacatagctctgtttgataaagtcagcagtctcggctctggctcagaccatgtgatggacgccatatcacaatgcgaacagtatgccaaagagcagggcgctcaggagagaaacgcaccctggaggctgttctttcgtaaggaagtttttactccctggcatagcccatccgaggacaacgtggccacaaacctgatttaccaacaagtcgtgagaggagtaaaatttggcgaatacagatgtgagaaagaggatgatctggctgaactggccagccaacagtatttcgtcgattacggaagcgaaatgattcttgagaggctcctgaacctggtgcccacatacatacctgacagagaaatcaccccccttaagaccctcgagaaatgggctcagctggcgattgcagcacacaagaagggaatctatgctcagcgcagaactgatgctcagaaagtcaaagaagacgttgtctcctacgctaggtttaagtggccacttctgttctcccgtttttatgaagcgtacaaatttagcggcccttctctccccaagaatgatgtgatcgtcgcggtgaattggaccggtgtgtatttcgtggacgagcaggaacaagtgttgttagaactgtccttccctgagatcatggctgtaagttcctcccgtgaatgtcgggtttggttgagcttgggatgttcagacctcgggtgcgcagcaccccattctgggtgggcaggactgacacctgccggaccgtgttctccctgctggtcttgccgcggcgccaaaacgaccgcgccctcatttaccttagcaacaatcaagggcgacgaatacacttttaccagcagcaacgctgaggacattagagacctggtcgtcacattcctcgaagggctaaggaaacgctccaaatacgttgtggctttgcaggataatcccaaccccgctggagaagagtccgggttcctatcgtttgctaagggtgatctcatcatcttggatcacgacactggagagcaggttatgaacagcggctgggccaatggtatcaacgaaagaactaaacagaggggcgactttcctactgattccgtctacgttatgccgacagtgaccatgcccccccgcgagattgtggcgctcgtgaccatgactcctgatcaaaggcaagatgttgttagactcctgcaactgcggacagccgagcctgaagtgcgtgctaagccctacacactggaggagtttagctatgattactttagaccgccgcctaaacatactctaagccgcgtgatggtgtcaaaagccagaggaaaggaccgactgtggtctcatacaagggaacccctcaaacaggccctgttgaaaaaactcttaggctctgaggagttatcacaggaggcatgtctagcttttattgccgtgttaaagtacatgggggactacccttccaagcgtacccggtcagttaacgaacttaccgatcagatcttcgaggggcccctcaaggccgaacccctgaaagacgaggcatatgtccagatactaaagcaacttacagacaatcacatacgctactcggaagagcgcgggtgggagctgttgtggctctgtacaggcctcttccccccttctaatatcttgctgccgcatgtccagaggtttcttcagtctcgaaaacattgtccattagccatcgactgtcttcagcggctgcaaaaagccctgagaaatggcagcagaaagtatccacctcacctggttgaagtggaggctattcagcacaagaccacacaaatttttcataaagtgtatttcccagacgatactgacgaggctttcgaggtcgaaagtagtactaaagcaaaagatttttgtcagaatatcgcaacccggctgctgctgaaatcaagtgaaggcttctcactgtttgtaaaaatcgctgacaaagtgctgtctgttcccgagaacgattttttcttcgattttgtccgacatctaacagactggatcaaaaaggctcggccaatcaaagacggaattgtgccatcgcttacctaccaagtttttttcatgaaaaagctgtggaccacaactgtacctggaaaagatcccatggctgacagtatcttccattattatcaggagctgccaaagtacctgagagggtaccacaagtgtacacgggaggaagtcctgcagctcggcgcactgatttatcgcgtcaagtttgaagaagacaagtcctattttcccagcataccgaagcttctccgagaactggtgccacaggacctgatccgccaggtcagtccagatgactggaaaagaagtatcgtcgcttatttcaataaacatgccggtaagagcaaggaggaggcaaaactggcctttctcaaactaatctttaagtggccgaccttcggttcggctttcttcgaggttaaacaaacaacagagccaaactttcctgagattttgctgattgccatcaataagtatggagtttcattgatcgaccctaagaccaaagatatactgactactcatccattcacgaaaatcagcaactggtcctctgggaatacctacttccacattaccattgggaacctggttaggggatcaaagctcctctgtgaaacgagtcttgggtataaaatggatgacctcctgaccagttatatctcccagatgctaacagctatgtcgaagcaaagaggatcaagatccggcaaatag

SEQ ID NO: 125454 - DNA, 6555 bp, Artificial Sequence
  Description of Artificial Sequence: Synthetic coding sequence
gcattgttacaaaagggagaccatgtgtggatggatcttcgtcttggtcaggagttcgatgtgcccatcggggccgtggttaaactctgcgactccgggcaagtgcaggttgtggacgatgaagataatgagcactggatatccccccagaacgcaacgcacattaagcccatgcaccccaccagtgtgcatggagtggaagatatgataaggcttggagacttgaacgaagcgggcattctgagaaatctgctgatacgttatcgggatcacctgatctatacatacacaggatcaattctggtagcggttaatccctaccagctacttagtatctacagtccggagcatatccgacagtacaccaacaagaagattggggagatgcctccacacatttttgctattgccgacaactgctacttcaacatgaagcggaacagccgcgatcagtgctgtatcatttccggagaaagcggtgccggaaaaaccgaaagtactaaactcatccttcagttccttgctgccatctcgggtcaacatagctggattgagcagcaagtgcttgaggctacaccgattctcgaagccttcggcaatgccaagactattcgaaacgacaactcttcccggtttggcaagtatatcgatattcacttcaataagagaggcgctatagaaggtgcaaagatcgagcagtacttactggagaagtctagagtctgccgccaggccctggatgagcgcaactatcatgtcttttactgtatgttggaaggtatgtcagaggaccagaaaaagaaacttggtctgggccaagcatcagactacaattatctcgccatgggcaattgtatcacctgcgaggggcgcgtggatagtcaggaatatgccaacataaggagtgctatgaaggttcttatgttcaccgataccgagaactgggagatatccaagctcctggcagccatcttacatctgggaaacctgcagtatgaggcaaggactttcgagaaccttgacgcgtgtgaagtactattctcacctagccttgccacggccgcatccctgctcgaagttaatcctcctgacctcatgtcctgcctgacttcgaggacgcttatcactcgcggggagacagtgtcaacaccattaagcagagagcaggccttggacgttagggatgcgtttgtgaaaggcatatacggacgcctgttcgtttggatcgttgacaagatcaatgccgccatttacaaacctccatcccaggatgtgaaaaatagtaggcgatctattggcttactagatatctttggcttcgagaattttgctgtcaattccttcgagcaactgtgcattaacttcgcaaatgagcacctgcagcagttttttgtacgacatgtgttcaagctggagcaggaagagtacgacctggaatctatcgactggttacatatcgagttcaccgataaccaggacgccttggacatgatcgccaataaacctatgaatatcatcagtctgattgacgaggagagcaaatttccaaaaggaactgacaccactatgctccacaagctgaatagtcaacataagctcaacgcaaattatatcccacctaagaataaccacgagactcaattcggaatcaatcattttgcagggattgtgtactatgaaacccagggtttcctggagaagaaccgcgacactctgcatggagacattatacaactagtccacagcagccgaaataaattcatcaaacaaatctttcaggcagatgtggccatgggagccgagacacgtaagagatccccaacgcttagcagccagttcaagcgatctctggagctgctcatgcggactctgggagcctgccaaccctttttcgtccgctgcattaaacctaacgaattcaagaagcccatgctgtttgatcgacacctctgcgtgagacagttgaggtattctggcatgatggaaaccatacgtatcaggagagcgggatatcccattaggtactcgttcgtggagtttgtggaacgctacagagtactgctgcccggagtgaagccggcttataagcagggcgatcttaggggcacctgccagagaatggcggaggccgtgctgggcacccatgacgactggcaaattggcaagacaaaaatttttctgaaagaccaccatgacatgctgcttgaggtggaaagggacaaggcaattaccgatagagttatcttgcttcagaaggtcatccgaggcttcaaggatcgatcaaacttcttaaagctcaagaacgccgccacacttatccaacgtcattggcgcgggcacaattgtcggaagaactatgggctaatgcggttgggatttctacgacttcaggccctgcatcggtcacgcaaactgcatcaacagtataggctggcgcgacaacggattatccagttccaggctagatgcagagcctaccttgtgcggaaggcattccgccacaggctttgggcggtgctcaccgttcaagcatatgcaagaggcatgatcgcccggaggctccaccagagattacgagccgaatacttgtggcgattagaagcagagaagatgagactggctgaagaggaaaaactcagaaaagaaatgagcgcgaagaaggctaaagaggaggccgagcgcaagcatcaggaaagattagcccagcttgcccgcgaggatgccgagcgtgaactgaaagaaaaggaagcggcaaggcggaagaaggagctccttgaacagatggaaagagcgcgccacgaacccgtgaaccattccgacatggtggacaaaatgttcggtttcctcggcaccagcggcggccttcctggtcaggagggccaggctccaagcggttttgaggacctggaaagaggacgacgggagatggtggaagaggatctggacgcggctttaccgctgcctgacgaagacgaggaagatctcagtgaatataagtttgctaagttcgccgccacgtactttcagggaacaaccacgcattcctacacccgacgccccctcaagcaaccgctactctaccacgacgacgaaggggaccagctagccgcactggcggtgtggataactatcctcaggttcatgggggacctgcccgaacctaagtaccacactgcaatgtctgacggaagcgagaagatcccagtgatgaccaagatttacgaaacccttggaaagaaaacatacaagcgagagctccaagcacttcaaggggaaggcgaggtgaccaaaagactccacgatggcgagtccacggtccagggcaattccatgcttgaagaccgcccaacctctaatttggagaaacttcacttcatcatcggcaacggcatcttaagacccgcactgcgcgatgaaatatactgccagatttcaaagcagctcacccacaaccccagcaagtcttcttatgcccgcggttggattctggtatccctatgcgtgggatgtttcgcccccagcgagaagtttgtcaagtatttaaggaattttatacacggtggaccgcctggctatgcaccgtactgtgaagagaggttgcggcggactttcgtgaacggaacacgaactcagcctcctagctggctcgagctgcaggctacaaagtccaagaagcctataatgttacctgtcacttttatggacggcactacgaagaccctcctgactgattcagcaaccacagcaaaggaattatgcaacgccctggctgacaagatttctctgaaggataggttcggtttctctctgtacattgctttgttcgacaaagtgtcatctcttggctcaggctccgatcacgtgatggacgccatttcccagtgcgaacaatacgcaaaagaacagggtgcccaggagcggaacgccccctggcggctgtttttcagaaaagaggtcttcacgccttggcactccccgagcgaggacaacgtcgccaccaaccttatataccagcaggtcgtcaggggtgttaaatttggagaataccgctgtgaaaaagaagatgatttagcggagctcgcatcgcagcagtactttgtggattacggatcagagatgatcctcgagcgcctgttaaacctggttcccacctacatacctgatcgagagatcacccccctgaagacactggagaagtgggcacagttggcgattgcggcccataagaaggggatctacgcccagcgtcggaccgacgcccagaaggtgaaggaggatgtggtctcctatgcacgcttcaaatggccgttgctgtttagtcgattctacgaagcctacaagttttccggccccagtctgccgaaaaatgacgtgatcgtagctgtgaattggacaggagtctatttcgtggatgaacaagaacaggtgctcttggagctttcattccccgagataatggccgtgagctcctcgcgagagtgtcgggtgtggctgtcactgggatgttccgacctcggatgtgctgccccccattctggttgggccgggcttactccagccggcccttgtagcccctgttggagctgccgaggtgccaagacaactgcgccttccttcacattggcaacaataaagggggacgaatatacctttacgtcctctaacgctgaagatattcgagacctggtggtcacgttcctcgagggactgaggaagcgcagtaaatacgttgtcgcccttcaggacaatcccaacccagctggggaggagagcgggtttctctctttcgccaagggcgatctcattatcctggatcacgacacgggggagcaggtgatgaactctggttgggctaatggaataaatgagcggactaaacagaggggggatttccccacagacagtgtctacgttatgccaaccgtgacaatgccccctcgggaaattgtggccctcgtaaccatgacacctgatcagcggcaagatgtggttcggctgttacagctgcggacagctgaacctgaggttagggcaaagccgtacacgctggaagaattttcttatgactatttccgaccgccccccaagcataccctaagccgcgtgatggtgtccaaagcccgaggtaaggaccggctgtggtctcacacccgcgagcccctgaaacaggcgctgctgaagaaacttctggggtctgaggagttgtcacaagaggcctgcctggccttcatagccgtcttaaagtatatgggggattacccctctaaacgaacacgatctgtgaatgaactgaccgaccagatttttgagggccctttgaaagctgagcctctgaaagacgaggcctacgtgcaaattctgaaacagctcacagacaaccacatcagatactctgaagaacgcgggtgggaactgctctggttgtgcacagggctgtttccacctagcaacattctccttccccacgtgcagcgcttcctacagtcaagaaaacactgccctttagcaattgactgtctccaacgactgcaaaaggctctcagaaatggatcccgcaagtaccctcctcacctggtagaggtcgaggctattcagcacaaaaccacccagattttccacaaagtttattttccagacgacacagacgaggcatttgaggtggaaagctcaactaaggctaaagacttctgccagaacatcgctactcgactgctgttaaaaagtagcgagggcttctcactgtttgtgaagatcgccgacaaagtgctaagcgtaccggagaacgacttctttttcgacttcgtaaggcatctgaccgattggattaagaaagcacggcccatcaaggatggaattgtcccttctttaacctaccaagtcttttttatgaagaagctttggacaaccactgttccagggaaggaccccatggccgatagcatcttccattattatcaggaactgccaaaatatttgagaggctaccacaagtgcacccgggaggaggtactgcaactcggcgccctgatctatagggttaagtttgaggaggacaagtcttatttccccagcattccaaaactactgagggagctggtaccccaggatcttattagacaagttagccctgacgattggaagagatccatagtggcctattttaacaagcacgccgggaaaagtaaagaagaagccaagctggcttttctgaagttaatctttaaatggcctacattcggaagtgccttctttgaagttaagcagactactgagcctaatttccccgagatactgctgatcgccatcaacaagtacggagtatcccttatcgaccctaagaccaaagacatattaacgacgcaccctttcaccaaaatctccaactggagcagtggaaacacatattttcacataaccatcggcaatctggtacgcggctccaagctgctgtgtgaaacctccctaggctacaagatggatgatctcttgacatcatacattagccagatgttgaccgccatgagcaaacaacgtgggtctagaagcggtaagtag

SEQ ID NO: 125455 - DNA, 3609 bp, Artificial Sequence
  Description of Artificial Sequence: Synthetic coding sequence
gcactgctgcaaaagggcgaccatgtgtggatggacctgaggctggggcaggaatttgatgtgcctatcggagccgtggtgaagctgtgtgactcaggccaggtgcaggtggtcgacgacgaagacaatgaacattggatctcaccgcaaaatgcgacgcacatcaagcctatgcaccccacctccgtgcatggcgtcgaagatatgataaggctgggtgatctgaatgaagctggcatcctgcgcaatcttctgatcagatacagggaccatttaatttacacctacaccggtagtatcctagtggccgtcaatccgtaccagcttctcagtatttactccccggagcatatacggcagtatactaataagaagattggcgaaatgccgccgcatattttcgctatagctgacaattgttacttcaatatgaagaggaacagccgagaccaatgctgcatcatctcaggagaatccggtgcaggtaagactgaatcgacaaagctcattttacagttcctggctgccattagtggccaacatagttggattgaacagcaggttttagaagccacacccattctggaggcatttgggaatgcaaagaccattcggaacgataactcctctcggttcggaaagtacatcgacatccattttaataaacggggtgcgattgagggtgccaagatcgagcagtatttactggaaaaatccagagtctgcagacaggccctggatgaaagaaattatcacgttttctattgtatgctggaggggatgagcgaagaccagaagaaaaaacttggactcggccaagcctcagactataattacttagcaatgggcaattgtattacatgtgaggggagagtggattcccaggagtacgcaaacatccgctccgctatgaaagtcctgatgttcacagacacagaaaactgggaaatctccaaattactcgccgccattctacatctggggaatttgcaatatgaagcacggaccttcgaaaatttagatgcctgtgaggtgctgttcagcccatccttagccaccgcagcatctcttcttgaggttaatccgcccgacctgatgtcctgtcttacaagccgcacactcataacacgaggcgaaacggtgtcaactcctttaagccgcgaacaggccctagacgtgcgtgatgcgtttgtaaagggtatttacggcaggttattcgtttggattgtggacaaaattaacgccgctatttacaagccgccctcacaggatgtcaaaaactccaggaggagtatcgggctgctggatatattcggattcgaaaatttcgcagtcaactcattcgagcagctgtgtattaatttcgccaacgagcatctgcagcaatttttcgtacgccacgtcttcaagctcgagcaggaggagtacgacctggagagcatagactggttgcatattgaatttaccgataatcaggacgctttggatatgattgccaacaaacccatgaatatcatcagtctgattgacgaagaatccaagttcccaaaaggaacggacaccactatgctccataaactgaactcccagcataaacttaacgcgaactatatccctcctaaaaataatcacgaaacacagttcggcattaaccactttgctggcatcgtctactatgaaacgcagggattcctggagaaaaacagagacactctccacggagatatcattcagctcgtccattcctccagaaacaaatttatcaaacagattttccaagccgatgtcgctatgggagctgagacaaggaaaagatcccctactctgtcctcccagtttaagagatctctcgagctactaatgcgcactttgggtgcttgccagccatttttcgtccgttgcataaagccgaacgagttcaaaaaacccatgctgtttgatagacacctttgcgttaggcagctcagatatagcgggatgatggagacaattcgcatccgaagggcgggataccccatcaggtatagctttgtcgagttcgtagagcggtacagggtgctactgcccggcgttaagcctgcatacaagcagggagatctgagaggcacttgtcagcgcatggccgaggccgtgctcggcactcatgatgactggcagatcgggaaaacaaaaattttcttgaaggatcatcatgatatgttgttggaggtggaaagagacaaggctattaccgacagggtcattcttctccaaaaggtgattaggggcttcaaagacaggtcgaatttcctgaaactgaagaacgctgcaaccctcatccagcggcactggcgcggacataattgtcgcaaaaattacggactgatgcggctggggttcttgcgactacaggccctccacaggagcaggaaactgcatcagcagtatcggttggctcggcagagaatcatccagtttcaagctcgctgcagggcttacctggtgcgcaaggcatttcggcaccggctgtgggccgtgctgactgttcaagcctatgctcgcggaatgatcgcgaggcgcctgcatcaacgcctcagagccgagtacttatggcggcttgaggccgagaagatgaggcttgccgaggaagagaagttaaggaaggaaatgtctgccaaaaaagccaaggaggaagccgagcgaaagcaccaggagcgcctagcacagctggcaagagaggacgcagagcgggaactgaaagaaaaggaggccgcccgacggaaaaaggagcttctggagcagatggagcgtgcgaggcacgaaccggtgaatcactcagacatggtggataaaatgttcgggtttttagggacctctggcggcttaccagggcaggagggccaagctccatcaggctttgaagacttggaacgggggcgaagagaaatggtggaggaggatttggatgctgctctgcctcttcccgacgaggatgaagaggatttgtcggaatataagtttgccaaattcgccgccacttactttcaggggacaactactcattcatatactcggcgacctcttaagcagcctctgctttaccatgacgatgaaggtgaccagctagccgccctggctgtttggataactatattgcgatttatgggcgatctgcccgagccaaagtatcatactgccatgtctgacggaagtgaaaagataccggtcatgacaaagatatacgagactctcgggaaaaagacctacaaacgcgagttacaggcactgcagggagagggcgaggtcctgcaggcacagttgcctgaagggcagaagaaatcttcagtgcgacacaaattagtccatctgacactcaaaaaaaagtcaaagctcacagaggaggttacaaagagactccacgatggagagtccaccgtccaggggaatagtatgctcgaagatagaccgacgagcaacctggagaaactgcatttcatcatcggcaacggcatcttacggcccgctcttcgctcagtccccccggagtcccttttagtggccgaatggtgcctgtgtcaaccttcaaaacggctgtcgcaagcccccggatttggattcgcagcttcttag

SEQ ID NO: 125456 - DNA, 6645 bp, Artificial Sequence
  Description of Artificial Sequence: Synthetic coding sequence
gccctcctccagaagggggatcacgtatggatggacctgcgccttggacaggaatttgacgttccgatcggcgctgtggtaaagctgtgcgacagtggtcaggttcaggtggtggatgacgaagataacgaacattggatcagccctcagaacgccacacatatcaagcccatgcatccaactagcgtgcacggggtcgaagatatgattagactcggtgatctcaacgaagcggggattctccgaaacctcttaataaggtatcgggatcacctgatctacacctataccggcagcatccttgtcgccgtaaatccctaccaactgcttagtatctatagccctgaacatatccggcagtatacgaataagaaaataggggagatgcccccccatattttcgctatcgcggacaactgttatttcaatatgaaaaggaatagtcgagaccagtgttgtattattagcggggaatctggagccggcaaaaccgagtccacaaagctgattctccagtttctggcggccatttctggccagcactcgtggatcgagcagcaggttctggaagcgacccccatactcgaggcttttgggaacgcaaagactatacggaatgataatagttcccgcttcggaaagtatatcgatattcactttaacaaacggggtgctattgagggagccaagatcgaacagtatctgctcgaaaagtccagggtctgcagacaggctctcgacgagcggaactaccatgtcttctactgtatgctggagggaatgagtgaagatcaaaaaaaaaagctgggtttgggacaggcatcagattataattaccttgccatgggtaactgcatcacctgcgaaggtcgtgtggacagtcaggagtacgcaaacattcgttcagctatgaaggtcttgatgttcaccgacacagaaaactgggagatctctaagctactagccgctatcctgcacctgggaaatctacaatacgaggctcgtacctttgaaaatctggatgcctgtgaggtcctgttcagcccgtccctggcaacggcggcaagtctgctggaggtcaatccacccgacttaatgagttgtctcacatccaggacactgattacccgcggggagaccgtgagtacaccccttagcagagaacaggccctggacgtcagggatgcattcgtcaagggaatttatggccggcttttcgtctggatcgttgacaaaatcaacgccgccatctacaagccgccctctcaggacgtgaaaaactctaggagatccatcggcctactggatatctttgggttcgagaacttcgctgtgaatagctttgaacaattatgcatcaatttcgctaacgagcacctgcagcagttctttgttcgtcacgtgtttaaactggaacaggaagagtacgacctggaatctattgattggctgcatattgagtttacagacaatcaggacgctctcgatatgattgctaataagcccatgaatattataagcttaatcgacgaggaatcaaagttccccaagggtacagacactacaatgttacacaagttgaactctcaacataagcttaatgctaactacatacctccgaaaaacaatcacgagacacagtttgggatcaatcacttcgcggggatcgtgtactacgagacccaaggctttcttgagaagaacagagatacattgcacggtgatatcatccagctggtccactcttcccggaataagtttatcaaacagattttccaagcagacgtggccatgggagcggagacaaggaagaggtctccaaccctgagctcccaattcaagcgtagcctcgagctgctgatgcgcacactgggagcatgtcagcccttcttcgtccgatgcatcaagcctaatgagttcaagaagcctatgctgttcgatcgacacctctgtgtaagacagctgcggtattctggcatgatggaaaccattcgcatccgacgagctggctaccctatcaggtatagctttgtggagttcgtcgaacggtacagagtgctccttccgggagtcaaacctgcctataagcaaggcgacctgcgtggaacatgccagcgaatggccgaggccgtcttgggtactcacgacgattggcagatcggaaaaaccaagatcttcctgaaggaccaccatgatatgttactcgaagtagaaagggataaggcgattactgacagagtgattttgttacagaaagtgatcagaggattcaaggaccgaagcaatttcttgaagctcaagaacgctgcaaccctcatccagaggcactggagggggcataactgcagaaaaaattatggcctaatgcggctgggctttttgcgactgcaagcacttcaccgctcccgtaaactgcatcagcaataccggttggcccggcagcgaattatccagttccaagcaaggtgcagggcgtacctagtcagaaaagcgttcaggcaccgactttgggcagtcctgactgtgcaggcctatgcccggggcatgattgccaggcgcctgcaccagcggctgagagccgagtacctttggagacttgaagccgaaaagatgcggttggcagaggaggagaagctccggaaggagatgagtgcgaaaaaggcgaaagaagaagcagagcgcaagcaccaggaaaggctggctcagctcgcaagggaagatgccgaaagagagctgaaagagaaggaagcagcaaggcgcaagaaggagctcctcgagcaaatggaacgggctaggcacgagccagtgaatcacagtgacatggtggacaagatgtttggctttctggggacttccgggggacttcccggtcaggaaggacaagctcccagcgggtttgaggacctggaaagggggcgaagggaaatggtcgaagaggatcttgacgcagctctgccactgccagatgaggatgaggaagatctgtctgagtataaattcgccaagttcgcagccacttacttccaaggcactacaacacacagctatacacgtcgccctttgaagcaacctcttctctaccacgatgatgaaggtgatcagctcgcggcccttgcagtctggattactatcctacggtttatgggcgacttaccggaacctaaatatcatactgccatgtcagacggaagcgaaaaaatcccagtgatgactaagatctatgagactctcgggaaaaagacttacaaacgtgagttgcaagctcttcagggagaaggcgaggcacagttgcctgagggtcaaaagaagagttctgtccgccacaaactggtccacctcaccttgaagaagaagagtaaactaactgaggaagtaacaaaaaggctccatgacggggagagcaccgttcagggaaatagcatgctagaggacaggcctacaagcaatttagagaaactacacttcatcataggcaacggtattctgaggcctgcactccgcgatgaaatttactgtcaaatttctaagcagctaacgcataatccttcgaaaagctcttacgcccgaggctggatactggtgtccctatgcgtgggctgtttcgcaccttcggaaaagtttgtgaaatacctcaggaattttatccacggcggacctccagggtacgctccttactgcgaagaaaggttgcgccggactttcgtgaacggcacccggacgcagcctccttcctggctcgaactgcaagctactaagagcaaaaagccaatcatgctcccagtgacatttatggatggcacaactaaaactttgttgactgattcggctacaactgccaaggaactctgtaatgccctcgctgataaaatctctctgaaggatcgctttggtttctctctgtacatagcgcttttcgacaaggtgtcatccctgggctccggctccgatcatgtgatggacgcgatttcacagtgcgaacagtacgccaaagagcagggggctcaggaaagaaacgccccatggcgactgtttttccggaaagaggtctttaccccgtggcattccccatccgaggataatgtggcgactaatcttatttaccagcaggttgtgcgcggagtgaaattcggagagtatcgctgcgaaaaggaagacgatttggctgagctagccagtcagcagtactttgtcgactacggatccgagatgatcctggagcgcttattaaatctggtccccacatatatcccagatcgtgaaatcacaccgctgaagaccctggaaaagtgggcccagcttgcaatagctgcccataaaaaagggatttacgctcagagacgcactgatgcccagaaggtaaaagaagatgtggtgagttatgccagattcaagtggcctctgcttttttcccgtttttatgaggcctacaaattcagcggtccgtcactgccaaagaatgacgttatagtggccgtcaactggacaggcgtgtactttgtggacgagcaggagcaagtccttctagagctgtcctttcccgagattatggccgtcagcagctcacgcgaatgtagagtgtggttgtcactgggctgctccgatctgggatgcgcagcaccacatagcggctgggctggtttgactcccgccggaccttgctcaccctgctggtcctgcaggggcgcaaagaccactgctccctccttcacgctcgctaccattaagggggacgagtacacatttacaagctctaatgcggaagatatacgtgatttagttgtgaccttcttggagggccttagaaaacgttccaaatacgtggttgccctgcaggacaatcccaaccctgcaggggaagagagcggcttcctgagttttgctaaaggtgatcttattattctcgatcacgacaccggagaacaggtaatgaactcgggctgggctaacggaattaacgaacggacaaagcaaaggggggacttcccaactgacagcgtgtacgtgatgccaaccgtcacaatgcccccacgagagattgtggcactggtcaccatgactcctgatcagagacaggatgtggtgcgcctgctgcaactcaggaccgctgaacccgaggtgcgagcgaaaccttacactttggaggagttttcctacgactattttagaccacctcccaaacatacattatcacgagttatggtctccaaggctagaggcaaggataggctgtggtcgcatacacgagagcctctaaaacaagccctgttgaagaagctcctggggagtgaagagctgtcccaggaggcctgcctggccttcatagcagttctgaagtatatgggcgattatccatccaagagaacgaggagtgtaaatgagctaaccgaccagattttcgaggggcccctgaaggcagaaccactcaaggacgaggcatacgttcaaatcctgaagcagctgaccgacaaccacatccggtattcagaggagagaggttgggagttactgtggttatgcaccggcctcttccctccatctaatatcctcctcccacatgtgcagcggttcctacaatccagaaaacactgtcccctggcaatcgactgcttgcagcgcctgcagaaggccctgagaaacgggtcccgcaaataccccccacatctcgtggaggttgaagcaatccagcataagactacgcagatctttcacaaagtgtattttcctgacgatacggatgaggccttcgaggtagaatcctccacgaaggcgaaggacttctgtcaaaatatcgcgacgcgccttctgttgaagtcatctgaaggtttctccctgttcgtgaagatcgctgacaaggttctcagcgtccccgagaacgattttttttttgatttcgtgaggcacctgactgattggatcaaaaaggctagaccaattaaggatggtatagtgccatccctgacgtatcaggtattttttatgaagaaattgtggaccaccacagtccccgggaaagatcccatggcggacagtatctttcactattaccaggaattgcctaagtatttgcggggctaccataagtgtacaagggaggaggtccttcagttgggcgctctgatctatcgggttaagttcgaagaggacaaaagctactttccatccattccaaagctgttgcgggaacttgtccctcaagatttgatcagacaagtgagcccagacgactggaagcggagcatcgtcgcctactttaacaagcatgcaggcaagtctaaagaggaggctaaattagccttcctcaaattgatcttcaagtggcctacatttggctcagccttcttcgaagtgaagcagaccacagaaccaaactttccagaaattctcctgattgccattaacaagtacggtgtgagcctgattgacccaaaaaccaaggacatcctgaccacgcatccattcaccaaaatctctaattggtcttccgggaatacatattttcacattaccatagggaatctcgtaagagggtccaaattgctgtgcgaaacttctctgggttacaaaatggatgatctgcttaccagttacatctctcagatgctaactgctatgagcaagcagagagggtcgcggtccggaaagtag

SEQ ID NO: 125457 - DNA, 6648 bp, Artificial Sequence
  Description of Artificial Sequence: Synthetic coding sequence
atggtaatattgcagcagggggaccatgtctggatggacttgcgacttgggcaggaattcgacgtgccaataggcgccgtggtgaagctgtgcgattctgggcaggtacaagtcgtggatgacgaggataacgagcattggatcagcccccagaacgcaacccacatcaaaccaatgcatccaacctctgtgcatggcgtggaagacatgatcagactgggggatctgaacgaggccggcatactgaggaatctgttgattcgctacagagatcatctcatctatacgtacacaggttctatcctggtcgcagtgaacccgtatcagctcttaagcatttacagtccggagcacattcgccagtacacaaataaaaagattggcgaaatgccgccccatatttttgccatcgcagacaactgctacttcaatatgaagaggaatagcagggatcagtgttgtattatttcaggagagagtggcgccggcaaaacagagagcacaaagctgattttgcaatttctcgcagcaataagcggccagcactcctggatcgagcagcaagtcctggaggcaacaccgatactagaggcatttggcaatgcgaagactatacggaatgacaattcttcccgctttggcaaatacattgacattcatttcaacaaaaggggagcaatcgaaggtgcaaaaatcgagcagtacctgttagagaagtcaagagtctgtcgtcaggctctcgacgaaagaaactaccatgttttctactgcatgcttgaggggatgtcagaagaccaaaagaagaagttaggtttagggcaggccagcgactacaattacctcgccatgggtaattgcattacctgtgaggggcgggtggacagtcaggagtacgctaatatcaggtccgcaatgaaggtgctgatgtttacggacacggaaaactgggagatatccaaacttctggcagcaatcctgcatctgggcaatctgcagtacgaagcccggaccttcgaaaatctggatgcatgtgaagtgcttttcagtcctagtctggcaactgcagcatctctgcttgaagtgaaccctcctgacctgatgtcctgcctgacatcacgtacccttattacaagaggtgagactgtgtctacacccctgtcgagagagcaggcgcttgatgtccgagacgccttcgtgaaaggcatctacgggagactatttgtgtggattgtggataagattaatgcagcgatctataaacctccctcccaggacgtcaaaaattcacggcggtccattggactgttagacatattcggcttcgagaacttcgccgtcaatagtttcgagcagctttgtatcaacttcgcgaatgaacacctgcagcagttctttgtcagacatgtgtttaagctggagcaagaggagtacgatctggagtctatcgattggctacacatcgagtttactgataatcaagacgcgctagatatgatcgccaacaagcctatgaatattatcagtctgatcgatgaagagtctaaattccctaaaggaacggacaccaccatgctccacaaactcaatagccagcacaaactgaacgctaactatattccaccgaagaacaatcacgaaacgcagtttgggatcaatcacttcgcaggcatcgtctactacgagacccagggatttctggaaaaaaacagagacacccttcatggcgacattattcaactggtgcatagctccaggaataagtttatcaaacaaatttttcaggctgacgtggccatgggcgcagaaacgcggaaaaggtccccgactctatcttcccagtttaagcgctctttagagctcctaatgcgaacattgggcgcctgccagccattctttgtcagatgcattaagcccaacgaatttaaaaaacctatgcttttcgaccgccatctttgcgtccggcaactcagatattcaggaatgatggagaccatacgcatacgaagagcaggctaccccatacgctatagttttgtcgaattcgtcgagagataccgagtgctcctcccgggagtgaagccagcatacaaacaaggcgacctgcgcggaacctgccagcgtatggccgaggcagtgctaggcacacatgatgattggcagattggaaagaccaaaatatttttgaaggatcaccacgatatgctcttggaggtcgaacgggacaaagccatcacagatagggtgatattactgcagaaggtgatcagaggcttcaaggacaggagtaactttttaaaattaaagaatgccgccaccctcattcagagacactggcgaggacacaactgtagaaaaaattacggcctgatgagactcggctttctgcggctgcaggccctgcaccgttctcgtaagttgcaccagcagtaccggctagcgagacagcggattatacagttccaggcacgatgtcgtgcttatttggtacggaaagcttttaggcataggctgtgggctgtactgaccgttcaggcctacgcaagagggatgatcgcgagacggctccaccagcgacttagggcggagtacctctggcgcctggaggcggaaaagatgcggctggcagaagaagagaagctgcgcaaagaaatgagcgctaagaaagctaaggaagaggcggagcgcaagcatcaggaacggcttgcgcagttagcacgggaggatgctgagcgcgagctgaaggaaaaagaagcggcaaggcgtaaaaaagagctcctggaacagatggagcgagcccgccacgagcctgtgaaccacagcgatatggtcgacaagatgtttggattcctaggtaccagcggcgggctcccgggccaggaaggccaggcaccgtcaggattcgaagatctggagagaggtaggcgcgagatggtggaggaagatttagacgcggctctgcccctccccgatgaggacgaagaggatttgtctgaatacaaatttgctaaattcgctgcaacatattttcagggcaccacaacccatagttacacacgccgcccattgaagcagcctctgttatatcatgacgatgaaggagatcagctggccgcgctggccgtgtggattacaatcctacggttcatgggtgacctgcccgaaccgaaatatcacaccgccatgagcgacggcagtgagaagatccccgtgatgactaagatctacgagaccctcggcaagaaaacctataagcgtgagctgcaggccctgcagggtgagggagaggcccagctccctgagggccagaaaaagagctctgtgagacacaagctggtgcacttgacactgaagaagaaatccaagctgactgaggaagtaacaaaacggttgcacgatggcgagagtactgtgcagggcaattctatgcttgaggatcgacctacttctaatctggaaaaactccactttataattggcaacggaatccttcgtccagctcttcgagacgagatctattgtcagataagtaagcagcttacacacaatccttcaaagtcctcttacgccagggggtggatccttgtctctctctgtgtgggctgttttgcaccgagcgaaaagtttgtaaaataccttagaaactttatccatggaggtccccccggttacgctccatactgtgaggaaaggctccgaaggacttttgttaacggaaccaggacccagccgcccagctggttggagctccaggctactaagagcaaaaaacccattatgctgccagtaacttttatggacggcactacaaaaactttgttgacggactcagccaccacagccaaggagctctgtaacgcactcgccgataagattagcctcaaagaccgtttcgggttttctctgtacatcgctttgtttgacaaggtctcttccctgggctcagggagcgaccacgtcatggacgctatttcccagtgtgagcaatacgctaaagaacagggcgcccaggagagaaacgcaccatggaggctttttttcagaaaagaagtctttacgccttggcactcaccatctgaagacaacgtagctactaatctgatctaccagcaggtagtgagaggggtaaaatttggagagtacaggtgcgaaaaggaagatgatctcgccgaactcgcctcgcagcagtattttgtggactacggcagcgagatgatcttggaacggttgctgaacctggtgccaacttacatccccgatagggagatcactccactcaaaacactcgagaagtgggcccaattggctatagctgcccacaaaaaaggtatttacgcacagcggagaactgatgcccagaaggtgaaggaggacgttgtgagctacgcccggttcaaatggccattgctgttctcaagattttacgaagcatacaaattctccggaccaagcttgcctaagaacgatgtgattgtggctgtgaactggaccggggtctattttgtggacgagcaggaacaggtgttattggagcttagttttccagagattatggccgtgtcttcctccagagagtgtcgggtttggctatcgttaggttgttccgacttgggatgcgctgctccccactccggctgggccggactaaccccagctggaccatgctcaccctgttggagctgtcgaggagcaaaaaccaccgcaccgtccttcacgttggcaactatcaagggagatgagtacacattcacatcttcaaacgccgaagacatcagagatctagtggttacctttctcgagggcttgcgcaaacggtcaaaatacgttgttgctctgcaagacaatcccaatcccgcgggagaggaaagcggattcttgtcattcgcaaagggcgacctgatcatactagaccacgatactggggagcaagtcatgaattctgggtgggcaaatggtatcaacgaaaggaccaaacaacggggggattttccaacagactccgtatatgtcatgcccacagttacaatgccaccgcgggagatcgttgccctcgtaacaatgactcccgaccagcgccaagacgtagttcggctgttacagctgaggaccgccgagcctgaagtgagggcgaagccatacacactggaggagttcagctacgactacttccgcccgccgcccaagcatacgttaagccgggtgatggtcagtaaggcgcggggaaaagaccgactctggtcccacactcgggagccactgaaacaggcacttcttaaaaagctcctcggttctgaggagctgtcccaggaggcttgtctcgctttcatcgccgtgctgaaatacatgggcgattatccctctaagcgtacaagaagcgttaacgagttgaccgaccagatcttcgaagggcccctcaaggccgaacctctgaaggatgaggcctatgttcagatcctcaagcagctgacagacaatcacatcagatattccgaggagcggggctgggagcttttgtggctttgtaccggcttgttccctcccagcaacatcctgctgccccacgtccagagatttttgcagagcaggaagcattgccccctggccatcgactgtctacaaaggctgcaaaaggctcttcgtaatggcagcagaaaatatcctccgcacctggttgaggtagaagcgatccagcataagacgacacaaatatttcataaggtgtatttcccggatgataccgatgaggcatttgaagtggaaagctctaccaaggccaaggacttttgccaaaacatagctactcgtctgctactgaaatccagcgaaggcttttcactgttcgtcaagattgctgataaagtactcagtgtccccgagaatgattttttcttcgatttcgtgcggcatcttaccgactggataaaaaaggctcgaccgatcaaagatggtatcgtcccatcccttacatatcaggtgtttttcatgaaaaaactttggaccactaccgtcccaggtaaggaccctatggctgactccatctttcactattaccaggagttaccgaagtacctcaggggctatcataagtgtacacgggaagaggtgctgcagctgggagccctgatttaccgcgtgaagttcgaggaagacaagtcctattttcctagtattccgaaactactacgcgaacttgtccctcaggacttaatccgtcaagtgagccccgacgactggaagcgatctatagtagcatacttcaacaaacacgctggtaaatcaaaggaggaggccaagctggccttcctgaagcttatctttaagtggccaacttttggcagtgcttttttcgaggtgaagcaaaccactgaacccaacttccccgaaattctactcattgctatcaacaaatatggggtctctcttatcgacccaaagacgaaggatattttaactacccacccctttacaaagatctcaaattggtcgagtggtaatacctattttcatataacgatagggaatctagtcaggggaagcaaactgttgtgcgaaacctcgctgggctacaagatggacgatctgttgactagctatatcagccagatgctaacagctatgtcaaagcaaaggggctcaaggagcgggaaatag

SEQ ID NO: 125458 - DNA, 3537 bp, Artificial Sequence
  Description of Artificial Sequence: Synthetic coding sequence
atggtcatccttcagcaaggcgatcacgtatggatggacctcagattgggacaggaatttgatgtgcccatcggagcagtggtgaaactatgcgattcaggacaagtccaggtagtggacgacgaggacaacgagcattggatcagcccccagaacgccacacacatcaagcctatgcacccgacatctgttcacggtgtggaagacatgatccggcttggtgaccttaacgaggccggtatcctgaggaatcttctcatccgatatagagaccatctgatctatacatacacaggctctatccttgtggcagtcaacccatatcagttactgtcaatctactcacctgaacacatccgtcaatacactaacaagaaaataggggagatgcccccccatatcttcgccattgcagacaattgctattttaacatgaagcgcaactcaagggaccagtgctgcattatttcgggagagagcggagcagggaagactgaatcaaccaagttaattctacagtttctggccgctatctccgggcagcattcctggatagagcagcaggtacttgaagcgacaccaatactggaagcttttggtaatgcaaaaacaatacggaatgacaacagttcccgcttcggcaaatatatcgatatccatttcaataagcgaggagccatagagggcgcaaaaatagaacagtatctgctcgaaaagtcgagggtctgccgacaggctcttgatgaaagaaactaccacgtattctattgcatgcttgaaggcatgtctgaggaccagaagaagaagctgggtttaggccaagccagcgactataactacctggcaatggggaattgcatcacatgtgagggccgagttgattcccaggaatacgctaacattaggtccgccatgaaggttctgatgttcacagataccgaaaactgggagatttccaagctgctggctgctattctgcacttggggaatctgcaatacgaagcacgcacatttgagaaccttgatgcatgcgaggttctcttctctccatcattggcaactgccgcctctctgttggaagtgaacccacccgacctcatgagctgtctgactagccggaccctcatcacccggggggagaccgtgtccacacctctaagccgggagcaggccctggacgtccgggacgccttcgtaaaaggcatttatggccggctgttcgtgtggattgtagataagataaacgcggctatttacaagcccccctcccaagacgtgaagaactcaaggcgctctatagggctactggacatctttggctttgaaaatttcgctgtgaatagtttcgagcaactgtgcataaacttcgccaatgaacacctgcaacagttctttgtgagacacgttttcaagctggagcaagaggagtacgatctagagtctatcgattggctacacattgagttcacggacaatcaggatgccctcgacatgatcgcgaacaaacctatgaacataatttccctcattgacgaggagagcaaattcccaaaggggacggataccaccatgctgcacaaactcaatagccagcacaagctgaacgctaactatattccccccaaaaacaatcacgagacccaattcgggataaaccactttgctggcattgtctattacgagactcagggatttctcgaaaagaatagggacaccttgcacggggacattatccagttagtccacagcagtaggaataagtttattaagcaaatcttccaggcagacgtagccatgggcgccgagaccaggaaacgctcaccaacactgtctagccaattcaaaagatcgctggaactgttgatgcgaacactgggggcatgccagcccttcttcgtaagatgcatcaagcctaacgagttcaaaaaacccatgctgtttgaccggcacctgtgcgtgcggcaattgcggtactccggaatgatggaaacgattaggattcgcagggccgggtacccaatcaggtactcatttgtcgagtttgtcgagcgctacagggttttattgcctggtgtgaagccagcctacaagcaaggcgacctgcggggcacatgccaacgtatggcagaagcggtcctcggtacgcacgatgattggcagatagggaagactaagatcttccttaaagaccatcacgatatgctgctggaagtggaaagagataaagccatcactgacagggtgatactgctccagaaagtgatccgcggctttaaggataggtctaacttcctgaagctgaagaacgccgctacgttgattcagcggcattggcggggccataattgccgcaaaaattacggactcatgagactgggattcctcaggttacaggccctgcaccgctcaagaaaactgcaccagcagtatcggctcgccagacagaggattattcaattccaggcaaggtgccgcgcctacctggtgcgaaaagctttccgccacagactctgggcggttttaaccgtgcaagcttacgcccggggcatgatcgctcgtcgactgcatcagcggcttcgagccgagtacttgtggcgtttggaagccgaaaagatgcggctggccgaagaagagaagctaaggaaagaaatgtcagccaagaaggccaaggaggaggcagaacgaaagcaccaggaacggctggcacaacttgccagggaggatgcggagagggagctcaaagaaaaagaggccgctaggagaaaaaaggagctgctggaacagatggagcgcgcccggcacgagcccgtcaaccatagtgacatggttgacaagatgtttggtttcctgggtacttcgggcgggctgcccggacaggaagggcaggcgccgtccggtttcgaggacttagagcgagggcgccgcgagatggttgaggaggacctggacgccgcgcttccactaccagatgaggatgaagaagatttatccgagtataagttcgccaagtttgcagctacgtactttcagggtacgacaacgcactcttacacaagaagacctctgaagcagccactgctctatcatgatgacgagggcgaccagttggccgctctggcagtgtggatcacaattctcagatttatgggcgatctccctgagcctaagtaccacaccgctatgagcgatgggagcgagaagatacctgtgatgaccaagatttatgagactctcggcaagaaaacctacaagcgggaactgcaagcattacagggtgagggtgaagcacaactgcctgagggccagaagaagtccagcgtgaggcacaaactggtacacctcacgctcaagaaaaagtctaagctgaccgaggaggtgactaagcggcttcacgatggagagagtacagtacagggcaactcaatgctggaggacagacctacttctaacctggagaagctacacttcattatcggaaacggtattctgagacccgcactcagatccgtccccggcggaggggacactcgggcctag

SEQ ID NO: 125459 - DNA, 6528 bp, Artificial Sequence
  Description of Artificial Sequence: Synthetic coding sequence
atggtgatacttcaacagggcgatcacgtctggatggatctaagacttgggcaggagttcgacgtgcccattggtgccgttgtgaagctctgcgatagtgggcaggttcaggtggtagacgatgaagacaatgagcattggatctctcctcagaatgcgacgcacatcaagcccatgcacccaacttctgttcatggggtggaagacatgatcagactgggcgacctgaatgaagccggaattttgcgcaacctgctaattcgttacagggatcatctaatctacacatacaccggcagcatcctggtagcggttaacccgtatcagctgctcagcatatactcccctgagcacatcagacagtatacgaacaaaaagatcggcgagatgccaccccacatctttgcgatcgccgacaattgctatttcaatatgaaaagaaattctcgggatcagtgttgcattatttccggggagtccggcgctggaaagacagagtctactaagcttatcttgcaattcctggctgctatctctggacagcactcttggatcgagcaacaagtgctggaggcaacaccgattctggaagctttcggcaacgccaagaccattcgaaatgacaacagctccaggttcggtaagtatatagatatacactttaataaacggggcgctatcgagggagctaagatagagcagtatttgctagagaagtcccgcgtgtgtcgccaggcactcgacgaaagaaattaccacgttttctactgcatgctagaaggcatgtctgaagatcagaaaaaaaagctcggacttgggcaggcatcagattacaactaccttgcaatggggaattgcattacctgtgagggaagagtagactcgcaggagtacgcaaatatccggtctgccatgaaggtgctgatgtttactgacaccgaaaactgggaaatttccaaactcttggccgccattttgcacctgggaaatttgcagtatgaggccagaaccttcgaaaaccttgatgcctgtgaggtcttattctctccatctctggcaaccgctgcgtctctgttggaggtcaacccccccgatctcatgagttgtctaaccagcaggaccctgattacccgtggtgaaactgtgtcgacgccactctccagagaacaagcacttgacgttcgagatgcgtttgtgaaaggaatatacgggagactgttcgtgtggattgtggacaagatcaatgcagcaatttacaaaccgccgagccaggacgttaagaactccaggcggagcatcggactgttggacatttttgggtttgaaaatttcgccgtgaattccttcgagcagttatgcatcaactttgctaacgaacacttgcaacagttctttgtacggcacgtatttaagctggaacaggaggagtacgatctggagtccatagattggcttcacatcgaatttacagacaaccaggatgcgttagatatgatcgcaaacaagccaatgaatattatctcactcattgacgaagaatctaagttccccaaaggcacggatacgaccatgctgcacaaactgaactctcaacacaagctgaacgcaaattatatcccacctaaaaacaatcatgagacacaattcgggattaatcactttgcgggcattgtgtactacgaaactcaaggttttttggaaaagaacagagatacgttacatggtgatatcatccagctggtccacagctctagaaataaattcatcaaacagatctttcaggcggatgtggctatgggggctgaaacccgaaagagatcacccacactgtcctcccaatttaaacgcagtctggaattgttgatgcgcacccttggtgcttgccagccattcttcgtacgctgcattaagcccaatgagttcaagaaacctatgttatttgatagacacctgtgcgtacggcaactccgctactctggtatgatggaaactatacggataaggagagcaggctatcctatccgatattcctttgtagaatttgttgagcggtacagggtccttttgccgggcgtgaagcccgcttataaacagggggatctcaggggaacatgccagaggatggctgaggccgtgctgggcactcacgatgactggcaaattggcaagaccaagattttcctgaaggatcaccacgatatgcttctggaagtggagagggacaaggcaataacggaccgcgtaatcttattgcagaaggtaataaggggtttcaaagatcggtcaaatttcctgaaattgaagaacgccgctacactcatacaaaggcattggagggggcacaactgtcgcaagaactatgggcttatgagactagggttcctgagattacaggctcttcatcgctctcggaagctacaccaacagtaccggctggctaggcagcgaattatccagttccaggcacggtgtcgggcctacttggtccggaaagcgtttaggcaccgcctgtgggctgtgctcaccgtgcaggcttacgccagaggcatgattgcccggagactgcaccagcgcctccgagcagagtatctctggcggctggaggcggagaaaatgcgacttgctgaggaagaaaaattacgtaaggagatgagcgccaagaaggcaaaagaggaggccgaacgaaagcaccaggagcgcctggcccagctcgctcgcgaggatgccgagcgggagcttaaagagaaagaagctgccagacgcaagaaagagttgctcgagcagatggaaagagctagacatgagccagtcaaccatagcgacatggtggacaaaatgtttggctttttagggacttccggcggcctccccggccaggagggccaggctccgtcaggctttgaagacctggagagggggaggcgcgagatggttgaggaagacctcgacgcagctttgcctctccccgatgaggacgaggaggatttgagcgaatataaattcgccaaattcgctgctacatacttccaggggactactacccacagttacactaggcgacctctaaagcaacccctgctttatcacgacgatgagggggatcaactagctgcgctggctgtgtggattaccatcctgaggtttatgggagacctgcccgagcctaagtaccacaccgctatgtcggacggttcagaaaaaatccccgtgatgaccaagatttacgaaactctggggaagaaaacatataagcgcgagctccaggctctgcagggggagggcgaggcacagctgcccgaagggcaaaaaaaatcttctgtgcggcataagctggtacatcttacccttaaaaagaaatcgaagctcacagaggaggtgacgaaacggttacacgacggagaatccaccgtgcaaggcaactccatgctggaggacagacccacttctaacttggaaaagctgcactttatcattggaaacggcattttgcggccggccctcagagatgagatttactgtcagatttccaagcagctgacccataacccgagtaaaagttcatatgcgcgcggatggatcctcgtaagtctttgcgtcgggtgcttcgccccaagtgagaaatttgtgaagtacctccggaactttattcacggaggaccccccggttatgccccctactgtgaagagcgcctgcgaagaacttttgttaacggcacacggactcagccaccctcatggctcgagctgcaggccactaaatctaagaaaccaataatgctgcctgtaaccttcatggacgggaccaccaaaaccctccttactgatagcgcaacaacggccaaggagctttgtaatgcactggctgataagatatcactgaaggaccgctttgggtttagcctttacatcgctttgtttgacaaagtaagcagcctgggaagcggttcagaccatgtaatggatgccatttcacagtgtgagcagtatgccaaggagcagggcgctcaggagcgaaacgccccatggagactgtttttcagaaaggaggttttcactccttggcactcccccagcgaggacaatgttgcgacgaatctcatctaccagcaggtggttcggggggttaagtttggagagtacaggtgcgagaaagaagacgatttagcagagctagcaagtcagcagtacttcgtggactatgggtctgagatgattctcgaacgcctactgaacctcgtgccgacctatatccccgatcgtgaaattactcccctaaaaacactggagaaatgggctcagctggccattgcagcccacaaaaagggcatctacgcccaaaggcggaccgacgcacagaaggtgaaagaggacgtggtgtcatatgccaggttcaagtggccactgctcttttcaagattctacgaagcttacaaattttctgggccaagtctaccaaaaaacgatgtcatcgtggctgtcaactggacaggagtatatttcgtcgacgaacaggagcaggtactgttagagttgagctttcccgagattatggctgtgtctagctcacggggcgctaagaccaccgccccttccttcactctagctaccattaagggggacgaatataccttcacttcatctaatgccgaggacataagagacttagtggtgacctttctggaaggcctccgtaagcgcagtaagtacgtcgttgctctgcaagataaccctaaccctgccggcgaggagtctgggttcctctccttcgctaagggcgatctaattatcctagatcacgatacaggcgagcaggtcatgaattcagggtgggcgaatggcatcaacgaacggacaaagcagaggggagattttccgaccgattcggtctacgtcatgcctacggttactatgcctccacgcgagatcgtggccctagtaacaatgacacccgaccaaagacaagatgttgtccggctactgcaactgaggactgccgagccggaggtgcgagcgaagccctataccctcgaggagttttcatatgactatttccgcccacctcctaagcatacgctgtcaagagtgatggtgtccaaggcgcgagggaaggatcgcctttggtctcacacccgcgagccattgaaacaagcattacttaaaaaactccttggctcagaggagctttcccaagaggcctgtcttgcctttatcgcggtgctcaaatacatgggagattaccccagtaagcggacaagaagtgttaatgaactcacggatcagatttttgagggccccctgaaggctgaaccactcaaagatgaggcctatgtgcaaatactgaaacagctgacagacaaccatatcagatactctgaggagcggggctgggagctcctgtggttgtgcactggcctatttccaccttctaacatcctgctgcctcatgtacagcgctttttgcagagtcgtaaacattgtcccctcgcgatcgactgcctgcaaaggttgcagaaggcacttcgcaacgggtcgcgcaaatatcccccccacttggtggaggtagaagcaatacaacacaaaaccacccagatttttcacaaggtttatttccccgacgatacagacgaagctttcgaggtggaatcttctacaaaggctaaggacttctgtcagaacatcgccactaggctgcttctgaagtcctccgaagggttctccctctttgtaaaaattgccgataaagtactgagtgtccccgagaatgatttcttttttgatttcgtccggcacctcaccgattggattaaaaaggctcgacccattaaagacggcattgtgccctctctgacatatcaggtcttttttatgaaaaagctctggacaactaccgtgccgggcaaagaccctatggctgattccatcttccactactaccaagagctgcctaagtacctgcgcggatatcataagtgtactcgcgaagaggtgctgcagctcggcgctctgatttacagagtcaaattcgaggaagacaaaagctacttcccgtccatccctaagcttctccgtgagctggttccccaggacctgattagacaggtcagccccgatgactggaaaaggagtattgttgcttacttcaataagcatgccggcaaatcgaaggaagaggctaaacttgcgttcttgaagttgatctttaagtggccgacttttgggtcagcctttttcgaacagacaacagagccaaacttcccagagattctgttgatcgccattaataaatatggggtcagccttatcgatccaaaaacaaaagatatactgactacccacccctttaccaagatttcgaactggagtagtggcaatacctactttcacatcacaatagggaatctcgtccgggggagtaagctgctttgcgagacctccctaggatataaaatggatgatctgctgacatcctatatctcccagatgcttacagcgatgagtaaacaacggggttccagaagcggtaagtag

SEQ ID NO: 125460 - DNA, 2532 bp, Artificial Sequence
  Description of Artificial Sequence: Synthetic coding sequence
ggcctatcagtccagtggctgctggacggcctcgcttgcttcttcgcctccctccacgtgccactcggtcgagtgcagctacatgcatctgcccggggaatccaggaaaaggaagacgacctcgcagaactcgcttcacaacagtatttcgtagattatggctccgagatgatccttgagagacttctgaacttagttcccacctacattcctgatagagaaattacccctttgaagacgcttgaaaagtgggcccaattggctattgcagcgcacaagaaagggatctatgcccagcgtcgcacagatgcacagaaggtgaaggaggacgtggtcagttatgcacggtttaagtggcctttactgttctcccgtttttacgaggcttacaagttctctggaccttcactgcccaagaacgacgtcattgtcgcagtgaactggaccggcgtctactttgttgacgagcaagaacaagtgctacttgagttgtcatttcctgaaatcatggccgtgtcttcatccaggggagcgaagaccacagctccgagttttaccctggcaaccataaagggggacgagtacaccttcacctcaagcaatgctgaggatatcagggacttagtcgtgaccttcctcgagggactccgcaagcggtctaagtatgtggttgcccttcaggataacccaaacccagcaggcgaggagtcaggattcctgtcattcgccaagggagatctgattatacttgaccatgacacaggcgaacaagtgatgaactccggatgggccaatggcatcaacgaacgcactaagcagagaggcgatttcccaaccgactccgtttacgtgatgcccaccgtgactatgcctcctcgtgagatcgtagctctggtaactatgactcctgatcaacggcaagatgtggtgaggctgctgcagctgaggaccgctgaaccagaagtgcgggccaaaccatatactctggaagagttctcatacgactactttagacccccccctaagcatacactgtcccgggtcatggtgtctaaagcccgtggcaaggatcggttatggtctcatacgcgcgagcctctcaagcaagcacttctcaagaagctcctggggtccgaggagttgtcacaggaagcctgtttagctttcatagccgtgctcaagtacatgggagattatccctctaagagaacacggtccgtgaatgaactgaccgaccaaatttttgaaggcccactgaaggctgagcctctgaaggacgaggcctacgtgcagattctgaaacaactcacagacaaccatattagatactccgaagaaagaggatgggaactcctgtggctttgcacaggtctgtttccaccatccaacatcctactgccgcatgtgcagcgcttcctgcagagcagaaagcactgccccctggctattgactgtctgcagcgcttgcagaaagctctgcgtaatggaagccgaaagtacccccctcatcttgtggaagtggaggctattcaacataaaactacccaaatcttccataaggtatattttccagacgacacagacgaagcattcgaggtagagagtagcaccaaggcaaaggacttttgccagaatattgcaactcgccttctattaaagagttcagaaggcttcagtctcttcgtaaagattgccgacaaggtgctctccgtcccagagaatgacttcttcttcgatttcgtccgccacctcactgactggatcaagaaagcccgcccgattaaggacggaattgtgcccagccttacatatcaggtattttttatgaaaaagctctggaccaccacagtccctggaaaggacccaatggcagatagcatttttcattactaccaggaattgccaaaatacctgcgagggtaccataagtgtactcgggaggaggtgttgcagctgggggccctcatctatagagtgaagtttgaggaagataagagctattttccaagtatccctaaactgctacgtgagctggtgccacaagatttgatcagacaagtttcaccggacgattggaagcgttctatcgtagcgtacttcaataaacacgccgggaaatccaaggaagaggccaagttagccttcttgaagcttatcttcaaatggccaacctttggcagcgccttttttgaagtgaaggttcaccatggtcttttacgtgctgaagaagagggtaatagggcgcttattaaacacagggattcatctttggggctctgggaaagggccatggccttggacacatgccctggtgaagggcggagagcagcccccagcgccctctcgcaacttagtgtgttggcaggtgtgtcccctggagatagaggcacacgccggtccagcgcctggcaatggcgccagacatgcaagcaggcgggcgttatggaggacggcctgtgcagcgatacgggcgagccaagcccccgttggcagtcctcaggaggctcagccggttgcgaaaaagcgtcttag

SEQ ID NO: 125461 - DNA, 4167 bp, Artificial Sequence
  Description of Artificial Sequence: Synthetic coding sequence
atgagattgggttttctgcggctgcaggccctgcatcgtagtaggaaactgcaccaacagtaccgtctggcacgacagagaattatacagttccaggccagatgtcgggcgtacttggtccgcaaggcgttccgccaccggttatgggccgtcctcaccgttcaagcctatgctagaggtatgatagcccgccgtctgcaccagcggctgagggctgagtatctttggcggctcgaggcagagaaaatgaggctcgcggaggaagagaaactccgaaaggagatgtctgccaagaaagctaaagaggaagctgaaaggaagcatcaggagagactggcccagttggcacgagaagacgccgaaagggagttgaaagaaaaggaggctgcccgacgtaagaaagagcttctcgaacaaatggaaagggcacggcatgaaccagtaaatcactctgatatggttgacaaaatgtttggatttctgggcactagcggaggcctgccgggccaggaggggcaggctccctcggggttcgaggaccttgagcgagggcgccgtgagatggtagaagaagacttagacgccgcgctgcctctccctgacgaggacgaagaggacctgtctgaatacaaattcgctaaattcgccgcaacctactttcagggtaccacaactcatagttacactcgacgacctttgaagcaaccactgctctaccacgatgacgagggggaccagttggccgctctggccgtatggattaccattttgaggttcatgggggacctgccagagcccaagtatcacaccgcaatgtccgatggttccgaaaagattcccgtgatgacaaagatctacgaaaccctgggaaagaaaacgtacaagcgcgagctgcaagccctgcagggggagggagaggcccaattgcctgagggtcagaagaagtcttctgtcagacataagctagttcacctaacgctgaaaaagaagagcaagcttactgaagaggtgactaagcgcttgcacgatggtgagtccacggtacaggggaattccatgctagaggatcgccctactagtaacctggagaagctccactttattatcggcaatgggatcctgagacctgcacttcgagacgagatttactgccagatctctaagcagttgacgcacaacccctctaagtcaagctatgcacggggatggatccttgtctcgctgtgcgtgggatgcttcgcacccagcgagaaatttgtgaaatacttgcgcaattttattcatggaggcccaccagggtacgctccatattgcgaagaaaggctgagacgcaccttcgtgaatggcaccagaacgcaacccccttcttggctggaactccaggcaaccaaatccaagaagccaattatgctgccagtaaccttcatggatgggaccaccaaaaccctcctaactgactctgccacaacagctaaggagctctgtaatgcccttgcggataagatatctctcaaggatcggttcgggttcagcctatatatcgctctgttcgacaaggtctcctcactggggtcaggatcggaccacgttatggacgccatttctcagtgtgaacaatacgcaaaggagcagggcgcacaggaaagaaatgctccctggagactgtttttccgcaaggaagttttcacgccatggcactcaccctcagaggataacgtggcgacaaacctcatctatcagcaggttgtgaggggggttaaattcggggaatacaggtgcgagaaagaagacgacttggctgaactggccagtcagcaatatttcgttgactacggctccgagatgatactggagagactcctaaatctcgtgcctacctacatcccagacagagagataacgcctctcaaaaccctggaaaaatgggcacagttggcaattgccgcacacaagaagggaatctatgcgcagagacgaactgacgcgcagaaggttaaggaagacgtcgtcagctatgcccgtttcaagtggcccctgcttttctcccgattctatgaagcttacaaattcagcggcccctccctgccgaaaaacgacgtgatagtggccgtgaactggaccggggtttatttcgtagacgagcaggagcaggtgctactggagctgtctttccctgagataatggccgtgtccagttcacggggagccaaaacaactgctccatcatttaccttagccactataaaaggagatgaatacactttcacatcctccaatgctgaagatattagggacctggtggtgacctttttggaggggctccggaaacgttcaaaatatgtcgtagctttacaggacaatcctaatcctgccggcgaagagtctggtttcttatccttcgccaagggcgatctgattattctggaccacgatactggcgagcaggttatgaattctggttgggccaacggcattaacgaacgtactaaacaacgcggagacttccctacagacagcgtatatgttatgcctacggtaaccatgccccctagagaaattgtggccctggtcacaatgactcctgaccaaagacaggatgtcgttagactgctgcagctacgcaccgcagagcccgaggtacgggccaagccgtatacattggaggagttttcttacgattattttaggccaccccccaagcacactctgtctcgcgtgatggtaagtaaggcccggggcaaggaccgcctctggagccacacaagggaacccctcaagcaagcactgctgaaaaagctgttgggctccgaagaactttcacaagaagcctgccttgcattcattgctgtcctgaagtacatgggcgattaccctagcaagaggacccgttcagttaacgaattgacagatcagatttttgaaggtccactgaaggcagaaccacttaaagatgaggcttatgttcagatcctcaaacaattgaccgataatcatatcagatacagtgaggagaggggatgggagctgctgtggctgtgcaccgggctcttccccccttcaaatatattacttccacatgtgcaacgcttcttgcagtctaggaagcattgccccctggccatcgattgtctgcagagattgcaaaaggcgctgcgcaatggtagcagaaagtatcccccccacttagtcgaggtggaagccattcagcacaaaacaacacagatcttccacaaagtatactttccagacgacacggacgaagcatttgaagtggagagctcaacaaaagctaaggacttttgccagaatattgcaacgcggctcttactcaagagtagtgaaggcttcagtctatttgtgaagattgctgataaagtgttgagcgttcccgaaaacgacttctttttcgactttgtccggcacttgaccgactggattaaaaaagcgcgacctatcaaggacggaattgtgccctcgctcacttaccaagtgtttttcatgaaaaaactttggaccaccactgtccctggaaaggatccaatggcagatagtatcttccactattatcaagaacttcccaagtacctgcggggctatcacaagtgcactagagaagaggttctgcagttaggcgccctgatttaccgcgtaaaattcgaagaggataaaagctatttcccttctatccccaaactactgcgggaattagttccccaagatttaatcagacaggtcagcccagatgactggaaacggtcgatcgtggcttatttcaacaagcacgccggaaagtccaaagaggaggcgaagctagcgtttctgaaactaatttttaagtggcctacctttggatccgcattcttcgaggtgaagcaaacaacagaacccaactttccagagattcttctgattgccataaacaaatatggcgtgtcacttattgatccaaaaaccaaagatatcctgactacacatccatttaccaagatatctaactggagcagcggcaacacatacttccatattaccatcggtaatctggtgcggggatcgaagttactatgcgagacaagtctgggttataagatggacgatttgctgacttcttatatcagtcagatgttgaccgccatgtccaaacaacgcgggtcacggagcggcaaatag

SEQ ID NO: 125462 - DNA, 2580 bp, Artificial Sequence
  Description of Artificial Sequence: Synthetic coding sequence
atgggacggaagcttgatctgagtggcttaacagatgatgaaactgaacacgttcttcaggtggtgcagagagatttcaatttgagaaagaaggaagaggagagactgtctgaactgaagcagaagctggatgaggaggggtcgaagtgctccatcctgtcaaaacatcagcagttcgtcgaacactgttgcatgaggtgctgctctcccttcacctttcttgtcaatacaaagcgccagtgcggcgattgcaaatttaacgtctgcaagagctgctgctcctaccagaagcatgagaaagcgtgggtctgctgtgtatgtcagcaggcaagactcttacgggcccagtcgctggaatggttttacaataacgtcaagtctcggtttaaaaggtttgggtctgccaaagtgctgaaaaacttgtatcgcaaacatcgactggagtccggcgcatgctttgatatcctgggcggctcactcttcgaatccaacctggaaaacgagggatccatttccggctcagatagcaccttctaccggcagagtgagggccacagtgtgatggatactctggccgtggcactaagagtagccgaggaggcaatagaagaagcgataagtaaagcagaggcctacggtgattctctggacaaacagaacgaagcaagctacctgagggatcacaaagaggaactgacagaagagctggctaccaccatactgcaaaagatcatacgaaagcagaaatctaaaagcgagcagcaagtggaagaagaacctggctggcctcacccccagtcatgcagcaccaaggtagctgatgaaggtacaagtgcgtcccccggcggttaccgcgcccctgcggccctctggaggagtcaatccgccttctctattactggagaggaggctctgaaaaccccccctgtagaagccccttctcggcaacctcgcgaccagggccagcatccgcgggctgaatccgccttgcccagctggaagagcgttgatcgcttagacgagaccaacctggctcctgtgctgcagagtcccgatggaaattgggtggcattaaaggacggagcgcccccgcctaccagactcctggctaaaccaaaatcaggcacgttccaggcattagaggtggcctcctctgtcgcctctgcatatgacgagatgggcagcgactccgaagaggatttcgactggagtgaagctttatctaagctatgcccacggagccgtgcactgccaaggaacccccaaccccagccaacacaggcccagagcagtgaccagggtccgattgcagcctcccctagctccgcactctccccgaatccagaagccatgtgttccgactccgaaacctcctctgctggatcctcccgggaagtgggacatcaggccagattatcatggctccagcgtaaggccccgcgcaatccagctgccgagaaaatgcggctgcacggggagctcgatgtcaacttcaatcctcaactcgcctctcgagaaacatcggactcatcagaaccggaggaggcaccgcacacaacagaccgacgagccaggcggtggcggcgggcccgcctcggatccgaagagccatcaaaggagccttccagccccagtgcccagcttcgcgatcttgacacacaccaagttagcgatgatcttagcgagactgacatttccaacgaagcccgcgacccgcaaacgctcacagataccactgaggaaaagaggcgtaatcggctctacgagttagcgatgaagatgtctgagaaggaaacatcctcaggagaggaccaagaatcggagccaaagaccgagagtgaaaatcagaaggagtccttgagcagcgaggataactcacagagcgtgcaggaggaactcaagaagaagttcagcgccgtgagcctttgcaatattagtaccgaagtgctaaaggtaatcaacgcaaccgaggagcttattgctgggagcaccggaccatgggagtctccccaggttccgcccgataggcagaaaggcatgttcccccggggtaccgaccaggtccgcctggacgaacagctgacttcattagaggagaacgtttatcttgcagctgggaccgtatatggcctggagacccagctgaccgagctcgaagacgctgccagatgtatccactccggaaccgacgagacacatcttgcagacttagaggaccaggtagccacagccgctgctcaagtccaccatgctgaactgcagatttctgacatcgaaagtcgcatttctgccctcaccattgccggcctcaatattgctccttgcgtgcgcttcacgaggcgcagagatcagaagcagcgaactcaagtgcaaaccatagatacatcccgccagcagaggcggaaactgccagctccgcccgtgaaagccgaaaaaatcgagacttcgtccgtgacaacaattaaaacattcaatcataattttatccttcaaggctctagtacaaaccgaactaaggagagaaaggggactacaaaggacctgatggagcccgctctcgaatccgccgtcatgtattag

SEQ ID NO: 125463 - DNA, 2313 bp, Artificial Sequence
  Description of Artificial Sequence: Synthetic coding sequence
atgcggaaagcggcgtccgccgctagcagccggagtacgtctagtctctggtccaccgctgcttgcgcggcagccagaccgtctccatctagtagtactcccagtgcctccgtcgagatagcgaacagcatgtcggcacgtgcagccgcccctacccggagtaccaaacggcccggatccgctgcttctgcttccaagagagggggcagtctgtttgagagtaacttggagaatgaaggatctatctccggcagtgattcgactttttaccggcaatcagagggtcatagcgtgatggacaccctcgccgtggcgctgagggtggctgaggaggctattgaggaagcaatctccaaagcagaagcttacggagactcactggataagcagaacgaggcctcatatctgcgggatcacaaagaagagctcaccgaggaactggcaacgaccatcctccaaaagattatcagaaagcaaaagtcaaagtctgagcaacaggtagaggaggaacccggatggccgcaccctcagagctgtagcactaaggtggccgatgagggcaccagtgcttccccggggggctatagagccccagcagcgttgtggcgcagccagtcagcattttccatcaccggggaggaggccctaaagacacctcccgtggaagccccttcccgccagcctcgggatcaaggacaacacccacgagccgaaagtgcactaccttcatggaaatcggtggacaggctcgacgagactaatctcgcacctgttctgcagtcccccgatgggaattgggtggcattgaaagatggtgctccacctccaacccggctgctggctaaacccaagtctggaacctttcaggctctggaggtggctagttccgtcgcctcagcgtacgacgaaatggggagtgacagtgaggaggatttcgattggagcgaagcactgagtaagctctgccccaggtctcgcgctttgccccgcaatcctcagccacagcccacccaggctcagagttccgaccagggacccatcgcagcctccccaagttcggcattgtccccgaatcctgaagctatgtgctccgatagtgagacgagctctgctgggtccagccgagaggtgggacaccaggctcggctttcctggctgcagagaaaagcacccaggaatcctgccgccgagaaaatgaggctccacggcgaacttgacgtgaactttaatcctcaactcgcctctagggagacctcagacagctcggagcctgaagaagccccgcatactaccgaccggcgggctagacgctggcggcgtgcacggcttggttctgaggagccttccaaggagccatcttcgccctccgcccaactgcgcgatctggatacacaccaagtgtcagacgatcttagtgaaacagacattagcaacgaggcccgagaccctcagacacttaccgacacaactgaggagaagcgtaggaatagactttacgaattggccatgaaaatgtctgaaaaagaaacttcctctggggaagaccaggaatccgagcctaagaccgaaagcgaaaaccagaaagagagccttagcagtgaggacaattcccagtcggtgcaggaggaactgaaaaaaaagttttccgcagtgtccctctgtaacatttcaacagaggtgctgaaagtcatcaacgcgactgaagagttaattgctgggtctaccggaccctgggaaagtccccaggtcccacctgatcgccagaaaggcatgtttcccagggggaccgaccaagttcgactggacgaacagctaacctctcttgaggaaaatgtgtacctcgccgcaggcacagtctatggacttgagactcagctgactgagcttgaggacgcagccagatgcatccactccggaactgacgagacccatttggctgatttggaagatcaggtagcaacagcagccgcacaagtgcaccacgctgaactgcaaattagcgacatcgagagccggatatctgcgttaacaatcgcgggcctcaatatagctccttgcgttaggtttacccgccgtagagaccagaagcagcgaacccaggttcagacaatcgacaccagcaggcagcagaggagaaaactaccagcccccccagtgaaggcggagaaaatcgaaacttccagcgtgactaccataaaaactttcaaccacaatttcatcctccagggatcaagcactaatcgtactaaggagcggaagggcaccacaaaggatctcatggagcctgccttggagtcagccgttatgtactag

SEQ ID NO: 125464 - DNA, 2580 bp, Artificial Sequence
  Description of Artificial Sequence: Synthetic coding sequence
atgggccgcaagctcgacctctctggcctaacagatgatgagacagaacatgtactgcaagtcgttcagcgcgatttcaacctacggaagaaggaggaggaacgcctcagcgagctcaagcaaaagctggacgaagagggatccaaatgctctatcctgagcaagcatcagcagttcgtggagcattgttgcatgagatgctgtagcccttttacttttttggtaaataccaaacgacagtgtggcgattgcaaatttaacgtatgtaaatcgtgttgtagctatcagaagcacgaaaaagcctgggtgtgttgcgtttgccaacaggcccgcctgctgcgggcacagtccctcgagtggttctacaataatgtgaagtctaggttcaagagattcggatccgctaaggtgcttaaaaacctctaccgtaaacacagactggagtctggagcttgttttgatatcctcggaggctctctgttcgagtcaaatcttgagaatgagggcagcataagcgggagcgactctaccttctaccgacagtcggagggacactccgtgatggacaccctagccgtggcactgagggtcgcagaggaagccatagaggaagctatttcgaaagcagaagcatacggggactcgctcgacaaacagaatgaggcctcttatcttcgagaccacaaagaagagctgaccgaagaactggcaaccaccatcctgcaaaaaatcatcaggaagcaaaagtcaaaaagcgaacagcaggtggaggaggagcccgggtggccacacccccagtcttgcagtactaaggtggccgatgagggaacatccgctagccccggtgggtatcgggccccagccgccctttggcgctctcagtccgcatttagcattacgggggaggaagcgcttaaaaccccaccagtggaagcccccagtcgtcagccccgcgatcaggggcaacaccccagagctgaaagcgcactgccaagttggaagagtgtggacagacttgacgaaacaaatctcgcacccgtgctgcagtcaccggacggtaactgggtggcactcaaagacggtgctccacctcctacaagactcctggcaaagccaaagtccgggacgttccaagcactcgaggttgcctcatcagttgcaagtgcatacgacgaaatgggttctgattctgaggaggacttcgactggtccgaagccctctcaaagctttgtcctcgcagcagagcgctcccccgtaatccccagccacagccaacccaggcccaatcgagcgatcaaggtcctattgcagcatcgcctagtagcgccttatctccaaacccagaggcgatgtgctccgattctgagaccagctctgccggctcctcccgtgaggttggccatcaggccagactgagctggttgcagaggaaggccccacggaatcccgccgctgagaagatgcgcttacatggcgagctggacgtgaattttaacccccaactggcaagcagggagacaagcgacagcagtgagccggaagaagcacctcataccaccgaccgcagggcccggcggtggcggcgcgctcggctcgggagcgaggaaccctccaaggaaccatcatctccgtctgctcagttgagggacctagatacccatcaggtgagtgatgacctaagcgaaacagacatcagcaatgaagccagggacccccagacattgactgacactacggaagagaagagaaggaacagattgtacgagcttgccatgaaaatgtcggagaaggagacctcatctggcgaagatcaggagtccgaacccaagacggagagcgaaaatcagaaagagtctctgagctccgaggacaattctcaaagcgtgcaggaagaactcaagaagaagttctccgctgtctctttgtgcaacatcagcaccgaggtcctgaaagtcattaatgctaccgaggagctgattgccggcagcaccgggccgtgggagtcaccccaagtgcctcccgacaggcagaagggaatgttcccgcgggggaccgaccaggtgagactcgacgaacagctcacgtccctggaggaaaatgtttacctggccgccgggacagtctatggcctggagactcagctgacagagctggaagatgcagcgaggtgcattcactccggaacagacgagactcatttggctgacttggaagatcaggtggccacagccgctgcgcaggtgcatcatgcagagctacagatttcagatattgaatcccgtattagcgctttgacaatagccggactgaatattgcgccctgcgtgcggtttacccgtcgacgcgatcagaagcagcgtacccaagtgcagacaatcgacacttctcgtcagcagcgacgaaaattgccagcaccgcctgtcaaggcggaaaagatcgaaacgagctcagtgacaacaattaaaactttcaaccataactttatcctgcagggctcgtcaactaaccggacgaaagaaaggaagggaacaacaaaggatctgatggagcctgctctggagtccgctgtcatgtactag

SEQ ID NO: 125465 - DNA, 2019 bp, Artificial Sequence
  Description of Artificial Sequence: Synthetic coding sequence
atggatacattagccgtggcactacgagtggcggaggaggccatcgaggaagccatttccaaagccgaggcttatggtgatagtttggacaagcaaaatgaagccagctatctgagagaccacaaggaagagctgacggaggagcttgctacaactattctccagaaaatcattcgtaagcagaagtccaagtccgagcagcaagtggaagaggaacccggctggcctcacccacagtcatgcagtacaaaagtggccgacgagggcacatccgcatcccccggtgggtatcgcgccccagcggccctctggaggtcccaatctgccttcagtatcacaggggaggaggcactgaaaactccacccgtcgaagcacccagcaggcagccccgcgatcagggacagcatccacgagctgagtcagctcttccgtcatggaagtcggttgatcggcttgacgagactaatctggccccagtgctccaatctccagatgggaattgggtagctttgaaggacggagccccgccccctacacggctgttggccaaacccaagagcggtacctttcaagctttggaggtcgcttcctctgttgcaagcgcctatgatgagatgggcagcgattctgaagaggatttcgactggtctgaagccctgtcaaagctatgccctaggtccagggccctacctcgcaacccgcagccacagcctacccaggctcagtcatccgatcagggccctatcgccgcctcaccaagctcagcactctccccaaaccccgaagccatgtgctctgactccgagacctcttctgctggctcatcaagggaggtcggacatcaagccaggctgtcctggctccagcgaaaggctcccagaaatcccgcagccgaaaagatgcgactccacggcgagctggacgtaaactttaacccccaattagcgagccgtgaaacaagtgattctagcgagccagaagaggctccccacacaacagatcgccgggccaggagatggcgcagagcccggttaggttccgaagagccaagcaaggagccaagctctccctcagcccagttacgagatctcgatactcatcaggtctccgacgacttgtccgagaccgacatcagcaacgaggctcgcgatccccagaccttgacagatactaccgaggaaaagaggcgcaaccggctgtacgagctggctatgaagatgtcagagaaggagactagtagtggcgaagaccaagagagcgaacccaagacggaaagtgagaatcagaaggaaagcctgagtagcgaggacaatagccaatctgtccaggaggaattgaaaaaaaagttctccgccgtctctctttgcaacataagcacagaggtcttgaaagtgattaatgctaccgaagaactgatcgcgggctccactggaccatgggagagcccacaggttccgccagacagacagaaggggatgttcccccgcggaaccgatcaagtcagacttgatgagcagctgacctctttggaagagaacgtttacttagcagccggaaccgtatacgggctcgaaactcaactgacagagctggaggatgccgcgcgatgcatccatagtggcacagacgaaacacacttggcagacctcgaggaccaggtggctacggcagcagcccaggtacatcatgccgagctgcagatctcagacatagagtccaggatttctgcattaacaatcgcgggccttaacatcgccccatgtgtgcggtttactcgaagaagagaccaaaagcagcgaacccaggtgcagacgatcgataccagtcgccagcagcggaggaaactcccagcgccaccagtcaaagccgagaaaattgagacgtccagtgtgacaacaattaagactttcaatcataactttatcctacagggcagcagcactaataggactaaggagcgcaagggaaccactaaagatctgatggagcctgcactggagtccgcagtgatgtactag

SEQ ID NO: 125466 - DNA, 2886 bp, Artificial Sequence
  Description of Artificial Sequence: Synthetic coding sequence
atgaagtatctgctgaatttcattggccagggacctgccacatatggtcccttctgcgctgagcggcttagacgaacctatgctaacggagtgcgagccgaaccccccacatggcttgagctacaggctgtcaagtcaaagaagcacattcccattcaggtgattcttgcaaccggagaaagccttactgtgcctgtggattctgcaagtacctccagagagatgtgcatgcacatagcccacaagcagggtctgagcgaccacctcggcttctcccttcaagtggcagtttacgacaagttctggtccttaggctcaggcagagaccacatgatggacgcaatagcacgctgcgagcaaatggcgcaggagcgcggggaatcccaacgccagtccccctggcggatctactttaggaaagagttctttactccttggcacgatagcagagaggatcccgtgtccacggagctgatttataggcaggtgttacgaggtgtttggtccggggaatatagttttgagaaagaggaagaactggtagagctgctcgcccgccactgttatgtacagctgggcgcgtccgccgaatctaaagctgtgcaggaacttctaccctcatgtattccgcacaaattataccggaccaagcctcctgacaggtgggcaagccttgtcactgccgcctgtgcaaaggctccctacacacagaagcaggttacccctttagctgtgcgggagcaagtggtggatgcggcccgactgcaatggccattattgttcagtcgtttgttcgaggtgataaccttatccgcttttactctgccttccctgctcgctaggcctccgccggctcaagatgccggaccagccggtgaagacgctgcagggactctgttcccacgaggccacggaagcggccaccagcaggtccgcgccttaagggaagatcttttccttcacactgagccccatcccccggcccctggccggacggcacacgaggttctgcattggggaattactcgatgtacagggtcattctctctgaagcctcgtagtaccaggaaaggtcagggcagtgtgcagccactagcaggcacatatctggaagggtccttcctgtgccacgggcgcgaactggttgcatggagggttcaggtagtgtgggaaggagacaagggacagtgccttgccggagcagatccccatagccacggaagcccttggatctccctgaccggaaatttcagcatgcccttcgggaaaagcactcaacagtcaggaacgtgtatctcgggcctctgtcaggtctattcaggacaccattcgccacttgcaacctcccctagatcaaccgatagtattacccacagtgccgacgagagaatgagcaaactgaaacacgccgaggtcaggtggctgcgtgtctccacctggcaaagtcggcagctgatatccgcgctgactttcgcagtaagcctgcggtgccactgcacgccggccacatcattatccgctcactcacaaccacacacttgggcggcccctctgtccgcatctgagcggccaacagtggtcagcggcctcgtcctcgcccttgctgagcagctgtgcgtgctgattcgatggaggggcctcctcgtaaccttgagtttcatcagccgagaggcgcagggaggtcagaggttactactgtccaccatgcatgaggaatacgagtttgtgtcgccaagcagcgtggccatcgcagagttggtagccctgtttctcgaaggactcaaggaacgtagtatcttcgctatggcactacaggaccggaaagctacagatgacacaacattactggcctttaagaaaggggatctcttggtgcttacaaagaagcaaggactgctggcttcagaaaattggacactgggacagaatgatagaacaggcaaaaccggcttggtccctatggcgtgtctttacacaatccctactgtcacaaagccttccgctcagcttctgagcctgcttgcaatgtccccagagaaacgaaagcttgcagcacaggagggccagtttacggagccccggcctgaagagcccccgaaagaaaagcttcacactttagaagagttctcctacgagttctttcgggcacccgaaaaagacatggtgtccatggcggttttgcccctcgccagggcccggggccacctctgggcatactcgtgtgagccactgcggcagcctctccttaagcgagtgcacgccaatgtagacctttgggatatcgcttgccaaatcttcgccacccccatcctgagatatatgggggactaccccagcaggcaagcctggccaaccctcgagttaacggaccaaattttcacacttgccttgcagcaccccgcactccaagatgaagtctattgtcagattctgaaacagctcactcacaactctaataggcatagtgaggagagagggtggcagctgttgtggctgtgcactggattgtttccgcctagtaagggactcttaccacacgcccagaaatttatcgacacccgtagggggaagctgctggccccagactgcagccgccggattcagaaggttttaaggacaggcccacgaaagcagcctcctcaccaggtggaagtggaggcggccgagcaaaacgtcagtaggatctgccacaaaatttactttcccaacgacactagtgagatgctggaggtggtggccaatacgcgagttagggacgtctgtgattccatcgccaccagactccagttggcatcatgggagggatgtagtctgttcatcaaaatatcagacaaggtgatatctcagaaagaaggggacttttttttcgactcactcagagaatag

SEQ ID NO: 125467 - DNA, 6354 bp, Artificial Sequence
  Description of Artificial Sequence: Synthetic coding sequence
atgagcggcttccgattaggcgaccatgtatggctggaacctccgagcactcacaagactggcgtggctattgggggcattatcaaggaagccaaaccaggtaaggtcttagtggaggacgacgaagggaaggaacattggatccgagctgaggacttcggagtgctatcaccgatgcaccccaacagcgtccaaggcgtggatgatatgattaggctgggtgaccttaatgaggcaggcatggttcacaatctccttattcgatatcagcagcacaagatctacacctacacagggtcaattcttgtggccgtaaacccttttcaggtactgccgctgtatactctggagcaggtccaactctactatagccgtcacatgggagagttgcctccgcacgtcttcgcaattgccaacaactgctacttcagcatgaaacgcaacaaacgcgaccaatgttgtattatttcaggagagtccggcgccggcaaaactgaaacaactaagttgattctgcagtttctggcgactatcagcgggcagcacagttggattgaacagcaggttttagaagccaaccctattcttgaggctttcgggaatgcaaaaaccatccgcaatgacaacagttcacggttcggtaagtatatagatatttacttcaatccctcaggggtcattgagggtgcccgcatcgagcagttcctgctggagaaatctcgggtgtgcagacaagctccggaggaaaggaactatcacatcttctattgcatgttgatgggagtgagcgcagaggataagcagctgctgtccctgggtacaccctctgagtatcattatcttactatgggcaattgcaccagctgtgagggtttaaacgacgcaaaagattatgcccacatcagatcagcaatgaaaatcctgcagttctcggatagcgaatcctgggatgtgatcaagctcctcgcggccattctgcacctcggaaacgttggatttatggcctccgtgtttgagaatctggacgcctccgacgtgatggaaactcctgcgttccccactgtaatgaagctgttggaggtccagcatcaggagttaagagattgcctgatcaaacatacaattttgataagaggagaattcgtgacccggagcctcaatattgcccaggctgcagatcggcgagatgccttcgtcaaggggatttacggccatctgtttctgtggattgtcaagaagattaatgcggccattttcacacctcccgcccaagacccaaagaacgttcgacgagccatcggactgctcgacatctttgggtttgaaaacttcgagaataactctttcgaacagttgtgtataaactttgctaacgaacacctgcagcaattctttgtccagcacgtgtttaccatggaacaggaggagtaccgctccgaaaatatctcttgggactacattcattacaccgataataggcctactctagatctgctggctctgaagcctatgtccataatctctctgttagatgaggaaagccggtttccacagggtactgatcttaccatgctgcagaagttgaacagcgtccatgccaataataaggcatttcttcagccaaaaaacatacatgacgccaggttcggcatcgcgcattttgctggcgaggtttattaccaagctgaagggttcctagagaaaaatagagatgtgctgtcgaccgacatcctcactctggtttacagctccaagaacaagttcctcagagagattttcaatctggagctggcggagacaaagctaggtcatggcactattcggcaggccaaggccggaaaccatctgttcaaaagtgcagactctaataaaaggccctccacactgggctcgcagttcaaacagagcctggatcaattgatgaagattctcacaaactgccagccctatttcatacgctgcatcaagcccaatgaatataagaagccactgttatttgatcgcgaactgtgtctcaggcagcttagatacagtggcatgatggaaactgtgcacatacgtaagtccggattcccaatacggtatacttttgaggaattttcccagagatttggagtgttactgccgaacgccatgagaatgcagctgcagggtaaactgaggcagatgaccctgggtatcaccgatgtttggctgcggacagataaggactggaaagcgggtaagacgaaaattttcctgagggaccaccaagatactctcctggaggtgcagcgttctcaggtgctcgaccgggcagcgttaagtattcagaaggtgctgcgagggtatcgctacaggaaggaattcttgaggcagagacgggcagctgtgactctccaggcctggtggcgcggctactgtaataggcgcaacttcaagctgatcttagtgggcttcgaacgattacaggctattgccaggagccagcccctggctcgccagtatcaagctatgcgacagcggaccgtgcagctgcaggctctgtgtagaggctacctggttcgtcagcaggtgcaggccaaaaggagagctgtagtggtcatccaggcacatgctaggggcatggcggcaaggcgaaatttccaacagcggaaggccaatgcacccctagtgatcccggctgaggggcaaaaatcgcagggagcactgcctgcaaaaaagcgcagatctatttatgacacagtgacagatacagagatggttgagaaggtattcgggtttctgcccgccatgatagggggacaagaaggacaggcctcacctcacttcgaagacctggagtccaagacgcagaaacttttggaggtagatctggacactgtgccaatggccgaggagcccgaggaggacgtggatggccttgctgagtatactttcccgaagttcgctgtgacctattttcagaaatccgccagtcacacacacatacgtcgccccctcagatatcccctgttgtaccacgaagacgacacagattgccttgcagctctagtgatctggaacgtgatcctaaggttcatgggcgaccttccagagcctgtactttacgctcggagctcacagcaagggtcgagcgttatgcggcagattcacgataccttgggcagagaacatggcgcacaggttccccaacatagccggagcgctcaggtggcctcccagttgaacattggggaggaagcactcgaaccggacggcctgggggccgatcgccctatgtctaaccttgaaaaagtgcactttatcgtgggatatgcaatacttcgcccaagtctcagggacgaaatttactgtcaaatctgcaaacagctgtccgagaatttcaagacctcctccctggcaagaggctggatcctcttaagcctttgtttgggttgctttccgccatctgagcgctttatgaagtatctgctgaatttcatcggacagggccctgctacgtacggacctttctgcgccgaacggctgaggcgcacttacgccaatggagtgagggccgagccaccaacatggctggagctgcaggccgtaaaatccaagaagcacattcccatccaggttattctcgctacaggcgagtcgctgacagtaccagtagattccgcctccacctccagagaaatgtgcatgcatatcgcccataaacagggactctcagatcatttggggttctctctgcaggtagctgtgtatgacaaattctggtcgctggggtccggccgagatcacatgatggacgccatcgccaggtgcgagcaaatggcccaagaaaggggcgaatctcagcgccagagtccctggcgcatctactttagaaaggagttctttactccatggcacgatagccgggaagacccggtctctactgaactgatctataggcaggtgctgagaggtgtgtggagcggagagtattcgttcgagaaagaggaagaactggtggaacttcttgccaggcactgttacgtgcagctgggggcctccgcagagagcaaggcagtacaggaactgcttccttcttgtattccccacaagctgtatcgaacgaagccccccgatcgttgggcttctcttgtaacagctgcttgtgcaaaggccccatacacccagaaacaggtgacccccctggcggtcagggagcaagtagttgatgccgcgcgcctgcaatggcctctcttattttcacggctgtttgaggtgattaccttgtccggacccaggctgcctaagactcagttgatactcgccgttaactggaagggcctctgctttctcgatcagcaggaaaaaatgctgctcgaactgagctttcctgaggtcatgggtctggccaccaaccgggaagcccagggcggacagcgcttgctgttgagcactatgcatgaggagtatgaatttgttagcccttctagcgtggccattgctgagctcgtagccctctttctggaaggactcaaggagagatccatttttgccatggctctccaagacaggaaggccacagacgataccaccctgctggcctttaagaagggcgacttgctcgtcctgacgaagaaacagggacttctggccagcgaaaattggactctgggacagaatgaccgcacagggaagaccggcctggtgccaatggcatgcctgtataccatacctaccgttaccaagcccagcgctcagctgctgagccttttggccatgagccccgagaaacggaagcttgctgcccaggaaggtcagtttacagaaccgagacctgaagagcctcctaaagagaaacttcatactttagaggagttcagttatgaattttttagagctccggagaaggacatggtatcgatggcagtgctgccactcgccagggctagggggcacttgtgggcttacagttgcgaacctttgcgccaacctttactgaaaagggtgcatgccaacgttgatctgtgggatatcgcgtgtcaaatcttcgccaccccgatcctaaggtatatgggagactatcccagccgacaggcttggcctaccctggaactcactgaccaaatcttcaccctcgcattgcagcaccctgccctgcaagatgaggtttattgccagatccttaaacaattgactcacaacagtaatcggcattcggaggaacgtgggtggcagctcctgtggctttgcaccggcttgttccctccaagtaaaggactgctacctcatgcacagaagttcatagacacccggcgaggaaagttactcgcccctgactgctcaagacgcatacagaaagtgctgagaaccggccctagaaagcagcctccccatcaggtggaggttgaggcagccgagcaaaatgtttcacggatttgtcataaaatctatttcccaaatgatacgagcgagatgctggaggtggtggctaacacaagagtacgcgatgtgtgtgattcaattgccacgcggttgcagttggcctcctgggaaggctgctcattatttataaaaatctcagataaggtgatctcccagaaggagggcgactttttctttgattctctgcgagaagtgtcagactgggtgaagaagaataagcctcagaaggagggagcacctgttactctgccctaccaagtttatttcatgcgcaagctttggttgaacatttcaccaggtaaggatgtcaatgcggatacgatacttcactaccaccaagagctgccgaagtatctgcggggtttccataagtgttccagagaggatgccatacacctcgccggactgatttataaggcacaatttaataatgatcggtctcagttggcctccgtgcccaaaatcctgagggagctggttccggaaaacctgactaggctgatgagttctgaggagtggaagaaaagcatcctgctcgcttatgataaacacaaggataagactgtcgaagaagccaaagtcgctttcctcaaatggatctgtaggtggcctacttttgggtctgccttcttcgaagtgaagcagacatccgagccctcatatccggatgtaatcctgattgctattaatagacatggcgtgctgctgattcatcccaagaccaaagatctgttaacgacgtacccctttaccaagatcagttcttggtcgtccgggtccacctacttccacatggccctgggcagcttgggacgcgggagccgtctcctgtgcgaaacaagtttgggatacaaaatggacgacttgctgacctcatatgttcaacagctgctaagtgcaatgaataagcaacgtggttctaaggcaccagccttggcatccacttag

SEQ ID NO: 125468 - DNA, 6351 bp, Artificial Sequence
  Description of Artificial Sequence: Synthetic coding sequence
atgtcagggttcaggctgggggaccacgtgtggctcgagcccccttccactcacaaaacaggcgtggctatcggaggcattattaaggaggccaaacctggcaaagtgctggttgaggacgacgaaggtaaggaacactggatcagagcagaggactttggggtgctgtcacccatgcaccctaattcggtccagggcgtcgatgatatgatccgccttggcgacctaaacgaagccgggatggtgcacaatctcctgatccgctaccagcagcacaagatctacacttatactggctccatcctcgttgctgtcaacccattccaggtgctgcccctttacacactcgaacaagtgcagctgtactatagtcgccacatgggcgaactgcccccacacgtctttgcaatcgccaacaactgctatttcagcatgaagcggaacaaaagggatcagtgttgtatcatcagtggcgaaagcggagccggcaagacagaaactaccaaactcatcctgcaatttcttgccacaattagtggacagcatagttggattgaacagcaagtattggaggcaaatccaatcctcgaagccttcggtaatgctaagactatccggaacgacaactcttcgcgcttcggcaagtacatagatatctacttcaatcccagcggcgtgatagaaggcgcccggatagaacagtttctgctggaaaaaagcagggtgtgccgccaggcacctgaagaaagaaactatcacattttctattgcatgctaatgggtgtgtctgcagaagacaaacagttgctcagcctgggcacaccaagtgagtaccactatctgaccatggggaactgtacttcctgcgagggcctgaatgatgctaaggactacgcacacatccgcagcgcaatgaagattctgcagttttcagatagcgaatcctgggacgtcatcaaactgctggccgccattctccatctcggcaatgttggctttatggcgagcgtgtttgaaaacctcgacgcatctgacgtaatggaaacccctgcctttcccacagtgatgaagctgctggaagtgcagcatcaggagcttagggactgtctaataaaacacacaatcctcatccgtggagaatttgttacccgctctctaaacatcgcacaggccgccgacagaagagacgccttcgttaaaggtatttacggccacctcttcctgtggatagtcaaaaagattaatgccgcgatcttcacgcctcctgcccaggatcctaagaatgtacgccgcgctattggacttttggatatatttgggttcgagaacttcgagaataattcattcgaacagctctgtattaacttcgcaaatgagcacctccagcaattttttgttcagcatgtgttcaccatggaacaagaagagtacagatcagaaaacattagctgggactacatccactacaccgacaacagacccactttagatcttctggctctgaaacctatgagtatcatctccctgcttgacgaagaatctcggtttccacagggaacagatttgactatgcttcagaagttgaactcagtacacgcaaataacaaggcattcctacagcccaagaatattcacgatgctcggtttggaattgcacattttgcaggcgaggtgtactaccaggctgaaggatttttggagaaaaacagagacgtcctgagcactgatattctgacactggtttacagcagcaaaaacaaatttctgagggagatcttcaacctggaacttgcagagaccaaactcggccacggcaccatacggcaggctaaagcagggaaccatctttttaaaagcgccgacagcaataaacgtcccagtaccctagggtcccagttcaagcaatcacttgaccagcttatgaaaattctcacaaattgtcagccctacttcatcaggtgcatcaaacctaatgaatacaagaagccgcttttgttcgatagggagctctgtctgagacagctccggtatagcgggatgatggagactgtgcacatccgaaagagcggatttcctatcagatacacctttgaggagttttcacaaaggttcggggttcttctccccaacgccatgaggatgcagctccaagggaaactgcgacaaatgaccctcggcatcactgatgtgtggctgagaactgacaaggattggaaggcagggaaaactaaaatttttctaagagatcaccaggatacgctattggaggtgcaacgatcccaggtcctagatcgcgctgccctgagcattcaaaaggtcctcagggggtacaggtatcgaaaggagtttctccggcagagacgtgccgccgtcacactgcaagcctggtggcgtggctactgcaatagaagaaacttcaagcttattttagtaggattcgagcgccttcaggccattgctcgctcacagcctctggcccgccagtatcaggcaatgaggcaaagaactgttcagttgcaagccctgtgccggggttatctcgtgcgtcagcaggtgcaggccaaacgccgagccgtggtagttatccaggcacacgccaggggcatggctgcccggaggaacttccagcagcgcaaggccaatgcacccctcgtgatccctgcagagggacaaaagagtcagggagctctgcccgcaaagaagcgtaggagcatatacgataccgtgacggacaccgagatggtcgaaaaggtgttcgggtttcttcctgcaatgatcgggggccaggagggtcaagcgagtcctcactttgaagacctggagagtaaaacacagaaacttcttgaggtcgatcttgatacggtgccaatggccgaagagccagaagaggatgtggatgggttagctgaatataccttccccaaattcgcagtcacatactttcaaaagagtgcaagccacacccacattagacggccacttagatatcctcttttataccacgaagatgataccgattgtctggctgctctggtcatttggaacgttatcttacgattcatgggcgacctgccagagcccgttctttatgcacggagttctcagcaagggtcatccgttatgcgacagattcacgatacattaggtcgggagcacggggcacaagtccctcagcattctcggtccgctcaagtggcttcccagctgaatataggcgaggaggcgctggaaccagatggtctgggagctgacagacctatgtcgaacttagagaaggtgcattttatagtaggatatgcaattctccgaccatctcttcgcgacgagatttattgtcaaatctgcaaacagctcagcgaaaattttaaaaccagctctctggcaaggggctggatactgctcagcctgtgcctggggtgctttcccccctctgaacggttcatgaaatatcttctgaatttcattggacaggggccagctacctacggcccattttgtgccgaacggctccgtaggacctatgccaacggagttcgagccgagccacccacctggttagaactccaggccgtgaaatcgaagaaacacatccctatccaagtgattctggcaactggtgagtcgctgacagtaccagtggactcagctagtacaagtcgggaaatgtgcatgcacattgcgcataagcaagggctcagcgatcaccttggcttttctttgcaggttgccgtctacgacaaattctggagtcttggtagtggtcgggatcacatgatggatgcaattgctagatgcgagcagatggcccaggagaggggagagtctcagaggcagtccccatggaggatatattttaggaaggagttcttcaccccttggcacgatagtcgagaggacccagtgtccaccgaactgatctacagacaggtgctgcgaggcgtgtggagcggagagtactcctttgaaaaagaagaggagctggtggaattgctggccaggcattgttacgtccagctcggtgcctctgcagagagcaaggcagtgcaggaactgcttccgtcctgcatccctcacaagctgtaccgcaccaagccaccggaccgctgggcttctctcgtcacggccgcctgtgctaaggcaccctacactcagaagcaagtcacacccctcgcggtgcgggaacaagtggttgatgccgcccgactccagtggccactgctgttcagccgtctcttcgaggtgatcactctgtccggcccacggctgcccaagactcagcttatactcgcagtgaactggaagggcctgtgttttcttgatcagcaagagaaaatgctgctcgaattaagttttcctgaggtgatgggcctggccacaaatcgagaggcacagggcgggcagcggctgctgctgagtacaatgcacgaggagtacgagttcgtcagtccctcttccgtggccattgcagagttggtggccctattcctcgaggggttgaaggagaggtctatctttgcaatggccctgcaagacaggaaggccacagacgacaccacactgctggcatttaaaaagggcgacctcctcgtgcttactaaaaagcagggtctgttagcctctgagaactggacattgggtcagaacgaccgaaccggcaagactggtctcgtacctatggcctgtctttatactatccccacagtgacaaaaccctcagctcagctgctcagtctcctagcgatgagtcccgagaagcgcaagctggccgctcaggagggccaattcacagagccgaggccagaagaaccccctaaggaaaaactgcataccctcgaggagttctcctacgaattcttccgagcccctgagaaagatatggtgagtatggcagtgctgccccttgcgagggctcggggacacctgtgggcctacagttgcgaaccgctgcggcagccactgctcaagcgtgtgcatgcaaatgtcgatctctgggatatagcttgccagatattcgtggcgatccttaggtacatgggggattatccgtccaggcaggcatggcccacactggagctgaccgaccaaatattcacactcgccctgcaacaccctgccttgcaggatgaggtgtactgtcagatcctcaaacagttaacacataatagcaatcggcattctgaagagcggggctggcaactgctgtggctgtgcacaggtttgttccccccaagcaagggtctgttgccacacgctcagaaatttattgacactcgacgcggtaaactcctggcccccgactgttcacgtagaattcaaaaagttctgcgcacgggaccacggaaacaacccccacatcaggtggaggtggaggcagccgagcaaaacgtgtcccgaatttgccacaagatctatttccccaacgatactagtgaaatgttggaggtagttgccaacactagggtgcgcgacgtgtgtgacagcatcgccacacgactgcagctggcttcatgggagggctgttccctgtttatcaaaatctcagataaggtcattagtcagaaggaaggcgacttttttttcgactcgctccgtgaagtatccgattgggtgaagaagaataagccccaaaaagagggtgctcctgtgaccctgccgtaccaggtgtactttatgagaaagctgtggttgaacatttctcctgggaaagacgtgaacgctgacactatcctgcattaccatcaggagctgcccaagtacttacgtggttttcataagtgttcacgggaagacgctattcacctggcgggcctcatatacaaggcacagtttaataacgatcgttcccagctggcctccgtgccaaaaattctccgcgaactggtgcccgagaacctcactcggctaatgtcctctgaagagtggaagaaatcaatcctgctagcctatgataagcacaaagataagactgtcgaagaagccaaagttgctttcctgaaatggatatgtagatggccaacttttggatccgccttctttgaggtgaagcaaacaagtgagccctcttatccagatgttatcctgatcgccatcaaccgacatggcgtcttgctcattcatcctaaaaccaaggatctcctgactacctatccttttactaagatctcctcctggagctccggttccacctatttccatatggcacttggtagcctaggcaggggcagcagattactgtgcgagacgtccctaggctacaagatggacgacttactcacgagttacgttcagcagctgctgagcgctatgaataaacagcgcggctcaaaagcccctgcacttgccagcacgtag

SEQ ID NO: 125469 - DNA, 6351 bp, Artificial Sequence
  Description of Artificial Sequence: Synthetic coding sequence
atgagcgggtttcgcctgggggaccacgtttggctggaaccgcccagtacccacaaaaccggcgtggctatcggcggtataatcaaagaagccaagcccggtaaagtgctcgtggaggacgacgaaggtaaagagcattggattcgggccgaggactttggggtattgtcccctatgcatcctaattccgtgcagggagttgacgacatgatccggctgggggatttgaacgaggcgggaatggttcacaatttactaataaggtatcagcaacacaagatatatacttatactgggtcaattcttgttgccgtgaaccccttccaggtgcttccactgtacacattagaacaggttcaattgtactacagtagacatatgggcgagttacctccccacgtcttcgcaattgcaaataattgctattttagtatgaagcggaacaagcgcgatcagtgctgcattatcagtggtgaaagcggcgcaggcaagactgaaactactaagctcattctgcagtttctggccacaatttcaggccagcacagttggatcgagcaacaagttcttgaagcaaacccaattctcgaggcctttgggaacgcaaagactatccgtaatgacaatagtagtcgcttcggtaagtacattgacatctacttcaatccttccggcgtcatagaaggagctcgaatcgaacagtttctgctcgagaagagtcgagtgtgtagacaggctcccgaagagaggaactaccacatattttactgcatgttgatgggcgtctccgctgaggacaagcagcttttgagtttgggcactccatccgagtatcactaccttacaatgggcaattgtacgtcatgcgagggcctgaacgatgccaaagactacgcacatattaggtctgcgatgaagatcttgcagttctcagatagcgagtcatgggacgtaattaaactactggcagctatcctgcatcttggcaacgtaggcttcatggcttccgtgtttgagaacctggatgcctctgacgttatggaaacccccgcatttcctactgtgatgaaactgttagaggtgcagcatcaggaactccgagactgcctgatcaagcacaccatcttaattaggggcgaatttgtgaccagatccctcaacatcgcccaggccgctgatcggagggatgctttcgtgaaaggcatctacgggcacctgtttctttggatagtcaaaaaaattaatgcggccatcttcacacctcctgctcaggaccctaagaatgttagacgtgctatcggacttctcgacatattcggattcgagaacttcgagaataacagcttcgaacagttgtgtatcaacttcgccaacgagcatttacaacagttcttcgtgcagcacgtattcacgatggagcaggaagagtatagatcggaaaacatctcttgggactacatacactataccgacaaccggcccacactcgatctcctggctttgaaacccatgagcatcatttcactgctggatgaagagagccgctttcctcagggcacagacctcacaatgctgcaaaaattaaacagcgtccacgccaacaacaaggcttttctgcagcccaaaaatattcatgatgccaggtttggcatcgcccattttgctggtgaggtctactatcaggcagaaggtttcctggagaagaaccgggatgtgcttagtaccgacattctaacgctggtctatagcagcaaaaataagtttctccgcgagatctttaatctggaattggcggaaaccaagctcgggcatggaacgatcaggcaagccaaggcaggaaaccacctgttcaagagcgcagactctaacaagcggccctctactctgggtagtcagtttaagcagtcactggaccagcttatgaaaatcttgacaaactgtcaaccctattttatccgctgcataaaacccaacgagtacaaaaagccactgctctttgatagagagctttgcttacgacagcttcggtactcgggcatgatggagacagtacacattagaaagagtggcttccccatccggtatacatttgaggaattctctcagagatttggtgtactcctgcctaacgccatgaggatgcagttgcagggtaagctccgccagatgacattggggattaccgatgtgtggctgagaactgacaaggactggaaagccgggaaaacaaaaatcttcttgcgtgaccatcaggacactcttttggaagtacagcggagccaggtcttagaccgggcggctctttcaatacagaaagttcttcgcggctacagataccgaaaggagttcctccgccagaggcgggctgctgtgacactgcaggcttggtggaggggctattgtaataggagaaacttcaaattgatcctggtgggctttgaaaggctgcaagccatagcccgtagccagccactggcacgacaatatcaagccatgagacagcggaccgtgcaactccaggcgctttgtcgcgggtatctcgtaaggcagcaggtccaggccaagcggagagccgtggttgtgatacaggctcacgcccgggggatggctgcacgtcgcaacttccaacagaggaaagccaatgcccctttggtcattcccgccgaagggcaaaagtctcagggggctctcccagctaagaaacgccgaagtatatatgacacagtgacagacacagaaatggttgagaaagtgtttggttttctgcccgcaatgatcgggggtcaggagggccaggcctcaccacacttcgaagacctagagtccaagacccagaaactcctggaagtggatcttgatactgtgcccatggctgaggagcctgaagaggacgtggacggtcttgcagagtatacctttccaaagtttgcagtgacctacttccagaagtccgctagtcacacccacattcgccgtccactacgatatccgctgctataccacgaagatgacactgattgcttagctgccttagtgatctggaatgtgatcttacggttcatgggtgatttgccagagccagtactttacgcgcgctctagccagcaaggaagttcggtaatgagacagatccatgatacactaggccgggagcacggggctcaagttccccaacacagccgctctgcccaggtcgcatcccaactgaatattggggaagaggctttggagcccgacggattaggagcagaccgccccatgagcaacctggagaaggtgcatttcatcgtcggctatgcgattctgcggccatcgttaagggacgagatctattgtcaaatctgcaagcagcttagcgagaactttaagacatcctccttagcccgaggctggattctcctgagtctgtgtctgggctgttttccaccgtccgagcgctttatgaagtacctgcttaattttattggccaggggcctgccacatacggaccgttctgcgccgaacgcctcaggagaacatatgccaacggcgtcagggctgagccaccgacttggctggagttgcaggcggtgaagagcaagaaacacatacctatccaggtgatcctcgccaccggcgagtcattaactgtaccggttgatagcgcctctacatctagagagatgtgcatgcatatcgctcacaagcaaggtctgagcgaccatttgggcttcagcctgcaagtggcagtgtacgacaagttttggtcccttggtagcggaagagaccacatgatggacgcaatagcccgatgcgagcagatggcccaggaaagaggcgaatcacagcggcagtccccctggcgcatctatttcaggaaggagtttttcaccccgtggcatgattcacgcgaggatcccgtgagtactgagctgatatacagacaggtgctccgaggggtgtggtcaggcgaatactccttcgagaaggaggaagagcttgttgagcttcttgcccgtcactgctacgtacaattgggcgcttcagccgagtctaaggctgtgcaggagctcctgcccagctgtattccccataagctgtacagaacaaaaccccccgaccggtgggcctctttggtgacggcagcctgtgctaaggccccgtatacacagaagcaggttactccactggctgtgagggaacaggtcgtcgacgccgcccggctgcagtggcccctattgttttcaaggttatttgaggtaattacactgtcgggacctagattgcctaaaacccagttgatccttgcagtcaattggaaagggctctgcttccttgaccagcaggaaaagatgctcctggagttgtcgtttccagaggtgatgggcttggccacgaacagggaggcccaggggggccagcgactgcttctgagtacaatgcatgaggaatacgagttcgtctcaccgtcatcagttgctatcgccgaactggtagccttgtttcttgagggcttgaaggagagatctatttttgctatggctctgcaggaccgcaaagccacagatgacaccaccctcctcgctttcaaaaagggggacttattagtgttgacaaaaaagcagggattgctggcctctgagaactggacactagggcagaatgataggaccggcaagacaggcctggttcccatggcttgcctgtacacgatacccacagtcacaaaacctagtgcccagttgctgtctcttctggcgatgtctcctgagaagcggaaactcgctgcacaggagggtcagtttaccgagcccaggccagaggaacctcccaaggagaagcttcacacacttgaagagttctcgtacgaattctttcgcgcacccgaaaaagacatggtcagcatggctgtgctaccgctggcccgcgctcgcgggcatttatgggcgtacagttgtgagcctcttaggcagcccctgctgaagcgcgtacacgccaatgtcgacctgtgggacatcgcttgccagatcttcgtagcaatacttaggtacatgggtgattacccatccagacaggcctggcccacgctggaattaacagaccagattttcactctagcactgcagcaccccgccctccaagacgaagtctattgtcagatccttaaacagctgacccacaatagcaacaggcattcagaagagcggggatggcagcttctatggctgtgcaccggcctgttcccacccagcaagggactgctccctcatgcccagaagttcattgacactaggcgcggcaaactcctggcccccgattgcagcaggagaatacagaaagttctgcgtactggaccccgaaaacaacctccacatcaggttgaggtggaagccgctgagcagaacgtgtccagaatatgccataagatttattttcccaatgataccagcgagatgttagaggttgttgcaaacacaagggtgcgggatgtttgcgattcaatagccactcgactccagctggccagctgggaaggatgttccctgttcattaaaatcagcgacaaggtgatctctcagaaggagggagacttcttttttgactcgctgcgcgaggtaagcgattgggtcaagaagaacaaaccccaaaaagaaggggcacccgtcacactcccataccaggtctatttcatgcggaagctatggctcaacatctcaccaggaaaagatgtgaacgcggataccatcttgcactatcaccaagagctgccaaaatacctcaggggcttccacaagtgttcacgagaagatgctatccacttagctggccttatttacaaagcgcagtttaataatgatagatcccagctcgcatctgtcccaaagattctccgggagctggtcccggagaacctcacccggctgatgtcttccgaagaatggaaaaaatctatcctgttggcttacgataagcataaggacaagacagttgaggaggcgaaggtggctttcttgaaatggatatgcaggtggcccactttcggctcagcattcttcgaagttaagcagactagcgagccaagttaccctgacgtgatcttgatcgctattaacagacacggtgtgctcctgatccatccaaagactaaagacctgcttaccacataccctttcaccaagatctcgtcttggtcttcaggcagcacctacttccatatggctctgggaagccttggaaggggctcacgcctgctctgtgaaacgtcattgggctacaagatggacgatctcctgaccagctacgtccaacagctactctcagcaatgaacaagcagagggggagcaaggcacccgcacttgcgtcaacttag

SEQ ID NO: 125470 - DNA, 4248 bp, Artificial Sequence
  Description of Artificial Sequence: Synthetic coding sequence
atgcctgatcagttcgaccaagctgtggtcctgaatcaattgagatacagcggaatgctcgagacagtgaggattcggaaggcaggatacgcagtgagacggccatttcaggatttctataaaagatataaggtcctgatgagaaacttggccctgcctgaggacgtccgcggtaaatgcacttccctactccagctgtatgacgcttcaaattcagagtggcaactcggaaaaactaaagtgttcctgcgcgaaagtttagagcagaaactagaaaagcggcgagaagaggaagtctcacacgctgcaatggtgattcgggctcacgttcttggcttcttggcacggaagcaatatcgaaaggtcctgtactgcgtggtgatcattcagaaaaactacagggcatttctcctgagaaggaggttcttacacctgaagaaggcagcgatagtgttccagaagcagctgcggggacagatcgcgcgccgagtctatagacaacttctggccgagaaaagggagcaagaagaaaagaagaagcaagaagaggaagagaagaaaaagcgggaggaagaagaaagagaaagggagcgcgaacgtcgcgaggccgaattgagggcccagcaggaagaggagacacgcaagcagcaggagttggaagcactccaaaaaagtcagaaagaggccgagctcacacgtgaacttgaaaaacaaaaggagaacaaacaggttgaggagatcctgcgcctggaaaaagagattgaggatctccagagaatgaaggagcagcaggagctttccttgactgaggcgtcgctgcagaagttacaagagaggagggaccaggaactcaggagattagaagaggaggcatgtcgggccgcccaggagtttttagagtcactcaatttcgacgagattgacgagtgtgtgcgaaatatcgagagaagtctatccgtgggcagtgaatttagtagtgagcttgctgagagcgcgtgcgaagagaaacccaatttcaatttcagccagccctaccccgaggaagaggttgatgagggtttcgaagcagatgacgatgcatttaaggattctccgaatccaagtgaacacggacattccgaccagaggactagcggcattagaacatccgacgatagctctgaggaggacccctatatgaatgatacagtcgtgcctacctccccgtcggctgactcaacagtgttattggcaccttctgtacaggatagcggaagccttcacaactctagcagcggggaatcaacctactgtatgcctcagaacgctggcgatctgcccagccccgacggtgattatgattacgatcaggacgactacgaggacggagctataacttcagggagctcagtcacattttcaaactcctatggatcccagtggtccccagactatcggtgtagcgtagggacctacaactcctccggtgcctaccgtttcagttctgagggcgcccagagctcattcgaggattctgaggaagatttcgattcaaggttcgataccgatgacgaattgtcttataggcgggattcagtatactcatgtgtgacacttccttattttcactcatttttgtatatgaaggggggtctgatgaattcctggaagcgcagatggtgcgtgctgaaggacgagaccttcctatggtttcggagcaagcaggaggcgctgaagcagggctggctgcacaagaagggcggcggatcttcaaccttaagtcgaaggaactggaaaaagcgatggtttgtcctccggcagtctaagctgatgtatttcgagaacgatagtgaggagaagcttaagggtactgtcgaagttaggacagccaaagagatcatcgataatactaccaaggagaatggtatcgatatcatcatggccgacaggacgttccatttgatcgcagaaagtcctgaggacgccagtcaatggttcagcgtcttaagccaggttcacgcctctaccgaccaagagatccaggaaatgcacgatgaacaggctaatccgcagaatgctgtggggactctggacgtgggattaatagattcagtgtgcgcttccgacagtcccgacaggcccaactcttttgtgattattaccgcaaatagggttttgcattgcaatgccgacactccggaggaaatgcaccattggatcactctgttgcaaagaagcaagggggacactcgggtcgaaggccaggagttcatcgtgcgggggtggttacacaaggaagtgaaaaacagccctaaaatgagctcactgaaattaaaaaagcgctggttcgtcttaacacacaatagtctggactactacaaaagcagcgaaaaaaatgccttaaaactggggacgctggtcctcaatagcctctgcagtgttgttcccccagacgagaaaatctttaaagagacagggtattggaacgtgaccgtgtatggaagaaaacactgttatagactgtacacaaagctcctcaatgaagcgacccggtggagtagcgctatacaaaacgtgactgatacaaaggccccaatcgataccccaacccagcaactgatacaagatatcaaagaaaattgcctgaatagcgacgttgtcgagcagatttacaaaaggaatcctatcctccgttacacgcatcatcctttgcactctccgctcctcccgctgccgtatggtgacatcaacctcaacctgctgaaagacaaaggttacacaaccctacaagacgaggcaatcaagattttcaacagcctgcagcaactcgaatccatgtctgatcctatcccaatcattcaggggatacttcagactggccacgacctacgccctttacgggatgaattgtactgtcagttgattaagcaaactaacaaggtgccccatcccgggagtgtgggaaacttgtactcttggcagatcctcacatgcctgtcctgtacttttctgccttcccgaggaattctgaaatacctgaagttccacctgaaacgtatccgggaacagtttcctggatcagaaatggagaaatacgcactgtttacctacgaatccctgaagaagacaaaatgtcgggagtttgtgccgtcccgagacgagattgaggccctgatccatcggcaggagatgacctctaccgtgtattgccacggggggggttcatgtaagatcactattaattcccatacaaccgccggtgaggttgtcgagaagctgattcgggggctggcaatggaagactcccggaacatgttcgccctgttcgagtataatggacatgtggataaggctatcgagtctagaacagtggtggccgatgtgctggctaaattcgaaaaattagcagcgacaagtgaagtgggggatcttccgtggaagttttactttaaactttattgcttcctggatacagacaatgtccccaaggatagcgtcgagtttgcctttatgtttgagcaggcccatgaggctgttattcatggacaccaccctgcaccagaggagaatctccaggtcttggctgccctgcggcttcagtatcttcagggggattacaccttacacgctgcgattccaccgcttgaggaggtgtacagcctgcagaggctaaaagccaggattagccagtccacgaagacatttactccatgcgagcgtctcgagaagaggcgtacgagcttcctggagggcacattgagacgctcttttagaacaggttcagtggtgcgacaaaaagtcgaggaggaacaaatgctagacatgtggataaaagaggaggtgtcaagtgctagagcctctattatcgataagtggagaaagttccaggggatgaatcaagagcaggccatggcaaagtatatggccctaattaaagagtggcctggctatgggagcactctgtttgatgttgaatgcaaagaaggcggtttcccccaagagctgtggctgggtgtgtctgcagacgccgtctccgtctacaagcgcggagaggggaggccacttgaggtttttcagtacgagcacatcttgtctttcggagcccctcttgctaatacatacaagatcgtggtggatgaaagagaactgctgttcgagacttccgaagttgtcgacgtggcgaaactgatgaaagcctacatctccatgatcgtgaagaaaaggtacagtacgacaaggtcggccagtagccaaggaagttcccgatag

SEQ ID NO: 125471 - DNA, 4248 bp, Artificial Sequence
  Description of Artificial Sequence: Synthetic coding sequence
atgccggaccagttcgaccaggcagttgtgctgaatcaactcaggtatagcggcatgctggaaacagtgaggatccgaaaggcagggtacgccgtgcgtcggcctttccaagatttctacaaacgctataaggtactgatgcgcaatttggccctaccagaagatgttcgaggtaagtgcaccagcctgctccaactttatgacgcctctaatagtgagtggcagctgggcaagactaaagtgtttttacgtgaatctctggaacagaagttggagaagcggagggaggaggaagtgtcacatgctgccatggtgattagggcacacgtcctcggtttcctagcccgtaagcagtatagaaaggtcctctattgtgtggtaatcatccagaagaattaccgtgctttcctgttgcgtcgtcggtttctccatctgaagaaggcagccattgtatttcagaaacaattgcgcggccaaatagcgcgccgtgtgtatcgccagctactggcggagaagcgggagcaagaggaaaagaagaaacaggaggaagaggagaaaaagaagcgcgaagaagaggaacgcgaacgagaaagagaaaggagggaagctgaactgagagcccagcaggaagaggagacccgtaagcagcaggagctcgaggcactccagaaaagccagaaggaggcggaactcacccgagagttggagaaacaaaaggagaataaacaggtcgaagaaattctgcgcctggaaaaggagatcgaggacctacagaggatgaaggagcagcaggaactgtctctcactgaggccagcctccagaaattacaagaaaggagggatcaggagctacgccggttggaggaagaggcctgcagggctgcacaggagttcttggaatcccttaatttcgacgaaatagatgagtgcgtgagaaacatagagaggtctctgagtgtgggatccgaattctcaagcgaacttgcagagtctgcctgtgaggagaaacctaactttaacttcagccagccctaccccgaagaggaggtagatgagggatttgaggccgacgatgatgcttttaaggatagcccgaatcctagcgagcacgggcacagcgaccaacggactagtggcatcagaacatcggatgatagttctgaggaggatccctatatgaatgatactgtggtgcctacttcaccctccgccgactcgacagtactgttggccccgagcgtccaggacagcgggtccctccataactcctcgtctggcgaatctacctattgcatgcctcaaaatgctggcgatcttccgtcccctgacggagactatgactacgaccaggacgactacgaagacggggccatcacatcgggttcgtcagtgacattttccaattcctacggatctcagtggtcaccagactatcgttgctccgtgggtacctacaactctagtggagcctaccgtttctcaagcgagggtgcccagtcaagcttcgaagattccgaagaggacttcgactccagattcgacacagacgatgaactgtcatatagacgagacagtgtgtacagctgcgtaactctaccttacttccacagctttctgtacatgaaggggggtctaatgaacagctggaaacgccgctggtgtgtgctcaaagacgaaacattcctttggttcaggtcaaagcaggaggcgctgaagcagggctggttgcataagaagggcggtggcagctcaaccctgtcacgccgtaattggaaaaagcgatggttcgtgctcagacaatctaaacttatgtatttcgagaatgacagtgaagagaagctgaaagggaccgtggaagtgaggacagctaaggaaattattgataacacaactaaggagaatggcatagacatcataatggccgatcgcacctttcacctcattgccgaatccccggaggacgccagccagtggtttagtgtgctgagccaggtgcatgctagcactgatcaggagatacaggagatgcatgatgagcaggcaaatccacagaatgctgtgggcactctggacgttggactgatagattccgtctgcgcgagcgattcgccggatcgtcccaactcctttgtcataataaccgcaaatcgtgtgctgcattgtaatgcagacacacctgaggaaatgcaccactggatcactttgctgcagagaagcaagggggatacaagggttgagggccaggagttcatcgtcaggggatggctgcacaaggaggtaaagaattcaccaaagatgtctagtctcaaactgaagaagagatggttcgttctcactcacaacagcctggattattataaatcatcagagaagaacgccctgaagctgggcactttggtgctgaatagcctgtgctccgttgtgcctcccgacgagaaaatcttcaaagagacagggtattggaatgtgacggtttacgggcgcaagcattgctaccgcctgtacacaaagctcctaaatgaggcgactcggtggtccagcgcgatccagaacgtgaccgacacgaaggcaccaatcgacaccccaacccagcaattgattcaagatataaaagagaactgccttaattcagatgtggtagagcagatttacaagcggaatccaatattgagatacacacatcacccgctgcattccccacttctgccactgccctacggagatatcaatctgaatctcctgaaagataaaggctacaccaccctgcaggacgaagccattaagatatttaacagcctgcagcagctggagtcaatgagtgatccaatacctataatccaggggatcctgcaaactggacacgacctgcgtcccctgcgagacgaactatattgtcagctgatcaaacaaacgaacaaggtaccgcatccaggatcagtcggcaacctctatagctggcaaattttgacctgcctctcctgcacctttctgccctcccggggcatactgaagtatctcaagtttcacttgaaaaggatccgcgagcaattccctggaagcgaaatggagaaatatgctctttttacctacgagagcctgaagaagacgaagtgcagggagtttgtgccgagtagggacgaaattgaggccctgatacaccggcaggagatgacatcaacagtctactgtcacggagggggctcttgcaagatcactataaattcccatacaactgctggcgaagtagtcgaaaaactgatcaggggccttgccatggaggatagccgtaacatgtttgctctattcgagtacaatggccacgttgataaagcaatagaatctagaaccgtggtggcagacgtccttgccaagtttgagaagttagcggccacctccgaggtgggtgatctgccgtggaagttctatttcaagctgtactgtttcctggataccgacaatgtcccaaaggactcagtggagttcgctttcatgttcgaacaggcacacgaagcagtcattcatggtcatcatcccgccccggaggagaatctgcaggtgttagcagccctcaggttacagtacctccagggcgattacactctgcatgctgcaatcccacccctcgaggaggtttactcactgcagcggcttaaagcccgaatttcacagtcaaccaagacgttcacgccatgtgagaggctcgagaagagacggacatcatttctcgaaggcaccctgcgacgctcattcaggaccggctcagtcgttcggcaaaaggtggaggaggaacagatgctggatatgtggattaaagaagaagtgtcatctgctagggcttctattatagataagtggcggaagtttcaaggaatgaatcaggaacaggccatggctaaatatatggccctgattaaggaatggccaggttatggctccacgctctttgacgttgaatgtaaagagggtggatttccccaggaactgtggttaggcgtcagtgcagatgcagttagtgtatacaagcggggcgaggggaggcctctggaggtctttcagtacgaacacatcctgtcattcggtgccccgctcgccaatacgtataaaatcgttgtcgatgagcgggagctgttgttcgagacaagcgaggtggtcgacgtggcaaagctaatgaaggcctatatctcaatgatcgtaaagaagcgttatagtacaacgcgcagcgcatcaagccaggggtcctcaagatag

SEQ ID NO: 125472 - DNA, 4194 bp, Artificial Sequence
  Description of Artificial Sequence: Synthetic coding sequence
atgctcgaaacggtgcggatccggaaagccggttatgcggtgcggcgacccttccaagatttctacaagcgttacaaggtgctaatgagaaacttagccttacccgaggatgtgagaggcaaatgtaccagtcttctgcagctctacgatgcaagcaactcggaatggcagcttgggaaaacaaaagtttttctaagagaatcattggagcaaaaactggagaaacgacgcgaagaggaggtgtctcacgcagccatggtcatccgagctcatgtgctgggttttctggccagaaagcagtacaggaaggtgctgtactgcgtagtcatcatacaaaagaactaccgagcttttttgctgcggagaagattcctgcacttgaagaaagctgccatcgtctttcaaaagcagttgcgcggccagatcgccagacgggtctacaggcaactgttggcagagaagagggaacaggaggaaaaaaagaagcaggaagaggaggaaaagaaaaagcgtgaagaggaagagcgggaacgtgagcgggaacgacgggaggctgagctgcgggcacaacaggaggaggagacaaggaaacagcaggagttggaggctctgcagaagtctcagaaggaggcggaacttacccgggagctcgagaaacagaaagagaacaaacaggttgaagaaatcctgcgactggagaaggagattgaagacctgcaacggatgaaagaacagcaggagctgtctctaactgaagcctccttgcagaaactgcaggagcgacgcgaccaagagctccggaggctcgaagaagaggcatgcagggccgctcaagagttcctcgaaagcctcaatttcgatgaaatcgatgagtgtgtgcgtaatatcgagcggtccctgagcgtgggcagcgagttctcaagcgagctcgccgagagcgcctgtgaagagaaacccaacttcaacttctcccagccctatcccgaggaggaggttgacgagggattcgaggccgatgacgatgccttcaaggacagtcctaaccctagtgagcacggacactccgaccagaggaccagtggcatcagaactagcgacgattcatccgaggaagatccctatatgaacgatacagttgttccaaccagcccctccgcagattctacagtcttgctcgcgccatctgtccaagattccggatcccttcataacagtagctccggagaaagtacttactgcatgccccagaacgccggcgatctgccttcgccagacggcgattacgactacgatcaggatgactacgaggacggcgcaatcacgtctgggtcgagcgtgaccttcagtaatagttacggctcccagtggagcccagattatcgatgctccgtcggaacttacaacagtagcggcgcctatagattttcctccgagggagcccagtcctcttttgaggactcagaggaagattttgacagcaggtttgataccgacgatgagctcagctaccgacgggattcagtgtacagttgcgtgaccctgccatatttccacagtttcctctatatgaagggaggcttaatgaattcctggaagcgacgctggtgtgtgctgaaggacgaaaccttcctatggtttcgctcaaaacaagaggcactaaagcaggggtggcttcacaagaaaggcgggggatcctcaacactttcacggcggaactggaaaaaacggtggttcgttttgcgccaatccaagctcatgtactttgagaacgatagtgaggaaaaacttaaagggaccgtggaggtgaggaccgccaaagagataatcgataacacaacaaaagagaatggtattgacatcatcatggccgatagaaccttccatctgattgctgagagccctgaagatgcatcccagtggttttcagtgctctcacaggtgcacgcgagtacagaccaagagattcaagagatgcatgacgagcaggccaatccacagaacgccgtcggcacactcgacgtggggcttatagactccgtttgcgcaagtgatagtccagataggcccaattcatttgtgatcatcacagcgaatcgggtcttacactgcaatgctgatacacccgaagagatgcaccactggataactttactgcagcgctcaaagggagacaccagagtggaagggcaggagtttatcgtgagggggtggcttcacaaagaagtgaagaattcgcctaaaatgtccagtttgaagctgaagaagaggtggttcgtcctgacccataatagtttggactattataaatcgagtgaaaagaatgctcttaaactcggcacactggtcttaaatagcctgtgttcggtcgtgcccccagacgagaagattttcaaagaaacgggctactggaacgtgaccgtgtacggaaggaagcattgctataggctgtatacaaagctcctgaatgaggcaactcgctggagttctgccattcagaatgtgacagacactaaggcacccatagatactcccacgcaacagctaattcaggatatcaaagagaactgcttgaactctgatgtggttgaacagatttataaacgaaatcccattctgcggtatacccatcatcccctgcattcccctctcctacctctgccctacggcgacatcaatttgaatctgctgaaggacaagggatatacgacactgcaggacgaggcgattaagattttcaactcactgcaacagctcgaaagcatgagcgatcccattcccatcattcagggcatcctgcagaccggccacgacctccgccccctgagagacgagctgtactgccagttaatcaagcaaactaacaaggtgcctcaccccggctctgtaggcaacctttactcttggcagattctgacctgcctgagctgtacatttcttccctcgcggggaatcctaaagtacctgaagttccacctgaaacgcattcgcgagcagtttccaggcagcgagatggaaaaatacgctctgtttacctatgagtctttgaagaaaactaaatgcagagaatttgtgccgtctcgcgacgagatagaagccctgattcacagacaggaaatgacctccaccgtttattgccatggcggcggatcttgcaagattacgatcaattcacataccacagccggcgaagtggtagagaaactgatacgcggtctggcaatggaggacagtcgtaacatgtttgctctcttcgaatataacggtcacgtggacaaggctatcgagagtagaactgttgtggccgacgtcctggctaaatttgaaaagctggccgctaccagtgaagttggcgatttgccgtggaagttttattttaaactttactgttttctggacacagataacgtgcctaaagatagcgttgagtttgcatttatgttcgagcaggcccatgaagccgttattcacggccaccatcccgcccccgaggagaacctgcaggtgcttgcagcacttcgccttcagtacctgcagggagattacacactgcatgccgcgatcccacctcttgaggaggtgtatagtttacagcggcttaaggctcggattagccagtcaactaaaacgtttaccccctgcgaaaggctggagaaacgaaggacaagttttctcgagggaaccctgaggcggagctttagaacagggtccgttgtacgtcagaaggtggaggaagagcagatgctggacatgtggatcaaagaggaagtctcatccgccagggcttcaattatcgacaagtggcggaagttccagggcatgaatcaggaacaggccatggccaagtatatggccttgatcaaggagtggcccggctatggttccactcttttcgacgtcgaatgcaaggagggaggattccctcaggagctttggctcggtgtgtctgccgatgcagtcagcgtttacaaaaggggtgagggacggcctctcgaggtgttccagtacgaacacattctttcgtttggcgcccctcttgccaatacatataaaattgtggttgacgagagggaactgctttttgagacctctgaggttgtggatgttgccaagcttatgaaagcctatataagtatgatagtaaagaagcgctactctaccacccggtcagcttctagccagggatcttctagatag

SEQ ID NO: 125473 - DNA, 6177 bp, Artificial Sequence
  Description of Artificial Sequence: Synthetic coding sequence
atggataacttttttacagaaggcacacgtgtatggctacgagagaatgggcagcacttcccatccacagtcaacagttgcgcggaaggaatcgtcgtcttccgtacagattatgggcaggtatttacatataagcagagcactatcactcatcaaaaagtcacggccatgcaccccaccaacgaagaaggagtggacgacatggcttcactcacagagttacacgggggctcaatcatgtacaatctctttcagaggtacaaacgcaatcagatctacacctatattggaagtatcctggcatctgtgaacccatatcaaccaatcgcgggcctttacgaacccgccacaatggaacaatactccaggcgacatcttggtgagctacccccacatatcttcgccatagccaatgaatgttacagatgtctgtggaaaagacacgacaaccaatgtatactgattagtggggagagcggtgccggcaagacagagtcaactaagctaattttgaagtttctgtccgttatctcccagcagtctcttgagctgtctttgaaagaaaaaacgagttgcgtcgagcgagctatcctcgaatcctcaccaatcatggaggcatttggcaatgctaaaacagtgtacaacaacaacagttctcggtttggaaaatttgttcagctcaatatttgccagaaaggaaatatccagggcggcaggatcgtggactatttactggagaagaatcgcgttgtacgacagaatcctggcgaacgaaactaccatatattttacgctcttctggccggcctggagcatgaggagcgcgaggagttttacttatctacccccgagaactatcactaccttaatcagagtggatgtgtggaggataagaccatctcagatcaggagtcctttagggaggtgatcacagccatggacgtaatgcagttttctaaggaggaggtgcgcgaagtatcccggttgctggcagggattctacatctcggcaacatcgaattcatcactgccggcggtgcgcaggtgagttttaagactgccctcggaagatccgcagagctccttgggctggaccccacccaattaacagacgccttaactcagcgctctatgttccttcggggtgaagaaatcctgacccctctgaacgtgcagcaagccgtcgatagccgggacagcttggcaatggccttgtacgcatgctgcttcgagtgggttataaaaaagataaattccaggatcaaagggaatgaagactttaagagcattgggatcctggacatctttggattcgagaactttgaggtaaatcacttcgagcagttcaatatcaattatgcaaacgaaaaactgcaggagtacttcaataagcatatctttagtctggaacagctggaatacagcagagagggccttgtctgggaggacatcgactggatagataatggagaatgtctggacttgattgagaagaagctgggcctactggctttgattaatgaggaatcccatttcccccaggcaacggattctacccttctggagaagctgcacagccaacatgcgaataatcatttttacgttaagccaagggtagctgttaataattttggagttaaacactacgccggggaagtgcaatatgacgtgaggggtatcctggaaaaaaatagggatacttttcgggacgacctgcttaatctgcttcgagagtcccgcttcgacttcatctacgacctctttgagcatgtgtctagtagaaataatcaggatacattaaagtgtggtagcaagcataggcgtccgactgtatccagccaattcaaagactccttgcatagcctaatggcgacattgtcatcctctaatcctttcttcgtaagatgtatcaaaccaaacatgcagaaaatgcccgaccagttcgaccaggctgtagtgctcaatcagctgagatatagcggaatgttagagactgttcggatcaggaaagctggatatgccgtcagacgccccttccaagacttttacaaacgctacaaagttctgatgagaaaccttgctctacctgaggatgtgagaggcaagtgtacttccttgctccagctctacgatgcatctaacagtgagtggcagcttggcaaaacaaaggtcttcctcagggagagtctggagcagaaacttgaaaagcggagagaagaagaagtatcgcacgcggctatggtgatccgggctcacgtgctaggattcctggcaaggaaacagtacaggaaggtactgtactgcgtggttataatccagaagaattatcgggcattcctgctgcgccggcgctttttgcatcttaaaaaggcagcaatcgtgtttcagaaacagctaagaggtcagatcgcccggagagtgtaccgacagctcctggccgagaagcgcgagcaggaggagaagaagaaacaggaggaggaggaaaaaaaaaagcgcgaggaagaagagcgtgaaagggaacgtgaacggagggaggcagaactgagagcccagcaggaagaggagactagaaaacagcaggagctggaggccctgcagaagagtcagaaggaagcagaacttactcgtgaactggaaaaacaaaaggagaataagcaggtggaggaaatattgcggctggaaaaggagattgaagacctgcaacggatgaaagaacagcaggagctgtccctgacggaggcctccttgcagaagctgcaggaacgaagggatcaggagcttaggcgtttagaagaggaagcctgcagagcagcccaggaattcctggaaagtctgaatttcgatgagatcgatgaatgcgttaggaatatcgaacgctccctaagcgttggatccgagttctcctccgagctggcagagagtgcttgcgaggagaagcctaattttaatttcagccagccatacccggaagaggaggttgatgaggggtttgaggcagacgacgacgcatttaaggattcacccaaccctagcgaacacggccactccgatcagcgcacctcaggaattcggacaagtgatgacagctcagaggaggatccctacatgaacgataccgtggtccctacctccccctcagccgactctaccgtgctgctggctcccagtgtgcaggactccgggtctctgcataactccagcagcggcgagagtacctactgtatgccgcaaaacgctggcgacttaccctcacccgacggagactatgactatgatcaagatgattacgaagacggagcaattacctcgggtagttctgtaacattctccaactcgtacggttcgcagtggagtcctgactatcgatgctcagttgggacctacaactcctccggggcttatcgcttcagcagtgaaggcgcacagagttcctttgaggattccgaagaggacttcgattcacgatttgacacagacgatgaattgtcgtacaggcgtgattctgtctattcttgtgtaaccctcccatacttccattcatttctttacatgaaagggggcttgatgaattcgtggaagcgaagatggtgcgtgttgaaggatgagactttcttatggttccggtccaagcaggaggcattgaaacaggggtggttacacaagaagggtggcggcagttcaaccctgagtagacggaattggaaaaaaagatggtttgttttgagacagtccaagcttatgtactttgagaacgactctgaggaaaagctgaaaggcactgttgaggtccgcacagcaaaggagataatcgacaatactacaaaagaaaacggcatcgatattataatggccgacaggacattccatctgatcgccgagtctcctgaagatgcctcacagtggttctcagtccttagtcaggtacatgcaagtaccgatcaggagatccaggaaatgcatgacgagcaggcgaatcctcagaacgctgtcgggaccctcgacgtgggtctgatcgacagcgtgtgcgctagcgatagccccgatagaccaaactcctttgttatcattactgccaatcgcgtgctgcactgtaatgccgatacccctgaagagatgcaccactggatcactctgcttcagaggagtaaaggagacacccgggtggagggtcaggagttcattgtgagaggctggctgcataaagaggtgaagaatagtcctaaaatgagctccctcaagctcaaaaagcgatggttcgttctcacccacaacagtcttgactactacaagtcaagcgagaaaaatgctctgaaactgggtactctggtcttaaacagcctgtgttccgtggtccctcccgacgagaagatcttcaaggagaccgggtattggaacgtgacagtgtatggccgaaaacattgttacaggctgtacacaaagctgctgaatgaggccaccaggtggagttccgcgattcagaacgtgactgatacaaaggcccccatagacaccccaacccagcaattaattcaagatataaaggagaactgtctgaattctgacgttgtggagcagatctacaagaggaacccaattctaagatacacccaccacccactgcactctcccctgttaccactgccctacggtgatataaacctaaatctcttgaaagacaaaggctatactaccctccaggatgaggctatcaaaattttcaatagcctgcaacagttagagtcaatgtctgaccctattccgatcatccagggaatcctacagacagggcatgatctccgcccgctgagggacgagctctactgtcagctgattaagcagactaacaaagtgccgcatccaggcagcgtgggaaatttgtactcctggcagatcctgacttgtctgtcttgtacctttctgccttcgcgtggcattctaaaatacttaaagttccacctgaagagaatccgcgagcaattccccgggagcgagatggagaaatacgccctgtttacatacgagagcttaaaaaaaacaaaatgccgagagttcgtgccttcacgcgacgagatcgaggccttaatccatcggcaggaaatgactagcaccgtgtattgtcacggtgggggctcctgcaagatcacaatcaactcccacaccacagctggggaagtggtggagaaattgatccgcgggctggctatggaggactcgcggaacatgtttgcgctgttcgagtataatggacatgtagataaggcaatcgagagcaggaccgtggttgcggacgtgttagctaagtttgagaaactggccgctacttctgaggttggtgacctgccatggaagttttacttcaagctttactgctttctggacactgataatgtgcctaaggacagtgtagagtttgccttcatgtttgagcaggcacacgaagcggtgattcatgggcatcacccagctcccgaagaaaacctccaggttctcgctgccctgaggttgcaatatcttcagggcgattatacccttcacgccgccattcctcccctcgaggaggtttattccctccaacggctcaaggctagaatctcccaaagtaccaaaacttttactccgtgcgagcgtctcgagaaaaggcggacctcttttctggaaggaacacttaggcgctccttccgaactgggtcagtcgtaaggcaaaaagtcgaagaggagcagatgttggatatgtggatcaaggaggaagtaagctctgctcgggccagcattattgacaaatggagaaagttccaaggcatgaaccaagagcaagccatggcaaaatacatggcactgattaaagaatggcccgggtacggaagcaccctgttcgatgtggaatgcaaggagggcggttttccacaggaactgtggctaggtgtgagcgcagacgccgtgagcgtatacaagcgcggtgaaggccgcccccttgaggttttccagtacgagcatatccttagtttcggggcccctctggcaaacacgtataagatcgttgtggacgaacgagagctgctgtttgagacaagtgaggtagtcgacgttgcaaaactgatgaaagcttacatttctatgattgtgaaaaaacgctatagcacgacccgcagtgccagtagtcaggggtccagccgttag

SEQ ID NO: 125474 - DNA, 4194 bp, Artificial Sequence
  Description of Artificial Sequence: Synthetic coding sequence
atgctcgaaacggtccgaataaggaaagctggctatgccgtgagaaggcctttccaagatttttataagcgctataaggtgcttatgcggaatttggcattgcccgaagacgtgcgtggaaagtgcacatccctattgcagctgtatgacgcctctaactctgaatggcagttgggtaagaccaaagtcttccttcgggaaagcttggaacagaagctggagaaaagacgggaagaagaggtctctcatgctgccatggtcattagagcccacgtgctcgggttcctagcacgtaagcagtacaggaaggtcctctattgtgtcgtgatcattcagaaaaattaccgcgcttttctcctcagaagaagattcctgcatctaaagaaagcagctattgtgttccagaaacagctgcggggacagatcgccagaagggtataccgtcagcttctcgcagagaagcgtgaacaggaggaaaagaaaaagcaagaggaagaagagaagaaaaagagggaggaggaggaacgagagcgcgagcgggagaggcgagaagctgaactgagggctcagcaggaagaggaaactaggaagcaacaggagttggaggcccttcagaagagccagaaggaggcggagttgactcgcgaacttgagaaacagaaagagaacaagcaagtggaggaaatactgaggctcgagaaggaaattgaagatttacagagaatgaaggagcagcaggagctctctctgacagaggctagtcttcagaagctgcaagagagacgggaccaggagctacgcagattggaggaggaagcgtgcagagccgcccaggaatttctggagtctttgaactttgacgagatcgacgagtgtgtcaggaacattgagaggagcttatcagtgggatccgaattctcaagcgaactggccgaaagcgcttgcgaagagaaaccaaatttcaatttttctcagccttaccctgaagaagaggtggacgaggggttcgaagctgatgatgacgcctttaaggatagccccaatcctagtgaacatggacattctgaccagagaacaagtgggattagaacctcggacgactcatcagaagaggatccatatatgaacgacaccgtggtgcccacctcaccaagcgctgacagtacagtgctactcgccccttctgtgcaggattccggatccttacataatagctcgtcaggcgagtcgacctattgtatgcctcaaaacgctggcgacctgcccagcccggacggagattatgactacgaccaggatgactatgaggacggcgccatcacaagcggttcttcggtgacattctcaaacagctacggctcccagtggtcgccagactataggtgcagcgtggggacctacaactcctccggagcatacaggttcagtagcgaaggcgctcagtcctccttcgaagatagcgaagaagacttcgacagcagattcgataccgacgacgagctctcataccgtcgggatagcgtgtactcatgtgtgactctgccttactttcactcttttctgtatatgaagggagggctcatgaacagttggaaaagaagatggtgcgtgctgaaagatgaaacttttctgtggtttcggtcaaaacaggaagccctcaaacaaggatggctccataagaagggcggtgggtcgtccactttgtccagacggaactggaaaaaaaggtggttcgtgctaaggcaatccaagttgatgtactttgagaatgattccgaagagaaactgaagggaacagtagaggtcaggacagccaaggaaatcattgacaacaccacaaaagagaatggcattgatataatcatggctgaccgaaccttccatctgatagcggagtcccctgaggacgcctctcagtggttctctgtgttgagtcaagtgcacgcttccaccgatcaggaaatccaagagatgcacgatgaacaggccaatccacaaaacgccgtaggcactctggacgtggggttaatagattccgtgtgcgcaagcgactcacccgaccgcccgaacagctttgtcataataacagcaaacagggttctacactgtaatgctgatacccccgaggaaatgcatcattggatcactctgctgcagcgaagcaaaggtgatactagagtagaaggacaggagtttatcgtacgtggttggctccataaggaggtcaaaaatagccccaaaatgtcctctctcaaactaaagaaaagatggtttgtcctgacccataatagtttagactactacaaaagttccgagaagaacgctctgaaactgggtacgcttgttctgaacagtctatgttcagttgtgccacctgatgaaaaaattttcaaagagaccggctactggaacgtgacggtgtatggccgcaagcactgctaccgcctctacaccaagctgttgaacgaagccacccggtggagtagcgcaatacagaacgtgaccgacactaaagcccccatagatacccctacccaacaattgatccaggacatcaaagagaactgtttaaactccgatgtagtggaacagatttacaagagaaaccctatcttgaggtacactcatcaccctcttcactcccccctgttgcccctgccttatggcgacattaatctgaacctgctgaaagacaaggggtacactactctgcaggatgaggccatcaagatctttaatagcctgcagcagctagaatcaatgtcagacccgatcccgatcatccagggcattttgcagaccgggcacgatctacgccctttacgagatgagctgtattgccagttaatcaaacaaacgaataaggtgccccatcccggttctgtgggtaatctgtacagttggcagatactcacttgtctctcctgtaccttcctaccgagccgcggaatccttaagtaccttaaatttcacctgaagcggattcgcgagcagttcccgggtagtgagatggaaaaatacgctcttttcacatatgaaagcttgaagaaaaccaaatgccgggaatttgtgccgtcccgcgacgagatagaggcactgattcataggcaagagatgacatctaccgtctactgccacggtgggggatcttgtaaaattactattaatagccacacaacagccggggaggtcgtcgagaagctgatccgcggactggcaatggaagattcccgtaatatgtttgccttgtttgaatataacgggcatgtcgacaaggctattgagtcccgcacagtcgttgcagatgtgctcgccaagtttgagaagctggccgccacttccgaggttggggatctgccctggaagttctacttcaaactgtattgtttcctcgatacagacaatgttcccaaagattctgtggaattcgctttcatgttcgagcaagcccatgaagctgtcattcatggacaccaccccgcccccgaggagaacttgcaggtcctggctgctctgcggctacagtatttgcaaggcgattatacactgcacgccgctataccaccactagaggaggtgtacagccttcagcgtctgaaggcacgtatttcacagtcaaccaaaacttttacaccatgtgaaagactggagaaacggcgcacctctttcttggagggcactttacgaagaagcttccggaccggctctgtggtgagacagaaagtggaggaggaacagatgctggatatgtggatcaaggaagaggtatccagcgccagagcctccatcatcgacaagtggcgaaagttccaaggaatgaaccaggagcaggctatggctaaatacatggcgctgataaaagagtggccagggtacggaagtaccctttttgatgtggagtgcaaagagggtggttttccacaggaactctggttgggggtgagtgccgacgccgtgtccgtctataaaaggggggagggtagaccactggaggtttttcagtacgagcatattctaagttttggcgctcctctggcaaacacctataagatcgtagtggacgagagagaattgctcttcgagacaagcgaagtggtagacgttgccaagctgatgaaagcctatatcagcatgatagtcaagaagcgctattctacgacaaggtcagcatcttcccaaggctcgtcacgttag

SEQ ID NO: 125475 - DNA, 552 bp, Artificial Sequence
  Description of Artificial Sequence: Synthetic coding sequence
atggagaatggcgccgtttacagtccaacaacagaagaggacccgggaccggcaagagggcccaggtctggcctcgctgcttactttttcatgggcagactgccccttctcaggcgagtgctcaaaggcctccagttactgctctctctgctggcttttatctgtgaggaagttgtgtcacaatgtactctctgcgggggcttgtatttcttcgaattcgtgtcctgtagcgcctttctgttaagcttgctgatattgatagtttattgcacgcctttttatgagcgcgtcgatactacaaaagtcaagagctctgacttctacatcacactaggtactggttgtgttttcctgctggcaagcattatcttcgtctctactcacgatcggacctcagcggagattgccgcaatcgtttttggcttcatcgcctctttcatgtttttgctggatttcattacaatgctgtatgagaagcggcaggagtcccaactcaggaagcctgaaaataccacacgcgcggaggcactgactgagcccttgaatgcctag

SEQ ID NO: 125476 - DNA, 1437 bp, Artificial Sequence
  Description of Artificial Sequence: Synthetic coding sequence
atgctggagttcgcccagaaatattttagagacccccagaggcgaccacaggacggattacggctaaagtccaaagaacctagggagagtaggactctggaggacatgctctgctttacaaaaacacccctgcaagagtctcttattgaactgtctgatagcagtcttagcaagatggcgaccgacatgttcctcgccgtcatgcgctttatgggcgacgctcctctgaagggacagtccgacctggatgtgctgtgcaacctcctgaaactgtgtggggaccacgaagtcatgagagatgaatgctattgccaggttgtaaagcaaataaccgacaataccagcagcaagcaggacagctgccaaagagggtggaggttgctctatatcgttacagcttatcactcttgtagtgaagtactgcacccccatctgaccagattcctgcaagatgtgagtcggaccccgggtcttccgtttcagggaattgccaaggcatgcgaacagaacctccagaagacacttaggttcggaggcagactggagttgccgtcctccattgagctccgggctatgctcgcaggtcggagcagcaagcgacagctctttctgctcccagggggcttggagaggcacttgaagataaaaacctgcacggtggcacttgatgtggttgaggagatttgcgcagaaatggccttaactcgccccgaagccttcaacgaatacgtgatcttcgttgtgacaaaccgtggtcaacacgtgtgcccattgtcccggcgcgcctacatccttgatgtggctagtgagatggaacaggtcgacggcgggtacatgctgtggtttcgaagagtgctgtgggaccaacccttgaaattcgagaacgagctgtacgtcaccatgcactataatcaggtccttcccgattatttgaagggactgtttagctccgtgccagcatcacggccttccgagcagcttctgcagcaggtgtccaaactggcatctctccaacacagagctaaggaccatttctacctccctagcgtgcgtgaggtgcaggagtacatccccgcccagctttatagaacaactgccgggtctacctggctaaatttagtaagccagcatcgtcagcagacacaggctctttcgccccatcaggcacgagcacagtttctgggactgttgagcgctctgccaatgtttggcagtagcttcttctttatccagtcttgctccaacattgctgtaccagccccgtgcatcctggcgataaaccataacggcttgaactttctcagtaccgaaacgcacgtcagcggactgtccctggctttgccgagccccccctccgtgccttggtcaccaacgccaagcaagcgacccagaccgcctgctgccgaggcccagtttcattgtttgccaccttcctag

SEQ ID NO: 125477 - DNA, 555 bp, Artificial Sequence
  Description of Artificial Sequence: Synthetic coding sequence
atgaacatgctatcctcccttagccctaccgtcgttctgccagactaccttaagggactatttagcagtgttccagcgtcgcggccctccgaacaactcctacagcaggtgtcaaaattggcttcgcttcagcaccgcgctaaggaccacttctacctccccagtgtgagagaagtccaggaatacatccccgctcagctgtaccgaactactgctggtagcacatggctcaatctggtgtcgcagcatcgacagcagactcaggctctgagcccccaccaggcccgtgcacaatttcttggcctgttgtcagcgctgcctatgttcggcagctccttcttcttcatacaatcatgctcaaacatagccgtgccggccccttgcatcctggctattaaccataatggacttaactttttgagcacggagacccatgtgagcggactttctctggctctcccatcgcctccttcagtgccgtggagccccacaccatctaagcgtccccgtcccccagcagccgaggctcaatttcactgcttaccgccctcctag

SEQ ID NO: 125478 - DNA, 735 bp, Artificial Sequence
  Description of Artificial Sequence: Synthetic coding sequence
atgcgcgatgaatgctattgtcaggtggtcaaacaaatcacagataacacatctagtaaacaggactcttgtcagagagggtggagacttctgtacatcgtcaccgcttaccacagctgttctgaggtgttacacccccacttaacccgattcctgcaggatgtgtcacggacccccgggctaccatttcaggggatagctaaggcatgcgaacaaaacttgcagaagaccctcagattcgggggccgactggagctgccaagttccattgaactccgtgcaatgcttgccggacgctccagtaaacgccaactgtttctgctgccggggggactggagcggcaccttaagattaaaacatgtactgtcgcgctcgatgtggtggaggaaatttgcgctgagatggctctaacccgtcctgaagcttttaacgagtatgtaatcttcgtggtcactaatcgcggggggaagtcaagatctaccagccagccttcgagcactgtgcagcggcaggcgcgcccgggctccacctggtcagcctcaacagggagtcgtcaccgcagaagcgcgccaacccggccggtgcccagcttttgggccagcagcgccccctacctttgtagtgcccccccatcctcctcttcccgggcggccgccaccctgctgtgtcaacccctcgcttcactgccatcaacaacgatggcatcaacattttcagctcagcggttgatgtag

SEQ ID NO: 125479 - DNA, 429 bp, Artificial Sequence
  Description of Artificial Sequence: Synthetic coding sequence
atggtgaaaggtggccaggaagccggtgggcagctccgcgttctccgggcctactcttttgccgacatactctttgtcacgatgccctcccagaatatgctggagtttaatctggcctcagagaaagttattttgttttcggcccgggctcaccaagtgaagacactggtagacgattttatcctggagcttaaaaaggactccgactacgtggttgctgtgcgtaatttcttgcctgaggatcctgccctcctggcctttcacaagggtgatatcatccatctgcagcccctcgagcccccccgcgtcggctatagtgccgggtgtgttgtgaggagaaaagtggtatacctggaagagttgcgtaggcggggacctgatttcggagtgtgtccccggacatggaaccccatacggggcgccagctag

SEQ ID NO: 125480 - DNA, 6165 bp, Artificial Sequence
  Description of Artificial Sequence: Synthetic coding sequence
atgtttaatctcatgaagaaagacaaggataaggatggagggcggaaggagaagaaagagaagaaggagaaaaaggagaggatgagtgccgccgaactcaggagtcttgaagaaatgtcccttcggcgcggctttttcaacctcaaccgctcctctaaaagagagagtaagacccgtctggaaattagtaatccaattccaattaaagtcgcttctgggtccgaccttcacctgacagatatcgactcagactcaaacagaggttcggtgatacttgactctgggcatctctcaacagcatctagttctgatgatttaaaaggcgaggaaggctcctttagaggatctgttctacaaagagccgcaaaatttggtagcctcgccaagcagaattcccaaatgatcgtgaaacggttcagtttcagtcagcgctccagagatgagtccgcctccgaaacttcaaccccatccgagcactccgcggctccttcgccccaagtcgaggttagaacactagaaggtcagctcgtccagcatcccggtcccggcatcccacgaccaggccatagatctcgcgcacctgagctggtgaccaaaaagttcccagtagacctacgtctgccgccggtggtccccctgccgccgccaactctacgggagttggaactgcaacgcaggccgaccggcgacttcgggtttagcctccggcgcactaccatgctggatcggggaccagaagggcaggcttgtaggcgagttgtgcacttcgccgaacctggcgcggggacgaaggatctggcactggggttggtccctggtgaccgcctggtggagattaatgggcacaatgtggagtctaaatccagggatgagatcgtggagatgattaggcaaagcggcgacagcgttcggctcaaggtgcaacccatccctgagttgtctgagttaagccggagttggcttcgctcgggggagggccctagacgcgaaccaagcgatgccaaaacggaagaacagattgctgctgaggaggcatggaatgaaaccgagaaggtctggttggttcaccgcgatggctttagcctggccagtcagctcaagtctgaggagctcaaccttccggaaggcaaggttcgggtgaagctagatcacgacggagctattttggacgtggacgaggatgacgtcgaaaaggccaatgccccaagttgcgacagactcgaagacctggcatcgctcgtatatctgaatgaatcgtcggtgttacacaccctgcgacaacgctacggtgcctcattgctgcacacctatgccggtccctccttgttggtattgggcccgcggggtgcgccagccgtctactccgaaaaggtcatgcatatgtttaagggatgtcgccgggaagatatggccccccacatctacgccgttgcccagactgcataccgcgccatgctaatgagcaggcaggatcagtcgattattctgctggggtcctccggatcaggaaaaacaaccagctgccaacacttggtccagtatctggccaccattgccggcatctccgggaacaaggtgttttccgttgagaaatggcaggcattgtacactctcctcgaagcgttcggtaactctccaaccatcatcaacggcaatgcaacgaggttttcccaaatactgtcccttgacttcgaccaagctggtcaagtggccagtgcttcaatacagacaatgctgctggagaaactacgggtcgctcgcaggccagccagcgaagcaacattcaacgtgttctactacctgctcgcgtgtggggatgggacactaagaaccgagctgcacctgaaccacttggccgaaaataatgtgtttggaatcgtcccactggccaagccagaagagaagcagaaagcggcccagcagtttagcaagctgcaggccgccatgaaggtccttggcatcagccccgacgagcagaaggcatgttggtttatcctggccgctatctatcatctaggggcagcgggcgccactaaagtccactccactgcggggagaaaacagttcgcaaggcatgagtgggctcaaaaggccgcttacctcttaggatgcagtctggaggagctgagctccgccatctttaaacaccagcacaaaggcggcacgctgcaacgtagcacctcttttagacaggggcctgaggagtctggtttgggtgatggcactggcccaaaactctccgccctggaatgtttggagggaatggcagcaggactgtactccgagcttttcacactactcgtcagtcttgtgaatcgcgcactgaagtcctcacagcacagcttgtgtagcatgatgatcgttgacacacctggtttccagaaccctgagcagggtggcagcgctcggggagcatcattcgaagaactttgtcacaattatacacaggatcgcctgcaacgtttatttcacgagcggacatttgtgcaggaactggagcggtacaaagaggagaatattgagctagcattcgatgatcttgaaccccccacagatgatagcgttgcagccgtcgaccaggctagtcaccagtccctagttagatccctcgcacgcacggacgaagccagaggactgttgtggcttctcgaagaggaagccctggtgccgggtgccagcgaagacaccctgctagaacgcctctttagctattacggaccacaggagggagataaaaagggacaaagccccctgttgcattctagtaagcctcaccacttcctgctgggtcacagtcatgggaccaactgggttgaatacaacgttacaggctggctgaactacaccaaacagaaccccgccacccagaacgccccacgcctgttacaagacagtcagaagaaaattatctctaatctgtttctgggccgggcagggtctgcgaccgtgctgtcggggagtatcgcaggccttgagggaggtagccaactagcattaaggagagccaccagcatgcgaaagacatttaccacagggatggccgccgttaagaagaaaagcctctgtattcagatgaagttgcaggtggatgctctcattgatactatcaagaagtctaagctgcatttcgtccactgtttcctcccggtcgctgaaggctgggcaggggagccacggtctgcatcgtcaaggcgggtttcttctagctctgagttagatctcccaagtggagatcattgcgaagctggccttcttcaattggatgttcctctcctgcggacacaattgaggggaagccgactgttagatgcaatgcgcatgtaccgacagggctaccctgaccacatggtgttttcagagttccgcaggcgattcgacgtactggcaccccacctcacgaaaaagcacggccggaattatatcgtggtcgatgagcgccgagctgtcgaagagcttttagagtgcctggacctagagaagtctagttgttgtatggggctttccagagtgtttttccgggccgggaccttggctagactcgaggaacagcgcgatgagcagaccagccgaaatctgacactgtttcaggccgcctgtagaggatatctggcgcgccagcatttcaaaaagagaaaaatacaggatctggccatccgctgtgtgcagaaaaatataaagaaaaataaaggggtaaaggactggccttggtggaaactgttcacaacagtgagacccttaattgaagtgcaactgtccgaggagcagattcggaataaggacgaagagatccaacaactcaggtctaagttagagaaggcggaaaaggaaaggaacgaactccgacttaattctgaccgactggagtcccggattagtgaactcacttcggaactgacggacgaacggaacaccggggaatctgcctcccagttactggacgcagagaccgccgagcggctccgcgcagagaaggagatgaaagaactccagactcagtatgacgctttgaagaaacagatggaagtcatggaaatggaggtgatggaagctaggcttattagagctgccgagattaatggcgaagtagacgacgatgacgctggtggagaatggcgattaaaatatgaacgggccgtacgcgaagtcgacttcacaaaaaagaggctgcaacaagagttcgaggacaagctcgaggtggaacagcagaataaacgccagctggaacgccgtcttggtgatctacaggcagactcagaagagtcccagagagcactacagcagcttaaaaagaaatgtcagcggttgaccgctgagttgcaggacacaaagctgcatctggagggccagcaggtgcggaaccacgagttggagaaaaagcagcgaagattcgatagtgaactctctcaagctcacgaagaagcccagcgggagaagctccagagagagaagctgcagcgtgagaaggacatgttactcgcagaggccttctcccttaaacaacaacttgaagaaaaagacatggacatcgccgggttcacccaaaaagtggtgagtctggaagccgagctgcaggatatctctagccaggagtccaaggatgaagcctcgctggccaaggtaaaaaagcagctgagagatctggaggccaaagtgaaggatcaggaggaagagcttgacgagcaggccgggaccatccaaatgttagagcaagcaaagctgcgcctcgagatggaaatggagcgtatgcgacaaacacattcaaaagaaatggagagcagagacgaagaggtggaggaagcacggcagtcctgccaaaagaagctgaaacagatggaggtgcagctggaggaggagtatgaagataaacagaaggtgctgagggagaaaagagaactggaaggtaaactggcaaccctcagcgaccaggtgaacagaagagactttgagtccgagaaacgtctgagaaaggatcttaaaaggactaaggccttgctcgcagacgcgcagttgatgcttgaccacctgaagaatagcgcgccttccaaaagagagatcgctcagttgaagaaccaacttgaggagagtgaattcacctgcgccgccgcagtcaaggcacggaaggctatggaagtagagattgaggatcttcacctgcagatcgacgacatagcgaaggccaagacagcactggaggaacaactcagtcggttgcagcgcgagaaaaacgagatccagaatcggctggaggaggaccaagaggacatgaatgagctaatgaagaaacacaaagccgcagtagcacaggctagtagggacctcgcacagataaatgatctccaggcacaactggaggaggcaaataaggaaaagcaggagctacaagaaaaattgcaggccctgcagtcacaagtggaatttcttgagcagagtatggtcgacaaatcgctggtgtctcgccaggaagcaaagatccgggagttagagacccggctggaattcgagcggacccaggtgaagcgactagaaagcttggcctcccggttgaaagaaaatatggagaagctgactgaggaaagagaccagcggattgctgctgagaaccgcgaaaaagagcagaacaagcgtcttcagagacaactgagagatacaaaagaggagatgggcgaactcgcccgaaaggaggccgaggcttccaggaagaagcacgagttggagatggaccttgagagtctggaagccgccaatcagtccctccaggcagaccttaaactggcgtttaaacggatcggcgatctgcaggcggcaattgaggacgaaatggagtccgacgagaacgaggatttgattaattctctgcaggacatggtcacaaaataccagaagaggaagaataagctggagggcgactccgatgtcgacagcgagctggaagaccgagtggatggagtgaagtcttggctgagtaagaacaagggcccttctaaggcggcctctgacgatggctcactgaaaagttcttcccctacctcgtactggaagagcctcgctcccgacaggagcgacgacgagcacgaccccctggacaacacttcccgtcctcggtattcacactcatatctgtcagattcagataccgaggcgaagttaacagaaacaaatgcttag

SEQ ID NO: 125481 - DNA, 6009 bp, Artificial Sequence
  Description of Artificial Sequence: Synthetic coding sequence
atgtttaacctgatgaagaaagataaagacaaagatgggggtagaaaagagaagaaggaaaagaaggaaaaaaaagagagaatgtcagctgccgaattgcggtccttggaagagatgagcctgcggcggggtttcttcaacctcaaccgctcaagtaaacgcgaatctaaaacccgcctggaaatctctaacccaatcccaatcaaggtggcgtctggatcggatctgcatctgaccgatatagattccgacagtaatcggggctccgtaatcctggattcaggccatctgagcactgccagttccagcgatgacctcaagggggaagaagggagtttcagaggcagtgtgctccagagagccgcaaaatttggctcgttagctaagcaaaattcgcagatgatcgtcaagaggttctccttttctcagcggagtcgcgatgagtcggcaagcgaaacatcaacccctagtgaacactctgcagctccttccccccaggtagaggtccgtactttagagggccagctggtgcagcacccaggaccaggcatccctcgcccaggccatagatccagggcccctgaattggttacaaagaaattccccgtggatctgagactgccgcctgtggtgcctctgccaccccctaccttacgcgagctcgagctacagaggcggcctacaggcgacttcggctttagcctgagacggaccaccatgctcgacagggggccagaggggcaggcctgcagaagagtggtgcacttcgctgaaccgggagcgggcacaaaagacttggccctggggctcgtgccaggtgatagactagtcgaaatcaatgggcataatgttgagagcaaaagtagggatgaaatcgtggaaatgataagacaatccggtgacagtgtccgcttaaaggtccagcccataccagagctgagcgagctcagcagatcgtggctgaggtctggtgaagggccgagaagagaaccaagcgacgccaagaccgaagagcagatagcggccgaagaggcctggaatgaaactgaaaaggtttggctggtgcacagggacgggttttcgttggccagccagctgaaatctgaggaactgaacctccctgagggcaaagttcgcgtcaagttggaccacgatggcgccatcctggatgtggatgaggacgacgtcgaaaaggctaacgcccctagctgtgaccgcttggaagatttggcgtccctggtgtatttgaacgagagttccgttctgcacacgctgcggcaacgctacggcgcctcactgctgcatacatatgccgggccatcactgcttgtgttgggtccccgcggggcaccggccgtctattcggaaaaagtcatgcacatgtttaaaggctgccgccgagaagacatggccccccatatctacgccgtggcacagaccgcctaccgcgcaatgttgatgtcccgccaggaccagtcaatcattcttttggggagctctggcagtggcaaaactacaagttgccagcacttggtgcaatacctcgcgacgatcgccggaatctcaggcaataaggtattttctgtcgagaaatggcaggccctgtatactcttttggaggccttcggcaatagccccaccatcatcaatgggaacgccacaagattcagccagattttgtctctggacttcgatcaagccggacaggttgcctctgccagcatacagactatgctcctggagaaattgcgtgtggctcgaaggcctgcaagcgaagcaacctttaacgtcttctactaccttctcgcttgtggcgatgggactctgcggaccgagctgcatctcaaccaccttgccgaaaataacgtgtttgggatcgtacccctggccaagccggaggagaagcagaaagctgcccagcaattcagcaagctccaggccgctatgaaggtcctggggatatctcccgacgagcagaaagcttgctggtttatcttggcagccatttatcacctgggcgccgccggtgctactaaagttcattcaaccgcgggacggaagcagtttgctcggcatgaatgggctcagaaggcagcctatttgcttgggtgcagcttggaggaactctcctccgccatttttaaacatcagcataagggcggcactctgcagagatcgacttctttccggcaaggtcctgaagagtcgggtcttggcgacgggaccggcccaaaattgagcgcactggagtgtctcgaaggcatggccgctgggctgtacagtgagctgtttactctgttggtgagcctggtgaatagggcactgaaaagtagccaacacagcctctgttcaatgatgatcgttgatacgccgggctttcagaaccctgaacagggcggttctgcccgcggcgcttcattcgaggagttgtgccacaattacactcaggatcggctgcagagattattccacgaacggacctttgtgcaggagctcgagcgatacaaggaagagaacatcgagctggcctttgacgacctagagccacccactgacgacagcgttgcggctgtcgatcaggcatctcaccaatcactcgttagatcactggccaggacagatgaggcccggggcctgctgtggttattggaggaggaagctctggttccaggggcctccgaggacacccttcttgaacgattgtttagctattatggcccacaggaaggcgacaaaaaaggacagtctcctttactgcatagctcaaaaccccaccacttcttgctggggcactcacacggtaccaactgggtggaatacaacgtgacgggctggctgaactatactaaacagaatcccgcaacacagaacgcacctcgtctgttgcaggatagccagaaaaagattataagcaacctattcctggggagagccggctccgccacagtgctcagcggttccatcgctgggttggaaggtggatcccaactagcccttagacgtgctacctctatgcgaaaaacctttactaccggcatggcggcagtcaagaagaagtccctgtgcatccagatgaaacttcaggtggacgccttgatcgacacaattaaaaaatcaaaactccacttcgtccactgttttctgccggtcgccgagggttgggcaggcgagccccggtccgcctcttctcgacgcgttagcagtagttcagagctggacttaccttcaggagaccattgcgaggctgggctgctgcagttggatgttccccttctgcggacccaattgcgggggagtagattactagatgcgatgcggatgtacaggcagggataccccgaccacatggtgttttctgaatttaggcgccggttcgatgtattagcgccgcatctaacgaagaaacatggtcggaactacatcgtcgtggacgagagacgggccgttgaggagctgctcgaatgcctcgacctcgagaagagttcttgttgtatgggactgtcacgcgtgttcttccgcgctggtacgctggcgcgtctggaagaacaacgcgatgagcagacatctagaaatctcactctgtttcaggccgcttgccgcggttacctggcccgtcaacatttcaaaaaacgtaagattcaggatctggcaatacgctgtgtccagaagaacattaagaagaacaagggtgtgaaggactggccctggtggaaactatttacgaccgtgaggccgctcattgaagtgcagttatcggaggaacagatccggaacaaagatgaggagattcagcaattgcgatctaaactggaaaaagcagagaaagagagaaacgaattaagactaaacagtgaccggcttgagtcacggatcagcgaactcacttctgagctaactgacgagaggaatacaggtgaaagcgcttcacagctgcttgatgcagaaaccgctgagaggctcagagccgagaaggagatgaaggagttacaaacccagtatgacgctctgaaaaagcagatggaggtgatggagatggaagtgatggaagctagactaattagagccgccgagatcaacggcgaagtggacgatgatgatgccggcggagaatggcgcctcaaatatgaacgggccgtgagagaggttgacttcacgaaaaagagactgcagcaggaatttgaggataaactggaggtagagcagcagaacaaacgacagctggagcgccggcttggagacctccaagccgactctgaggagagtcagagagccttgcaacagcttaagaaaaagtgccagagacttaccgctgagctccaagacacaaaacttcacttggaaggtcagcaggttcgcaatcacgagcttgagaagaagcaacgcagattcgacagtgagctcagccaggcccacgaggaggcacagcgcgaaaagctccagagggagaaactgcagagggaaaaagatatgctgctggctgaagctttcagcctgaagcagcagctggaagagaaagatatggatattgctgggtttacacagaaggtggtcagtctcgaggccgaacttcaagacatcagtagtcaagaaagcaaggacgaagcctctttagccaaggtgaaaaagcagctaagagatctggaagcaaaagtgaaagatcaggaggaagagctcgacgaacaggcaggcaccattcagatgctggagcagctgaaacagatggaggtgcaacttgaagaggaatacgaggacaaacagaaagtcctccgcgagaagagagaattggagggcaaacttgccacacttagcgatcaggtaaatcgacgcgacttcgagagtgaaaaaagactgaggaaagacttaaagcgcaccaaggcactcttagcggatgcccagctaatgttggatcatctcaagaattctgctccttcaaaacgagaaattgctcaattgaagaaccaactggaggagtcagaatttacctgtgctgcggccgtgaaagcccgcaaggccatggaagtggaaattgaagacttgcacttgcaaatcgacgacatagcgaaggccaagacagcgcttgaagagcaactatcgcgccttcaaagagagaagaatgagatccaaaatcgattggaggaggatcaggaagacatgaatgaattgatgaaaaagcacaaagctgcggtggcgcaggcaagtcgagatctcgcccagataaatgacttacaggcgcagttggaagaagcgaataaggagaagcaagagctgcaagagaaactccaagcgctccagtctcaggttgaatttctggagcagagtatggtggacaaaagtctcgtctctagacaggaggcaaaaattcgggaactcgaaacacgcttggagttcgaacgtactcaggtgaagaggcttgaatccctcgcttccagactcaaagagaatatggagaagctgacagaagaacgggaccagcggatcgctgctgaaaatcgagaaaaggagcaaaataagcggctgcagaggcagctaagggatacaaaggaagagatgggggagttagccaggaaagaggccgaggccagcagaaaaaaacacgaactcgagatggacctggagagcctggaggccgctaaccaatcactgcaagccgacctaaagctggccttcaaacggatcggcgaccttcaagctgctatcgaagatgagatggagtcagatgaaaacgaggacctgattaattcagaaggcgactcggatgtggactcagagctggaggaccgggtcgatggcgtaaagtcctggctgtccaagaataagggcccaagcaaggctgcttctgatgacggctcgctgaaatcttcttcgcctacatcttattggaaaagcctggctcctgatcggagcgatgacgagcatgaccctctggacaatacttccaggcccaggtacagccacagctacctcagtgacagcgacacagaggccaaattaaccgagaccaacgcctag

SEQ ID NO: 125482 - DNA, 4929 bp, Artificial Sequence
  Description of Artificial Sequence: Synthetic coding sequence
atggagggacctaggaccaccaagctcgaaggttcctcgaaggagggtagcggaccttcccggtcacctcagcctccaacctcccctattccacctgaaacttcacagagagctcggagcccagctcccaccttggctatgaacggacctggcgcagcaactgccgaaggcctgtcggaggaagccccagccgtgtactctgagaaggtgatgcatatgttcaagggctgcagaagagaggatatggccccacatatctacgctgtggctcagactgcttatcgcgctatgctgatgtctaggcaggatcagtccattatactgctcggaagtagcggctccggcaagactacctcctgtcagcatctggtccagtacctcgcaacaattgccggaatcagcggtaataaggtcttctccgtcgagaagtggcaggcactgtacacactgttggaagcctttggtaattcccctacaattatcaacggaaacgctactcggttttcacagattctgagcctcgactttgaccaggccggacaagtggcctccgcttccattcaaacaatgctccttgagaaattgagggtggccaggcggcccgcctccgaagcaactttcaatgtgttctattatctcctggcctgcggtgatgggacgctccgaaccgagctccatttgaaccacctggctgagaacaatgtgtttggcatcgttccgctggctaaacctgaggaaaaacagaaagcagctcagcaattttcgaagctgcaggctgccatgaaagttctgggcatcagcccagatgaacagaaggcctgttggtttatactggcggccatctaccatttgggagctgctggcgccacgaaggaagccgctgaagctggcagaaaacaatttgcgaggcatgagtgggcacagaaggccgcttacctgctgggctgctcactcgaggagctttcctcagccatcttcaaacaccagcataagggcggaacgcttcagagatcaacatcgttcaggcaggggcctgaagaaagtggcctcggagacgggactggccccaaactgtccgcattggagtgcctggagggcatggcagcggggctgtactccgaactcttcacgctgctcgtgtccctggtgaaccgcgcgctcaaaagcagccagcacagcctctgctctatgatgatcgtggatactccaggcttccaaaatcctgagcagggaggaagcgcccggggtgccagtttcgaggaactctgtcacaattatacccaagatcggttgcaaagattgtttcacgagcggacattcgtgcaggaactggagcggtataaggaggagaatatcgagctggcttttgatgacctggagccccccaccgatgacagtgttgccgccgtggaccaggcttctcaccaatcgctggtcagatcactggcaaggaccgatgaggccagaggcctgctctggctgctggaagaagaggcactcgtaccaggggcctcagaagacaccctgctggagaggctcttctcctactatgggccccaggaaggggataagaaagggcagagtccacttttgcactcctcaaaaccgcaccatttccttctaggccattctcacggtacaaattgggtggaatataatgtgacagggtggctaaattataccaagcagaatccagccacgcaaaatgcacccaggcttctgcaggacagccagaagaaaataatttccaatctctttttgggtcgtgctggctcagccaccgtgctctccggcagtatcgcaggacttgagggaggctcccagctggccctgagacgtgctacaagcatgaggaaaacctttacaaccggtatggccgccgttaagaaaaaatctctttgcatccaaatgaaattgcaggtggacgctcttatcgatacgattaaaaagtccaagcttcattttgtacactgtttcctgcccgtcgccgagggctgggctggcgaacctcgtagtgcctcaagtcggcgggtatcatctagcagcgagctagacctgcccagtggcgaccactgcgaagccggcctgcttcagctggacgttcccctactccgcacccagctcaggggctccagattgctggatgctatgagaatgtacaggcaaggctacccggaccacatggtcttttcggaatttagaaggcgtttcgatgtgctcgccccccacctgactaagaagcatggacgcaattatatcgttgtagacgaacgtagagccgtggaggagctgcttgaatgcctggatctggaaaagtcttcctgctgcatggggctctcccgcgttttttttagagctggaactctggcacggctcgaagaacagcgagatgagcagacgtctaggaatcttaccctgttccaggccgcatgccgcggatacttggcccgacagcatttcaagaaacgtaagatccaggacttggctatcaggtgtgtccagaaaaacattaaaaaaaataagggcgtgaaggactggccttggtggaagctctttaccaccgtaagacccctgatagaagtgcagctgtctgaagagcagataagaaataaggacgaggagattcagcaactaagaagtaagctcgagaaggctgaaaaagagaggaacgaactgaggctcaattccgatcgcctggagagtcggattagtgaactgactagcgagctaacggacgagcgcaatacaggagaatcagcctcacagttgcttgatgcggagacagccgaaaggctcagggctgaaaaagagatgaaagaactgcaaacccagtacgacgctttaaaaaagcaaatggaggtcatggaaatggaggttatggaggcacggttaataagggctgcagaaatcaatggcgaggtcgacgatgatgatgcagggggtgagtggcgtttgaagtacgaacgcgccgtccgagaggtagacttcaccaagaaaagacttcaacaagagttcgaggataaactcgaagtggagcagcagaacaagagacaactggagagacgcctgggagatctacaggctgattcggaggagagccaaagggccctgcaacagctgaagaagaagtgccagcggttaactgccgaacttcaagataccaagttgcatctggaagggcagcaggtgagaaatcacgagttggagaagaaacaaagacgcttcgatagcgagctgagccaggcccatgaagaggcacaacgggaaaagctccagagggaaaagctccagagggagaaggacatgcttctggccgaagcctttagtttgaaacagcagctggaggaaaaggatatggatattgccgggtttacccagaaggtcgtgtctctggaggcagagttgcaggatatctccagtcaggaaagcaaggacgaagcatcccttgccaaagtgaagaagcaattgagagaccttgaggcaaaagtgaaagatcaggaagaagagctggatgagcaggcgaagctgaggttggagatggagatggagaggatgcgtcagacacactctaaggagatggagtctagagacgaagaggtggaggaagcccgtcagtcttgtcagaaaaagctgaagcaaatggaagtacagctcgaagaggagtatgaagacaagcagaaggtgttgcgcgagaagagggagctagaaggcaaactggcaacattatctgatcaagttaaccgcagagatttcgaatcggaaaagcggttaaggaaagatctgaaacgtactaaagctttactggcggacgctcaactcatgctcgatcacctaaagaactctgctccctctaaaagagagatcgcgcagctgaagaatcaacttgaagagagtgagtttacctgcgctgcagcggtaaaagcccgcaaggcgatggaggttgagatagaggatctgcacctccaaatcgacgacatcgcaaaggccaagacagccctcgaagaacagctgagccgcctgcagcgggaaaagaatgaaattcagaatcgcctggaggaggatcaggaggatatgaacgaacttatgaagaagcacaaggcagccgtcgctcaagcgtctcgtgacctggcccagatcaacgatctgcaagcccagctggaagaggccaataaggaaaagcaggagcttcaggagaaactccaagcactgcaatctcaggtcgaatttttagaacagtcaatggtggataagtcactggtaagtcggcaagaggcaaagatacgagaattggagactagactcgagttcgagcgaacccaggtgaaacggttggaatctctggcttcccggctgaaggagaatatggaaaagctcacggaggaacgggaccaaagaatcgccgcagagaacagggagaaggaacagaacaaacgcctccagcggcagctgcgcgacacaaaagaagagatgggcgagttggcacgaaaggaagcagaggcatccaggaagaagcatgagctcgaaatggacctggagtctctcgaggccgccaatcagtctctgcaggcagacttaaagctggcgttcaagagaataggggatctccaggcagccatcgaggatgagatggagagcgatgagaacgaagacttaatcaatagcgagggtgactccgacgtggactccgagctggaggaccgggttgacggtgtgaagtcttggctgagcaaaaataaaggaccctctaaggctgcatctgatgacggcagcctcaagtcctcatctcccacatcctattggaagtctctcgcaccggaccgctcggacgatgaacatgacccactcgataatacctcgcgacctcgatactcccattcttacctgtccgattctgacacagaagccaagctcacagagactaacgcttag

SEQ ID NO: 125483 - DNA, 6165 bp, Artificial Sequence
  Description of Artificial Sequence: Synthetic coding sequence
atgttcaacttaatgaagaaagataaagataaagatggcggaagaaaggagaagaaagaaaagaaggaaaaaaaagagcgaatgagtgccgcagaactgcgtagcctggaggaaatgagtttgcggaggggctttttcaatctcaacaggtcttccaaacgggagtcgaaaactaggcttgagatcagcaaccctattccaataaaggtggcctctggctcagacctgcacctgaccgacatcgattcggattctaatcgcggtagtgtaatcctggatagcggacatctgtccactgcctcatcctcagacgatctgaagggcgaggaaggcagctttagaggtagcgtgctgcagagggccgctaaatttggctctctcgctaagcagaatagtcaaatgattgtgaagcggtttagtttttctcaacgtagcagagatgagagtgcatccgagactagcacgccttctgaacactccgccgcaccttcaccacaagtcgaagtccggaccctggaagggcagttggtacaacacccgggccccgggatacccagaccaggacacaggagccgggcccctgagctggtgactaagaaattccccgtggatctgcggcttccccctgtggtaccgctgcctccaccgaccttgcgagagcttgaactgcagcgccggcccaccggtgactttggatttagtctcagaaggaccacaatgctagatcgggggcctgaggggcaggcttgtcgcagagtggtacatttcgctgaaccgggcgccggcaccaaggacctggccttaggactcgttccaggggataggctcgtcgagattaatgggcacaatgttgaatctaagtcacgagatgaaatcgttgagatgataagacagagtggagactctgtgcgactgaaggtgcagcccattcccgagctgtcagaattgtcccggtcatggttaaggtcaggggagggaccccgccgcgaaccaagtgatgctaagacagaggaacagatcgccgctgaggaagcatggaacgaaacagagaaagtctggctggtgcatcgcgatgggttttctttggcgtcacagctgaagtccgaagagctcaacctgccagagggcaaagtacgtgtgaaactcgatcatgacggagccattctcgacgtggacgaagacgacgtggaaaaagcaaacgctccttcgtgcgatcgactcgaggaccttgcttctttggtctacctcaacgagtcttccgtgttgcacactctacggcagagatatggtgcatctctgctccatacatatgccggtccatccctgttggttctgggccctcgcggcgcgccagctgtctactctgaaaaagtcatgcacatgtttaagggctgtcgccgagaggacatggccccccacatttacgccgtagctcaaacagcctatcgcgctatgctaatgagtcgtcaggatcaatcaattatcctccttggctcatctggtagcggaaagacaacatcttgtcaacacctggtccagtatctggcaaccattgcggggataagcggcaataaagtgttttctgtcgaaaaatggcaggcgctctatactctgctagaggcctttggtaatagccccaccatcattaacggtaacgccacccgatttagtcagattttgtcacttgatttcgaccaggccggccaggtggcatccgcctccattcagacaatgctgttggagaagctccgagtcgcccgcaggccagccagtgaagccacattcaacgtattctactacctgttagcttgcggggatgggacactgcgcaccgagctgcacctgaaccaccttgcggagaataatgtttttgggatcgtcccactggccaagcccgaagaaaaacagaaggcagcccagcagttcagcaaactccaggccgctatgaaggtgctggggatatctcccgacgagcagaaggcatgttggtttatcctggccgccatctatcacctgggggcggctggggcaaccaaagaagcagccgaggcaggccgaaaacaatttgcccggcatgaatgggcccagaaggccgcttatctcttaggatgctctttggaagagctgtctagcgcaatctttaagcatcagcacaagggcgggactcttcagagatctacaagctttagacagggccctgaagaaagcgggcttggcgatggcacgggcccaaaactttcagcgctcgaatgcctcgagggcatggccgccggactctactccgaattgtttacactactggtgagcctcgttaatagggcactgaagagtagccaacatagtctgtgctcaatgatgatagtcgatactcctggatttcagaaccccgaacaggggggatccgcccggggcgcgagctttgaggagttgtgccacaattatacacaggacagactgcaacgcttattccacgagaggacctttgtgcaggaattggaaagatataaggaggaaaatattgaactggccttcgacgacctcgagccgcccaccgatgactcagtcgctgcggtggaccaggcgagccatcagtctctggtccgatcgttggcacgcacagacgaggcccgcggcctgctctggctgctcgaagaggaagccctagtcccaggggcatctgaagacaccctgttggagaggttgtttagttactacggcccacaggagggcgacaagaagggacaaagtccattgctgcattccagcaagcctcaccactttctgttgggacactctcacggcactaactgggtggagtacaacgtgacaggttggttaaattacacaaagcagaaccctgctactcagaatgcaccaaggctgcttcaggattctcagaagaagatcatttcgaatctgttcttaggacgagcaggcagcgcgaccgtgttgtccggatctatcgcaggtttagagggtggatcccaactggcccttcgtagggccacttccatgagaaagactttcacgaccgggatggctgccgtgaaaaagaaatccctgtgcatccaaatgaagttgcaggtcgatgcgttgatcgatactataaaaaaatcgaaactccatttcgttcactgttttctgcctgttgcagagggttgggccggcgagccaaggtctgccagctccagacgcgtaagcagcagtagcgaactcgacctgccttccggggatcattgcgaagctggacttctgcagctggatgtgcctctgctgcgaacacagttgaggggcagtcgcctcctggacgctatgagaatgtatcggcaggggtaccctgatcacatggtctttagcgaatttcggcggaggtttgacgtcttggcaccccaccttacgaaaaagcacggacggaactacattgttgtcgacgagagacgtgcagtcgaagagctgttggaatgcttagatctcgagaagagctcctgctgcatgggacttagtagagtcttcttcagggcaggcaccctggctcggctcgaggagcagagggatgagcagacgtctcggaatctgactttgtttcaggcagcttgccgaggttacctcgcccgtcagcactttaagaaaaggaaaatccaggacttggctataaggtgcgtgcagaaaaacattaagaaaaataagggcgtcaaagactggccatggtggaagctgttcaccactgtgagacctctgatagaggtgcagctgtctgaggaacagataaggaacaaagacgaagaaatccagcagttgcggtcaaagctcgaaaaagcagagaaagagaggaatgagctacgcctgaatagtgacaggttggagagtagaatcagcgagctcacctctgagctgaccgacgagcggaacaccggagagtcagcaagtcagttgctcgacgccgaaacagctgaacggctgcgggctgaaaaggaaatgaaggaactccagactcaatacgacgctcttaagaaacagatggaagtgatggaaatggaggtgatggaggctcggttgattcgggcagctgagattaacggcgaggtcgacgatgatgacgccgggggcgagtggcgcctgaagtacgagcgggccgtgagggaggttgactttacaaagaaaagactgcaacaggagttcgaggacaagctggaagtcgaacagcaaaacaagcgtcagctggaaagacggcttggcgatttgcaagccgactccgaagagtctcaacgagcactgcagcagttgaagaaaaagtgccagcggctcactgctgagcttcaggataccaagctccatctggagggccagcaggtgcgtaatcacgaactggagaaaaagcagcgcagatttgatagtgaactttcgcaggcccacgaggaggctcagagggagaaattgcagcgcgagaagcttcagagggagaaagacatgctgttagctgaggcttttagcctcaaacagcagctcgaagagaaagacatggacattgccggatttactcagaaagtcgtgagcctcgaggccgaactccaggacatctcatcacaggaaagtaaggacgaagcgagtctggcaaaggtgaagaagcagttacgggatctcgaagccaaggtgaaagatcaggaagaggaactggatgaacaagcaggcacgattcagatgctcgagcaggctaaactgaggctggaaatggaaatggaaaggatgaggcagacccattccaaagagatggaatcgcgcgacgaggaagtggaagaagcaaggcaatcatgtcagaagaagctgaaacaaatggaagtgcagctcgaggaagagtacgaggacaaacaaaaagtgctacgcgagaagcgggaactcgagggaaagctggcgacgctttctgatcaggtgaaccgcagggactttgagagtgagaaacggctccgcaaggatctgaaaaggaccaaagcattattggccgacgctcagctgatgctcgatcacctgaaaaatagcgctccatcgaaacgggagatagcacaattgaagaatcagctggaagagtccgagttcacctgtgcggccgcagtgaaagccaggaaggccatggaggtggaaattgaggatctccatctgcagatagatgatatcgcgaaagcaaagaccgcccttgaggaacagctatctcgtctccagcgggaaaaaaacgagatccaaaacaggcttgaggaggatcaggaggacatgaacgagctcatgaaaaaacataaagccgctgtggcgcaggcttctcgggatctagcacagatcaatgacctccaggcgcaactagaggaggcaaacaaggaaaagcaggaactgcaggaaaagctgcaggctctgcagtcgcaggtggagttcctggagcagtcaatggtggataagagtctcgtaagtcgccaagaggcgaagattcgtgagctagaaactagactggagtttgagaggacacaggtgaaacgccttgagtctctagcatcccgcttgaaggagaacatggagaagctcacagaggagcgcgaccaaaggatcgccgcagaaaaccgcgaaaaggagcaaaacaagcggctgcaacgccaactgagggacaccaaggaagagatgggcgagctggctcggaaggaagccgaggcttctagaaagaagcacgagttggagatggacctggaatcgctagaggccgccaatcaatcactccaagcagatttaaagttggcctttaaaagaattggggacttacaggcagctatcgaagacgagatggagtcggatgagaacgaagatctgattaactccctgcaggatatggttaccaaataccagaaaaggaagaataaattggaaggagattccgacgtggattcggagttggaggacagggtggatggcgtgaagtcatggctctcaaaaaataaggggccgagcaaggctgcctcagacgacggttctctgaaaagttcttcaccaacaagctattggaagtctctggcacccgacagaagcgatgacgaacacgacccgctggacaatactagcaggccccggtatagccatagctacctttctgacagcgacacagaggcgaagctcaccgaaaccaacgcatag

SEQ ID NO: 125484 - DNA, 2808 bp, Artificial Sequence
  Description of Artificial Sequence: Synthetic coding sequence
atgcgtatgtaccgtcaaggctatccagatcacatggttttttccgagtttagaaggaggtttgatgtcctggccccgcacctcaccaagaaacacggtcggaattatattgtagtagacgagagaagggccgtggaggaactgctcgaatgtctggatctggagaagtcttcttgttgcatgggactcagccgggtgttttttagggccggaacactggcaagattggaagagcaacgtgatgaacagacatcacgaaatcttacactgtttcaggccgcctgccgaggttatcttgcccggcagcactttaaaaagcgaaaaatccaggatttggccattaggtgcgtgcagaaaaatatcaaaaaaaacaaaggggttaaagactggccttggtggaaactattcactaccgtccgacctctgatcgaggtgcagctcagcgaagagcaaattcgcaataaggacgaggaaatccagcagttacgatcaaagctggaaaaagctgaaaaagagagaaacgaactgagactgaactctgatagactcgagtccagaatcagtgaattaacctctgagttgaccgacgagcgtaatacaggagaaagcgcctcccagctcctggacgctgagacggccgagcgcttacgggccgagaaagaaatgaaggaattacagactcagtatgatgcactaaaaaagcagatggaggtgatggagatggaagtgatggaagcccgcctaattagggccgccgagatcaacggagaggttgatgatgacgatgccgggggcgagtggaggttgaaatatgagcgggctgtacgcgaagtagacttcaccaagaaaagactgcagcaggagtttgaagataagctggaggtagaacagcagaacaagagacagctcgaaagacgactgggcgatctccaagctgattctgaggagagtcaaagagcgctgcagcagctgaagaaaaagtgtcaacgcttaaccgccgagctgcaagatacgaagctccatcttgaggggcagcaggtgagaaatcatgagctcgaaaaaaaacagcgaagattcgacagtgagctgtcacaagcacacgaagaagctcagagggaaaaactccagagggaaaagttgcagagagagaaagacatgctcctggccgaggccttcagcctgaagcaacagcttgaagaaaaagacatggacatcgcagggttcacacaaaaggtggtgtccttggaagcggagctgcaggatattagttcgcaagagtcgaaggacgaagctagcctggccaaagttaagaaacagttgcgcgacctggaggctaaggtcaaggaccaggaggaagaacttgatgagcaggccgggacgatccagatgctggaacaagcaaaactgagattggagatggagatggaaaggatgagacagacccattcaaaggagatggagagcagagatgaggaagtggaggaggcacgccaatcttgccagaagaaactcaagcaaatggaagttcagctcgaggaagagtatgaagacaaacaaaaagtgctgcgcgaaaagcgcgaactggagggtaaactggccacccttagcgatcaagtgaataggcgggacttcgaatcagagaaacggttgaggaaggacttaaagcgaaccaaggccctacttgctgatgcgcagcttatgctggatcacctgaaaaactcagcgccctccaaacgtgaaatcgcacaactgaaaaaccagctcgaagagtctgaattcacatgtgcagctgcagtaaaggcacgcaaagctatggaagtggaaattgaggacctgcacttacagatcgatgacattgcgaaggcaaaaaccgcgctcgaagaacagctctcacgcctgcagagagagaaaaatgagatccagaaccgacttgaagaggaccaggaggatatgaatgaacttatgaaaaagcacaaggcagctgtggcacaagcatcccgagaccttgcccagatcaacgacctgcaggcacagctcgaagaggccaacaaggagaagcaggaacttcaggagaagctgcaagccctgcagagccaggttgagttcctggaacagagcatggtggacaagtcgctggtatctcggcaggaggctaaaattagggagttggagaccagattagagtttgagcggacccaagttaaaagattggagtccttggcctcacgccttaaggagaacatggaaaagctgacggaagagcgagatcaacggatcgcagcggagaatagggagaaggaacaaaacaagagattacaaaggcaactgcgcgacaccaaggaggaaatgggggaactggcccgcaaggaggccgaggcaagtcggaagaagcatgagctggagatggacctcgagagcctggaagctgcaaaccagagtctccaagccgacctgaagctcgcgttcaagaggattggtgacctccaggccgccatcgaggacgagatggaaagcgacgagaacgaggaccttattaatagcgaaggggatagcgatgtggatagcgaactcgaggatagggtggacggggtcaaaagttggcttagcaaaaacaaaggcccatccaaagcggccagtgatgatgggagcctaaagtcaagctctccaacatcttactggaagtcactggcccccgatagatctgatgacgaacatgatccgctagacaatactagtcgacctagatacagccattcatacctgagtgactccgacacagaggccaaacttaccgagaccaacgcttag

SEQ ID NO: 125485 - DNA, 6120 bp, Artificial Sequence
  Description of Artificial Sequence: Synthetic coding sequence
atgttcaacctcatgaaaaaagataaagacaaggatggaggacggaaggagaagaaggaaaagaaagaaaaaaaagaacgcatgtcagccgctgagctgagatcattggaagaaatgagtttgaggagaggcttttttaacctgaatcgtagcagtaagcgagaatccaaaacacggttagagatatccaaccccatacccatcaaggtggcctcaggatctgacttgcacctgactgatatcgattctgacagcaacagagggtcggtgatattggacagcgggcaccttagcaccgcttcctctagcgacgacctgaagggggaagaaggaagcttccgtggatccgttctgcagcgcgcggcaaagtttggtagcctcgccaagcagaactcccaaatgatagtcaaaagattctccttcagccagcggtcgcgcgacgagtctgcctctgaaactagcaccccatcagagcacagtgctgccccttcgccccaggtcgaggtgagaactctagagggacagctggtacagcaccccgggccaggaattccaagacccggtcatcggtcacgtgctcccgaactggtgaccaagaagttcccagtggatctgcgcctgccccccgttgtacctttgcctcccccgaccctgagggagctggaactccagcgtaggcctacgggtgattttggcttctcgctgcgacggacaaccatgttggaccgcgggcctgaagggcaggcttgccggcgcgtcgtccatttcgcagaacctggcgcaggcaccaaggacttagccctgggattggtgcccggggatagattggtcgagatcaatggtcacaatgtggaatccaaatcaagagacgaaatagtcgagatgatacgccagtcaggcgattccgtccggcttaaggtgcagcccatccccgaactgtctgaacttagccggtcttggctccgttctggggaaggacctaggagagagcccagcgatgccaaaactgaggaacagattgccgcagaagaagcctggaatgagactgagaaagtttggctggtgcaccgagacgggtttagtcttgcctctcagcttaaatcagaagagttgaatctgcccgagggcaaggtaagagtaaagcttgaccacgatggggccatcctcgacgttgacgaagatgacgttgaaaaggctaatgctccctcttgtgacaggctggaggatcttgcctctctcgtctatctcaatgagagcagtgtgctccacacgttgcggcaacgctacggtgcatctctcctccacacatatgcaggtccctcattgttagtgctcggacctcgcggagcgcctgccgtgtattccgaaaaagtgatgcatatgttcaagggctgtaggcgagaggacatggccccccatatctacgctgtggcgcagaccgcctaccgagcaatgttgatgagtcggcaagaccagtcaattatactgctcggcagttccggatcaggcaagaccacgagctgtcagcatctggtgcagtatctagctactatcgcgggtatcagcggaaataaggtcttttcggtggagaagtggcaggccctttacacactgctggaggcctttggcaactcaccaacaattattaacggcaacgcgactagattctcccaaattctctcccttgacttcgaccaggccggacaggtcgcttcagcatccattcagacaatgcttctggaaaagctacgggtcgctaggaggccagcatcagaggccacattcaatgtcttctattacctactcgcttgtggagatggaacgctaaggaccgaactccatctaaaccaccttgctgagaataatgtgttcgggattgtcccgcttgccaaacctgaggagaagcagaaggccgcccagcagttctccaagctgcaggcagccatgaaggtgctcggaatttcccctgatgaacagaaggcctgctggtttatccttgccgccatttatcatctgggagccgctggagcaaccaaggaagctgctgaggccgggcgcaagcagttcgcaagacacgaatgggcacagaaggcagcatatctgctcggttgcagtctcgaggagttatcaagtgccatatttaagcaccaacataagggaggcacgctgcagcggtctacatctttccggcaggggcccgaggaatccggattgggggacggaactggacccaagctgagcgctctggagtgccttgaggggatggccgccggcctttattctgaactcttcacactcctcgtgagtctggttaatcgggcactaaagtccagtcagcacagcctctgcagtatgatgatagtagatacaccaggcttccaaaaccctgagcagggtggctctgcgagaggggctagcttcgaggaactatgtcataactacacccaggatcgcctgcagcgccttttccacgagcgaactttcgtacaggagttggaaaggtataaggaggagaacatcgaactggctttcgatgatctggagcctcctaccgatgacagtgtggcagcggttgatcaggcaagccaccagagccttgtgcgcagtctagcgcgtaccgacgaagcccggggtcttttgtggctgctcgaagaagaagcacttgtgcccggcgcatctgaagacactctgttggaacggctgttcagttattatgggccccaggaaggggataagaagggccagtctccgctgcttcacagctccaaacctcaccacttcctgctggggcactcccatgggaccaactgggttgaatacaatgtgactgggtggcttaactacacgaaacagaaccctgcgacccaaaacgctcctcgcctgttgcaggactcacagaaaaagattatctctaacttgtttctgggaagagccggctcggcaacagtgttatccggctccattgccggcctggaaggtggctcgcagttggccctgcgtagagctaccagtatgcgtaagacgtttaccacaggaatggcagctgtcaagaagaaatccctgtgcatccaaatgaagcttcaggtcgacgcactaatcgataccattaagaaaagcaagttgcactttgtgcactgtttcctacctgtggcagaaggctgggctggtgaacccagatcagcctcatcaagaagagtgagctcttcttcggaactagacctgccttcgggggatcattgcgaggccgggctgctgcagctggatgtgcctcttctgaggacccagctaagagggagccgcctgcttgatgccatgcgaatgtacaggcagggttatcctgaccacatggtgttctccgaatttcgacggcgcttcgatgtgctggcgccgcacttgactaaaaagcacgggcggaattatattgttgtggacgaacgccgcgctgttgaggaactcctggagtgcctggaccttgagaagtcctcctgctgcatgggactttctagggtcttttttcgggcaggtacattagcacggttggaggagcagagagatgaacagacatcccgcaacttgacactgttccaggccgcctgccgcggttaccttgcccggcagcacttcaagaagcgcaagatccaggacctagctatccgctgcgtccagaagaacatcaaaaagaataaaggtgtcaaggattggccgtggtggaagttatttacaacggtaaggcccctgattgaagttcagctatctgaagagcagatccgcaacaaagacgaggagatccagcagctgcgttcaaaactcgaaaaagctgaaaaggagaggaacgagctccgcctgaactcagaccgtctggagtcgagaatttctgaactcacatcagagctgaccgacgaacggaatactggagagtcggccagtcagctgctggacgcagagaccgccgaacggttaagggcggagaaagagatgaaggagttacagacacagtatgatgctctgaaaaagcagatggaagtgatggaaatggaagtgatggaggcaagactcatccgagccgccgagatcaatggagaggtagacgacgatgacgcagggggcgaatggcggctcaagtatgaacgcgcagtccgtgaagtggattttacaaaaaagcgcctgcagcaggagttcgaagataaactggaggtggaacagcagaacaaacgtcaactcgagcggcgcctaggggacctacaagccgattctgaggaatcccagcgagcccttcagcagctaaagaagaagtgtcagcgccttactgccgagctgcaggacaccaaattgcacctggaggggcagcaggtgcgaaaccatgagttagaaaaaaagcagcggcggttcgatagtgagctaagtcaggcccacgaggaagcccagcgggaaaagctccagcgcgaaaaattgcagagggaaaaggatatgctgttagcagaggccttctctctgaagcagcagctcgaggaaaaggacatggacatagccggcttcacgcaaaaggtggtaagtctggaggcagagctccaggatataagctctcaggaatcaaaggatgaagccagcttagctaaggtgaaaaagcagctaagggatttggaagcgaaggtcaaggaccaggaagaggagctggacgagcaggcaggtactatccaaatgctcgagcaggctaagcttcgcctggaaatggaaatggaacgaatgcgacagacacactcgaaggaaatggagtctcgcgacgaagaagtggaggaggcccgccagtcgtgtcaaaagaaacttaaacaaatggaagtccaactcgaggaagagtacgaagataaacagaaggtgctgagggagaaaagagaactggaaggtaagcttgcaacactttctgatcaggttaacagacgggatttcgagtccgaaaagcggctacgaaaagacctgaagaggacaaaagctctgctagccgacgcccagctaatgctggaccaccttaaaaactcagcaccctccaaaagagagattgcccagctcaagaatcagttggaggagtctgaatttacttgtgccgctgccgtcaaggctagaaaggctatggaagtggagatcgaggacctccacctgcagattgacgacatagcgaaagctaaaactgccctcgaggagcaactgtcacgccttcagcgggagaaaaatgaaattcagaatcgactcgaggaggatcaggaagatatgaacgagctgatgaaaaagcacaaggcggcagtggcacaagctagccgggatctggctcaaatcaacgacctgcaggcccagctggaagaagccaacaaggaaaaacaggagctgcaggagaagctgcaagccttgcagagccaggtggagtttctcgagcagtcaatggtggataagtcgttagtctcaaggcaagaggcaaagattcgggagcttgaaacaagactagaattcgagcggacccaggttaaacggttagagagtttggcctctcgattgaaggagaacatggagaagctgactgaggagcgggaccaacgcattgcagccgaaaatcgagaaaaagagcagaacaaacgactgcagaggcagcttagagacacgaaggaagagatgggagaattagcgagaaaggaggctgaagcctcaaggaagaaacacgagctcgagatggacctggaaagtctcgaagccgcgaatcagagcctgcaggcagacctgaaactagcttttaaacgtattggagatttacaagcagcaatcgaggatgaaatggaatccgacgagaacgaagacctgataaactctgaaggagacagcgacgtggatagcgaactcgaggaccgggtggacggcgttaagagttggctgtctaagaataagggcccatccaaagcagcctccgatgatggatcactgaagtcgagttctcccacctcatactggaagagcctagcacccgataggtccgatgacgaacacgatcctctggataacacgtctcgcccacggtactcccactcttatctgtcggattccgatactgaagccaaactcaccgagacaaatgcctag

SEQ ID NO: 125486 - DNA, 6009 bp, Artificial Sequence
  Description of Artificial Sequence: Synthetic coding sequence
atgtttaatctaatgaagaaagataaggacaaagatggtggtcggaaagaaaagaaggagaagaaggagaagaaggaacggatgtccgccgccgagctacgctcactggaggagatgagcctgcgcagagggttcttcaacctgaataggtccagtaagagagagagcaaaactcgactcgagatttctaatcctatccccataaaggtggccagcggaagtgatctgcacctgactgacattgactctgattccaacaggggctctgttatcttggacagtggccacctttcaacagccagttccagcgatgatctgaagggagaggagggatcatttaggggatctgtgctccagagagctgcaaaattcggcagccttgctaagcagaacagtcagatgatcgtgaagaggttttccttctctcagcgcagcagagacgagagcgcaagtgagacgtcaaccccctctgagcacagcgccgcccctagtcctcaggtggaagtgagaacccttgagggtcagctggtccagcatcccggtcccggaattccacggcccggtcatcgatcccgtgcccctgagctggttacaaaaaaatttcctgtagacctgcgccttccaccggtcgtcccgttacctccacctactctgagagaactggaattgcaaaggcgcccaacaggtgattttgggttctctctcagaaggacaaccatgctggaccgcggccccgaagggcaggcatgtcggcgagtggtgcatttcgcagaacctggcgcagggactaaggacttggccctggggctcgtgcccggggatcggctggtcgaaattaatggccacaatgtggaatcaaaatctcgagatgagatagtggagatgatcagacagtctggcgatagcgttcgactcaaagttcagcccatccccgagctgtccgagctgagtcggtcctggctcagaagcggtgaaggcccacgacgggagcccagcgatgcgaaaaccgaagagcaaatcgccgcagaagaggcctggaacgagaccgagaaggtctggctggtccacagagacggcttcagcctggcctctcagcttaaaagcgaagaactgaacctgcccgaaggcaaagttcgagttaagctcgaccatgatggcgccattttggatgttgatgaagacgatgtggaaaaagccaacgccccttcttgtgatcggctagaagatctggcatcccttgtctacctcaacgaatcttcagtgctacataccttgagacaaaggtatggcgcctccctcctacatacttacgcaggaccctcactgttggttctggggccccgaggcgctccagcagtgtatagtgagaaggttatgcacatgtttaagggctgccgacgggaggatatggctccccacatctacgccgtagcccaaaccgcttatagggcaatgttaatgagcaggcaggaccaatctataatcctgctgggatcgagtgggagtgggaagaccacgagctgtcaacatctggtgcaatatctggctactatcgccggaatctctgggaataaagtcttttctgtcgagaagtggcaggctctttataccttattggaggcattcgggaactcccctacaataattaacggcaacgctactaggttttctcaaattctgtcactggatttcgaccaggccggccaggtggcctccgcaagtattcagactatgctacttgaaaagctcagagtagcccggagacccgccagcgaggctacgttcaatgtgttctactatctcctcgcctgtggagatggaaccctgcgtactgaactgcacctgaaccacctcgccgaaaataatgtgtttggaatagtgcctctcgctaagccggaggaaaagcagaaagctgcccagcaattcagcaaactacaggctgccatgaaggttctcgggatttccccggacgagcagaaggcttgttggtttattctagccgccatttaccatctgggcgccgctggcgctactaaggaagccgctgaggctgggcgcaagcagttcgcaagacatgagtgggcacagaaggcggcctatcttctgggctgttcccttgaggagctctcaagtgccatttttaagcatcagcacaagggggggacactgcaacgttcaacttcttttcgacagggtcccgaggaatcgggtctgggggacggcaccggacctaagctgtcggcattggaatgcctcgaaggcatggccgccggcttgtacagcgagttgtttactctgttggtgtccctggtgaacagggccctcaagtcaagtcagcactctctctgctctatgatgattgtagacactcccgggtttcagaaccctgagcaggggggctccgctagaggggcctcctttgaggagctctgccataactatactcaggatcggttgcagagattatttcacgaacgtactttcgtgcaggagctggagcgttacaaggaagaaaatattgagttggcctttgacgatctggagcctcctaccgacgacagcgtcgctgccgtggaccaggcctcccaccagtcacttgtcagatccctggccaggacagatgaagctcgcgggcttctgtggctgttggaggaggaagcactagtgcctggagcttctgaggacacgctgctggagagactgttttcatactatggaccccaggagggagacaagaaggggcagagtcccttactgcactctagcaaacctcaccatttcctgctggggcatagtcatggaactaactgggttgaatataacgtgacagggtggcttaattacacgaagcagaatcccgctactcagaatgctccacggctcttgcaggattcacagaagaagatcatctcaaatctgttcctgggcagggccggctccgcaaccgttctttctggctctatcgcaggactggaggggggttctcagctcgctctccggagggctactagtatgcggaagactttcacaactgggatggccgcagtgaaaaagaagagtctgtgcattcagatgaaactgcaggtggacgccctgatcgacactattaagaaatcaaagttgcatttcgttcattgttttctccccgtggccgagggttgggccggcgagcctaggtctgccagcagccggagggttagctcttcatccgagctagacctgccgtcaggtgatcactgcgaagcaggcttactacagcttgacgtgcccctgctgcgcacccagttaaggggtagcaggctgttggatgcaatgcgaatgtatagacagggctaccctgatcatatggtgttctcggagtttcgaagaagattcgacgtactcgctccacatcttactaagaaacacgggcggaattacatcgttgtggacgaaagacgggccgtcgaggagctgctcgagtgccttgatctcgaaaaatcttcttgctgcatgggactgtccagggtgttttttcgagcaggcacactcgctagactggaggagcagagggatgaacagacctctagaaatttgacgctttttcaagctgcatgcagggggtatctagcccgtcagcatttcaagaaaagaaagatacaagacctagctataagatgcgtgcagaagaatataaaaaagaataaaggtgttaaagactggccctggtggaagctcttcaccacagttcggccactaatcgaggtacaactgagtgaggagcagatccggaacaaggacgaagagatccagcagcttaggagcaagctggaaaaagccgaaaaagagagaaatgaactgcgccttaattctgaccgcctggaatcgcgtattagtgaactgacttcggagttgaccgacgagcgaaacacaggggagtcagcctcccaactcttagatgccgaaacggctgagcgcctgcgtgccgaaaaagagatgaaagagctacagacccaatacgacgctctaaagaaacagatggaagttatggaaatggaggtcatggaagcacgcctgattagagctgcggagatcaatggtgaggttgacgacgacgacgccgggggagagtggagactgaaatatgaacgggcggtgagagaggtggatttcacaaagaagagactgcaacaggaatttgaggataaactcgaggtggagcagcaaaataagcgccagctcgagcggaggctgggggacctgcaggccgacagtgaagagagtcaaagggcgttgcagcagctgaaaaaaaaatgccaacgccttactgctgagctgcaggataccaagctgcacctggagggccagcaggtgaggaaccacgagctagagaagaaacagcgcaggtttgattccgagctttcgcaggcacacgaggaagcccagagggagaagcttcaacgcgaaaagctgcaacgggagaaggatatgttgctggctgaggccttttctctaaaacagcagctcgaagaaaaagacatggatatagctggattcacacagaaggtagtttccctggaagctgaactccaggacatctcctctcaggagagtaaggacgaggctagcctcgctaaagtgaagaagcagttgagagatctggaggccaaggtcaaagatcaagaagaagaattggacgagcaggccggaactatacagatgctcgagcaactgaagcagatggaggtccagctggaagaggagtacgaagacaagcagaaggtgctgagggagaaacgggaactcgagggaaagttggctaccctttctgatcaggtgaacaggcgagatttcgagagtgagaagcgactcagaaaggaccttaagagaaccaaagcgctattggcagacgcccagctgatgctagatcatctcaaaaattcggctccctcgaagcgtgaaatcgcccagttaaagaaccagctggaggagtccgagttcacctgtgccgctgccgtgaaggcccggaaagctatggaggtggaaatcgaagacttgcacctgcagatcgacgacattgccaaggccaagaccgcactggaagagcagctatcccggctccaacgagaaaaaaatgagatccagaaccgcttagaggaagaccaggaggatatgaacgagctgatgaaaaagcacaaagcagcagtcgcccaagcgtcacgagacctggctcagatcaacgacttgcaggcccaattagaagaagccaataaggagaagcaggagctccaggagaagctgcaggccctgcagagtcaggtggagttcttagagcaatcaatggtggacaagtcattggtgtcacgacaggaggccaaaattagagaactcgagacgagactggagtttgagagaacgcaagtgaaaaggctcgagtcgctggcgtcgcgactcaaggaaaacatggagaaactgacggaagagagggaccaaaggatcgccgccgaaaacagagagaaagagcagaataaaagacttcaacggcagcttagggacactaaagaggagatgggcgagctcgctcgcaaagaggctgaggccagtaggaagaagcatgaactggagatggatctggaatccctggaggccgccaaccagagcctgcaagctgatctgaaattagccttcaaacggattggtgacctgcaggccgcaattgaagacgagatggagtccgatgaaaacgaggatctgatcaatagtgagggcgactcggacgtggactccgaactcgaagatcgagtcgatggggtgaaaagttggctatctaagaacaagggaccttcaaaagctgccagcgacgacggctccctaaagagttcttctccgacgagttattggaaatcgctggcccccgatcggtctgatgacgagcatgaccccttggacaacactagcagacccaggtattcccattcgtacctttcagatagtgacaccgaggctaagctgaccgaaacaaacgcatag

SEQ ID NO: 125487 - DNA, 2808 bp, Artificial Sequence
  Description of Artificial Sequence: Synthetic coding sequence
atgagaatgtataggcaggggtaccccgatcacatggtgttctctgaatttcggcgccgattcgacgtgctagctccacacctgacaaagaagcatggtcgtaattacatcgttgtcgatgagagaagagcagtggaggaattacttgagtgcctcgacttggaaaagtcctcgtgctgtatgggcttatcaagggtattctttcgggcgggtacactagccagactggaagagcagcgtgacgagcagacaagtcggaacctcacattgtttcaggcggcctgtagaggatatctcgcgcgtcagcatttcaagaagaggaaaatacaggatctggccatccgatgcgttcagaagaacatcaagaagaataagggagtgaaggactggccctggtggaaactctttacaaccgttagacctctcattgaagtgcagctgagtgaagagcagattagaaacaaggatgaggagattcagcagctgcggagtaagctggagaaagccgaaaaagagagaaacgagctcaggctgaatagcgacaggctggaaagccgaatctctgaactgacgagcgaactgacagacgaaagaaacacaggcgagtcagcgtcccaattactcgatgccgaaacggccgagagactccgtgctgagaaggaaatgaaggagctgcagacccagtatgacgctctcaagaagcagatggaggtgatggaaatggaagtcatggaggcccgactgattagggccgccgagatcaacggagaagtggatgatgatgacgccgggggcgagtggcgacttaagtatgagagagccgtcagggaggtggatttcaccaagaagcggctccagcaggaattcgaggacaaactggaagtggagcagcagaataagaggcaattggaaaggagactgggcgacctccaggcagattctgaggaatctcaacgcgccctgcagcagctgaagaagaagtgccagagattgaccgccgaactacaagatacgaagctgcatctggagggccagcaggtccgtaaccacgaacttgaaaaaaaacagcgacgcttcgacagcgagctgagtcaggcccatgaggaggcgcagagggaaaaactacagagggaaaagctgcagagagaaaaggatatgctgctcgcagaagcgttcagccttaaacagcaattggaggagaaggacatggatattgctggctttacacaaaaagtggtttcactagaggcagaactccaggatataagctctcaggaatctaaggacgaggcctcgctggcaaaggttaagaagcaactgagggatctcgaggctaaggttaaggatcaggaagaagagttggatgaacaggccggcacaatccagatgttggagcaggccaaactgcggctcgagatggagatggagcgtatgagacagacccacagtaaggaaatggaatcgagagatgaggaggtcgaagaagctcggcaatcatgtcagaagaagctgaagcagatggaggttcagctcgaggaggaatatgaagacaagcagaaggtgctgagggagaaacgggagctggagggcaaactagctacactaagcgaccaggtgaacagacgcgactttgaaagcgagaagcgcttgagaaaagacctgaaaagaaccaaggcattgctggcagacgcccagctgatgctcgaccatctcaagaactctgcaccgtccaagcgcgagatcgcacagctcaaaaaccagttggaggagtccgaattcacatgtgccgcagcagttaaggctaggaaggccatggaagtggaaattgaagacctgcatttgcaaattgatgatatcgctaaagctaagacagccctagaggaacagctctcccgattgcaaagggagaaaaatgaaatccagaataggctggaggaggatcaggaggacatgaacgagctgatgaaaaaacacaaagcagcagtggcgcaggcttcccgcgatcttgcccagattaacgacctccaggcacagttagaggaagccaataaagagaagcaggagctgcaggaaaagcttcaggccctgcagtctcaggttgagtttctcgaacagagtatggtggataaatccctcgtgtcccgccaagaggctaagatccgggagctcgaaacccgcctcgaatttgagagaacccaggtgaagcgccttgaatcattagcatccaggctcaaggaaaatatggaaaagctgactgaagagcgggaccagcggatcgcagcagaaaatagagagaaagaacagaacaagaggctgcagcggcaactacgggataccaaggaggaaatgggggaattggcccgcaaggaggccgaggcctccaggaagaaacatgagctggagatggacctcgagtcattggaggctgcgaatcagtcgctgcaggcggatctaaagctggcttttaagaggattggagatctgcaggcagccattgaagacgagatggagtcagacgaaaacgaggaccttatcaattcagagggggactcggatgtggattcggagctggaggatagagtggacggcgtgaaatcctggctgtccaagaacaagggcccaagcaaggctgctagtgatgacggctccttaaagtctagttcacctacctcctactggaaatccctcgcacctgacaggagcgacgatgagcacgaccctttggataatacgtcaaggcctcggtacagtcatagctatttgagtgacagtgatacagaggccaaactgacagagaccaacgcctag

SEQ ID NO: 125488 - DNA, 963 bp, Artificial Sequence
  Description of Artificial Sequence: Synthetic coding sequence
atgacattcgtgcttctttcctcaagtcagctggaagagcagctgtcccgcctgcagcgtgagaagaacgaaatccagaatcgacttgaggaggatcaggaggatatgaacgagctgatgaagaaacataaggctgcagtcgcccaggcatccagagaccttgctcagatcaacgatctgcaggcccaactggaggaggcaaataaagagaaacaagagctgcaggagaaactgcaggctttgcagtctcaagtggagtttctggagcagagcatggtggacaagagtcttgtatcacgccaggaggccaagatccgagagctagagacgagattggagttcgagagaacccaggtgaaaagactggagagcctcgcatcacgccttaaagagaacatggagaagctgacagaagagagagaccagagaatcgctgccgagaacagagaaaaagaacagaacaagcggctgcaacgccaacttcgggataccaaagaagaaatgggcgaattagcacgaaaggaagccgaggcgtccaggaaaaaacatgaactggaaatggacttagaaagcctggaagctgcaaaccagtccttacaggccgatctgaaactcgcctttaagcgaataggggacctacaggctgccatagaagacgagatggagtctgatgaaaacgaagatctgattaatagcgaaggagactctgacgttgacagcgagctggaggaccgggtggatggggtgaagagctggctgagcaagaacaaaggcccaagcaaagcagcttctgatgatggatccctgaaatcctcttcccctacatcttattggaagagcttggccccagatcgtagcgatgacgagcatgatcctcttgataacaccagccggcctcgctacagccattcctatctgtcagactcagataccgaagccaaactgacggaaacaaacgcttag

SEQ ID NO: 125489 - DNA, 7704 bp, Artificial Sequence
  Description of Artificial Sequence: Synthetic coding sequence
atggccataagcagccggctagccctctgggagcagaagatcagggaggaggacaagtctccacccccttctagccccccacctctgttttctgttatccccgggggtttcatcaagcagcttgtgcgcggaaccgagaaggaagctaaggaagcccgacaacgcaagcagctcgctgtggccagccctgagagggagatcccagaaatctctatctctcagcccaactccaagtcttcttccggcacacgctccggcagccaacagatttctcaggacgatcagtcgtccagccccggtagcagcgatatactcggaaaagaatccgaagggtctcgctcccccgacccagaacagatgacatctatcaacggagagaaggcccaggaactcggctcttccgcaaccccaaccaagaagacagtgcctttcaagaggggggtgcgccgcggtgacgtgctcctaatggtggccaaactagatcctgattcggctaagcccgagaagacccacccacatgatgcaccaccatgcaaaacatccccacctgccaccgatactgggaaggagaagaaaggcgagacctccagaacaccttgcggaagtcaagcctccaccgaaatcctagctccgaaggccgagaaaacgcggacaggaggcctcggtgatcccgggcaagggaccgtggcgctaaaaaaaggagaggaggggcagagtatcgtggggaaagggctaggtactcccaagactacagagctcaaggaggccgagcctcagggcaaagatcggcaaggaacgagaccacaggcccaggggccaggggagggggtgcggcccggcaaagccgaaaaggagggggcagaacctaccaatactgtggaaaaagggaatgtgtctaaagacgtgggcagtgagggaaagcacgttcggccccagatacccggtaggaagtggggtggatttctgggccggcggtccaaatgggatggcccccagaacaagaaggataaagagggagtgctcctgtcaaaagctgagaaaacaggcgaaccccagacacaaatggagaagactagtcaagtgcagggcgaactgggggatgacctacgtatgggcgagaaggccggcgagctcaggtccactactggaaaggctggtgaatcttgggacaaaaaggaaaagatggggcagccacagggcaaatccgggaacgcgggggaggctcgttctcagaccgagaaaggatgtgaggccccaaaagaggttagtacaatggtggagtctcctgctgcacctgggaaagggggctggcccggtagtcgcggacaagaggctgaggagccatgcagccgagcaggcgatggcgcaggggctctagaaactgaactggagggcccctcacagccagccttagagaaggatgctgagagaccgcggatccgtaaggagaatcaagatggacccgccccgcaggaagaaggtaagggcggccagtctcgagatagcgaccaggctcccgaggatcgttggtacgaagctgaaaaagtctggcttgcccagaaagacgggttcacccttgcaacggtgcttaaaccagacgaaggcaccgccgatctcccagcaggtcgagtccggctctggattgacgccgataaaaccataaccgaggtggatgaggagcacgtgcacagagctaacccaccagaactggatcaggttgaagacttagcttcccttatttcagtgaatgagtcctcggttctgaatacgctgctccagcgctataaagcccagttgctgcacacctgcaccggccccgacttaattgtgcttcagccccggggaccttcggtcccaagcgctggtaaagtccctaaggggcgccgggacggcctgccagctcacataggctctatggcacagcgggcgtactgggcactgctgaaccagcggcgcgaccagtccatcgtcgccctcgggtggtcaggtgcaggaaagacaacttgttgcgaacaagtgctcgaacacctcgtggggatggctggctcggtggacggccgagtttcggtcgaaaagatacgagcaaccttcaccgtcctgcgcgctttcggcagcgtgagcatggcccatagccgcagtgcaacgagattttctatggttatgtcactggactttaatgccactggacgaataactgccgctcagctacagacaatgctgctcgagaagtcccgtgtcgctagacagccggagggagaatcaaactttcttgtattttctcagatgctggctggactggatctcgatctgagaacagagttaaaccttcatcagatggcggattcctccagctttggaatgggtgtgtggtccaaacctgaagacaaacagaaggcagccgccgccttcgcgcagctgcagggggccatggagatgctcggtatctccgagtccgaacagcgagccgtttggcgtgtccttgccgccatttaccatctaggcgcagctggtgcctgcaaggttggcagaaagcagttcatgcgatttgaatgggcaaattacgcggctgaggcccttggatgcgaatacgaggaactcaatacagcaactttcaaacaccatcttaggcaaataatccagcagatgaccttcggcccttcccgttggggactcgaagacgaagagacaagttccgggctcaagatgactggtgtggactgtgtagagggcatggcaagcggcctctaccaggaactgttcgcagctgtggtgagcctgatcaaccgcagcttctcttctcatcatctgagcatggccagcattatggtagttgactccccaggctttcagaatccccgccatcagggaaaggatcgggcggctacctttgaggaactatgccacaattacgctcatgagcggctccagctcttgttttatcaaagaacctttgtttccactctccagaggtaccaggaagagggagtgcctgtccaatttgacctccccgatccttcacccggtaccaccgtggccgtcgtggaccagaacccatcccaggtgcgacttcctgccggcgggggagcccaggacgccagaggcctattctgggtcctcgatgaagaggtgcatgtggaagggtcgtcagattctgtagtactcgagcgactgtgtgccgcttttgagaagaagggcgccggaacagaaggaagttcagctcttcgcacttgtgaacagccactccagtgtgagatcttccaccagcttggatgggaccctgtgagatacgatctcaccggttggcttcatcgggccaaacccaatctcagcgccctggatgctccgcaagtcctccaccaatctaagcgtgaggagctccgttcactcttccaagctcgtgcaaagctgccccctgtgtgtcgtgccgtcgccggtctggagggaactagccagcaggcccttcaaagatcgagaatggttcggcgtaccttcgcaagtagtctggctgccgtcaggagaaaggcaccctgcagccaaattaagctgcagatggatgcactgacatcaatgataaagcggtccagactgcacttcattcactgtctggtcccaaatcccgtggttgagtccagaagtggacaagagagtccgcctccccctcagccgggtcgggataaacccggagccggcggtcccctggcactcgacatccccgccttaagagtgcagctggcaggcttccatatcctagaagcgctgagacttcatcgaacaggttacgctgatcacatgggacttacacgattccgtcgacagtttcaagtgctcgacgccccactgctcaaaaaactgatgtccaccagcgagggtattgacgagcgcaaagcagtagaggagctgctcgaaacccttgacttagagaagaaggccgttgcggtcggccacagccaggtgttcctgaaggctggagtcatcagccgcctggaaaaacagagggaaaaattagtgagtcagtcgatagtcctgtttcaagcagcttgcaagggcttcctttcaaggcaggagttcaagaaactgaaaatcagacgcctagccgctcagtgtattcagaagaatgtggctgtctttcttgcggtcaaagattggccttggtggcagctcttggggtcccttcaacctctcctgtcagcaaccatcggcacggagcagctgagagctaaagaagaggaactcacgactctgagacgcaagctggaaaagagtgagaagcttaggaatgagctgagacaaaatactgaccttctcgagagtaagatagccgacctgacctctgatctggcagacgaacgttttaagggcgacgtagcctgccaggtactggaaagcgagcgggccgagcgcctgcaggcattccgcgaagtgcaggaactaaaatccaagcacgaacaggtgcagaagaaattgggtgatgtcaataaacagcttgaggaggctcagcaaaaaattcagctgaatgatctagagcggaatcctacagggggagccgatgaatggcagatgcggttcgactgcgcccagatggaaaatgagtttcttagaaaaaggctgcaacaatgtgaggagagattggatagcgaactcacagctagaaaagagctggagcaaaagctgggggaactgcaaagtgcctatgatggagccaagaaaatggctcaccaactaaaacgtaagtgtcaccatctgacttgcgatctggaagacacgtgcgtgctgctggagaaccagcagagtcgcaaccacgaactggaaaaaaagcagaagaaatttgatctccagctagctcaagccctgggggaatctgtctttgaaaagggtctgcgggagaaagtgacccaggaaaacacatccgtaaggtgggaacttggccagttacagcagcagcttaagcagaaggaacaggaggccagccagctgaagcaacaggtggagatgttgcaggatcataagagggaactgttgggctcacctagtcttggcgagaattgtgtagctggcctaaaagaaaggctgtggaagctcgaatccagcgcccttgagcagcaaaagatccaaagccaacaggagaacaccattaaacagctggaacagttgcgccaacggttcgagcttgagattgagaggatgaaacagatgcatcaaaaagatcgggaagatcaggaggaggagctagaggacgtgcggcagagctgtcagaaaagattgcatcagttggagatgcagctggaacaagagtacgaagaaaagcagatggttctgcatgagaagcaggacttagagggattaattggcaccctgtgcgaccagatcgggcatcgagacttcgacgtcgagaaaagattaagaagggacttacgaagaacacacgccctgcttagcgatgtgcagctcctgctgggtaccatggaggatggtaaaactagcgtctcaaaggaggaactggaaaaggttcacagccagctggagcaatctgaagccaaatgcgaagaagcgcttaagacccagaaggtcctgacagcagatctggaaagcatgcattctgaacttgaaaacatgactagaaataaatcattggtggatgaacagctgtacaggctgcaattcgagaaggcagacctcttgaagcggatagatgaagatcaggatgaccttaatgaacttatgcagaagcacaaagatctcatcgcgcagtctgctgctgatatcggacagatacaagagctccaacttcagctagaagaagccaagaaggagaagcataagctccaggaacagctgcaggtggctcagatgcgcatcgagtaccttgagcagtctacagtggatcgtgcaattgtgagtcgacaggaagcggtgatttgcgacctcgagaacaagacagagtttcagaaggtgcagatcaagaggttcgaggtgctcgtaattcggctgagagattccctgatcaagatgggtgaagagctctcccaggctgcaacttctgagtctcaacagagggagagctcgcagtactaccaacggcggctcgaggagctcaaagcggacatggaagagctggtccagcgcgaagcagaggcctctagaaggtgcatggagcttgaaaagtacgttgaggagttagccgcagttaggcaaacccttcagactgatcttgaaacgagtatacgtaggatcgccgacctacaggcggccctggaagaagttgcatcttccgattctgataccgagagcgtgcagaccgccgtcgattgtggctcgtccggccgaaaggagatggataatgtatctattttgtcttcacaaccggaaggctcactccaatcttggctgtcatgcaccctgagtctcgctaccgacacaatgcgaactccaagccgccagtccgccacaagctctcgcattctgtcacccaggattaatgaagaggcaggagatacagagcggacgcagagcgccttggctctgagccgagcacgttccaccaacgtgcatagtaagacctctggggataagccagtgagccctcatttcgtgcgacgccaaaaatactgtcacttcggcgacggggaggtgctggccgtgcagcgcaagtcaactgagcgccttgaaccagcaagctcacctttggcttcacggtccaccaacactagccccctgtctcgggagaagctgcccagcccatcagccgcgctgtccgagttcgtggaaggactccgccgcaaaagagcacagcgcgggcagggctcaactttaggtcttgaggactggccgaccctgcctatttatcagactacgggtgctagcaccctgcgccgcggccgcgcaggatcagatgaaggtaatctctctctgcgagtaggcgctaagtctccactggagatcgagggggctgccggcggcctgctgcgatccacctcccttaagtgcatcagttctgatggggtgggcgggactactctactacctgagaagtctaaaacacagttttcatcctgtgaatccctcctggagtcccggcctagtatgggacgcaaattgtcgtcaccaacaactccccgcgacatgcttctgtccccaaccctgaggccaaggcgaaggtgcctggaatctagcgtggatgatgcaggttgccctgatttgggaaaggagcctttggtgtttcagaacagacagttcgctcacctaatggaagagcccctgggatccgaccctttcagttggaaactaccttctctcgattacgaacgcaaaaccaaggtggactttgacgacttcctgcccgccatccgcaagccccaaacacctacatctctggcggggagcgctaagggcggacaggatgggtctcaaagaagctcaattcattttgagactgaggaggccaacagatcttttttatctggaatcaagactattcttaaaaagtccccagagcctaaagaggacccggcccacctaagcgattcttcttcttccagtggatccatcgttagctttaagtctgccgattccatcaaatccaggccaggcattcctcgtctagccggggatgggggggaaaggacctctccagaacgtagggagcccggtactggcagaaaggatgatgatgtggcatcaattatgaaaaaatatttgcaaaagtag

SEQ ID NO: 125490 - DNA, 7707 bp, Artificial Sequence
  Description of Artificial Sequence: Synthetic coding sequence
atggccatctcctccagactggccttgtgggaacagaagattagggaggaagataaatcacccccaccctccagtccgccacccttattcagcgtcattcccggcggctttataaaacaattagtccggggaacagagaaggaagctaaagaggcgcggcaacgaaaacagctggcagtggcttcacccgaacgcgagattccggagatctctatcagccaaccaaactctaagagcagtagcggaactcgctctggatctcaacagattagtcaggatgatcagagctcatcccccggctcttcagatattctgggcaaagaatctgaggggagcagatcaccagacccggaacagatgaccagcatcaatggagagaaggcccaggagcttgggtccagtgccacccccactaaaaaaactgtgcccttcaaaaggggggttagaaggggagatgtgcttctgatggttgccaagctggatccggatagcgccaaaccagagaagacacatccacatgatgcccccccgtgcaaaacttctccacctgctacagatactgggaaagagaaaaagggcgagacaagccgcactccatgtggctcccaagcttctaccgagatcctcgcccccaaagccgaaaagacccgcacaggaggcctgggggatcctgggcagggcaccgtggcattgaaaaagggggaagaagggcaatccatcgtgggaaaaggtctcgggaccccaaagacaaccgagctgaaagaggcagaaccacaggggaaagatagacaagggacgagaccgcaggcccaaggcccaggggagggcgtgcggccggggaaggctgaaaaggagggggccgagcctactaacacagtggaaaagggaaacgtgagtaaggacgttggctcagaagggaaacatgtaagaccccagatcccgggacgaaagtgggggggctttctagggaggaggagcaagtgggatggtccacaaaataagaaggataaggagggcgtcttactgtcaaaagctgagaagaccggtgagccccagacccagatggaaaagacttcacaggtacagggtgagcttggcgacgacctgcggatgggagagaaggctggcgaactacggagcaccactggaaaggccggtgagtcatgggacaagaaggagaaaatgggacaacctcagggtaagtcgggaaacgccggggaggcgaggtcccagacagagaaaggatgtgaggccccgaaggaggtctctacaatggtcgaatcccctgccgccccagggaaaggcgggtggccaggcagtcggggccaggaagctgaagaaccttgttccagggcaggggacggcgccggtgcactcgagactgagttggagggccccagccaacccgccttggagaaggacgctgagcgacccaggatcaggaaggaaaatcaggacggtcccgccccgcaggaagaggggaaaggcgggcagagccgggatagcgatcaggccccagaggacagatggtatgaggcagagaaggtgtggctagctcaaaaggatggattcaccctggcgactgttctcaaacctgacgagggaaccgccgatctgccagcaggccgggtgcgtctgtggattgacgctgacaagacaatcaccgaggttgatgaggaacacgtgcatagggctaatcccccagagttagaccaggttgaggacctggctagcctcatcagtgtcaatgaaagttctgtgctgaatacgcttttacagcgctataaggcccagttattacacacttgtacgggaccagatttgatcgtgttgcagccccgaggaccctccgtccccagcgctggtaaagtgcccaaaggacgcagggatgggctgccagctcatatcggttcaatggcacagagagcctactgggccctgctaaatcagcggagggatcaaagtattgtagccttgggctggagcggtgccggcaaaactacctgctgtgagcaggtgctggaacatctggtgggcatggcaggcagtgtcgacgggcgtgtttccgttgagaaaatccgagccacatttactgttctgagggcgtttggctctgttagcatggctcatagtcggtcagctactcggttctccatggtaatgagcctcgattttaacgcaacaggtcgtatcacagctgctcaactccagactatgttgctggaaaagagcagagttgccaggcagccagagggcgagagtaattttctggtgttcagccagatgctcgccggactcgatcttgatctccggacagagctcaatctacaccagatggcagatagcagtagcttcggaatgggggtgtggtccaaacccgaggacaagcaaaaggcggcggctgcctttgcgcaattgcaaggcgctatggagatgcttggcatcagtgagagcgaacagagagccgtatggcgagtcctggctgccatctaccaccttggggccgctggagcctgcaaggtggggcggaagcaattcatgagatttgagtgggctaactacgcagctgaggcccttggatgcgagtatgaggagctcaacaccgcaacatttaaacaccatctgaggcagatcatacagcagatgacctttggcccctcccgttgggggttggaagacgaggagacctcgagcggcctcaaaatgaccggtgtggactgcgtggaggggatggcgtccggactttatcaggagttgttcgccgcagtcgttagcttaattaacagatcattttcttcccatcacttatcaatggccagcatcatggttgttgacagccccggatttcagaatccacggcaccagggaaaggatagggcagctacttttgaggagctctgtcacaactatgcccatgagcggttgcagctgctgttttaccagcgcacctttgttagcacccttcagaggtaccaggaagaaggagtccctgttcagttcgatcttcccgaccccagtcccggcactacagtggccgtagtggatcagaatccctcccaacaagtaaggctgccagctggcggaggggcccaggatgccagaggactgttttgggtgctggatgaggaagttcacgtggaaggcagcagtgactcagtcgtgctcgaacgtctgtgcgccgccttcgagaagaagggcgccggaacagaaggtagcagcgcattacggacctgcgagcagccccttcagtgtgaaatcttccatcagctcggttgggacccagtacgctacgatctcaccgggtggttgcaccgggccaaaccaaatctcagcgctctggacgcacctcaggtgctgcatcagtcaaagcgcgaagagctgcgcagcctctttcaggctcgggcaaagctgccgcccgtgtgtcgggcggtggctggccttgaggggacctcccagcaggccttgcaaagatctcgcatggtaagaagaactttcgcctcatcactggccgctgtgcgtcgtaaagcaccttgcagccagattaagttgcaaatggacgccctcacgtccatgatcaagcggtccagacttcactttatccactgtctggtgccaaacccagttgtcgagtcgaggagtggccaggagtctccccccccgcctcagccaggccgtgacaagcctggagctggaggcccactggccttggacatccccgcgctaagggttcaactagctgggttccatatactagaagctttgagactccaccgcaccgggtacgccgatcacatggggctgactaggttccgcaggcagttccaggttttggacgcgcccctgctaaagaaactgatgtccacaagtgaaggcatcgacgaacgcaaggcagtggaggagttgctggaaaccctcgatttagaaaaaaaggctgtcgctgtgggccatagccaggtgtttctaaaagccggagtgattagtcgtttggagaaacagcgagagaaactcgtgtctcagagcatagtgttattccaggcagcgtgtaagggattcctgagcaggcaagagttcaagaagttgaaaattagacggctggctgctcagtgcattcaaaagaatgttgctgtgttcctagctgtaaaggattggccatggtggcagcttcttggcagccttcaacctctcctctcggccactatcgggaccgaacaattgagggcaaaggaggaggagctgactacgctgcgccggaaactagaaaaaagcgagaagctcaggaatgagctccgccaaaataccgacctgctggagagtaagatcgctgatctcacctccgacctcgctgacgagcgattcaagggagatgttgcttgtcaggtgctggaatctgagcgtgctgagaggctgcaggctttcagggaagtgcaggagcttaagagcaagcacgagcaggtgcagaagaaactgggcgacgtgaacaagcaactggaggaagcacagcaaaagattcagctgaacgacttagaacggaaccccactggcggagctgatgagtggcagatgcgtttcgattgcgcccagatggagaatgaattcctgcgaaaacgccttcaacagtgtgaggagcgactcgacagcgagctgacagctagaaaagagctagagcaaaagttgggggagctgcaatcggcttatgatggcgcaaaaaaaatggctcatcaactcaagcgcaaatgtcaccatctgacttgcgatctcgaggatacttgtgtactgctagagaatcagcaatcaagaaatcacgaactggagaaaaagcagaagaaattcgacctccaactggcacaggccttgggggagagcgtgttcgaaaagggcctccgcgaaaaggtcacccaggagaatacctccgtgcgttgggagctgggccagctacaacagcaactgaagcaaaaggaacaggaagcctcccagttaaagcaacaagtggagatgttgcaggaccataagcgggagctgttagggagccctagtctcggagagaattgcgttgcaggactgaaggagcgcctgtggaagctcgaatccagcgcactggaacaacagaaaatacagagccagcaagagaataccatcaagcagctggaacagctgcggcagcgttttgagctcgagatcgaacgtatgaagcagatgcaccaaaaggatagggaggatcaggaagaagaattagaagatgttcggcagtcctgccagaaacggctgcaccagctcgaaatgcaactcgaacaggagtatgaggagaagcagatggtcctacatgagaagcaggatctcgaaggactcatcgggaccctttgcgatcaaattggtcatcgcgattttgatgtggagaagcggttacggcgcgatctgcggcggacccacgcacttctatccgacgtccagctacttctcggaactatggaagacggtaaaacgtccgtcagcaaagaagaactcgaaaaggtgcacagtcagctagagcagagcgaggcgaagtgtgaggaggcgttgaagacacagaaagtactaactgctgacctcgaaagtatgcatagcgaattagagaacatgaccaggaataaaagcctggtggacgagcagctttatagactgcagttcgagaaggccgacctccttaaaagaatagacgaggatcaggacgatctgaatgaactgatgcagaagcacaaggaccttatcgcccagtccgccgcagacattggccagatccaagagctgcagcttcagctagaagaagctaagaaggagaaacacaaattgcaggagcaattgcaagtggctcaaatgagaattgagtatctggagcagtctaccgtggatagggcaattgtatcccgccaggaggctgtaatctgcgacctggaaaacaagacagagtttcaaaaggtgcagataaagcgattcgaagtccttgtgattaggctgcgcgacagtttaattaaaatgggggaggaactctctcaagccgcaacatccgagagccagcaacgagagagttcccagtactatcaacggcgactggaggaactgaaggctgatatggaggaactggtgcagagagaggccgaagcatcccgcagatgcatggaactagagaagtatgtagaggagctcgccgcagttaggcagacactgcagactgatctggaaacctcaattcgcaggatcgcggatctccaagcagcactcgaggaagtggctagctccgactcagacactgagagtgttcagactgctgttgattgtggttcatctggtaggaaggagatggataatgtgtccatcctctcctcccagccggaagggtctcttcagtcatggctgtcttgcacactgtccctggctactgatacaatgcgcaccccaagtcgccagagtgccacttccagccgcatactctctcctaggattaatgaagaagccggtgacacagagcgaacacagtccgcactggccctctcaagagcccgctccactaacgtgcattccaaaacttccggggacaaacccgtgtctccacatttcgtgcgtcgacagaaatactgccacttcggagatggcgaagtgctcgctgtgcagagaaagtctaccgaacgactagagcccgccagctcccccctggcgtctaggagtacaaacacaagcccactgagcagggagaagctgcccagtccttccgccgccctctcggagtttgttgaagggctgcggcgtaagagagctcagagaggacagggaagtacactgggattagaggattggcccaccttgcccatttatcagaccactggagcgagcacccttaggcgtgggcgagccggatcagatgaaggaaacctcagtctcagggtaggcgctaagtcgccactggagatcgagggagccgccgggggcttgttgcgttctacttccttgaaatgtatttcttctgacggagttggaggcaccactctcctgcctgagaagtctaaaacgcaattttcgtcttgcgagtccttgttggagtccaggccgtccatgggacgcaagctgtccagcccaacaacgcctagggatatgctgttaagcccgactcttaggccgcgacgaagatgcttggaatcttcagttgacgacgctggctgccccgacctcggaaaggaaccgctggtgttccagaatcgtcagtttgcccatttgatggaagagcctctgggatctgacccattttcctggaagctaccttcattagattatgaacgaaagaccaaggtcgactttgatgattttctgccggccatacgtaagcctcagacaccaacaagcctggctgggagcgcaaagggaggccaggacggaagccagaggtcatcaatccacttcgagactgaagaggccaacaggagtttcctctctggtattaaaacgatcctaaagaagagcccagagcccaaggaagaccccgcccacctgtctgacagcagctcatcttctggctccatcgttagcttcaaatccgccgattcaatcaaatcgagacctggaatacctcgcctagctggagatggcggcgaaagaacctctcctgaacgtagagaaccagggacagggaggaaggacgacgatgtggcaagcattatgaagaagtatctccaaaaatag

SEQ ID NO: 125491 - DNA, 7704 bp, Artificial Sequence
  Description of Artificial Sequence: Synthetic coding sequence
atggcgatctcatctaggctggccctgtgggaacagaagattcgtgaggaggataagagtcccccgccatccagcccaccgcctctattctcggtaattccaggcgggttcatcaaacagttggttagaggtacagaaaaagaagcaaaagaggcaaggcagaggaagcagctcgcagtagcgagcccagaacgcgagattccagaaattagcatttcccagccaaactcaaaaagctcttccggcacacggagcggctcccagcaaattagccaagacgaccagagctcttcacctggctcatccgacattctagggaaggagtccgagggctctcgcagcccagacccggagcagatgacaagcatcaatggcgaaaaggctcaggagctgggaagcagcgccacacccaccaaaaagacagtgccatttaagagaggagtcaggcgtggagatgtgttgctcatggtcgctaaattggatccagatagcgctaaacccgagaaaacccatccacatgatgctccaccatgtaaaactagtcctccagccaccgataccggtaaggagaagaaaggagaaacgagccggaccccctgtggctcacaggcctcaacagagattctagcccccaaggctgagaaaacacgcactggaggtctgggcgacccaggccaaggaacagttgctttgaaaaagggggaggagggccagagtattgttgggaaaggccttgggacacccaagaccaccgagttaaaggaggctgagccccagggcaaggaccggcaggggacacgccctcaggctcaggggcctggagaaggtgttaggcctggaaaggcggaaaaggagggcgccgaaccaacaaacaccgttgagaaagggaatgtgtcgaaagatgtgggaagcgagggcaaacacgtccgaccacagatacctgggaggaaatggggaggattcctgggccgaaggtcaaagtgggacggtccacaaaataagaaagataaggagggcgtacttctcagcaaagccgagaaaacgggcgaaccgcagacacagatggaaaaaacctcccaggtgcagggggagctcggcgacgaccttagaatgggtgaaaaggctggagagctgcggagtaccactgggaaagcaggcgaaagctgggataagaaagagaagatgggccagccccaggggaaatcggggaatgccggagaggcccggagtcagactgagaaaggctgtgaggcgccgaaagaggtaagtactatggtagagtcccctgccgcccctggcaaaggtggatggcccgggtctagggggcaggaggctgaagaaccatgtagtagagcaggcgacggtgccggcgcgctggagacggaacttgagggccctagtcagccagccttggaaaaggacgcagaaagaccccgcatccggaaggagaatcaggacggacctgcaccccaggaagagggcaagggtgggcagtctagagactccgatcaagccccggaggaccgctggtacgaggcagagaaggtttggcttgcccagaaagatggatttacattggccacagtcctcaaacccgatgaagggaccgccgacctgccagccggtagagtgagactgtggatcgatgcagacaagacaatcacggaggtcgatgaggaacacgtgcacagagcaaaccctccagaactcgatcaggtcgaggacctggctagccttatctctgtgaatgaaagcagcgtcctcaacaccctcctgcaacgctataaggcccagctcttgcatacctgtactggacccgacttgattgtcctccagccccgcggaccctcagtgcctagtgccggcaaggtacccaagggcaggagagatggcttgccggcccacattgggagcatggcccagcgtgcttattgggccctgcttaatcagaggagagaccaatccatagtcgctctcggatggtccggagctggaaaaaccacctgctgcgaacaggtgttggaacacctggtcgggatggccggcagcgtagacggcagagtctcagttgagaaaataagagcaacgtttaccgtcctgcgagcgtttggcagcgtcagcatggcccactcccgttccgcgacgaggttctccatggtgatgagtctagactttaatgccacggggaggatcacagccgcacagctgcaaaccatgcttctggagaaaagtagggtggctagacaaccagagggcgagtctaactttctggtttttagccaaatgctggcaggactcgacttagaccttcggaccgaactgaacctacaccaaatggccgatagcagcagcttcggaatgggtgtttggtccaagcccgaagataaacaaaaagccgccgctgcgttcgctcagctccagggggccatggaaatgcttggtatttcggagtctgagcagagagccgtctggagggtcctggccgcaatctatcatctgggggccgccggcgcatgcaaggtcgggcggaaacaattcatgagatttgagtgggctaattacgctgcagaggcgctgggttgcgaatatgaagagctgaataccgccaccttcaagcatcacttacgccagataattcagcagatgacattcggcccttcacgctggggactggaagatgaggaaactagctcgggccttaagatgaccggggtcgactgtgttgaaggcatggcctcaggtctctatcaggaactctttgccgccgttgtatcattgatcaaccgatctttctcttcgcatcatctttccatggcttctatcatggtcgtggacagtcccggttttcaaaaccctcgtcaccaggggaaagaccgggctgccacttttgaagagctctgtcataactatgcccacgaacgattgcagctgctgttttaccagcgaacctttgtcagcacccttcaaagatatcaagaagagggtgtgccagtgcagttcgacctccctgacccaagccctgggacaaccgtggccgtggttgatcaaaatccttcgcaggttcgcttgccagctggaggtggggctcaagacgcacgcggccttttctgggtgctggacgaggaagtgcatgtggagggcagtagcgactcagtcgtgctggagaggctctgtgctgcatttgagaagaaaggcgccggaactgagggaagcagcgctctgcgcacatgtgagcagcctttgcagtgcgaaatcttccatcaattggggtgggaccccgtccgatatgacctaaccgggtggctgcacagggcaaagcccaatctttctgcactggatgcaccacaggtgttgcatcagagtaaacgggaggagttgaggtccctattccaggcccgagccaagttaccaccagtttgcagggcagtggctgggctcgagggcacatcccagcaggcgcttcagagaagtagaatggtgagacgtactttcgccagctcgctcgccgcagtgcgtcgaaaggctccttgctcccagattaagttacaaatggacgcacttacgtctatgataaaaagatcaaggcttcacttcattcactgcctggtgcctaatcccgtggtcgaaagcaggtccgggcaggagtccccacccccccctcagccaggtagagacaagcccggagccgggggtccactcgcactcgatattccagctttgcgtgtccagctggccgggtttcatattctggaggcactgaggttacaccggactggttacgcggatcacatggggctgacccgctttcgccgccagttccaggtacttgatgcccccctgctcaaaaaacttatgagtacatcagagggcattgacgaacgcaaggcagttgaagagctgcttgagaccctggatctagagaaaaaggccgtagcggtggggcactcgcaggtttttcttaaagctggcgtaatctcgcgcctagagaagcagcgggagaagttagtgtcccagtcgattgtactattccaagcagcctgtaagggattcttatcacgccaagaattcaagaagctcaagattcggaggctagcggcccaatgcattcagaagaatgtggctgtgtttcttgccgttaaggactggccttggtggcaactcctcggtagcctacaacccctgttaagcgccaccattgggactgagcagctgagggctaaagaggaggagcttacgaccttgcgcaggaagctggagaaaagcgagaagctgcggaatgagctgcgtcagaataccgatctgctcgagagcaaaattgctgatctgacgagcgatttagctgacgaaagatttaagggagacgttgcgtgccaggtgctggagagtgagagggcagaaaggctgcaggccttccgtgaagtccaagagctcaagagcaagcacgaacaagtgcaaaaaaagttgggagatgtgaataagcaactggaagaagcgcaacaaaagattcaactcaatgaccttgagcgaaacccaactggaggggcagatgagtggcagatgaggttcgattgtgcccagatggagaatgagttcctccgaaagagactacagcagtgtgaggaaaggcttgatagtgagctgaccgccagaaaggagcttgagcaaaagctgggtgaactgcagtccgcttacgacggggcaaaaaagatggcccaccaactgaagagaaaatgccaccacttgacttgcgaccttgaggacacatgtgtcttgctggaaaatcagcagtcgaggaaccatgaacttgagaagaaacagaagaaatttgatctgcagctggcgcaggcgctgggagaaagtgtgttcgaaaaaggcctgcgcgaaaaagttacccaggagaatacatccgtacgttgggagctgggccagctgcagcagcagttgaaacagaaggagcaggaagccagccagctcaaacagcaggtggaaatgctgcaagatcacaaacgcgagctcctgggttcaccttcactgggggaaaactgcgtcgcaggactgaaagagcggctgtggaagctcgagtcaagtgccctggaacagcaaaagattcagtcccagcaagaaaacaccataaagcagctcgagcaactgaggcagcgcttcgagctggaaattgaacgaatgaaacagatgcaccaaaaagatagggaggaccaagaagaggagctggaagatgtcagacagtcttgccaaaagcgcctgcatcagttggaaatgcagctcgaacaggagtacgaagagaagcagatggtcctgcatgagaagcaggaccttgaggggttgatcggaacactgtgtgaccagattggccacagagatttcgatgtggagaagaggctgcggcgagacctgcgccggacacacgcccttcttagcgatgtgcagctgcttctcgggacgatggaggatggtaaaacgagtgtgagcaaggaggaactggagaaggtccacagccagctagagcagtcagaagcgaaatgcgaagaggctctgaaaacccagaaagtccttacagctgatctcgagtctatgcacagcgagttggaaaatatgacgcgcaacaaaagcctggttgacgagcagctctaccgccttcaattcgaaaaggctgacctcctaaagcggattgatgaggatcaagacgatctgaatgaactgatgcaaaagcacaaggacctgattgctcaaagtgccgccgatattgggcagatacaggagcttcagttgcaacttgaggaggcaaaaaaggaaaaacataaattacaggagcagctgcaggtggcccagatgaggattgagtatctcgaacagtctacggtggatcgtgcaatcgtgagcaggcaagaggccgtgatttgcgacttggaaaacaaaaccgaattccagaaggtgcagatcaaacgttttgaagtactggtgattaggctgcgcgattccctgattaaaatgggcgaagagctcagccaagctgcgacctctgaatctcagcagagagaatcctctcagtactatcagagaagactagaagaactgaaggccgacatggaagagctcgtgcaaagggaggccgaagctagcaggcggtgtatggagctggaaaagtatgtggaagagcttgccgcggtacgacagaccctgcagacagaccttgaaacatctattcgccgtattgcggacctgcaagccgctctggaggaagtcgccagctccgatagtgacacagagtcagtgcaaaccgctgtggactgcggtagtagtggccgcaaggagatggacaatgtgtccattctaagttcccagcccgaggggtctctgcagtcatggctcagttgcacactgtcccttgcaacagacaccatgcgcactccttcaagacagagtgccacgtcctctcggatactttcgccaagaatcaacgaggaagcgggagacactgaacggacacagtctgcactggcactgagtcgcgcccgcagcaccaatgtgcatagtaagacctctggagacaagccagtctccccccattttgtccgcagacagaaatactgtcacttcggagacggggaagtgctggctgtccagaggaagagcacagaaaggctggaacctgcctccagtccgctggccagccgtagtaccaatacaagtcctctttcccgggaaaaacttccatctccttccgcggcgctgagtgaattcgtggagggcctgaggcggaaacgcgcacaacgcggccagggctctactctcgggttggaagactggcctacactccccatctaccaaaccaccggagcctccacattgcgcagaggtcgcgctggttccgatgaggggaacttgtccctgcgggtaggagcgaagtctccactcgagatcgaaggagcggcgggcggactactgcgtagtacaagcctgaagtgcattagctctgatggcgtaggtggaacgacactgctccctgagaaaagtaaaacgcagttttcctcctgcgaatcattgctggaatcccgccctagtatggggagaaaattaagctcacctacaaccccacgtgacatgctcttaagcccaactctgaggcctcgtagacgctgtctggaatcctctgtggatgacgcgggatgccccgacctcgggaaagaacccctggttttccagaatcgccagttcgctcatctgatggaagaaccgcttggttcagacccgttctcctggaagctcccctcactcgattatgagcgcaagaccaaagtcgactttgacgacttcctgccggctatccgcaagccacaaaccccgaccagcctcgcgggctctgcaaaggggggccaagacggctcgcagcggtcaagtatacattttgagacagaagaagccaacaggagtttcctctcaggtatcaagaccattcttaaaaagtccccagagcctaaagaggacccggctcacctcagcgatagttcgtcatctagcggttctattgtaagctttaagtctgccgattcaatcaagagtaggcctggaatcccgaggttagcaggtgacggcggagagcgaacttcacctgagaggagagagccgggaactggtcgtaaggatgatgacgttgcgagtatcatgaagaagtatctgcagaagtag

SEQ ID NO: 125492 - DNA, 603 bp, Artificial Sequence
  Description of Artificial Sequence: Synthetic coding sequence
atgggaaacagcaagtcaggcgctctcagcaaagaaatattggaagagctgcaattaaatactaagttttcagaagaggaactgtgttcctggtatcagtcattccttaaagactgcccaaccggtcgcatcacacagcagcagtttcaatccatctacgctaagttttttcctgacactgacccaaaagcttatgctcaacacgtgtttcgcagttttgatagcaacctggatggaaccttggactttaaagaatatgtgattgccttacacatgaccactgccggcaagacaaatcagaagctggaatgggcattcagtctgtacgatgtagatggtaacggaactatatcgaagaacgaagtactcgagatcgtgatggccatattcaagatgattacgcctgaagacgtcaaactgctgcctgacgatgagaatacccccgaaaagcgagctgaaaagatctggaagtactttggcaagaatgacgacgataagctcaccgaaaaggagttcattgaagggactttggctaataaagaaatcctacgtctcatccaatttgagccgcagaaagtaaaagaaaagatgaagaatgcttag

SEQ ID NO: 125493 - DNA, 1884 bp, Artificial Sequence
  Description of Artificial Sequence: Synthetic coding sequence
atgtcctctgacagcgagatggccatctttggtgaggctgccccctttttaaggaagagcgagagagagagaattgaagcacagaacaagccctttgacgccaaaacgagtgtgtttgtcgtagaccctaaagaatctttcgtgaaggctaccgtgcagagccgcgaaggcggtaaggtcacggcaaaaactgaagccggcgcaacggtgactgttaaagatgatcaggtttttccaatgaatccccccaagtacgacaaaatcgaggacatggcaatgatgactcatctgcacgaacccgcagtactttacaacctcaaggagaggtatgctgcatggatgatctacacttacagtgggcttttctgtgtgaccgtgaacccttataagtggctacctgtctacaacgcagaggtggtgaccgcgtatcgggggaaaaagagacaggaagcccctccccacatcttctccatcagcgacaatgcctaccagtttatgttgaccgacagagagaaccagtccatcctgatcacaggagaatctggggccggcaaaaccgttaatactaaaagggtgattcagtactttgccaccatcgctgtcaccggggaaaagaaaaaagaggaggtgaccagcggcaaaatgcagggaacactggaagatcaaattataagcgcaaatccccttctggaagccttcggcaacgccaaaaccgtacgaaatgacaattcctcaaggttcgggaagtttatcaggattcatttcggcactactggtaagctggcctccgcagacattgagacatacctgctggagaaaagccgggtgaccttccagctgaaagccgaacgaagctatcacatcttctatcagataatgtccaacaaaaagcctgatctgatcgaaatgttactgatcacaactaatccatacgattacgcctttgtctcccagggcgagatcaccgtcccctcaatcgatgaccaggaagaactgatggccaccgacagcgccatcgagatcctgggattcacaagtgacgagagagtttccatatacaagctcacaggagcagtaatgcactatggtaacatgaaattcaaacagaaacaacgagaggagcaagccgagcctgacggcaccgaagtcgccgacaaggcagcctatctgcagaacctcaattcagctgacctgctgaaagcactatgctatcctcgggtgaaagttgggaatgagtacgttaccaaaggtcagactgtccagcaggtttacaatgcagtgggcgcccttgctaaagccgtctatgacaagatgttcctttggatggtgactcgcataaaccagcaactagacacgaagcagccccgagccaactcagaggttgcccagtggcggaccaagtatgagacagatgcaatacaaaggactgaggagctggaggaagcgaaaaaaaagctggctcagcgcctgcaggacgccgaagagcacgttgaagcagtgaacgctaagtgcgctagtctggaaaaaactaagcagagacttcagaacgaagtggaagatctcatgatcgacgtggagaggacaaacgctgcttgcgcggctctggataaaaaacagagaaattttgataagattctagccgagtggaagcagaaatgcgaggaaacgcatgcggagttggaagcctctcagaaggagtctcggagcctttcgacggagctttttaaaatcaagaacgcatacgaagaatcccttgaccagctggaaaccctgaaacgagagaacaaaaatcttcaacaggagatctccgacttgaccgaacaaatagccgagggaggaaagcggatccacgaactagagaaaattaagaagcaggtcgagtag

SEQ ID NO: 125494 - DNA, 5919 bp, Artificial Sequence
  Description of Artificial Sequence: Synthetic coding sequence
atggctcaaaaaggtcaacttagtgatgatgagaaattcctctttgtggataaaaactttatcaattctccagtagcccaggcagactgggcggctaagcgactcgtctgggtgccaagcgaaaagcagggttttgaggcggcaagtatcaaggaagagaagggtgatgaggtggtcgtggaactggtcgaaaatggcaagaaagtcaccgtaggcaaggatgatatccagaagatgaatcctcctaaattctccaaagtggaggatatggcagagctgacatgcctgaacgaagcaagtgtactccataatctaagagagaggtacttttctggcctaatttatacctatagcgggctgttttgtgtggttgttaatccttacaagcacctgcctatatactccgagaagatcgtcgatatgtacaaaggtaaaaaaaggcatgagatgcccccacacatctatgcaattgcggacacagcttaccggagtatgctccaggatagggaagaccagagcatcctgtgcaccggcgagagtggtgcaggaaaaacggaaaatactaagaaggtaatacagtacctggctgtggtggcatcctctcataaaggaaagaaagatacatccataaccggggagcttgagaaacagttgctccaggctaaccccatcctggaagcattcggcaacgccaagactgtgaagaacgataatagcagtcggtttggaaagtttatcagaataaactttgacgtgactggctatatcgttggagctaacatcgaaacttatctgctagaaaagagcagggcgataaggcaggctagggacgagagaacttttcacatattttactatatgatcgcaggagcaaaggagaagatgagatccgatctcctactggagggattcaataactataccttcctcagcaatggttttgtgcctatacctgccgcccaagacgatgaaatgttccaggaaaccgtggaagctatggcgatcatggggttctctgaagaggaacagcttagtattctgaaggttgtgagctccgttttgcaattgggaaatattgtgttcaagaaagagaggaacaccgaccaagcgtccatgcctgacaatacagccgcccaaaaagtgtgccacctcatggggatcaatgtgaccgatttcacacgatccatactgacaccgcgcattaaagtgggcagggacgtggtgcagaaggcacagacaaaggagcaggccgattttgctgttgaagccctggccaaggcaacatacgaaaggctgttccggtggatcctgacaagggtgaataaggcgctggacaaaacccaccgtcagggcgcatcatttttagggatattagacatcgctggcttcgaaattttcgaagtgaatagcttcgaacagctttgcatcaactacacaaatgaaaaattgcaacagttgtttaaccacaccatgttcatcctcgagcaggaggagtatcagcgagagggaattgagtggaactttatcgactttggcctagatttgcagccctgtattgagttgattgagcggcccaataatccaccaggggttttggcattgttggatgaggagtgctggttcccaaaggccacagataagagcttcgttgagaaactgtgtactgaacaaggctcccatcccaagttccagaagccaaagcagctgaaggataagacagagttcagtataatccactatgccggaaaggtcgactataatgcctctgcctggctgaccaagaacatggacccacttaacgataacgtaacaagcttgctcaacgcgagcagtgataagtttgtggccgacctgtggaaggatgtggacagaatcgtgggcctggaccagatggctaaaatgacagagagctcactgccaagcgcctcgaaaactaaaaagggcatgttcagaacagtgggccaattgtataaagaacagctgggcaaattaatgacaactttgagaaacaccactcccaatttcgtcaggtgcattattccgaatcacgagaagagaagtggtaagttggacgccttcctggtgctggaacaacttcgctgtaatggcgtactggagggcataagaatctgcaggcaggggttccctaatcgcattgtgtttcaggagttccgacagcgctacgaaatcctggccgcgaatgctatccctaaaggcttcatggatggaaagcaggcttgtatcctcatgattaaggccctagaattagaccctaatttgtatcgcattgggcaatctaagattttcttccgcaccggagtgcttgcacacctggaggaggaacgagacttaaaaatcacagatgttatcatggcttttcaggcgatgtgtcgaggttacctggcaagaaaagcctttgcaaaacgtcagcagcagcttacagcaatgaaggtcatccagaggaactgtgcagcctatctgaagttgaggaattggcagtggtggaggctgttcacaaaagtgaagccattgctgcaagtgacaagacaggaggaagaaatgcaagccaaggaagacgagctgcagaagacaaaggaacgccaacagaaggctgagaatgagttgaaagagctcgagcagaaacacagccaactgacggaggagaaaaatctcctgcaagaacagttgcaagcggaaacggagctatacgcagaagcggaagagatgagggtgaggttggcagcgaaaaagcaggagctggaggagattctgcacgagatggaagcgcgcctggaagaagaggaggataggggccagcagctgcaggccgagcggaaaaaaatggcccagcagatgctcgacctggaggagcaactggaagaagaagaagcagctcgccagaagttgcagctggagaaggtcacagcagaggccaagatcaaaaagctggaggacgagatactcgttatggatgaccaaaacaacaagcttagcaaggaaagaaagttactggaggagcggatatcagacctcactacaaatctggcagaggaggaagagaaagccaagaacctgaccaaactgaaaaataaacatgagtccatgatttccgaactggaggtgaggcttaagaaagaggaaaaatccaggcaagaactagaaaaactgaagaggaagctcgagggtgatgcatcagattttcatgaacagatagccgatctacaggcccagattgccgaactgaagatgcaactggccaagaaggaagaagagctccaggctgccctggcaaggctggacgatgagatcgcccagaagaataacgccctcaagaagatccgggagttagaaggccatattagcgacttgcaggaggacttagacagcgaacgggcagctcggaacaaagccgaaaagcagaagcgggatctaggtgaggagttggaagcgctgaagacggagcttgaagatacactggattccaccgcaacgcagcaggagttacgtgccaagagagaacaggaggtaaccgtcctgaaaaaggccctcgacgaagagaccagaagccatgaggcacaagtacaggaaatgcggcagaagcatgcccaagcagtggaggagttgacagagcaactcgagcagttcaagcgtgcaaaggcaaacctggacaaaaacaagcagacactagaaaaggaaaatgctgacctcgcaggtgagctgagggtcctgggccaggccaaacaggaggtggagcacaagaagaaaaagctcgaggcccaggtgcaagagcttcaatcaaaatgtagtgatggcgaacgggcgcgagcagaattaaacgataaagtgcataaacttcaaaatgaggttgaaagtgtgactgggatgctgaatgaggctgagggaaaggctattaaactggccaaggacgttgcttccttgagttcgcagctgcaggacacacaggagctgcttcaggaagagacgaggcagaagctgaatgtatcaacaaagttgcgacagctggaagaggaacgcaacagtctgcaggatcaattggacgaggaaatggaggccaagcaaaatctggagcgtcacataagtactctcaacatccagctgagtgacagcaagaaaaagctacaagatttcgcctccacagttgaagctttagaggagggaaaaaagcggttccagaaagaaatagagaatttaacccaacagtacgaggaaaaggccgccgcctatgataaactggagaagaccaaaaatcgactgcaacaggaactcgacgatctggtcgtggacctggacaatcagcgacagctggtgtcaaacctggaaaagaagcagaggaagtttgatcagctgttggccgaagaaaagaacatctcttcaaaatatgccgatgagcgtgaccgggccgaggcggaagctagagagaaggagacaaaggcgctgtctctcgctagagcattggaagaggcccttgaagccaaggaggaactcgaaaggactaacaaaatgctgaaggccgagatggaggatctggtatcgtccaaggacgatgtgggcaaaaatgtgcacgaactcgagaaatcgaagcgggctttggagacgcagatggaggagatgaaaacccaattagaagagctggaagacgaactgcaggccactgaagatgcaaagttgcggctcgaggtaaacatgcaggcacttaaggggcagtttgaaagggatctgcaagccagagacgaacagaacgaggagaagaggagacagctgcaacgtcagctgcacgaatacgagactgaacttgaagatgagcgtaaacaaagagcactggctgccgcagctaaaaaaaaactcgagggtgacctgaaggatctggagttacaggctgattccgcgatcaagggccgggaagaagcaatcaaacagctacggaagttgcaagcgcagatgaaggacttccagagggagctagaagacgcacgcgcctctagagatgaaattttcgcaactgcgaaagagaacgagaaaaaggctaaaagtttggaggctgatctgatgcagttacaagaggaccttgcagctgctgagagggcgagaaaacaggctgacctcgagaaagaggagcttgccgaggaattggcctcatccttatctggccggaacgcactccaggatgagaaaagaagactggaagcgaggatcgcccagctggaggaagaacttgaggaggagcaggggaatatggaggccatgagcgatcgggttcggaaagctacccaacaggccgagcagttgtcaaatgaactagccacagagagatcgactgcccagaagaatgagtccgcccgacagcagttagagaggcagaacaaagaattacgctcaaagctgcatgagatggagggggccgtgaagtctaagttcaagagcaccattgcagcccttgaagcaaagatagctcagctggaggagcaagtcgaacaggaggctcgcgaaaaacaggccgccacaaaatcccttaagcagaaggataagaaactaaaggaaattctcttacaagtggaagatgagcgaaagatggcagaacagtataaagaacaggccgagaaggggaacgctagggtaaagcagcttaagcgccagctcgaggaagcagaggaggagtctcagcgaatcaacgctaatcgccgaaagctccagagggagcttgatgaagccactgagagtaacgaggccatgggcagagaggtgaatgctctaaaatcaaagctgagaagaggcaatgagacctcctttgtgccaagtcggcggagtggaggacggagagttatcgagaatgccgatggcagcgaagaagagaccgacacacgggacgcagactttaatgggaccaaagccagtgagtag

SEQ ID NO: 125495 - DNA, 5817 bp, Artificial Sequence
  Description of Artificial Sequence: Synthetic coding sequence
atggctcaaaaggggcagctctctgacgacgaaaaatttctgtttgtggacaagaacttcattaatagtcctgtggctcaggcagactgggcagccaagagactggtctgggtccctagtgagaagcaggggtttgaagccgcttccattaaagaggaaaagggcgacgaagtggtcgtcgaactggtagagaatgggaagaaagtgactgtgggtaaagacgatattcagaaaatgaacccgcctaagttcagtaaagtcgaggacatggcggagctcacatgcctgaatgaggccagcgtactgcacaatctgcgggaaagatactttagcgggttgatatacacatacagcggactgttttgtgtggttgtcaatccttataaacacttacctatctactctgagaaaattgtggatatgtataaagggaagaagagacacgagatgcctccccatatttatgccattgcagataccgcctatagatcgatgctgcaggatcgcgaggaccagtccattctctgcactggcgagtcaggcgccgggaagacagaaaacaccaagaaggtgattcagtaccttgctgtcgtggcctcttctcacaagggtaagaaagatacctcaattactggcgagctcgaaaaacagcttctccaggccaatcctatcctggaggcctttggcaatgcgaaaacagtgaaaaatgataacagtagtcgcttcggcaagtttattcggattaattttgatgtgaccggctacattgtgggtgctaatatcgaaacttatcttcttgaaaagtcgagggccatcagacaggctagagacgaacgaacttttcatattttctattatatgatcgccggcgcgaaggaaaaaatgagatctgacctactgctcgagggattcaacaattacacattcttgtcgaacggttttgtacccattccggcagctcaggatgacgagatgtttcaagaaacagtggaggcaatggccattatggggttcagcgaagaagagcagttgtccatcttgaaggtggtgtctagtgtcctgcagctgggcaatatcgtttttaaaaaggagagaaacaccgaccaagcgagtatgcctgacaatacagccgcacaaaaagtgtgccacctgatgggcatcaacgtcacagactttacacgaagcattctaacacctcggatcaaggtcggacgggacgtggtgcagaaggcccagaccaaagagcaggctgactttgccgtggaagcactggcaaaagccacttatgagagactgtttcggtggatccttaccagagtgaacaaggcccttgacaagacccacaggcagggcgccagctttcttgggattctggacatcgccggctttgaaattttcgaggtgaatagtttcgagcagctttgcatcaactatacaaatgagaaactgcaacaactctttaaccacactatgttcatcctggagcaggaagagtaccagagggagggcatcgagtggaatttcattgattttgggctggatttgcaaccttgcatcgagctgattgagcggcccaataatcccccaggggttctagccctattggacgaagaatgttggttcccgaaggctactgacaagtccttcgtcgagaaactgtgcaccgagcagggatcccaccccaagttccagaaaccaaagcagctgaaagataagacggagttttctatcatccattatgctggtaaggtggattacaacgcctcagcatggctgacgaaaaatatggaccctcttaatgacaacgtcacatccctccttaatgcaagctcagataagttcgtcgctgatctctggaaggacgtggataggattgttggcctggatcagatggctaagatgacagaaagctccctgcctagtgccagcaagaccaaaaaggggatgttcagaacagtgggtcaactgtataaagagcagttagggaaacttatgaccactctccgaaacaccacgcctaactttgtgcgatgtatcattcctaaccatgagaagagatctggtaagttggacgcattcttagtcctggagcagctgcggtgtaatggcgtcctagaaggtatcaggatatgcagacaaggctttcccaatagaattgttttccaagagtttcgccaacggtacgagatccttgctgcgaacgccattcccaaggggtttatggacggcaagcaggcttgtatactaatgatcaaggccttagaacttgatccaaacttgtataggataggccaaagcaaaatcttttttcgcactggcgtgcttgcccacctggaagaagaacgcgatttgaagatcactgatgttattatggcctttcaggctatgtgccgggggtatctggcccggaaagcgtttgcaaagagacagcaacagcttacagcaatgaaggtgattcagcggaattgcgccgcatacctcaagctccggaattggcagtggtggcgactgttcacaaaggttaaacccctgttacaggtaaccagacaggaggaagaaatgcaggctaaggaagatgaacttcaaaaaaccaaagagaggcagcagaaagcggaaaatgaattgaaggagctggaacagaagcactcacagttgactgaggagaagaacctcctccaggagcaattgcaggcagagactgaactgtatgcggaggctgaagaaatgcgtgtgagattggccgctaagaaacaggaacttgaagaaatcctgcacgagatggaggcccgtctggaggaagaggaggatcgcgggcagcaattacaggccgagagaaagaagatggctcaacagatgctggatttggaggagcaattggaggaggaagaggctgcacgccaaaagctgcagttggagaaggtcaccgctgaggccaagattaagaagcttgaagatgagatcctggttatggatgaccagaacaataagttgtccaaggaaagaaagctgctggaagagcgcattagcgatctaactactaatttagccgaggaagaagagaaagctaaaaatctcacgaaactcaagaataagcacgaaagcatgatctccgagctggaggtgcggttgaaaaaggaagagaaaagccggcaggagcttgagaagctaaaacggaaactggaaggggacgcctctgatttccacgaacagatcgctgatttgcaagcccaaatcgccgagcttaagatgcagctggcaaagaaggaagaagaactccaggcggccctagcccgactagacgacgagatcgctcagaagaacaacgccctcaaaaagattcgggagctggaggggcatatctcagaccttcaggaagatctggactccgaacgagcggcaaggaataaagctgagaagcagaagcgggacctcggcgaagaactcgaagccttaaagaccgagcttgaagatacgctagactccacagctacacagcaggaactgcgggccaagcgagaacaagaagtgacagtgctcaaaaaggccctggacgaggaaacacggtcacacgaggcgcaagtgcaggagatgagacagaaacacgcacaagccgtggaagaactcactgagcaattagaacagttcaagagggccaaggcaaatctggacaaaaataaacagactctggagaaggagaacgccgatctggcaggggagctcagggtgctcggacaagcaaaacaggaggtggagcacaagaagaagaaactcgaggcacaggtgcaagaattacagtccaagtgttctgatggcgaacgggctcgggctgagctgaacgacaaggtccataaacttcagaatgaggttgagagtgtgactgggatgttaaatgaagccgaaggcaaggccatcaagttggcaaaggacgttgcgtcactttcaagtcagctacaggatacgcaggaactgctccaggaagagacaagacaaaagttgaatgtgagtaccaaactgcgccaactcgaagaagagcgtaactctcttcaggatcagctggatgaagagatggaagctaaacagaaccttgagcgccatatttccactctaaacattcagctatccgacagtaaaaaaaagctgcaggatttcgcctcaacagtggaggcattggaagaaggcaaaaaacgtttccagaaagaaatcgaaaacctcacccagcagtacgaagaaaaggctgctgcctacgataagctggaaaaaactaaaaaccgattacagcaagagcttgatgatctggtcgtggatctcgacaaccaacggcagctggtctcgaatctcgaaaagaagcagcgcaagttcgatcagcttttagccgaggaaaaaaacatttcctccaaatatgctgatgagcgagatagagccgaggctgaggctcgtgaaaaagagacaaaggcgctcagccttgctcgcgcgttggaggaggccctggaagccaaggaggagcttgagcgaacaaataaaatgttgaaggcggaaatggaagatctcgtgagcagtaaagacgacgtggggaaaaatgtgcatgagctggagaagtcgaaaagggcactggaaacacagatggaggagatgaagacgcagctggaggaactggaagacgaactacaggcaactgaagatgcaaaactccggctggaggtgaatatgcaggctctcaaggggcagttcgagcgagacctccaagcccgagacgagcagaacgaggagaagagaagacagctgcagagacagttacatgagtatgaaactgagctagaagacgagagaaaacagcgcgccctggcggcagccgcaaagaaaaagctggaaggcgatttgaaggacctagagctgcaggctgactccgccatcaaagggcgggaagaggccatcaaacagctgcgcaaactgcaggcacagatgaaagacttccagcgggagctcgaagacgcccgagcctcccgtgatgagatcttcgcaactgccaaagagaatgagaaaaaggctaaatctctggaagccgacctcatgcagctccaggaagatctggccgccgccgagcgcgcacggaagcaggcagacctagagaaggaggaactcgcggaggagttggccagttccttatcagggagaaatgcactgcaagatgaaaagcggagacttgaggcacggatcgcccagctggaagaggagcttgaggaggaacagggcaacatggaggcaatgagtgatcgagtgcgaaaggccacacaacaggccgagcaactcagcaatgagttagccactgagcgttccactgcgcaaaaaaacgagtcagcaaggcagcagttggagaggcaaaataaagagcttagaagcaaactgcacgaaatggagggcgccgttaaatccaaatttaaaagcacaatagccgccttggaggccaaaattgcacagctcgaggaacaggtcgaacaggaagctagggaaaagcaggcagctaccaagtcattgaaacaaaaggataaaaagcttaaggaaatccttttgcaggtcgaggatgagcgcaaaatggctgaacagtataaagagcaagcggagaaagggaatgcacgcgttaaacagttaaagcgtcagttagaagaagccgaggaggagagccagcgtattaacgcaaacaggcggaaactccagagggagctcgacgaggccacagagtctaatgaggccatgggccgggaggtgaatgcccttaagtctaaattgcgcggccccccaccccaagaaacttcacaatag

SEQ ID NO: 125496 - DNA, 6090 bp, Artificial Sequence
  Description of Artificial Sequence: Synthetic coding sequence
atggcgcagaaaggccagctcagcgatgacgagaagtttctattcgtagacaaaaactttatcaactccccagtggctcaggctgactgggcagccaaacgcttggtctgggtgcctagtgaaaagcaaggatttgaagccgcaagcattaaagaggagaagggcgatgaggtggtcgtggagctagttgagaacggcaagaaggtgaccgttggcaaagatgacatacagaagatgaatccacctaagttctccaaagtggaagatatggctgaacttacatgcttaaatgaagcgagcgtgctgcataacctgcgtgaacgctatttctcaggcctcatttatacatactctggcttattttgtgtggtggtcaacccctataagcacctgcctatatattccgagaaaatcgtggacatgtataagggcaagaaacgccacgagatgccgccccacatttacgccatcgcagatacagcctatcgatctatgttgcaggatcgcgaggatcaatcgattctgtgtactggtgaatcaggagcgggcaagacagagaatacgaagaaggtcatccagtacctggccgtggtcgccagctcacacaaaggtaagaaggatacttccataactgagggcccgagcttctggcgaggggagctcgagaagcagctgctgcaggcaaatccaatactcgaagcattcggaaacgctaaaaccgtgaagaatgacaattcctctcgctttggcaaattcattcgtatcaacttcgacgtcacagggtatatcgtcggcgctaacatcgaaacatacttgctggagaagagccgggctatccggcaagcccgggatgaacggacgttccatatcttttattatatgatcgcaggcgccaaggagaagatgaggagcgatttgctgttggaaggtttcaataactatacattcctgtcaaatggctttgtgcctatcccggctgctcaggacgatgagatgttccaggagaccgtggaagcgatggccatcatgggcttttcggaagaagagcagctctctatattgaaagtggtttccagcgtactccagctgggcaacatcgtgttcaaaaaggaaagaaataccgaccaggcctccatgcccgacaacacagccgcgcagaaggtgtgtcacctcatgggcatcaatgtgactgatttcactagatcgattctgactccccgcatcaaagtgggtcgcgacgttgtgcagaaggctcagaccaaggaacaagccgattttgctgtagaagccctcgccaaagcaacctacgagagattgtttcgctggattctgacccgggtaaacaaggccctggacaagactcacaggcagggtgcttcctttttaggcattttggacatcgccggctttgagatctttgaagtgaattcgttcgagcaactgtgcatcaattataccaacgagaagctccagcagttgttcaatcatactatgttcatcctggaacaggaagagtatcagcgggagggcatagagtggaatttcatcgactttgggcttgacctgcagccttgcatcgagctgattgaacgtcccaacaatccaccaggggtgttggctcttctagacgaggaatgctggttcccaaaagctaccgataagtcattcgttgagaagctttgcactgagcaggggtcacatccaaagtttcagaaaccgaagcagctaaaggacaaaaccgagttctccataatccattatgccggcaaggtcgactataacgcatccgcctggctgaccaagaatatggatccactcaatgacaacgttacttccctcctgaatgcaagttcagacaaatttgttgctgacctgtggaaggacgtggatagaattgtgggtctggaccagatggcgaagatgacagagtcctctctccccagcgcaagtaagaccaagaaagggatgtttcggactgttggacagctgtacaaggagcagcttggaaaacttatgaccacccttcgcaatactacgcctaacttcgttagatgtatcattccaaaccacgaaaaacggtctggtaaacttgatgcctttcttgtgctggagcagcttaggtgcaacggggttctggaaggcattcgtatctgccgccagggctttcccaatcggatagtgtttcaggagtttaggcaacgctatgaaatactggctgccaacgctatcccaaagggattcatggatggcaaacaggcatgcattctgatgatcaaagctctcgaattggaccccaatctgtatcggataggccaaagcaagatattctttaggacaggagtattggcccacctggaggaggagcgcgatctcaagattacggacgtgattatggccttccaggctatgtgcaggggctatctggcgaggaaagcgttcgccaaacgacagcagcagctgacagccatgaaggtaatccaaagaaactgcgcagcctatctgaagctgcgcaactggcagtggtggaggctcttcacaaaggtgaaacccttgctgcaggtgaccagacaggaggaagagatgcaggcgaaagaggacgaattacagaaaactaaagagcggcagcagaaagccgagaacgagctgaaggaactcgaacagaagcattctcagctgacggaagaaaaaaatctgttgcaggagcagctccaggcagagaccgagctctatgccgaggcggaagagatgagagtgcgattggcagcaaagaagcaggagctcgaagaaatcctgcacgaaatggaagcccgcctcgaagaggaagaagataggggccagcagctgcaagcagaacgcaagaagatggcccagcaaatgcttgacctggaagagcagctagaggaggaagaagcggctcggcagaaactgcaattagagaaggttaccgcagaagctaagattaaaaaactcgaggacgaaattctggtgatggacgatcagaataacaaattaagtaaggagagaaaactgctggaggagaggatctctgatctcaccaccaacctcgctgaagaggaggaaaaagctaaaaacttgactaaacttaaaaataagcacgagtctatgatcagcgagctcgaggtccgactaaaaaaggaggaaaaaagccgccaggagcttgaaaagctgaaaagaaagctcgaaggggatgcgagtgactttcacgagcagattgccgacttgcaggcccagatcgcagaattaaagatgcagctagccaaaaaggaggaggagctgcaggcagccctggcccggcttgatgacgagatcgcacaaaagaacaacgcgctgaaaaagataagggagctggaaggacacatatccgacctccaggaagatctggattcagaacgagcggccaggaacaaggcagaaaagcaaaagcgggacctgggggaagaactggaggctctcaagacagagctggaagatacgctggactcaacagccactcagcaagagctgagagctaaaagagagcaggaggtgacagtgctcaagaaggcccttgacgaggagacacgaagtcatgaagcccaggttcaagagatgcggcagaaacacgcacaggccgtagaggagctgacagagcagcttgagcagttcaaacgggccaaggcgaatctggacaagaacaagcagacgctcgaaaaggaaaacgcagatttagccggcgagttaagggtgctcggtcaagcaaagcaagaggtggagcataaaaagaaaaaactggaagcgcaagtgcaggaacttcaaagtaagtgttccgatggtgagagagcacgagccgagttgaacgacaaggtgcacaagctgcaaaatgaagtcgagagcgtgaccgggatgcttaacgaggccgaagggaaggccataaaactggctaaggacgtcgcctcactcagttcacagttgcaggatacgcaagagctgctccaagaggagactcgtcaaaagttaaatgtttctaccaaactaagacagctggaggaagagcgaaatagcctgcaagaccagttggacgaggagatggaagccaaacagaacctggagagacatatcagtactctcaatatccagctctcggacagtaaaaaaaagctgcaagactttgctagtaccgtggaagccctcgaggagggcaaaaaaaggtttcagaaggaaattgaaaacctgacgcagcagtatgaagagaaagcagctgcctacgacaaactggaaaagacaaaaaatcgtctgcagcaagaactagacgatctagtggtggatctggacaatcagcggcagctcgtgagcaaccttgagaaaaaacagcgcaagttcgatcagctgctggccgaagagaaaaatataagtagcaagtatgccgacgagcgcgaccgggctgaagctgaagctagggagaaggaaaccaaagcactgtctttagcccgcgccctggaagaggcactggaggcgaaggaggagcttgagcgtactaacaaaatgcttaaggcagagatggaagacttggtctcttcaaaggatgatgtcggtaagaatgtgcatgaactcgagaagtctaaacgtgcccttgagacacagatggaagagatgaaaactcaactcgaggagctcgaagatgaactgcaggccacagaggacgcgaaactccgcctggaggtcaacatgcaggccctcaaagggcaattcgagcgggacttgcaggcccgggacgaacagaacgaggagaagagacgtcagttacaacgacaactccatgaatatgagacagagctggaagacgaacgaaagcagcgcgccctagccgctgccgccaagaagaaactggagggggatctcaaggaccttgaactccaggctgacagcgctattaaaggcagggaagaggctatcaagcagctccgaaagttgcaggcccagatgaaagactttcaacgagagctggaagatgctagagccagtagagacgagatcttcgctacagccaaggagaacgaaaagaaggcgaagagcttggaggcagatttaatgcaactccaggaggatctcgccgccgccgagagagccaggaagcaggctgacctggagaaagaggaactggccgaggaactcgcctcatctctttctggacgcaacgccttgcaggacgagaaaaggcggctcgaagcacgtatcgcccagctggaggaggagttggaggaagagcaaggcaacatggaagcgatgagcgaccgcgtgcggaaggccacccagcaggccgagcagctctccaacgaactggccaccgaacgaagcacagcacaaaagaatgagagcgctcggcagcaactcgagagacaaaacaaagaactgcggagcaagctgcatgaaatggagggggccgtcaaatccaagtttaagtctacgattgccgccctggaagcaaagatcgcccagctggaggagcaggtggagcaggaagcaagggaaaagcaggcagctacaaagtccttgaagcaaaaggacaagaagctgaaagaaatcctgctgcaagtggaggacgagcggaaaatggcagagcagtacaaggaacaggccgagaagggcaatgcccgagtaaagcagctcaagagacaactcgaggaagcggaagaggagagccaaagaatcaatgccaaccgccgaaaacttcaacgagagctggacgaagccaccgaatcaaatgaagcaatggggcgggaggtcaacgctctgaaatcgaagctgagaggaccaccccacagaaagctgcgctcagacgcccccggcgaagagactcgtcccctgagcttcctcctggaggggctggaagacgtggaactgctaaaaatgcagatggttctgaggcggaagcgaaccttggaaactcagacaagcatggagccccggcctgttaacaaacaactctcaacggtgctccaccatggaaaaaagaccaaaaatcagaacaagcagactaagaagacacagcaacagccacggacaaaacaaaaccccgcggattgtacctag

SEQ ID NO: 125497 - DNA, 5940 bp, Artificial Sequence
  Description of Artificial Sequence: Synthetic coding sequence
atggctcagaagggacaattgtccgacgatgagaaattcctgttcgtggacaagaactttattaattcaccagtcgcacaggccgactgggcggcaaagcgactggtttgggtgccgtcagagaaacaaggcttcgaagcggccagcataaaagaggagaagggggatgaagtggtagtcgagctggtggagaacggcaagaaggttaccgtggggaaggatgatatccaaaagatgaacccccctaagttcagcaaggtggaggatatggcagaactgacctgccttaacgaagctagtgtcctgcacaatctccgtgagagatatttttccggcctgatatacacctattccggcttgttctgcgtggttgtgaacccctataagcacctccctatttattctgaaaagatcgtggacatgtataagggaaaaaagaggcacgagatgcctcctcacatctatgcaatagctgatacagcatataggtctatgcttcaagacagagaggaccagtcaatcttatgtaccggagaatcgggagcaggtaagactgagaataccaaaaaggtgattcagtacctggctgtcgttgcctcttcacacaaaggtaagaaagacacaagcatcacacaagggccatccttcgcttacggagaactggaaaaacagcttttgcaggccaatcctattctagaagccttcgggaacgcaaaaaccgtcaagaacgacaactcgtcacggtttggtaaatttatcagaattaacttcgacgtaaccgggtatatcgtcggagcaaacatcgagacctatctgctagaaaagtccagggcaattcggcaagcgagagacgagcgaacctttcatatattttactacatgatcgccggggctaaggaaaagatgcgttccgacctgctgctggagggcttcaataattatacatttttaagcaacgggttcgtgccaattccagcggcccaggacgatgaaatgtttcaggagacagtggaagcaatggctattatgggtttctctgaagaagaacagctgagcattctcaaagtggtgtcctctgtattgcaactcgggaatatagtttttaaaaaggaaaggaacactgaccaagcttcaatgcccgataatactgcggcacaaaaggtgtgtcacctgatggggatcaacgtcacagacttcacacgaagcattctgactccaagaatcaaggtgggccgggatgtggtccagaaggcacagaccaaagagcaggctgattttgccgtcgaggcgctggcgaaagccacttatgagaggctcttcaggtggatcctgaccagggtgaataaagcgctcgataagacacacagacagggagctagctttctgggaatactagacattgccggattcgagattttcgaagtcaattcgttcgagcaactttgtattaactacaccaacgaaaagctgcagcaactgtttaatcacactatgttcatcctggagcaggaggaataccagcgggaaggcatcgagtggaactttattgacttcggtctggacttacaaccctgtatcgagctgatcgagcgaccgaacaatccaccgggggtgctggccctgttggatgaggagtgctggtttcctaaggctactgacaagagcttcgtcgagaaactgtgcaccgaacaaggctcccatccaaagtttcagaaacccaaacagctcaaggacaaaaccgaatttagtattatccactacgcaggtaaagtggactataacgcgtcagcatggttgaccaaaaatatggaccctctgaacgacaacgttacttcgctgctaaatgcctctagcgataaattcgtagccgatttgtggaaggacgttgaccggatcgttggcctcgaccagatggctaagatgacggaatcaagtctaccctccgcctctaagaccaagaagggcatgtttaggacggtggggcaattgtataaagaacagctcgggaagttgatgacaaccctgcgtaataccaccccgaattttgtcaggtgcatcattcctaatcatgaaaagaggtcagggaaactggacgctttcctggtactggaacagttacgatgtaatggagtcctcgagggaataagaatttgtcgccagggatttcccaaccggatagtgttccaagagtttcgacagagatacgaaatactcgcagccaatgctattcctaaagggttcatggatggaaagcaggcatgcattcttatgatcaaagcgttggagctggatccaaatttgtacagaatcgggcagtcaaagattttcttcagaaccggtgtgctggcgcacttggaggaggaaagagatctgaaaattacagacgtgatcatggcatttcaggccatgtgcagggggtacctcgcacgcaaggcctttgccaagaggcaacagcaactgaccgccatgaaagtgattcagcgaaattgcgcagcttacttaaaacttcgcaattggcaatggtggagactgttcacaaaggttaagcctctgctccaggtgacacgccaagaagaggagatgcaggccaaggaggatgagctgcaaaaaactaaggagaggcagcaaaaggcagagaacgagctgaaagagctagaacaaaaacactcacagctgactgaagagaagaatctgctacaggaacagttgcaggctgaaacagagttgtacgccgaagctgaggaaatgagggttaggttggccgctaaaaagcaggagctagaagagatcctccacgagatggaagcccgcctcgaggaggaggaagacagggggcagcagttacaggccgagaggaaaaagatggcccaacagatgctcgatctggaagaacagctggaagaggaagaggccgctcggcaaaaactgcaactcgaaaaagtaaccgccgaggccaaaattaagaaactcgaagacgaaattctggtaatggatgaccagaacaacaagctgtccaaggagaggaagcttcttgaagagcgcataagcgatctcacaaccaatttggccgaggaagaagagaaggctaaaaatttaactaaactgaaaaacaagcacgaaagtatgatctcagagctcgaggttcggcttaagaaggaagagaagtcaaggcaggagttggaaaaactgaagaggaagcttgagggtgatgcttccgacttccatgagcaaatcgcagacctgcaggctcaaatagcagagctgaagatgcagctcgccaagaaagaggaagagctccaagccgctcttgctcgcctggacgacgaaatagcgcaaaagaataatgcactgaagaaaatacgcgagctggaaggtcacattagtgatctgcaggaagatctggactcagagcgcgccgcccgaaacaaagctgaaaagcaaaagagggaccttggggaggagcttgaggcgctcaagacagagctggaggatacattagactctacagctactcagcaggagctgcgcgccaaacgggagcaggaggtgaccgtgcttaaaaaagctctggacgaagagactcggtctcatgaagcccaagtgcaagagatgcgccagaagcacgctcaggctgtcgaggaactgacagagcagttggagcagttcaagcgggctaaggccaacctggacaaaaacaaacagactctggagaaagaaaatgccgatttggccggagagttgagggtgctcggccaggccaagcaggaggttgaacacaaaaaaaagaagctagaagcccaggtccaggaattacagtcgaaatgcagcgacggcgagcgggcccgtgctgagctgaacgacaaggtgcataaactgcaaaatgaggttgagagcgtgaccggcatgctgaacgaggctgaaggcaaggctattaagttggcgaaagacgttgcttctctgtcatcccagcttcaggatacgcaggaactcctccaggaggaaaccagacaaaagctgaatgtttccaccaagctccggcaattagaagaggaaaggaactccttacaggaccagctcgatgaggagatggaagccaagcagaatttggaaaggcacatctccacattgaacatacagctgagcgattccaagaagaagctgcaggacttcgcaagtactgtggaggcactggaggagggaaagaaaagattccaaaaggaaattgaaaacctgacgcagcaatatgaggaaaaggccgccgcgtacgataagttggagaagactaagaacagactccaacaggagctggatgacctggttgtggatctggacaaccagcgtcagctagtcagtaacctggagaaaaaacaaaggaagtttgaccagttgcttgccgaagagaaaaatatttctagcaagtacgccgacgagcgggaccgggctgaggccgaggcgcgagagaaagaaacgaaggctctcagcctggccagagctctggaagaggctttggaagctaaagaagaactagagaggaccaataaaatgttaaaggcagaaatggaagatctggtcagttcaaaggatgacgtgggcaaaaatgtgcatgaacttgaaaagagcaaacgcgcacttgagacgcaaatggaggaaatgaaaacacagttggaagagctggaggacgaactgcaggcaaccgaggacgccaaacttagactggaagtgaacatgcaggcgttgaaggggcagttcgagcgggaccttcaagctcgcgatgagcagaacgaggaaaaacggagacagctccagcggcagctgcacgaatacgaaactgaactcgaggatgagagaaaacagcgggcattagctgcggctgccaagaagaagctggaaggagacttgaaagacctggagctacaggccgattctgctataaagggccgggaggaagcaattaaacagctgcgtaagcttcaggcgcagatgaaggactttcagcgagaactcgaagatgcccgggctagtcgtgacgaaatttttgccaccgctaaagaaaatgagaagaaagctaagtccttagaagcggaccttatgcagctgcaggaagacctcgctgcagccgagagagcccgaaagcaggccgaccttgaaaaagaggagctcgctgaagagctggcctcctcactgtcagggcgcaatgcactacaggacgaaaaacggcgcctggaagcccgcatcgctcagctggaagaagaacttgaagaggagcagggcaacatggaggctatgagcgatagggttcgcaaggctacacagcaggcagaacagctgtcaaacgagcttgccactgagcggagcaccgctcagaaaaacgagtccgccagacagcagcttgagcggcaaaacaaggaactgcgatcgaaattgcatgagatggaaggagctgtgaaatcgaagttcaaatcaaccatcgcagcccttgaggccaaaattgcccaattagaagagcaggtcgagcaggaggcccgcgagaagcaggcggccaccaaatctctcaaacagaaagacaaaaagctaaaggagatactgttgcaggtcgaggatgaacgaaaaatggcggagcagtataaggaacaggctgagaaggggaatgctcgcgtcaaacaactcaagcggcagttagaggaggcggaggaggaatctcagagaatcaatgccaatcgaagaaagctgcagcgcgaactcgacgaggccaccgagagtaatgaggccatggggcgcgaggtgaatgctctaaaatccaaattgcggcgagggaatgaaacctcctttgttccttcacgacgaagtggcggccgccgagtgattgagaatgctgacgggagcgaggaggaaacagataccagggatgcagactttaatgggacaaaagcctcagagtag

SEQ ID NO: 125498 - DNA, 5838 bp, Artificial Sequence
  Description of Artificial Sequence: Synthetic coding sequence
atggcacagaaaggccagcttagcgatgacgagaaattcttgttcgtagataaaaatttcatcaacagccctgtcgcacaggccgattgggccgctaaaagattagtgtgggttccaagtgagaagcaggggttcgaggcggcgtcaatcaaggaggagaaaggagacgaagtggtggtcgagcttgttgagaatggcaagaaagtgacagttggtaaggatgacatacagaaaatgaaccccccaaagttctctaaagtggaggatatggccgagttaacctgtctgaacgaagcatcagttttacacaatttgagagagagatacttttccggcctcatctatacgtattctgggcttttttgcgtggttgtgaacccatacaaacacctgcctatttacagcgaaaagattgtcgacatgtataaagggaaaaagaggcacgagatgcctccacatatttacgccattgctgacactgcatatcgaagcatgctgcaggaccgcgaagaccagagcattctgtgtaccggcgaatcaggggccggaaaaacagagaatacaaagaaggttattcagtacttggctgtggttgcctcaagccataagggtaaaaaggacacgagcatcactcaggggccatctttcgcttatggtgaattggagaagcaattgctgcaggctaatccaattctagaggctttcggcaacgctaagaccgtaaagaatgacaattcttcccggtttggaaagtttatcagaataaatttcgacgtgacagggtacattgtgggggcgaacatcgagacatacctgttggagaaatcgagggctatcaggcaagcccgcgacgagaggactttccatattttttattatatgatcgccggggccaaagaaaagatgagatccgatctcttgcttgagggattcaataattacacttttcttagcaacggctttgtccctattcccgctgcacaagacgatgagatgttccaagaaaccgtggaagccatggccatcatgggattttctgaagaagagcagctctcaatcctcaaagtggtaagctcagtgctacagctcggcaatatcgtattcaaaaaggagaggaataccgaccaggcatcaatgcccgacaataccgccgcccaaaaagtctgccacctcatggggataaatgtcacagacttcactcggtctattttaacacctaggatcaaagtgggccgtgacgtcgtgcagaaagcacagacaaaggaacaagccgattttgcagtggaggctttagccaaggcaacttatgaacggctttttagatggattctgaccagagtgaataaagctctcgacaagacccacagacaaggtgcaagtttcctcggcatcttggacatagccggcttcgagatatttgaggttaactcctttgagcaactgtgtatcaattatactaacgaaaagctgcagcagctgtttaatcataccatgtttattctggaacaggaagaatatcagagggaaggcatcgagtggaatttcatcgactttggccttgaccttcagccatgtattgagctgattgagcgccctaacaatccccctggggttctggccctcctggacgaggaatgctggtttcccaaggccactgataagagtttcgtcgagaaactgtgtactgaacaaggatcacaccccaagtttcaaaagcccaaacagttaaaggacaagaccgagtttagcatcattcattacgccggcaaagtggattacaatgcatccgcttggctcactaagaatatggatccactgaatgataatgtgaccagtctgctgaatgctagtagcgacaaattcgtcgccgacctttggaaggatgtggataggatcgtaggcctagaccagatggcaaagatgacggagtcctctctgccaagcgcttctaagaccaagaaggggatgttcagaaccgtaggacaactctataaggagcagcttggcaaactaatgaccactcttcgcaacactactccgaatttcgttcgttgcattattcctaaccacgagaagaggtcaggtaaattagatgcctttctcgttctggagcaactgcgatgcaatggagttttggagggtatcagaatttgcaggcaggggttccccaatcggatcgtgtttcaggaattccgacagcgctatgagatcctggcggctaacgctatccctaaaggcttcatggatgggaagcaggcatgtattttgatgatcaaagcacttgaattggaccctaacctttatcgcatagggcaatccaaaatttttttccgtacgggagtgctggcgcatcttgaagaggagcgggacttgaagatcaccgacgttataatggcctttcaggccatgtgtagggggtacctcgctcgcaaagcatttgccaagcgccagcaacagctgacagccatgaaggtaatccagcgaaactgcgcagcttatctgaagctgcgtaactggcaatggtggagactgtttaccaaggtgaagccgttactccaagtgacccgacaggaggaggagatgcaagctaaggaagacgagctgcagaaaaccaaagagagacaacagaaagcggagaacgaactgaaggagctggaacagaaacactcccagctgacagaagaaaaaaatcttcttcaggaacaattacaggcagagactgagctgtacgccgaggctgaggagatgcgcgtgcgcctggccgccaagaaacaggagctggaggaaatcttgcacgagatggaagcccggttggaagaggaagaggatcgcggccagcagttacaagcagaacgcaaaaagatggctcagcaaatgctcgacctggaagaacagttggaagaagaggaggcggcccgacagaagctgcaactggaaaaggtcactgccgaggcaaagatcaaaaagcttgaggatgaaattttggtgatggacgaccagaataataagttgagcaaagagcggaaattattggaggagcgaatctcagacctgactacaaatcttgccgaggaggaggagaaagcaaaaaatttgaccaaactgaaaaataagcacgagtctatgatctccgagcttgaggtgcggttgaagaaggaagagaagagtcgacaggagctcgaaaaactgaagagaaaactcgagggggacgcatcagattttcatgaacagattgcagatctgcaggctcagattgccgagcttaaaatgcaacttgctaagaaagaggaggagctgcaagccgcacttgcccgactggatgacgagattgctcagaaaaacaacgcattgaagaaaatcagagagctggaaggacacataagcgacctacaggaggacctcgattccgagcgcgccgcccgcaacaaagcagaaaagcaaaaacgagatctgggtgaagaactagaagctcttaagaccgaacttgaggatacacttgactccacagccacacagcaggagttgagggctaagagagagcaggaggtcacggtacttaaaaaggctctggacgaggaaacaagatcccacgaggcgcaggtgcaggaaatgcggcagaaacatgcccaggccgtggaagagctgacagagcagttggaacaattcaagagagctaaagccaatctagataaaaataagcagactctggaaaaggaaaatgcagatctggccggcgagttgagagttttagggcaggctaaacaggaagtcgagcacaagaagaaaaaactcgaagcccaggtccaggagctgcaatccaaatgctccgatggcgaaagggcgagagcggagctcaatgataaggtgcacaaactgcagaatgaggtggaatccgtgaccggcatgctcaatgaagccgaaggaaaggctatcaaactggccaaggacgtggcctccctctcctctcagcttcaggacacccaggaactgctacaggaggaaacccggcaaaaactcaatgtgagtactaagttgcgacagctggaggaggagagaaattctttgcaggaccagctagatgaggaaatggaagcaaagcaaaacctggaacgccacatttcaaccctgaacatacagctgagtgactctaagaaaaagctgcaggacttcgcctccactgttgaagccttggaagaaggaaaaaaacgattccagaaggagatcgaaaatctgacccaacagtacgaggagaaggccgcagcttacgataagctggaaaaaactaaaaatcgcctgcagcaggagctggatgaccttgtggtggaccttgataaccagagacagttggtgtccaatcttgagaaaaagcaaaggaagtttgaccagctcctggccgaagaaaagaacatctctagcaaatacgctgacgagcgggatcgagcagaagcagaggccagagagaaggaaaccaaagccctgtccttggctcgggctctggaagaagcccttgaggcgaaggaggaactggaaagaaccaataaaatgttgaaggccgaaatggaggatctagtgagttccaaggacgacgtggggaaaaatgtgcatgagttggaaaagtctaaacgcgctctggaaacacaaatggaggagatgaagacgcagctggaagagttggaggatgagctacaggccactgaagacgctaagttacggctcgaagtgaacatgcaggcccttaaagggcagtttgagcgagacctgcaggctcgagatgagcagaatgaggagaagagaagacagcttcagcgtcagctccatgaatatgagaccgagttggaggacgaacggaagcagagagcattagcggccgccgccaagaagaagctggaaggcgatctcaaggaccttgaactgcaggccgacagcgcaattaagggaagagaggaggcgattaagcaactgcggaagttgcaggcccagatgaaggacttccagcgcgaactggaggatgccagggccagccgcgatgaaatcttcgctaccgcaaaagagaatgagaagaaggccaagtctctggaagccgatctgatgcaactgcaggaggacctggccgctgcggaaagggcccgcaaacaggctgatctggaaaaagaagagctggcagaggaattggcatcctcgctttccggacgtaatgccctccaggacgagaagcgaaggttagaggctcgaatcgcccaacttgaggaggagctggaagaggaacagggcaacatggaggcaatgtccgacagagtcaggaaagccacacaacaggctgagcaactgtccaatgaactggctacggagcgctcaaccgcgcagaaaaacgagagtgcacgacagcaacttgagagacagaataaggagttgcgctctaaactacacgagatggagggtgccgtgaagtccaaattcaagtccacaatcgctgccctggaagccaagatcgcacagctggaggaacaggtcgaacaagaggcccgggaaaaacaggccgccaccaagagcctgaaacaaaaggacaaaaagctaaaggagatcctgctgcaggtggaagatgagagaaagatggccgaacagtataaggaacaagccgaaaagggaaatgcccgggtgaagcaacttaagcgccagttggaggaggcggaagaggaatcccaacgcattaacgctaacaggcggaaattgcagcgtgagctcgatgaggcaacggaaagtaatgaggctatgggcagggaggtcaatgctctcaaaagcaagcttcggggcccaccaccccaggagacatcacagtag

SEQ ID NO: 125499 - DNA, 5817 bp, Artificial Sequence
  Description of Artificial Sequence: Synthetic coding sequence
atgagttcagatgccgagatggccatttttggagaggccgccccatacctgcgcaaacctgagaaagagcgcatagaggcccaaaataggccattcgactccaaaaaagcatgtttcgttgcggataacaaggagatgtatgtgaaaggcatgatccagacccgggaaaacgacaaagtgatcgtcaagaccctggatgaccgcatgctgaccctgaacaatgatcaggtgttccccatgaatcctcccaagttcgataagatagaagatatggcaatgatgacccatctgcacgagcctgctgtcctttacaacctcaaagaacgctatgctgcctggatgatttatacttactcggggctgttctgcgtcactgtcaatccttacaagtggctacctgtttataagcctgaggtcgtagcggcttaccggggcaaaaaacgccaggaagcgcctccccacattttcagcatatctgataacgcataccagtttatgttgaccgacagggacaaccagagcatccttatcacaggagagtcaggagccggaaaaacagttaacacgaaacgtgtcatccaatattttgcaacaatcgccgtaaccggcgataaaaaaaaggagacgcaaccgggtaagatgcaaggaaccttagaggatcagatcatccaggccaatccactcttggaggccttcggcaacgcaaagactgtacgcaatgacaactctagtcggtttggcaaattcatcagaattcactttggagccaccggcaaactcgcgagtgcagacatcgaaacttatctcctcgaaaagagtagagtgacattccagctcagcagcgagcgctcttaccacattttttaccagataatgtccaacaaaaagccagaactgattgatctattgctgatttctacaaacccatttgacttcccatttgttagccagggagaggttaccgtggccagcatcgatgactcggaggagctgcttgctaccgataatgccattgacatcctgggctttagttcagaggaaaaggtaggtatctacaagctaaccggcgcagtgatgcattacgggaatatgaagttcaaacagaaacagcgggaggagcaggccgagcctgacggcaccgaagtggcggacaaagccggatacctgatggggttgaacagtgccgaaatgctgaaaggtttgtgttgccctagagttaaggtggggaacgagtacgtgaccaaggggcagaatgtccagcaggtcactaattccgtcggcgcgctcgccaaagccgtgtatgaaaaaatgttcttgtggatggtgacccggatcaatcagcagctggacactaagcagcctaggcaatactttataggagtgcttgacattgccggcttcgagatctttgactttaattccctcgaacagctctgcatcaatttcaccaacgaaaaactccagcaattttttaaccatcatatgtttgtcttggaacaggaggaatacaagaaggaggggatagagtgggaattcattgatttcggcatggatcttgcagcctgtatcgagcttattgagaagcctatggggattttctccatccttgaagaagagtgtatgtttccaaaagccacagatacatcgtttaaaaataagctctacgaccagcatttgggtaaaagcaataattttcagaaacccaagccggcgaaaggcaaagcagaggcccacttctcactggtgcattatgctgggacagtggattataatatcgccggctggctagataaaaacaaagatcctctcaatgaaacagtggtgggcttgtatcagaaaagctccctgaagcttctaagcttcttgtttagcaactatgcaggcgccgagaccggcgactccggtgggtccaagaagggagggaaaaagaaagggagtagctttcagaccgttagtgcagtatttagagagaacctgaacaaattgatgaccaacttacggagcacccatccacatttcgtcaggtgcttgattccaaacgagacaaagacccccggtgtgatggaccactacctggtcatgcatcagctacggtgcaacggggtcttagaaggcattcgcatatgccgcaagggttttccttcaagaattctctatgcggacttcaaacagcgctaccggatcctgaatgccagtgccatacctgaaggccagttcatagatagcaagaatgcaagtgagaaacttctgaattccattgatgtggatcgcgagcaattcaggttcggcaataccaaagttttttttaaagccggcctactgggtctactcgaagagatgagggacgagaaactggtcacgttgatgactagcacgcaggccgtttgccgtggctacctgatgcgcgtagagttcaagaaaatgatggagcggcgggactccatcttttgcatccagtataacattagatccttcatgaatgtgaaacattggccttggatgaacctcttctttaaaattaagccgctgctgaaatcagccgaggcagagaaggagatggctaccatgaaggaagatttcgagcgaacgaaagaagaattggcgagaagcgaggcccgcagaaaggagcttgaggagaagatggtcagcctattgcaggagaaaaacgaccttcagcttcaggttcaatctgagacagaaaacctaatggatgccgaggaaaggtgcgaaggacttattaaatcaaagattctgctggaggctaaggtgaaggaattaaccgaaaggctggaagaggaggaagagatgaattccgaactcgtggctaagaaacggaatcttgaggataaatgctcctctttaaagcgtgatattgacgacctggagttaaccctcaccaaggtcgagaaagagaagcacgcaacagaaaataaggtaaagaatctctcggaggagatgacggcgctggaggagaatattagtaagctgaccaaggaaaagaagtctctgcaggaagcccatcagcagacgctcgacgatctccaagttgaggaagacaaggtgaacggcttgataaagattaatgcaaagctggagcagcagactgatgacttggagggctccctggaacaggagaaaaagttgagagcagacttggagcgcgctaaaagaaagctggagggcgacttaaagatgtctcaggaatccataatggaccttgagaacgataaacaacagatagaagaaaaactaaagaagaaagaatttgagttatctcagctccaggcaaagattgacgatgaacaggtccactcactccagtttcagaaaaaaattaaagagctgcaggctaggatcgaggagctcgaggaggagatcgaggccgagcacacgctcagagcgaagatcgagaaacagcggtctgacctggctcgcgaactggaagagattagcgagcggctcgaagaggcaagtggagccactagcgcgcagatagaaatgaacaaaaagagagaagctgagttccaaaagatgcgccgagatttagaagaggcgaccttgcagcacgaggccacagctgctactcttaggaagaagcaggccgatagcgtggccgagctcggagagcagatcgacaatctccagcgggtcaagcagaaattagagaaggagaagtccgagctgaagatggagatcgacgatatggcatctaatatcgaggccctctccaaatcgaaatccaatattgagcggacatgcagaacagtggaggatcagttttcagagattaaagcaaaagacgagcagcagacccaattaattcatgacctgaacatgcagaaagctagactgcaaacccaaaatggggaactttcacacagagtggaggaaaaggagagcctgatcagtcagctgacaaagagcaagcaggcactgactcagcagctcgaagaactgaaaagacagatggaagaggagaccaaagctaaaaatgccatggctcacgccctacaatctagcaggcacgactgtgacctgctaagggagcagtacgaggaggagcaggaggcaaaggctgagctgcagagagcgctgtccaaagcgaactccgaggtggcccaatggcggaccaaatacgagactgatgctatccagaggactgaggagctcgaggaagctaaaaagaaattggctcagcggctgcaggaagccgaggagaacactgagacagctaactctaagtgcgcgtcattggagaaaacaaagcagcgtttgcagggagaagttgaggatctgatgagggacctcgagcgcagccacacagcatgcgctacactggataaaaagcagaggaactttgacaaagtcctagccgagtggaagcaaaaactcgatgagagccaggccgagcttgaggcggcacagaaggagtcccgcagcttaagtaccgaactgttcaaaatgcgtaacgcatacgaggaagtagtagaccagctggagactttgcggcgggaaaacaaaaacctccaggaggaaattagtgatttaacagagcagatagctgaaacaggaaaaaacttgcaggaggccgagaagacaaagaagctggtggaacaggaaaaatccgatctccaggtggcgctagaggaggtggagggctccctggagcacgaggaaagtaaaattctccgtgttcaactggagctgtcccaggttaaatctgagcttgaccggaaagttatcgagaaagatgaggagatcgagcagcttaagcgtaatagtcagagggctgccgaggcactccagtcagttttggatgccgaaatccgttctcgcaatgatgcattgcgcttgaaaaagaagatggaaggcgacctgaacgaaatggagattcagttgggacattccaaccggcaaatggcagaaacacagaagcatctcaggacagtacagggacagttgaaggacagtcagctgcaccttgatgacgcgctgcgatcaaacgaagacctcaaagagcaattggccatcgtggagcgcaggaatgggctgctgcttgaggagctggaagagatgaaggtggcccttgaacagacagagagaactaggcggttgtcagaacaggagcttttggacgcctctgaccgggttcagctcttgcactcccagaacaccagcttaattaatactaagaaaaagctcgaggccgacatagcccagtgtcaggcagaagtcgaaaacagcattcaagaatctcggaatgcggaagagaaggccaagaaggcaataaccgatgccgcgatgatggctgaagaacttaagaaagaacaagatacatccgcccacctggaaaggatgaagaaaaaccttgagcaaacagtcaaggacctgcagcatagacttgacgaggccgagcagctggccctgaaaggaggaaagaaacagattcagaaacttgagaaccgggttcgagaactagaaaacgaattggacgttgagcaaaagcgtggggcagaggccctaaagggcgcccacaaatacgagcgcaaggtgaaagagatgacctaccaagccgaggaggaccacaagaacattctgcgtcttcaggatctcgtggataaactgcaggccaaagttaagtcctacaagcgccaagccgaggaagccgaggaacaggcgaacacccagctgtcccgctgtagaagggtccaacacgaactggaagaagctgcggagcgggccgatattgccgaatcccaggtgaacaagctgagagctaaaagtagggatgttggttcccagaagatggaagagtag

SEQ ID NO: 125500 - DNA, 2001 bp, Artificial Sequence
  Description of Artificial Sequence: Synthetic coding sequence
atgttgtctcatatgttgtacaagaaggagaacgccatcgatattctgggattttcgagtgaggagaaggtagggatatacaagctgactggggcagtgatgcactacggaaacatgaaattcaagcagaagcaaagagaggagcaggcagaacctgacggcacggaagttgcagacaaggccggatatctgatgggcctaaactccgccgaaatgctgaaaggattgtgctgccctagggtcaaggttgggaacgaatacgttacgaagggccaaaatgtgcagcaggtcactaattctgtcggcgccttggcaaaagctgtctatgagaaaatgttcctgtggatggtgacacggataaatcagcagctggatacaaagcagcctaggcagtactttataggcgtgctcgacatcgccggtttcgaaatctttgacttcaatagcctggaacaactttgcatcaattttactaacgagaagctgcagcagtttttcaaccatcacatgttcgttctagagcaggaagagtacaagaaggaaggaatcgagtgggagtttattgattttggcatggatctagccgcgtgcattgagttgatcgagaaacccatggggattttttccatacttgaggaagagtgcatgttcccaaaagcaaccgacacaagttttaagaataaactgtacgaccaacacttgggcaagtcaaataattttcaaaaacctaaacccgccaagggcaaggcggaggcccacttctctctagtgcattacgccggcactgtggactacaatatagcaggctggctggataaaaataaagatcccctcaatgaaacagtggttggcctctatcaaaagtcaagtcttaaattgctgagcttcctattttccaattatgcaggagccgagaccggagacagcggcgggtccaaaaagggcggcaagaagaaggggagttcttttcagacggtgagtgctgtgtttagagaaaatcttaacaagctgatgacaaatttacggtccacccacccgcatttcgttcggtgcctgattccaaacgaaaccaaaacccccggtgtgatggaccactaccttgttatgcaccagctccgctgcaatggcgtgttagagggtatccgtatctgtcgcaagggattcccaagtcggatcctgtacgcggacttcaagcagagatatcgcatcttaaacgcctctgctatccctgagggtcaattcatcgactctaagaacgcctctgagaaacttctcaacagtattgatgtggatcgggagcaattccggtttgggaacactaaagtattctttaaagcgggcctgctgggcctactggaagaaatgcgggatgaaaaattggtgacactgatgactagcactcaggccgtctgtaggggctatctgatgagagtggaattcaaaaaaatgatggagagacgtgatagtatattttgtattcagtacaacattcgtagtttcatgaacgtgaagcattggccctggatgaacctctttttcaagatcaagcctttgctgaaaagtgccgaagccgagaaagaaatggccaccatgaaagaagacttcgagcgaactaaggaggaactggcacgctctgaggcgcggagaaaagaactgaccgagaggctggaggaagaggaagaaatgaactcggagcttgtcgccaagaagaggaatctggaggacaagtgttccagcctcaagagggatattgacgacctggagctgactctgactaaggtcgagaaagaaaagcacgccacggaaaataaagtgaaaaacttgagtgaagaaatgacagcacttgaggaaaacatttctaaactcaccaaggagaaaaaatccttgcaggaagcccaccagcaaacattggatgatttacaagtggaggaggacaaggtgaacggattgattaaaataaacgctaaacttgaacagcagacagacgacgagggcgtgtag

SEQ ID NO: 125501 - DNA, 6111 bp, Artificial Sequence
  Description of Artificial Sequence: Synthetic coding sequence
atggcagccgtgacaatgagcgtgcctgggaggaaggcgccaccaaggcctggaccagtgccagaagccgctcagccttttctatttactcctcggggccccagcgccggaggcggaccaggaagtgggacatccccccaggttgagtggacggcccggcggcttgtctgggtgccctctgaattacacggattcgaagccgctgccctcagggatgagggggaggaagaggcagaggtggaactagccgaatcaggaagacgtctgaggctgcccagggaccaaatacaacgcatgaatccaccaaaattcagtaaggctgaggacatggccgagctgacatgtctgaacgaagcttctgttctgcacaacctgcgggaacggtattactcgggcctcatctacacctactctggactgttctgtgttgtgataaacccatataaacaactccccatttatacagaggccattgtcgaaatgtaccgtgggaagaagaggcacgaagtccccccacatgtgtatgccgtgaccgaaggggcctaccgttctatgctgcaggatcgagaagatcagagtattctgtgcaccggggaatcgggcgccggaaagaccgaaaacactaaaaaagtcattcagtacttagcgcacgtggcttcgtctccaaagggtagaaaggagcctggcgtccctgcatcagtctccaccgtcagctatggcgagcttgagcggcagctgctgcaggctaaccccatccttgaagcgtttggaaacgccaagacagttaaaaacgataattcttctcggttcggaaaattcattcggattaactttgatgttgccggctatatagtaggcgctaacatcgaaacctatctgctagagaaaagcagagctatccggcaggccaaagatgagtgtagtttccacattttctaccagctgctaggcggagccggcgaacagttaaaagccgacctgctgctggaaccttgtagccactatagatttctcacaaatgggcctagttctagcccaggccaggaacgggaactattccaagagaccctagaatctttgagagtcctgggattttcccacgaggagattatatctatgctgcgtatggtctccgccgtgctgcagttcggcaacatcgctctgaaacgtgagcggaacacagatcaggctaccatgccagataatactgcagcccaaaagttgtgccgcctcctagggttgggagtgaccgacttctcaagagcccttctcacgccaagaatcaaggtggggcgcgattatgttcagaaggcccagaccaaggaacaagcagactttgcgctggaagctctggcaaaggcaacatacgaacgccttttccggtggctcgtactcaggctcaatagggccctggaccgaagcccacggcagggggcctccttccttggaatcttagatattgctggctttgagatctttcagttaaattcattcgagcagctatgtatcaactacactaatgaaaagcttcaacagctctttaatcacacaatgttcgttctagaacaagaagaataccagagagagggcattccctggacctttctcgatttcggtctggacttacagccgtgtattgacttaatcgagaggccggcgaatccccccggcctactggccctgcttgatgaagagtgttggttcccgaaagctacggacaagagtttcgtggaaaaagttgcccaagagcaaggcggccacccaaagttccagagacccagacacctcagggatcaggccgatttctccgtgctgcactacgccggcaaagtggactataaggccaatgagtggctgatgaagaatatggatcctctgaacgataatgttgcggcactgctacaccagtcgacagatagactgaccgcagagatctggaaagatgagcacgggggcttccagcagttttccttcctgggcagctttcctcctagccccccgggcagtgcagagcgctgctcgtcagctatctcaccacctggcgtagagggcattgtgggacttgagcaggtgtcttccctcggcgatggcccccccggaggacgaccccgcaggggaatgttccggaccgtgggtcagctttataaggagagcctcagcagactgatggcaactttgtctaacaccaatcccagctttgttcgctgtattgtgcctaaccacgaaaaaagagccggaaaattggagccccggcttgtcctcgaccagttgaggtgtaatggagttctcgaggggatacgcatttgcaggcaagggttccccaatcgtatactgtttcaggaattcagacagaggtacgagattttaaccccaaacgcaattcccaaagggttcatggacggcaaacaggcttgcgagaaaatgattcaggcattggaacttgatcctaatctatacagagtgggacaatccaagattttcttcagggccggcgtgttagctcaactggaagaagaacgggacttgaaagtcaccgacatcatcgtgtctttccaggcagctgctaggggctaccttgcccgacgcgcattccagaagcgacagcagcagcagagtgcactgagggtgatgcagagaaactgtgccgcttatctcaagctgaggcactggcagtggtggcggttatttacgaaagttaagccactgctccaggtcactcggcaggatgaggtgttacaggcccgggctcaggagttgcaaaaagtccaggagctccagcagcagtccgccagagaagttggcgagttacaagggagagtcgcgcagctcgaggaggagagagccaggcttgctgaacagctgagagcagaggccgagctctgcgcagaggctgaggaaacaaggggccggctggctgctcgtaagcaagagctggaattagtggtgtcagagctggaggcccgcgttggcgaggaagaagaatgcagccgacagatgcagacagagaagaagaggctccagcaacacattcaggagctagaggctcatctggaagccgaagagggtgctcgacagaagctccagctggagaaggttactactgaggctaagatgaaaaagttcgaagaggacctgctgctgctggaggatcagaactccaagctgtccaaggaaagaaaactgcttgaggaccggctggccgaattctcatcacaagcagcagaagaggaggagaaggtgaagagtttgaataagttacgcctgaaatacgaagctacgatagctgacatggaggaccgattaaggaaggaagagaagggcagacaggagctggaaaagctgaaacgacggctagatggggaatcatctgaacttcaggagcagatggtcgagcagcagcaaagggccgaagaactcagggctcagctgggccgcaaggaggaggagctgcaggcagctctcgctagagctgaggacgaaggaggcgctcgtgctcagttactgaagagcctccgcgaggcacaagccgcactggccgaggcccaggaagacctcgaaagcgagagagtggccaggacaaaagcagagaaacagagacgcgacttaggagaggaacttgaagccttacgaggtgagctggaagacactttggattccactaatgctcagcaagagctgcgctccaagcgcgaacaggaggtgaccgagctgaagaaaacattagaggaggagaccagaatccacgaggctgctgtccaggagctgaggcagagacacggtcaagcccttggagagttggccgagcaattagaacaagcccgcagagggaaaggtgcgtgggagaagactcgcctggcactggaggctgaggtttcagagctgcgagcagaactgagttccttgcagaccgcacgccaagagggggagcaacgccggcggcgacttgaactccagttgcaggaagtccaaggccgcgctggtgatggggaacgagcccgcgcggaggcggccgaaaagctgcaaagagctcaggccgagctggagaacgtgagcggggcattgaacgaggccgagtcaaaaactatacgactctctaaggagctgagcagcacagaggcgcagcttcacgatgcccaggagctgttacaggaagagacccgagcaaaactcgctctaggatcaagggtgcgggctatggaggcagaggcagctgggttgcgcgagcagttagaagaggaggcagctgcccgagaacgcgctggacgcgagctgcagacagcccaggctcagctgtcagaatggcgacggaggcaggaagaggaggccggtgcgctggaagctggcgaggaggctcgacgccgagcagccagagaagctgaggcactaacacagcggctcgctgaaaaaacagagaccgtcgataggctggaacgcggcaggaggcgccttcagcaagagctggatgacgccaccatggacctggaacagcaacggcaacttgtctcgacattggaaaaaaagcagaggaagtttgaccagctcctggccgaagagaaggctgccgtactgcgcgctgtcgaggagagggaacgggcagaggcagagggtcgggaaagagaggcccgagccctgagcctgacccgcgcgctagaggaggagcaggaagctagggaggagctagaaaggcagaacagggctcttagggccgaacttgaagctttgcttagtagtaaggatgacgtgggtaagtcagtgcatgagctggagcgggcgtgtcgcgttgctgagcaggcagccaatgacctcagagcccaggtcaccgaactggaggatgagctgactgccgcagaagatgccaagctgaggctggaagttactgtgcaagctctgaagacacagcatgaacgagatctacaggggagagatgaggcaggagaggagcgcaggcgccaacttgctaaacagcttcgagacgccgaagtcgagagggacgaggaaaggaagcagagaactctagcagtagctgcgcgtaagaagctggagggggaactggaggagctcaaggcgcagatggcctctgctggccagggaaaggaagaagcagtgaagcagctgcgtaaaatgcaagctcagatgaaagaactttggcgcgaggtagaagagacacgcactagccgagaggaaatctttagccagaaccgcgagagcgaaaagcgtctgaaagggctggaagcagaagtgctccggttgcaggaggaactggctgcatcggaccgagcccggagacaagcacaacaggaccgcgacgaaatggccgatgaggtggccaacggtaacttgtctaaggccgcaattctggaggaaaaacgtcagctcgagggacgcttaggccagttggaggaagaacttgaggaggagcagtcaaacagcgagcttcttaatgataggtataggaagctcctcttgcaggtcgaatctcttactacggaactgtctgccgagcgatccttctccgcaaaagccgaaagtggacggcaacagctagaacggcaaattcaggaattacgcgggcgtctcggcgaggaagatgctggcgctcgagctaggcataaaatgacaatcgctgccctcgaaagtaagctggcccaggctgaagaacaattggagcaggagacgagagaaagaattctgagcggaaagcttgtccgaagagccgaaaagcgcctcaaggaggtggtattgcaggtagaggaagagaggcgagtagccgaccaactgcgggatcagcttgaaaaggggaatctcagagtcaagcagctaaaaagacagctggaggaggccgaggaagaggcttcccgggctcaggccggaaggcgccgcttacagcgcgaattagaagatgtaacagagtcagctgagagcatgaatagagaagtcacaacacttcgcaataggctgcggcggggtccactgaccttcactacccgcactgttagacaggttttccggctggaggagggtgtggcgtccgacgaagaggccgaggaagctcaacctggctcaggacccagccctgaacccgaaggctcaccccccgcccatccccaatag

SEQ ID NO: 125502 - DNA, 4437 bp, Artificial Sequence
  Description of Artificial Sequence: Synthetic coding sequence
atggctgcggtgactatgagtgtgccaggccgtaaggcccccccacgaccagggcccgtgcctgaagccgcccagcctttcctgtttacaccccgggggccctcagcgggaggcggcccagggtccggtacctcccctcaggtggagtggactgcaaggcgccttgtgtgggtgccaagcgaacttcatggattcgaggccgcagcattgagggatgagggcgaggaagaggcagaggtcgaactggccgagtcaggacggcgtctgcgtctgcctcgggaccaaatacagcgcatgaatccccctaaattttcgaaagctgaagacatggccgagctaacgtgtcttaatgaagcaagcgtgttgcataacctccgcgagcgatattatagtggcttgatatacacatattccgggctgttctgcgttgtgataaatccttacaagcagcttcccatctacactgaagccattgtggaaatgtatcgcggcaagaagaggcacgaagtccctccacatgtgtatgctgtcacggagggcgcctatcgaagtatgttacaggacagggaagatcagagcatcctctgcaccggagaaagtggagccgggaagaccgagaacactaagaaagtgattcagtacctagcccatgtggcttccagccctaaggggaggaaagaacctggggtaccaggcgagttggagagacagttactgcaggcaaaccctattctggaggccttcggtaatgctaaaacagtgaaaaatgacaattcgagccgcttcggtaaattcattcggataaattttgatgtagctggatacatcgtgggggccaatattgaaacatacctgcttgagaagagtagggctatcaggcaagctaaggatgaatgctccttccatatattctatcaacttttgggcggggccggagagcagctgaaagccgatctgctgctagaaccctgttcccattacagatttctgactaatggtcctagcagctcaccaggccaagaacgggagctgttccaggagacactggagtctcttagagtgctgggattcagtcacgaggaaattatctctatgcttcggatggtgtccgccgtcttacagtttggaaacatcgccttaaaacgcgaacgtaacactgatcaggccaccatgcctgacaatacagcggctcagaaactctgtcggctactgggcctgggtgtgaccgatttcagtcgcgcgctgctcaccccgcggatcaaagtcgggagggactatgtgcagaaagcacaaacaaaggaacaggctgacttcgccctcgaagctcttgcaaaagcaacctatgaaaggctttttaggtggttagtgctccgtcttaatcgggcccttgatcgctctcctagacagggcgctagtttccttggaatccttgatatcgctggtttcgagatttttcagttgaactccttcgaacagctatgcattaattacacaaacgagaaactgcaacagctgttcaaccatacaatgtttgtcttggagcaggaggaatatcagcgcgaaggaatcccctggacattcctggactttggactagacctacaaccttgtatagatctgatcgagcggccagcaaatcctcccggtcttctggcgctcctcgacgaggagtgctggttccctaaggcgacggataagtcattcgttgagaaagtggctcaggagcagggtggacacccgaagtttcaacgacctaggcacttacgggaccaagccgacttctcggtactgcattatgctggtaaagtagactacaaagccaatgagtggctgatgaagaacatggatcccctgaatgacaacgtcgcagcactgctgcatcagagcaccgatcgcctcactgccgagatttggaaggatgtcgaaggcatagtagggctggagcaagtcagctcattgggggacggacctcctggcggtcgtccacggcggggaatgttcaggactgtgggtcaactctataaggaatcgctctcacggcttatggccaccctgtctaacaccaacccaagctttgtgcgttgtatagtgccaaatcatgagaagcgggcgggcaagctcgagccacgactggtgttagaccagcttaggtgtaatggggtgttagaaggcattcgaatatgccggcagggattccctaatcggatcctattccaagagttccgccagcggtatgagatcctaacacccaatgctattcctaaagggttcatggatggcaagcaggcttgtgaaaaaatgatccaggcactggagctggaccctaacctataccgcgtggggcagtcaaaaattttctttcgagccggcgtgctggcacagctggaggaagagcgcgacctcaaagttaccgatatcattgtgagcttccaggctgctgcaagaggctacctggctcggcgggctttccagaagaggcaacagcagcagtctgctctccgtgtaatgcagagaaattgtgctgcataccttaaattgaggcactggcaatggtggagattgtttacaaaagtgaagccactcctgcaggtgacaaggcaggacgaagtgttgcaagccagggcccaggagctgcagaaagttcaggaactgcagcagcagtctgcccgtgaagtgggcgaactccagggccgcgtggcacagttggaggaggaacgggcccggttggcggagcaactgcgggccgaagccgagctatgtgcggaagcagaggaaactcgtggccgactggcggctcggaagcaggaattagagctggtggtttcagaactggaagcacgtgtcggggaagaagaagagtgctctcgtcagatgcagacagaaaagaagaggctccagcagcatatccaagagttggaggcgcacctggaggcagaagaaggcgcgagacaaaaactgcaacttgagaaagtcaccactgaggccaagatgaaaaaatttgaagaggaccttttactgctggaggaccagaactccaagctgtctaagagcggctcttgttggaagatagtgtggccaagctcccacccaaggcagttgagaagaaggaggcgctctcgggcaagtatttcatatggtagtaacatgaggccccagtcccagacttggagggaccggttacgaaaggaggagaaaggccggcaggaactcgaaaagctgaagcgacggctggacggagaaagcagcgagcttcaggaacagatggtcgaacagcaacaaagggctgaggagctgagagctcaactcggccgcaaggaagaggagctgcaggctgcgctcgcgcgagcagaggatgaggggggcgctcgtgcccaactgctgaaatcactacgggaggcccaggctgctctggctgaggcacaggaagatctggagtccgagcgggttgccaggacaaaagccgaaaagcagcggagagacctgggcgaagagttagaggcactgaggggagagctcgaggatacactggattctactaacgcccagcaagagctgaggagcaaaagagaacaagaggtcaccgaactcaagaaaaccctagaagaggagactagaatacacgaagctgccgtacaggagctgaggcaaagacacggacaggctctcggcgagctcgctgagcagcttgagcaagcccggaggggaaagggcgcttgggaaaaaacgaggctggccctggaggcggaggtgtccgaattgcgcgccgaactatcaagccttcagactgctcgccaggagggggaacaaaggcggcgcagattggaactgcagctgcaggaagtgcagggcagggcgggagatggagagagagcgcgcgcggaggctgcagagaaactgcagagagcgcaggctgaactagaaaacgtatctggggctctgaacgaggcagaatctaagaccatacgattgtctaaagagttgtcatccaccgaggcccagctgcacgatgcacaggaacttttgcaggaggaaacaagggccaagcttgctttagggtccagagttcgggcgatggaggcagaagccgccggcctgcgagaacagctggaagaggaggcagctgcccgcgaaagagcgggaagggagctgcagaccgctcaggctcaacttagcgagtggaggagacggcaggaagaggaagctggcgctctagaggcgggggaagaagcccgtaggagagccgcacgcgaggctgaggctctcactcaaagactggcggaaaaaacagagaccgtagacagactggagcgcgggcgtcgtagactccagcaggaactggatgatgccacactgtcacctgacgctctgactgacggagctcaacccccgtcctcacttgacccgacaggtccatgccctcgcaatcctgcactttag

SEQ ID NO: 125503 - DNA, 5340 bp, Artificial Sequence
  Description of Artificial Sequence: Synthetic coding sequence
atggctgccgtaaccatgagcgtccccggaagaaaggctccacctcgacccggccctgtcccagaagcagctcagcccttcctattcactccaaggggaccttcggcaggcgggggtccgggttctggaacttccccccaagtagagtggaccgctaggcgtctcgtttgggtcccgagcgaacttcacggatttgaagccgcagccctccgggacgagggcgaagaagaagcagaggtggagttggccgagagcgggcgccgcctgcgattaccccgggaccagatccagaggatgaaccctcctaaatttagtaaggctgaggatatggccgagcttacctgcctgaatgaggcttccgtgctccacaatcttagggaaagatattactccggtctcatttacacttatagcggtctcttctgtgtggtcataaacccctataagcagttaccgatctacaccgaagccattgtggaaatgtataggggcaagaagcggcacgaagtcccccctcacgtctatgccgtaacagagggggcatacaggagtatgctgcaggaccgagaagatcagagcatcctatgcactggagagtccggtgcagggaagactgaaaataccaagaaggtcatccaatatttggcccatgtggcatccagcccaaagggccgtaaagaacccggcgttccgggagaattggaacggcaattgttacaagccaatcctatcctggaggcgttcggaaatgcaaagacagtgaaaaatgacaatagtagccgcttcgggaagttcattcgcattaatttcgacgttgcaggctatattgtaggggctaatattgagacttatttacttgagaagagccgagccatcagacaagccaaggacgagtgcagtttccatatcttctaccagctgctgggtggggccggtgagcagcttaaggccgacctcctgctcgagccatgtagccactaccgatttctgaccaacgggccatcctcaagccccggtcaggagcgcgaactatttcaggagaccttagaaagcctcagagtgctgggcttttcccatgaagagatcatttctatgctgagaatggtgtccgctgtgctacaatttggtaacatcgcattaaaacgtgagcggaacacagaccaggctactatgccagacaataccgcagctcagaagctgtgccggctcttaggtctaggcgtgactgatttttcgagggctctgcttacaccccgaatcaaggtagggagggattatgtgcagaaggcgcagactaaggagcaagccgactttgccctcgaagcgctagctaaagctacttatgagcgtctgtttcgatggctggtcctgagactcaatagagccctcgataggagcccccggcagggtgcctcttttctgggcatactggacattgcaggctttgagatctttcagctgaattcttttgagcaactgtgtataaattacacaaacgagaagctccaacagctctttaaccatacaatgttcgtcttggaacaggaggaataccaacgagaggggataccttggactttcctcgattttgggctggatctgcagccctgtatagatctgattgaacggcccgctaatcccccaggactgctggcactgcttgacgaagagtgctggttcccgaaggccacagataaatccttcgtggagaaggtagctcaggagcaaggcgggcatcccaagttccagcgacccagacacctgcgagaccaggcggatttcagtgtcctacattatgccggaaaagtggactacaaggctaacgagtggttgatgaagaacatggaccctctcaacgacaacgtggcagccttgctccaccagtcaacggaccgattgaccgccgaaatctggaaggacgtggaaggcattgtaggactcgagcaggtctctagcttgggagacggtccaccgggtgggagaccacgacgtggaatgtttcgtactgttggacagctgtataaggagtctctctctcgcctcatggccactcttagcaatacaaatccctcctttgtgaggtgcatcgtgcccaatcacgaaaagcgggctgggaagctcgagccgaggctggtgctggatcagttgaggtgtaacggcgtcctggaaggtatccggatctgtaggcagggatttccgaaccggatcctgtttcaggaatttaggcagagatacgaaatactcactcccaacgcaatcccaaaaggttttatggatggcaaacaagcctgcgagaagatgattcaagcgctagagcttgatcctaacctctaccgagtgggccaaagtaaaattttcttcagagccggcgtattagcccagctggaggaggagagggatttgaaagtgacggacattattgtgtcttttcaagccgccgccagagggtatctggcccggagggctttccagaaacgacagcagcagcaaagcgccctcagagtcatgcagaggaattgcgccgcctacctgaagctcaggcactggcagtggtggcgcctgttcactaaagtcaagccgctgctccaggttacccgccaagacgaagtgctacaagccagagcgcaggaactgcagaaggtccaggagctgcagcagcagagtgcccgcgaagtcggagaactccaaggacgagttgctcagttagaagaagagagagctcgcctggccgaacaactacgggccgaagctgagctgtgcgccgaagctgaagagacacgcgggcgtttagccgcccgaaagcaggaattagagctagtcgtgagcgagctggaagcccgcgtcggagaggaggaagaatgttccaggcagatgcagacagagaagaagcggctgcagcagcacatacaagagctcgaggctcatctagaggccgaggagggtgctcgccagaagctgcagctcgagaaggtaacaaccgaggcaaaaatgaagaagttcgaagaggatttactgcttctagaagaccagaatagtaaactaagcaagtctggtagctgctggaagatcgtgtggccttcttcccacccccgccaacttcgaagacgccggaggagtagggcctcaatttcttacgggtccaacatgaggccccagtcccagacatggcgagacaggttgcgcaaggaggaaaagggtaggcaggagctggaaaagctgaaacggcggctggatggcgagtcttccgaactccaggagcagatggtcgagcagcagcaacgcgccgaagagctaagagcacagctgggcagaaaggaggaagagcttcaggctgccctcgctagagcagaggacgaagggggtgcacgggctcagctgctgaagtccttacgcgaggcccaggcagccctggcagaagcccaagaagatctggagtcagagcgggtggctcggactaaagcggaaaaacagcgaagggacttaggcgaagagttggaagccttacggggagaactggaggatactctcgattcgaccaacgcccagcaggaactccgaagcaagcgcgagcaggaggtgactgagttaaaaaaaacgctcgaagaggaaacgaggatccacgaagctgctgttcaagagctaagacagagacacggccaggccctaggagaactggccgaacagctggagcaggcaaggagaggcaagggagcgtgggagaagactcgactggccctggaagcagaagtttcagagcttcgtgccgaactgagtagtttgcagaccgccaggcaagagggtgagcagagacgccgccggttggaactacagctgcaggaggtgcagggcagggcaggggacggggagagagcacgggccgaagccgccgaaaagctccagcgagctcaagcagagctagaaaatgtgtctggagccctcaacgaggctctgttgtcttcgaaagacgatgtaggaaaaagcgtgcacgagctagagcgcgcttgtagggtggccgagcaggccgctaatgatctgcgcgcccaagtgaccgagctagaagatgagctgaccgctgccgaggatgccaaactccgactggaagtgacagtccaggctctgaaaactcaacatgaaagagatctgcagggacgggacgaggccggtgaggagcggcgcaggcagctagccaaacagctgcgggacgcagaggtggaacgggatgaagaaaggaaacaaaggactctggccgtggccgcccgcaagaaactggagggcgaactggaagaattgaaggcccagatggctagtgccggacagggaaaggaggaggccgtgaagcaactgaggaaaatgcaggctcaaatgaaagagctgtggcgagaggtcgaggaaacccggacatcaagggaagaaatcttctctcaaaaccgcgagagcgaaaagcggctgaaggggttggaggccgaggtccttaggctccaggaagagctcgcagctagtgacagggccaggcggcaggcacagcaagatcgggacgagatggcggacgaggttgccaacgggaacctttctaaagcagctattcttgaggaaaagagacaactggaaggtagactgggacagctcgaggaagagcttgaggaggaacagagcaatagcgaactactgaacgatagatatagaaaactgctccttcaggtggaatccctgactacagagctgagcgctgagcggagcttttccgctaaggcagaaagtggcagacagcaattagaacggcagatccaagagctgagaggacggctgggcgaagaggatgcaggcgctcgcgcccggcataagatgacaatcgcagctctggaatctaagttggcgcaggctgaggagcagctggaacaggaaacccgtgagcgcattctctctggcaaactggtgagacgggccgagaagcgcctgaaggaagtcgtgttacaagtggaagaagaacggcgagttgcagatcagcttcgggatcagcttgagaaggggaacttacgggttaagcagcttaagcggcagctggaggaggctgaggaggaagcgtctagggcacaggcaggacgccgccggctgcagagggagctcgaggacgttaccgaatccgccgagtcaatgaaccgagaggttaccactctccgcaataggctgaggagagggccccttacatttactaccaggactgtgcgacaggtgttcaggctggaagagggggtcgctagtgacgaggaagctgaggaggcacagccagggagtgggccatcgccggaacctgaaggcagtcctcctgctcacccccagtag

SEQ ID NO: 125504 - DNA, 6087 bp, Artificial Sequence
  Description of Artificial Sequence: Synthetic coding sequence
atggcagccgtcaccatgtccgtccctggcaggaaagcacccccaaggcctggaccagttcccgaggccgcccagccttttctattcacccccaggggcccttctgctggaggaggacctggctccggaacgtccccacaggtggagtggactgcgcgtcgtttggtttgggtgcccagtgaactgcacggtttcgaagcagccgccctgagagacgagggggaggaggaagctgaggtcgagctggccgaaagcggacgccgcctccgcctccctcgtgatcagatccaaaggatgaacccacctaagttttcaaaggctgaggatatggccgagctcacatgccttaacgaagcctcagttctgcacaacttgcgcgaacggtattactctggcctcatctacacatactctggcctcttttgtgtagtcataaatccatataagcagctgcctatctatacagaggcaatcgtcgagatgtacagaggcaaaaaaaggcacgaggttcctccgcatgtctacgctgtaaccgagggagcataccgctctatgctccaggaccgagaagaccagtctattctatgtactggcgagtctggcgctggaaagacagaaaacaccaagaaagttatccagtacctggcgcatgtcgcttcatcacctaagggaagaaaggagcctggcgtgcccggggagttagagaggcaactcctgcaggccaatcccattttagaggcctttgggaacgccaaaaccgtgaagaacgataattcatcaagatttggcaaatttatccggatcaacttcgacgtggctgggtacattgttggtgctaacatagagacctatcttctagagaagtcaagagctatcagacaggccaaggacgaatgttcgttccatatcttttatcagctactcggtggcgcgggagagcaattgaaagcagatctgttacttgaaccatgctcgcactataggttcctgacgaacggacctagttcatcccctggccaggagcgcgagctgttccaggaaactcttgagagtctgcgggtcttggggttctctcatgaggagatcataagcatgcttaggatggtgtccgccgtcctgcagttcggaaatatcgcgttgaagcgcgagagaaatacagaccaggccaccatgccggataacaccgcggcgcagaagctgtgtaggctactggggctgggagtgactgatttctctagggctctgctgactcctaggatcaaagtgggaagggactacgttcagaaagcgcagacaaaagagcaggcagattttgcattggaggctctcgctaaagccacgtatgaacgcctgttcaggtggctggtgcttcggctgaatcgggcgctggatcggtccccccgtcagggggcttcctttcttgggatacttgatattgcagggttcgaaattttccagttaaattcattcgaacagctctgcatcaactacactaatgaaaagctgcagcagcttttcaatcacactatgttcgtgctagaacaggaagaataccaacgtgaagggattccatggacttttttggattttggactggatctccagccatgcattgatctgattgagcggcctgcgaaccctccaggcctgcttgctctgctagacgaggagtgttggttccctaaggccactgataagtctttcgtggagaaagtggcccaggagcaaggggggcatcccaagtttcagcggccccggcacctcagggatcaggccgattttagtgtgctacactatgctgggaaagtggactataaggcaaatgagtggctcatgaaaaacatggaccctctcaacgacaacgtcgcagcactcctccatcagagtacagacagacttactgccgagatttggaaagatgagcacggcggcttccagcaattttccttcctgggttccttccctccttcccccccaggctccgctgagcggtgctctagtgcgatctccccaccaggagtggagggaattgtagggctggagcaagtctcaagcttgggtgatggtcctcctggagggagacctcggcgaggcatgtttaggaccgtgggccagctctataaagaatcactcagtagactcatggcaacgctgtctaacactaacccatctttcgttcgctgcatcgtgccaaatcatgagaagagagcagggaagctggagccccgcttggttctggatcagctgcgctgcaatggagtgctggagggaatcaggatctgcaggcaggggtttccaaaccgtatcctgttccaagaattcagacagcgatatgagatcctcaccccaaatgccatccctaaagggttcatggacggcaagcaggcttgtgagaagatgatccaggctctggagctcgaccccaatctttacagagttggacagtctaaaatcttttttagagccggcgtcctcgcccagctggaagaagagcgagatctaaaagtaaccgatattattgtttcctttcaggccgcagcacggggataccttgcacgaagagccttccagaaacggcagcagcaacagagtgctttgcgggtgatgcagagaaattgcgccgcttacctgaagctgaggcactggcagtggtggagattattcaccaaagtgaagcccctcctgcaggtgacacggcaggacgaggtccttcaggctcgagctcaggaattacaaaaggtgcaagaactgcagcagcaatccgcccgcgaggttggggaacttcagggtcgagtggctcagttggaggaagaacgggcgaggctcgcagaacagctgagagctgaggcggagctgtgtgccgaggccgaggaaactcggggcagactcgccgccaggaaacaggagttggagctggtggtgagcgaactagaggctcgcgttggggaggaagaggagtgttcccggcagatgcagactgaaaagaaaaggctgcaacagcatatacaggagcttgaagcgcacttggaggctgaggagggcgccagacagaagcttcagctcgagaaggtcactacagaggccaagatgaagaagttcgaagaggacctcttgctgttggaggatcaaaattccaaactcagcaaagagcgtaaactgcttgaggatcggctggccgaattctcttcacaggcggcggaggaagaggagaaagtgaagagtctaaacaaactgaggctcaagtacgaagcaactatagccgatatggaagaccgtttaagaaaggaagagaagggaagacaggagcttgaaaagctgaagcggaggctcgatggagagagttcagaactgcaggagcagatggtggagcagcagcagagagcagaggaactgcgtgcacagttgggtcgcaaggaggaagagcttcaggctgccctcgcaagagcagaagatgagggtggtgcccgagcgcaactgctcaagtcgctgcgggaggcccaggctgccctggcagaggctcaagaggatcttgagtccgagcgcgtagctcgcaccaaagcagaaaagcagcgtagagacttaggagaggaactggaggcattaaggggagagctcgaagatacgctggactccaccaatgctcagcaggagttgaggagcaaacgtgagcaggaggtaaccgagctgaagaagaccctggaagaggaaacgagaatacacgaggccgctgtgcaggagctgagacagcgacacgggcaggcgttgggcgagctggctgaacagctggagcaggcccggaggggcaagggcgcttgggaaaaaacaaggctcgcactcgaagcggaagtgagtgagctcagagcagagctcagttccctgcagaccgccagacaggaaggagaacaaaggagaagaagactggagcttcaactccaggaagttcaaggtcgggccggggatggggaaagagcgcgagctgaagccgctgaaaagctgcagagggcacaagccgagctggaaaacgtctctggggcactgaatgaagctgaatcaaagacgatcaggctctctaaagaactgagttcaacggaagcccaactgcatgacgctcaagagttgctccaagaggaaacaagagctaagcttgccctgggctcccgcgtccgggcaatggaggcagaggccgcaggtctgagagaacagctggaagaagaagcagccgcacgtgagcgagcgggtagggagcttcaaaccgcacaggcacagctgagtgagtggcggaggcgccaggaggaagaggcaggcgccctggaggcgggagaagaagcccgcaggcgtgccgctcgagaggccgaggcgctgacccagaggctcgccgaaaagaccgagacagtagaccgcctggaaagaggtcggcgcaggctgcagcaggaactggacgatgccactatggacctggaacagcagcggcagctggtctccaccctggagaagaagcagaggaaatttgaccagttgttagccgaggagaaggctgctgtgctccgggccgtggaagaaagagagcgggccgaagctgaggggcgggaaagggaagcacgggctttgtctctgacaagggcactagaggaggaacaggaagctagagaggaactggagcgccagaaccgcgccttgcgtgccgagcttgaggctctcttaagttctaaggatgacgtgggtaagtcagtacatgagctcgagcgagcgtgtagagtcgcagagcaggccgctaacgatcttcgggctcaggtcacagagctggaggatgagctcactgccgcagaggatgccaaactccggctcgaggtgaccgtgcaggcactgaagacccagcacgaacgcgatttgcaggggagggacgaggctggagaggagcgcaggcgacagctcgccaagcagttgcgggatgccgaagtggaaagagacgaggagcgcaagcagagaaccctagccgtagccgccaggaaaaaactggagggggaactggaggaactaaaggcgcagatggcttcggcaggacagggaaaagaggaagctgtaaaacagctgcgcaaaatgcaggcgcagatgaaggagctctggcgagaggtcgaagagacccggacatcgagggaggaaattttttcacagaatagggagagcgagaaacgcctgaagggactcgaagcggaagtgctccggctgcaggaagaattggctgctagcgacagggccagacggcaggcccagcaggacagggatgagatggctgatgaagtcgcaaatggcaatctgagcaaagcagcaatcctggaggagaagaggcaactggaagggcgactgggccagctggaagaggagctcgaagaggagcagtctaactctgaactcctgaacgaccgttataggaagctactcctgcaggtcgaaagtctcacaaccgaactttctgctgagaggagtttttccgccaaggctgagtctggcagacagcagcttgagcgacagatacaagaactgcggggacgcctaggtgaagaagacgccggggccagagccagacacaagatgacaatcgccgctctggagtctaagctggcacaggccgaggagcagctcgagcaggaaactagagaacggatccttagtggtaagctcgttcgaagagctgaaaaacggctgaaagaagtagtgttgcaggtggaggaggaacgcagggtagctgaccagttgagagatcagctggagaagggcaatctccgggtgaagcagctgaaaaggcagctggaggaagccgaagaagaagcgtccagagcgcaggccggaagaagacgtctccagcgagagttagaggacgtgactgaaagtgcagagagtatgaatagggaagtgacaacacttagaaatcgccttcgccgcggtcccttaacttttacaacccgtactgtgagacaggttttcagactggaggagggcgtggcttccgatgaggaagccgaggaagcgcagccaggtagcggaccatcccctgagccagaggggtcacccccagcacaccctcagtag

SEQ ID NO: 125505 - DNA, 6012 bp, Artificial Sequence
  Description of Artificial Sequence: Synthetic coding sequence
atggctgctgtcacaatgtcagtccccggccggaaagcaccacctaggcccggcccggttcccgaggcggcccaacctttcctattcaccccccgtggacccagcgcgggcggtgggccaggtagcggcacatctcctcaagtcgagtggaccgccagacggctggtctgggttccaagtgaactccacggatttgaagctgccgctctgcgagatgagggcgaagaggaggccgaagtagagctggccgaatccgggcggcggctccgtctgccgcgggatcagattcagcgcatgaatccccccaagttcagcaaagccgaagacatggccgagctgacttgcctgaacgaagcgtccgtgttgcataatctccgggaaagatactactccggtttaatttacacatacagcggactgttttgcgtggtgatcaacccttataaacagctgcccatctacaccgaagcgatcgtggagatgtatcggggaaaaaagcggcatgaagtgccaccccacgtgtacgcggtgacggagggtgcttatagatccatgctacaggaccgcgaggaccagtcgattttatgcacgggggaatctggcgcgggcaagacagaaaacacaaagaaggtgattcagtacctggcgcacgttgcttccagtccgaagggaaggaaagaaccaggagtaccggcatctgtgagtacagtttcctatggagagcttgagcgccagctgttgcaagctaacccgatcctcgaggcctttggaaacgccaagactgtaaaaaacgacaatagttcccgcttcggcaaatttatacgcatcaattttgatgttgccgggtatatcgtcggggcgaacatcgagacatatctcctggagaaatcacgggcaataaggcaggccaaagacgaatgttcgtttcatatcttctaccagctgctggggggcgcgggagaacaactcaaggcagatctccttctggaaccttgtagtcattaccgcttcctgaccaacggtccaagctcctcccctggccaggaaagggagctgttccaagaaacacttgagagtctgcgcgtactaggcttcagtcatgaggagatcataagtatgctccggatggtgagcgccgtgctgcagttcggtaacatcgccctgaagcgtgagcggaataccgaccaggccaccatgccagacaatacagctgcccaaaagctttgcaggctcttgggtctgggcgtgaccgattttagtagggcccttctgacccctagaatcaaggtcggacgcgactacgtgcagaaagcccaaacaaaagagcaagcagatttcgcattggaggccttggccaaggccacatacgaacgcctgtttcgttggctagtgctgaggttaaatagggcactcgatcgttctcccaggcagggtgcatctttcctgggaatcctggatatcgccggcttcgagatatttcagctgaattcatttgagcagctgtgcatcaactacactaacgagaagctacaacagcttttcaaccatactatgttcgtgctcgagcaagaggagtaccagcgcgaggggatcccttggacctttcttgatttcggattggatctccaaccgtgcatagatttaatagaaagacccgctaatccgcccgggttgctggctctactggatgaggagtgctggttccccaaggctacagacaaatcatttgttgaaaaagtggcgcaagaacagggggggcatcctaagtttcagagaccgagacatttgagagaccaagctgatttttcagtcctgcactacgccgggaaagtagactacaaggctaatgaatggttgatgaagaatatggaccccctgaatgacaacgtggctgctctactgcatcagtctacagaccgccttactgctgaaatttggaaagacgttgaaggcatcgtgggactggaacaggtgagttcactaggcgacggccctccaggggggaggccccgaaggggcatgttcagaaccgtgggccagctctacaaggagagtctctcccgtctgatggccaccctgtcaaataccaacccttcatttgtaaggtgcattgtgccaaaccacgaaaaaagagccgggaagttagagcctcggctggtccttgaccagctacgctgtaacggcgtgctggaagggatccgcatatgtagacaagggtttcccaaccgaatcctttttcaggagtttagacagagatatgagatcctgacccccaacgccatccctaagggattcatggacggaaagcaggcgtgtgagaaaatgatccaggccctggagcttgaccccaatttgtatcgggtagggcagagtaaaatctttttccgggccggcgtattggctcagttagaagaagaaagggatctgaaggtgacagatattatcgtgtcctttcaagctgcagcccggggttatcttgcccgacgcgcttttcagaagagacagcagcagcagtctgctctgagagtaatgcagaggaactgtgctgcatacctcaagttaagacattggcagtggtggcgtttgttcacgaaggtcaaacccctgctgcaagtcaccagacaggatgaggttctacaggcacgcgctcaagagctccagaaggtgcaagagctgcagcagcagagtgcccgagaggtgggcgagctccaaggccgagtggcccagcttgaagaggagcgagcgcgactggcagagcagttgcgcgcagaggccgagttatgtgccgaagctgaggaaacccgcgggcgactcgctgcgaggaagcaagaactcgagctcgtggtcagcgagctcgaggctcgggtcggcgaggaggaggagtgttcccggcaaatgcaaactgaaaagaaaagactgcagcaacacatccaggaacttgaggctcacctcgaagcggaggagggagcccggcaaaagctgcagctggaaaaggtcacgacggaagccaagatgaaaaaatttgaagaggacttgttgcttttggaagaccaaaattcgaagctctccaaggaacggaagctgctcgaagaccgcctggcagagttctccagccaggctgctgaggaggaagaaaaagtaaaaagtctcaataaactgaggcttaaatacgaggctactattgcagatatggaggaccggctgaggaaagaagagaaagggcgtcaggagctagagaaactgaaaaggcgacttgatggcgagtctagtgagctgcaggaacagatggttgagcagcagcaaagagctgaggagctgagggcccaactcggacgaaaagaggaggagctccaagcggcactagcaagggcagaggacgaagggggagctcgtgcgcaactgcttaagtctctgcgtgaagcacaagcagccctggccgaggctcaagaggacttagaatctgaacgggtagcccgcaccaaagccgagaaacagaggcgagacctgggggaggagctggaagctctacgcggggagctggaggatacactagacagtactaacgcccagcaggaactccgatcaaaaagagaacaggaggtgaccgagctgaagaagacattggaagaggaaactagaatccatgaagccgccgttcaggagctcagacagcggcacgggcaagcactcggagaactcgccgaacagctggagcaagctaggcgaggaaagggcgcatgggagaagactcggctggctctggaggcggaagttagcgagctgagggcagaactctccagtttgcagaccgcccgccaggagggcgagcagcgaaggcggagactggagttgcaattgcaggaagtccagggccgcgccggtgacggcgaacgtgcgcgcgctgaggcagctgagaaactgcagcgagcgcaggctgaattagaaaacgtgagtggagccctgaatgaagccgagagcaagacaattcgactatctaaggagctgtcatctacggaagcccaactgcatgatgcacaggagctcctgcaagaagagactcgcgctaaactcgcacttgggtcgcgggtgagagccatggaggcagaggctgcagggttgcgagagcaactcgaagaggaagcggctgccagggagagggcgggcagagagttgcaaacagcccaggctcagttatctgaatggcgacgccgacaagaagaagaagctggcgctctggaggcgggggaggaagctcgccgccgcgcagcccgagaggccgaggcgctgactcagaggttggcagaaaagacggagacagtggatcgactggaacgcggtcgccgcagacttcaacaggagctagatgacgccacaatggaccttgagcagcagcgccagttggtgagcaccctcgagaaaaagcaaaggaaattcgatcagttgctcgctgaggaaaaagcggcggtgctgagggcagtagaggagcgcgagagagctgaggcagagggaagggagcgggaagcaagggccttgagtttgacccgggctctggaggaagagcaagaggcgagggaagagctggagagacaaaatagggctttgcgggctgagctggaagcgctgttgtcctcaaaggatgatgtcgggaagagtgtccacgagctcgagcgggcttgccgcgtcgcggaacaagctgctaacgacttgcgtgcacaagttacagaactggaggacgagctgactgctgctgaggatgcgaaacttaggctagaggttaccgtccaggcactcaagacacagcatgagcgcgacttgcaaggacgggatgaagctggtgaggaaaggaggcggcagttggccaagcagctgcgagacgccgaggttgagcgagacgaggaaagaaagcagcgcaccctcgctgtggccgcccgcaaaaagctggagggggagctcgaggaactgaaggctcagatggccagtgctgggcagggcaaggaagaagcagttaagcagctccgcaagatgcaggcacagatgaaggagctatggcgtgaagtcgaagaaacaaggacttctagagaggagatcttttcgcagaacagagagagcgaaaagagactcaaggggctcgaagccgaagtgttgcgtctgcaggaagagctggcagctagtgatcgcgctagacgccaggcccagcaagatagggatgaaatggctgacgaggtggctaatggcaatttaagcaaagctgcaatcttggaggaaaagaggcaactcgaaggccggctgggccagctcgaagaagagctggaggaagagcagtccaatagtgagctgttaaacgatcgatatcggaagctgctcctacaagttgaatctctgacgaccgagttgagtgccgagcggtctttctcagccaaagccgagtccggtcgacagcagctggagcgccagatccaagaattgcgaggccgtctgggagaagaggatgccggagcccgggccagacataaaatgacgattgcagccttagaaagtaaactggctcaggctgaagagcagctggaacaggagacgcgagagcgtatcctgagtgggaagctggttcgtcgtgctgaaaaaaggcttaaagaggtggtcctccaggtggaagaggaaagacgagtggccgatcaacttagggatcagctggagaagggaaatctgcgtgtcaagcagctgaagcggcagctagaagaggccgaggaggaagcctctagagcccaggctggtcggcgccggctccaacgcgagctcgaggacgtcaccgagagcgcggagtctatgaaccgagaggtaaccacgctaaggaaccgcctaaggaggggacctctgacatttaccacaaggacagtgaggcaggtgttccgtctcgaggagggtgtggcaagtgacgaagaggcagaggaggctcaacccggcagcggcccttcaccagagcctgagggcagcccccctgcccacccccagtag

SEQ ID NO: 125506 - DNA, 6111 bp, Artificial Sequence
  Description of Artificial Sequence: Synthetic coding sequence
atggcagctgtgactatgtcggtccctggacggaaagcaccacctcgtccagggcccgtgcccgaggctgcacagccctttctgtttacccccaggggcccctcggcgggtggaggccccggctccggtacatctccccaagtggaatggactgccagaaggctcgtttgggtgccatctgagctacacggcttcgaggcggctgctcttagagatgaaggggaggaggaggcagaggtggaactggctgaatcaggaaggcgcctgcgattgcccagggatcaaattcagagaatgaaccctcccaaattctcaaaagcagaagatatggcggaactgacgtgtttaaacgaggcatctgtactccacaatctccgcgaaaggtactacagtgggctcatttacacttactcaggtctattttgtgtcgtgattaacccatacaaacaactgcctatctataccgaggcaattgtagagatgtataggggcaagaaacggcacgaggtgccaccacatgtgtacgctgtgactgagggcgcttaccgctctatgctgcaggaccgcgaggaccagagcatcctgtgcactggggaatccggagctggcaaaaccgaaaataccaaaaaggtgattcaatacctcgcccacgtcgccagctcaccgaaaggtagaaaggagccaggagtgccggtcagcaaccctgctctgggatggggagagcttgaaagacagctgctgcaggccaaccccattttggaggctttcgggaatgcaaaaacagttaagaatgacaactcctcgcggttcggcaaattcatccggataaactttgatgtggctgggtacattgtgggagccaatattgagacctacctgctcgagaaaagtagggcaatccggcaggcaaaggacgagtgttcctttcatatattttatcagctcctgggcggtgcgggcgaacagctgaaagcggatctccttttggagccttgttcacactacaggtttcttactaacggcccttcttcctcacccggacaggagcgggaactgttccaggagactctcgagagcctgagagtactggggttttcccatgaagaaatcatttcgatgctccggatggtttctgcggtccttcagttcggcaatatagcactaaagcgggaacgaaacaccgaccaggcaacaatgccagataataccgcagcacaaaaactctgcagacttctaggtctgggcgtcaccgatttctctcgcgcccttctaacgcctaggattaaagtggggcgcgactacgtgcagaaagcccagacgaaggagcaggctgattttgccctcgaggcactggcaaaggctacatatgagcgtctctttcgctggctcgttcttcggctaaacagagcactggaccgctctcccagacagggggcatctttccttggaattctcgatattgcaggctttgagatttttcagctgaacagtttcgagcagttatgcattaactacactaatgagaaactgcaacagttgttcaaccatactatgtttgtgctggagcaagaggagtaccagagagagggaataccatggaccttcctcgactttggcctcgatttacagccttgcatcgatttgattgagagacctgctaacccgcctgggcttcttgcacttctcgacgaagagtgttggttcccaaaagcaacggacaaatcattcgtcgaaaaagtagcccaagagcaagggggccatccaaaattccagcggcctcgacacttacgtgatcaagctgatttctcagttctgcactatgcaggaaaagtagattacaaagccaatgagtggcttatgaagaatatggacccgctcaatgacaacgtcgccgctctcctgcaccagtccactgacagactcaccgccgaaatctggaaggacgaacatggtgggtttcagcaattttccttcttgggctccttcccgccttctccacccggcagcgcagaacgatgctccagcgctatatccccgcctggcgtggagggcattgtgggcctggagcaggtgtcaagtctgggtgatggaccccctggcgggaggccgagacggggcatgttccgcacggtgggacaactctataaggagagcctgtctaggctcatggccactctcagtaacaccaatccaagctttgtcagatgcatcgtgccgaaccacgagaaacgggctggcaaacttgagcccagactggtgctcgaccagcttagatgcaatggtgtgcttgagggaatacggatttgccgccaaggattccccaataggatactgtttcaagagttccgccagcggtacgaaatattgacccccaatgcgattcccaaggggttcatggatggcaagcaagcatgtgagaagatgatccaagcccttgagcttgaccctaacctttatcgcgtgggtcaatccaagatttttttccgtgccggcgtactggcccagctcgaggaggaacgcgacctgaaagtgactgacattattgtatccttccaagcagctgcccgaggatacctggccaggagagcattccagaagcggcagcagcagcagagcgcccttcgagttatgcagcgcaactgcgccgcatatctcaaactgcgccattggcagtggtggaggcttttcactaaggtaaaacctctcctccaggtgacacggcaggatgaagtgcttcaagctagagcccaggagctgcagaaggttcaggagcttcagcagcagtcagccagagaagtcggcgaactccaggggcgcgttgcacagctcgaggaagagcgggcgcggctggccgagcagttacgtgccgaggccgaattgtgtgcagaagccgaagagacccgagggcgcctggctgcacgcaagcaggagctggaacttgtggttagtgagctcgaagctagagtgggcgaggaagaggagtgtagcagacagatgcagactgagaagaaaagattgcagcaacacatccaggagctagaggctcatttagaggctgaggaaggagccagacagaagctgcagctcgagaaggtcaccaccgaggctaagatgaaaaagtttgaggaagacttgctgctgcttgaagaccaaaattctaagctttctaaagaaaggaagctactggaggatcgtctcgcggaattcagcagtcaagccgccgaagaggaagaaaaggtgaaaagtttgaacaagctgcggcttaagtacgaagctacaatcgcggatatggaggacagactacgtaaagaggagaagggaagacaggagttggagaaactcaaacgaagactggacggggagtcttcagaattacaggagcagatggtggaacagcagcagagagctgaggagctgagggcgcagctcggtagaaaggaggaggagttgcaagcggctctggcgagagccgaggacgaaggcggcgctcgcgcacagcttctgaagtcccttagagaagcccaggccgctctggccgaggcccaggaagacctcgagtcggaaagagtcgcaagaacgaaggctgagaaacagcggagagacctcggcgaggagttagaggccctgcgtggtgagctggaggacactctcgacagcacgaacgcacagcaggagctgcgaagcaaacgagaacaggaggtgaccgagcttaaaaaaactctggaggaggaaacaagaatccacgaggctgccgtacaagaactcagacagagacacggacaggccctgggggaactagcggaacagctagagcaggccagaaggggcaaaggcgcgtgggagaagactcgattggcactggaagcagaggtgtctgagttgcgggccgaactttcgagcctgcagactgctcggcaggagggagagcaaagacgccgaagacttgagctacaattgcaggaagtacagggtcgggctggggatggagagagagctagagcagaggctgcagaaaaactgcagcgagcccaggcagagctcgagaacgtgagcggagcactgaacgaggccgagtctaagaccatacgcttgtctaaggagctcagcagcacggaggcacagctccatgacgcccaggagctgctgcaggaggaaaccagggctaagctggctcttggtagccgagtgcgggcaatggaagcagaagccgccgggctgagagaacagctggaagaggaggccgccgctagagaaagagctggaagggagcttcaaaccgctcaggcgcaactgagcgagtggcgccgacgacaggaggaagaagcgggcgccctggaagccggggaggaggccagacggagagccgcacgggaggcggaggcgcttacgcagcgcttagctgagaaaacagaaacagtcgatcgccttgaacgcggcagacgccggctgcagcaggaactggatgacgctacaatggacctcgaacagcaacggcagctggtttctaccttggaaaagaagcagagaaagtttgatcagcttctggcggaggaaaaagctgccgtccttcgggccgtcgaagagagagaacgggcagaggctgaaggcagggagcgcgaagcacgagcactgagtctgactagggcgctagaggaagagcaagaggctagagaagagctggagaggcagaaccgcgctctgcgggctgaactagaggctcttttgtcgtccaaagacgatgtcggcaagtcagtgcatgaactggaaagagcctgccgggtagccgagcaagctgctaacgatctgagagcgcaggtcacagaattagaggatgaattaactgcagccgaagatgccaagctgagacttgaggtgaccgtccaggctctgaagacccagcacgagcgggacttacaagggcgcgacgaggctggcgaggaacgccgtcgacagctagcaaaacagctaagggacgcagaggtggagagggatgaggaacgtaagcagagaacactggccgtggcagctcggaaaaagttggagggggaactggaagagctgaaggctcaaatggcatccgcagggcaaggcaaggaggaagcggttaaacagcttcggaaaatgcaggcacagatgaaagaattgtggagagaggtggaagagacccggacaagccgggaggagatcttcagtcagaatagggagagtgagaagaggctgaaaggcctcgaggcagaggtactccgccttcaggaagaacttgccgcatctgatagagcaaggaggcaagctcagcaggaccgggatgagatggctgacgaagtcgcaaatggcaatctttcgaaggccgcaatccttgaggagaagcgtcagctggaaggccgactgggccaactcgaagaagagctggaggaagagcagagcaattctgagctcttgaacgataggtacaggaaactcctgctgcaggtggagagcttgactacagaactgagcgccgagaggagctttagtgctaaggccgaatcaggccggcagcagctggagagacagattcaggaactgaggggacgcttgggagaggaggacgcgggggccagagccagacacaagatgacaatagccgcccttgagtctaagctcgcacaggctgaagaacagctggagcaggaaaccagggagcgaattctatccggcaagttggtgagacgggccgaaaagagactaaaagaagtagtgctccaagtggaggaggagcgtcgcgttgccgaccaactccgtgatcaactggaaaaaggcaacctgcgtgtgaagcagctcaaaagacagctggaggaggcagaggaagaggcctccagggctcaggcaggcaggagacggctgcagagagaactggaggatgtgactgagagcgctgagtccatgaaccgcgaggtgaccactcttaggaaccgactccgaagaggacccctcaccttcaccactcgcactgtgcgacaagtctttagactggaggagggcgtagcatccgacgaggaggcagaagaagcccagccgggtagtggacctagccctgaaccggaaggctctcccccagctcatccccagtag

SEQ ID NO: 125507 - DNA, 5841 bp, Artificial Sequence
  Description of Artificial Sequence: Synthetic coding sequence
atggtcgaatcctgcctgcttacttttcgcgccttcttttggtggattgcactgatcaagatggatctgtctgatcttggtgaggcggccgcctttctacgcagatccgaggcagaactgcttttgctgcaagctacagcactggacggtaaaaaaaagtgctggatccccgacggcgagaacgcctatatagaggcagaggtcaaggggagcgaagacgacggtactgtgattgtcgaaactgctgacggggaatccctgtctatcaaggaggacaaaatccagcagatgaaccccccagagtttgaaatgatcgaagacatggctatgctcacccacctcaatgaagcttccgtcctgcacacgttgaagagacgatatgggcagtggatgatctacacctactccgggttgttctgtgtcactataaacccttataagtggctccctgtgtaccagaaggaggttatggctgcttacaaggggaagcggaggagcgaggcccctccccacatattcgccgtggccaataacgccttccaggatatgctgcacaatcgagaaaaccagtccatcttgttcaccggggaatccggcgctggaaaaacggtcaattctaagcacattattcagtatttcgcaaccatcgctgctatgatcgagtcaaggaaaaagcagggagctctggaggaccagatcatgcaggccaatactatattggaagctttcggtaatgcaaagaccctccgcaatgacaatagttcgcgttttggaaagttcatccggatgcattttggtgctcgaggaatgctaagtagtgttgacatcgatatctacctcctcgaaaagtccagagttattttccaacaggcgggagaaaggaactatcacatcttctaccagattttgagcggccagaaggaacttcacgatctgctgctcgtgtcggcaaacccaagcgatttccacttctgtagctgcggagcagtgaccgtcgaatcactggatgatgctgaggagttattggccacagagcaggctatggacattcttggctttcttccggatgaaaagtacgggtgttacaagctgacaggggccattatgcatttcgggaatatgaagttcaagcaaaaaccgcgggaggagcagctcgaagctgatggcactgagaatgcagataaggctgctttcctgatgggtattaactcaagtgagctcgtaaagtgtttaattcacccgaggattaaggtgggtaatgagtacgttacacgcggtcagacaattgaacaggtgacctgcgctgtgggtgccctctcaaagagtatgtacgagcgaatgttcaaatggcttgtggcgaggatcaaccgcgcactggacgccaagctgtctaggcagttcttcatcggcatcctcgacatcactgggttcgagattcttgagtacaactcgttggaacagctctgtatcaattttactaacgaaaagctccaacagttctttaactggcacatgtttgtattagagcaggaggagtacaaaaaggagtcgatcgagtgggtcagcataggtttcggtcttgatcttcaggcgtgtatcgacttaatcgagaaacccatggggatcctgagcattctcgaggaggaatgcatgttcccaaaggccacagatttgacattcaagactaagcttttcgataatcactttgggaagagcgtgcacctgcaaaaacccaagccagacaagaaaaagtttgaggcccattttgagctcgtgcattacgccggagtcgtcccctacaatatatcaggatggcttgaaaagaataaggatttgctgaatgagaccgtggtggcagttttccagaaatcgtcgaacagactcctggcgtccttattcgagaattacatgagtacagattctgccatcccctttggagaaaaaaagcggaaaaaaggagccagctttcagacagttgccagtctgcacaaggagaatctaaataagctgatgactaacctaaagtctaccgcaccccattttgtcaggtgtatcaaccccaacgtgaataagattccgggcatcctagacccatacctggtcctgcaacagctgcgatgtaacggggtgctagaaggcacacgtatctgtcgcgaaggctttccgaatcggctgcaatacgccgatttcaaacaacgctactgcattctcaatcccaggacctttcccaagagtaagtttgtgtcctctcgcaaagcagcagaggagctgctcgggtcccttgagatagatcacacacaatacaggttcggcatcacgaaggttttcttcaaggccggattcttaggacagctggaagccatccgcgacgagagattatcaaaggtgtttacacttttccaggcccgagcccagggcaaattgatgaggattaagttccagaaaatcctggaggaaagggacgctctgattcttatccaatggaacatccgtgccttcatggctgtcaagaactggccctggatgcgcctattcttcaagatcaagcctctcgttaagtcatcagaggtaggggaagaggtggctgggcttaaagaagagtgcgctcagctgcagaaagccctggagaaatccgagttccagagggaagaactgaaggcaaagcaggtcagcttgactcaggagaagaacgacctgatcctgcaacttcaggctgagcaagagactcttgctaatgtggaggagcagtgtgaatggttgattaagagcaaaatccagctggaggctagagtcaaagaactgtctgagcgggtggaagaggaggaggagataaactctgagttgacagctcgcggccgaaaactcgaggacgagtgtttcgagctgaaaaaagaaatagatgatctggaaacaatgctggtgaagtcagagaaggagaaaagaacaaccgagcacaaggttaagaatctgaccgaggaagtcgagttccttaatgaagatatcagtaagctgaacagagcagctaaagttgtccaggaggcacaccaacagacactagacgacctgcacatggaggaagagaaacttagctctctgtccaaagcaaatcttaagttggagcagcaggtggacgagctagagggagcactcgagcaggaacggaaggcgaggatgaactgtgaacgcgaacttcataaattagaaggaaacctgaagctgaatagagaaagcatggagaatttggaatcttcacagcgccacctggcagaagaactgcgcaaaaaggaattggagctgtcgcagatgaactctaaagtggagaacgaaaaaggactcgtggcccagttgcagaaaaccgtgaaggaactccaaactcagatcaaagacttgaaagagaaactggaagctgagcgcaccacaagggcgaagatggaaagagaaagagctgatttgacccaggatttggcagacttgaacgagcggctggaagaggtaggtggctcttcccttgcgcagctcgaaattactaagaaacaagaaaccaaattccagaagctgcaccgcgatatggaggaagctactcttcactttgaaaccacaagcgccagtttgaagaagaggcatgcagattccctggccgagctggagggtcaagtagaaaatttacagcaagttaagcagaagctagagaaggataagtcagatttacagctcgaggtcgacgatctcctgactcgggtcgagcagatgacacgcgctaaagctaacgccgagaaactttgcaccctgtacgaggaacgtttacacgaagcaactgccaaactggataaagttacgcagctcgccaacgacttggcagcgcagaagaccaagctctggagtgagagtggcgagttcctgagaagactggaggaaaaggaggcactcataaaccaattgtctagagaaaaatccaacttcactcgtcaaatcgaagacctcaggggccagctggagaaagaaacaaagagccaatctgctctcgctcatgccttgcagaaggcacagcgtgactgtgacctcctccgcgaacagtatgaagaggaacaggaggtgaaggctgaactacatcggacactcagtaaggtcaacgccgagatggtacagtggcgcatgaaatacgagaataacgttatacaaagaaccgaagatctggaggatgctaaaaaggaactggccatacggctgcaggaagccgccgaggccatgggagttgccaatgctagaaacgcaagcttggagagggccaggcaccagttacagttggagctgggtgacgccctgtctgacctgggaaaggtccgctccgccgccgctagactggatcagaagcagctgcagtcaggtaaggccctggctgattggaaacagaaacacgaagaaagtcaggctctcctggacgcgtcccaaaaggaggtacaggccctgtccacagagcttcttaaactaaagaatacatatgaagaatcaattgtcggtcaggagaccctgcgccgcgagaataagaacttgcaggaagagatttcgaatctcactaatcaggtgagagagggaacgaaaaacttaaccgaaatggaaaaggtgaaaaagttgattgaggaagagaagactgaagtccaagtaactctcgaggagactgagggggccttggaacggaacgaatccaaaatcctgcacttccaattagaactcctggaggcaaaggccgagctagagcgtaagcttagcgagaaggacgaagagatcgaaaacttccggcggaagcagcagtgcaccatcgacagcctgcagtcgagcctggattccgaggccaaaagtaggatcgaggtgactcgtctaaagaaaaagatggaggaagatttaaatgagatggagctgcagctaagctgcgcaaaccgccaggtcagcgaggcgacaaaaagcttggggcagctccagattcaaattaaggatctccagatgcagctggacgacagtacccaactgaatagcgacctgaaggagcaggtcgctgtggctgagcggaggaattccctccttcagtccgaactggaagatcttcgttctctacaggagcagacagaacggggacggcgtttaagtgaggaggaactactggaggctactgagcgcattaacctgttttacacacagaacactagcttactgtcccagaagaagaagttggaagcagatgtagcaaggatgcagaaagaggctgaagaagtcgtgcaggagtgccaaaatgctgaggagaaagctaaaaaggccgctattgaggctgctaacctctccgaagagttaaagaaaaaacaggacacgatagctcatctcgagaggacccgtgagaacatggaacaaactatcacagacctacagaaacggctcgccgaagctgagcagatggccctaatgggctctaggaaacagattcagaaactggaaagcagagtccgcgaattggagggggagctggagggggagattaggagatcagcggaagcgcagcggggtgcacgaagactcgaacggtgcatcaaggaacttacctatcaggccgaggaggataagaaaaacctgagtcgcatgcagacccagatggacaagcttcagctgaaagtgcagaattataagcagcaggttgaggtggccgaaacccaagctaatcagtacctcagtaaatacaaaaaacaacagcacgagttgaacgaggtgaaggagagggccgaggtagctgaatcacaggttaataagctgaagataaaagcaagagagtttggcaagaaggtacaggaggaatag

SEQ ID NO: 125508 - DNA, 5826 bp, Artificial Sequence
  Description of Artificial Sequence: Synthetic coding sequence
atgagctccgacagtgagttggctgtcttcggtgaagctgcgcctttcctacgtaaatcagagagggagagaatcgaagcccaaaacagaccatttgatgccaaaacatctgtttttgtggccgaaccaaaggagagctttgtgaaaggtacaatccaaagccgagaaggggggaaagttactgtcaaaaccgagggaggcgcgactctgactgtgaaagatgatcaggtgtttcctatgaaccctcctaagtatgataagattgaagacatggccatgatgacccaccttcacgagccagcggtgctgtacaatcttaaagagcgttatgctgcctggatgatctacacttattccgggctcttctgtgtcaccgtgaatccttacaaatggttgcctgtgtacaagccggaggtcgtgactgcctatcgaggcaagaagaggcaggaggcacccccgcacattttcagcatatccgacaatgcgtatcaatttatgctcaccgaccgcgaaaatcagagcattttgattactggggaatccggtgctggcaagacagtcaataccaaacgtgtgatacagtactttgccacaatcgcagtcacaggcgagaagaaaaaagaggagatcacaagcggcaagatacaggggactctcgaagaccagattatctccgcaaaccccctccttgaggcctttggtaacgccaagactgtccgaaatgacaacagttcaagattcggaaagttcatccggattcactttggaacaacaggaaagcttgccagcgctgatatcgagacctacctgctggaaaagagtagggtagtctttcaacttaaggccgaacgcagctaccacattttttaccagattacgtcgaacaagaaaccagaattgattgaaatgctgctgataaccaccaacccctacgactaccccttcgtctcccagggagaaatttccgttgcctctattgacgaccaagaagagctgatggccacggatagcgccattgacatcctcggtttcacaaacgaagaaaaggtgtccatctacaagctgacgggggcggtgatgcattacggaaatctcaaattcaagcagaagcagcgggaagaacaggcagaacctgatggaactgaggtggctgacaaggctgcttatctgcagtcgctgaattcagccgatctgctaaaagccttatgctaccccagggtcaaagtgggaaatgagtacgtgacaaaaggccagacggtggagcaggtatctaacgctgtgggcgcgttggctaaagctgtatatgaaaagatgtttctgtggatggttgcgcgaattaaccaacagctcgataccaagcaaccccgccagtacttcattggagtgctggatattgccgggttcgaaatcttcgatttcaactccctggagcaactgtgtatcaatttcaccaatgagaaactgcagcagttctttaaccaccacatgttcgtccttgagcaggaagagtacaagaaggagggtattgagtggacctttatcgatttcggaatggacctggccgcatgcatcgagctgattgaaaagccaatgggcatattctcaatcctggaagaagagtgcatgttccccaaggccactgatacttccttcaagaataaactgtacgaccagcaccttgggaaaagcgcgaacttccaaaagcccaaggtggtcaaagggaaagctgaggcgcactttgcactcatccactatgccggcgtggttgactacaatataactggttggcttgagaagaacaaggatccgctaaacgaaactgtcgtagggctctatcaaaagagcgcaatgaaaacactagcccaactgttctccggcgcacagaccgccgagggcgaaggtgccggcggcggtgctaagaagggaggcaagaagaagggtagctccttccaaacagtatccgctctgttcagagagaatcttaataaactgatgacgaaccttagaagcacccacccccacttcgtaaggtgcatcattccaaacgaaacgaagaccccaggggctatggagcacgaattagttcttcatcagcttcgctgcaacggtgtgctagaaggtattcgcatctgtaggaaaggtttcccatctagaatactgtatgccgacttcaagcagcgctacaaggtgctcaacgctagcgccatccctgagggtcagtttatcgacagcaagaaagccagtgagaaactgctcgcatccattgatatagatcacactcagtataagttcggacacacgaaagtatttttcaaggcaggactgcttgggctcctagaggagatgcgggacgataagttggcgcagctgatcacaaggacgcaggccaggtgtcgagggttcctcgcccgcgtggagtaccaaagaatggtcgaaagacgcgaagcaatcttctgcatccagtacaacatccggtcttttatgaatgtgaagcattggccatggatgaaattgtttttcaagataaaacccttacttaagtcggctgaaacagaaaaggagatggctacaatgaaggaagagttccaaaaaattaaggacgagctcgcgaaaagcgaggcaaagcgtaaggagttagaggaaaagatggtaacccttttaaaagaaaaaaatgatctccagctgcaggttcaagccgaggctgaagggctagcagatgccgaagaaagatgcgaccaacttatcaagaccaaaatccagttagaggcaaaaattaaggaagttaccgagcgagccgaggacgaagaggaaatcaatgccgaactgacggcaaaaaaacgcaagctagaagacgaatgtagcgagctgaagaaagacatcgatgacctggaactcactctcgctaaagtcgagaaggagaagcacgcaacggagaataaagttaagaacctgaccgaggagatggccggacttgatgaaacgatcgctaaattaacaaaagagaagaaggccctccaggaagcccatcagcaaactctcgatgatctccaggccgaggaggataaggtgaatactcttaccaaggcaaaaattaagttggaacagcaggtagacgatctcgagggctcactggagcaagagaagaaactgcggatggatctcgagagagcaaaacgcaaactagaaggagacctcaagctggcacaggagtccatcatggacatagaaaatgaaaagcaacagctcgatgagaagctgaagaagaaagagtttgaaatctcaaacctgcagagcaagatcgaagacgaacaagcgctggggatacagctgcagaaaaagatcaaagagttacaggctcgcattgaagaactggaggaggaaatcgaggccgagagggcctctcgcgcaaaggcagaaaaacagcgcagcgacttaagccgcgaactcgaggagatctctgagagactggaagaggcgggcggtgcaacaagtgcgcagattgaaatgaacaagaagagagaagccgagtttcaaaagatgcgcagggatctggaggaggctaccttgcagcatgaagcaaccgctgcgacgctgaggaagaagcatgcagattctgtggcagaactgggagaacaaatagacaacctgcagcgggtaaaacaaaaactggagaaggaaaagtccgagatgaaaatggaaatcgacgacctggcttctaatgtggagacagtgagtaaagccaaaggcaacctggaaaagatgtgcagaactttggaagaccagctcagtgagttaaagtcgaaggaagaggaacagcagcgccttatcaatgacctgacagcccagcgggggcggcttcagaccgaaagcggcgagttttctcggcagctggacgagaaagaagcactggtgtcgcagctgtctcggggaaaacaggcattcactcagcaaattgaggaactgaaacggcagctggaagaggagatcaaggcaaagaacgccctggctcatgcactgcagtcatcgcggcacgactgcgacttactccgcgagcagtatgaagaggaacaggaatcaaaagccgagctgcagagggccctcagtaaggccaacaccgaagttgctcagtggcgtactaaatacgaaaccgacgccatccaacgcacagaggagcttgaggaagcgaaaaagaagctggcacaacgactccaagcagccgaggagcatgttgaggccgttaacgcgaaatgtgcctccctagagaaaaccaaacagcggttgcagaatgaggtggaagacttaatgctcgatgtggagcggactaatgcggcctgcgcagccctggacaagaagcagagaaattttgacaagatccttgccgagtggaagcaaaaatgcgaggagacccacgctgagttagaggcttctcaaaaagaagcccgctccctggggacggaactctttaagatcaaaaatgcctatgaagagtccctggatcagctcgagactctcaagcgcgagaacaagaatttgcagcaggaaatctccgatctcaccgagcaaatagcagaaggtgggaaacgcatccatgagctcgaaaagataaagaaacaggtggagcaggagaagtgtgagctacaggcagcactggaagaagccgaggcctccttggaacacgaggaagggaaaatcctccggatacagttggaactcaatcaggtcaagtctgaggtggatcgaaaaatcgcggagaaagatgaggagatcgatcagctgaagaggaaccacatccggatagtcgaaagtatgcaatccacgctcgacgctgagatccgctccaggaatgacgcgatcagactcaaaaaaaaaatggaaggcgacctgaatgagatggagatccagctgaaccacgcgaatcgcatggcggcagaggcactccggaactaccggaatacccaaggcatccttaaggatacccagatccatttggacgacgccctgcggtcccaggaggatctgaaggagcagctcgccatggtggagcgcagagctaaccttttgcaagctgagatcgaagagcttcgcgctacccttgaacaaaccgaacgatccagaaaaatagccgagcaagagctgcttgacgcgtcagagagagtccagctcctccatacacagaataccagcctcataaatacaaaaaagaagctggaaactgacatttctcagatgcaaggagaaatggaggacattctgcaggaagctcggaacgccgaggaaaaggctaagaaagctatcacagatgccgcaatgatggctgaggaactgaagaaggagcaggacacctcagctcacttggaacgtatgaaaaaaaatatggagcagaccgtaaaggacctccagttgcgattggacgaagctgaacagctggctcttaagggtggcaagaagcaaattcaaaaattagaggctcgcgtgcgtgagctagagggggaagtggagtcggagcaaaagcgaaacgcggaagctgtcaagggattaagaaagcatgaacgtcgagtaaaagagctcacatatcagactgaggaagataggaagaatatactccgcctgcaggatctggtggacaagctacaggcaaaagtgaagtcgtacaaacgacaggctgaggaagcagaggaacagagcaacactaatttagcaaaattccggaagctgcagcatgaactggaagaggccgaagagagggctgacattgccgaatctcaggtcaataagttgcgagtgaaatctagggaggtgcacacaaaagttatttccgaggagtag

SEQ ID NO: 125509 - DNA, 5826 bp, Artificial Sequence
  Description of Artificial Sequence: Synthetic coding sequence
atgtcatccgactctgagttggctgttttcggcgaggccgctccttttctaagaaagtctgagcgcgaacgcattgaagcacagaaccggccatttgacgcaaagacctctgtcttcgtcgcagaacccaaggaatctttcgtcaagggtactattcagtcacgggagggcggcaaggtgacagtcaagacagaaggaggagctacactgacggttaaagatgaccaggtgttccccatgaacccccccaaatatgataaaattgaagacatggctatgatgacccatttgcatgagccggctgtactatacaatctcaaggaacgttacgcggcctggatgatctatacctacagcggattattttgtgtgacagtgaacccatataagtggttgccggtgtacaaacctgaggtggtgacggcttaccgcggaaagaaacgtcaagaggcaccccctcatatcttctctattagcgacaatgcctaccaattcatgcttacagatcgggaaaaccagagcatactcattacaggtgaatccggcgccggtaagaccgtgaataccaaaagagtaatacagtattttgctacaattgctgtcactggcgagaaaaaaaaagaagaaattacctccggcaagatccagggaaccctggaagatcagataatttccgcaaatcccctgctcgaggcatttggcaacgccaaaactgtgcgcaacgacaattcttcacggttcggcaaattcatccgcatccattttggaaccactggaaagttggcctcagccgatatcgaaacttaccttctggaaaaaagcagagttgtgtttcaactcaaagccgaacggtcataccatatcttttaccagattacaagcaataaaaagcccgagttaatcgagatgctactgataactactaacccttacgactacccttttgtgtctcaaggcgaaatctctgtggccagtattgacgaccaggaagagctgatggcaaccgactcagccatcgacattttgggattcaccaacgaagagaaagtcagtatttacaaactgacaggcgccgtgatgcattacggcaacttgaagttcaagcagaaacagcgggaggagcaggcggaaccagatggcaccgaggtggccgataaagctgcctacctgcaatccttgaactcggcagacttactaaaagccctctgctatcctagggtcaaggtgggaaacgaatacgtgaccaaggggcagaccgtggaacaagtcagcaacgcagtgggcgccttggctaaggccgtctacgagaaaatgttcctgtggatggtggctagaatcaaccagcagctcgacaccaaacagcccaggcaatacttcatcggagtgctggatattgccggatttgagatattcgacttcaactctttggagcagctgtgcatcaacttcactaacgagaagctccagcaatttttcaatcatcatatgtttgtcctagaacaggaggagtacaagaaggagggaatcgaatggacattcattgattttggcatggatctggcggcatgcatcgagctcattgaaaaacctatgggcattttttccatcctagaggaagagtgtatgttccccaaggctaccgatactagtttcaagaacaaactctatgaccagcaccttggcaaaagcgccaactttcagaaaccaaaagtagtaaaaggaaaggcggaggcccattttgctttgatccactatgcgggcgtcgtggactacaatatcacaggttggcttgagaaaaacaaggaccctctgaacgagaccgtcgtgggcctgtatcagaaatcagcaatgaagacactcgcccagcttttctctggggcgcagaccgcagaaggtgagggcgccgggggtggagccaagaaggggggcaagaaaaaggggtcatcattccagactgttagcgctctcttcagggagaacctgaacaagcttatgactaatctccgatccacccacccccatttcgtgaggtgcatcattcccaatgagactaaaaccccaggtgcaatggaacacgagctggtgctgcaccagctgcgttgtaatggtgttctggaagggattcgaatctgtcgaaagggttttccgtctcggatcttatatgctgatttcaagcagcgttataaggtcctgaatgcttcagccatcccagaaggacagtttatcgattcaaagaaggccagtgaaaaattgttagcatctattgacatagatcacacccagtacaagttcggacacacaaaagtattctttaaagccggtctgctcggcctgttggaagaaatgcgtgatgataagctcgcacaactgattacgagaacgcaggcacggtgtcgaggattcctcgcccgtgtggagtaccagcgcatggtggagagaagagaggctattttttgcatccagtacaacataagatcattcatgaatgtgaaacactggccatggatgaaattattcttcaagattaaacctttgcttaaatccgccgagacggagaaagaaatggccacaatgaaggaagagtttcaaaaaatcaaagatgagctggctaagagcgaagccaagaggaaggagctcgaagagaagatggtgacgctgttgaaggaaaagaatgacctgcagcttcaagtgcaagctgaggccgaaggcttggccgacgcagaggaacgctgtgatcagctaataaagaccaagatccagcttgaagctaagatcaaagaagtgactgagcgggctgaggatgaggaggagattaatgcagagctgacagcgaaaaaaagaaagctcgaggatgagtgttcagaactgaagaaggacatcgacgacctcgaactcacgttagcaaaagtagagaaggagaagcacgccacggaaaataaggtcaagaatctcacagaggagatggcaggcctggacgagaccatcgccaaactgactaaagagaaaaaggcactccaggaggcccatcagcagaccctggacgatctccaggccgaggaggacaaagttaacacactgaccaaggccaaaatcaagctggagcagcaggtggatgatttggagggctccttggagcaggagaagaagctgcgaatggatttggagcgggctaaaagaaaactcgaaggtgatctaaaactggcccaggaaagtataatggacattgagaatgaaaaacagcaactagacgaaaagcttaaaaagaaagagtttgagatctctaatctacagagtaaaatcgaagacgaacaggccctgggtatccagctgcagaaaaagattaaagagctgcaggcacgaatcgaggagctggaggaagaaatcgaagcagaacgagctagtagagctaaggccgagaagcagaggagtgatctgtcaagagagctggaggaaatttctgaaagattggaagaagcagggggggcaacctcggctcagattgagatgaataagaagcgggaggctgaattccaaaagatgaggagagacttggaagaagccacgttgcagcacgaggccaccgcggccaccctgcgtaagaagcacgccgacagcgtggccgagctgggtgagcaaattgacaatttacagagagtgaagcaaaagctggagaaggaaaagtccgaaatgaaaatggagatcgacgatctggcaagtaatgtagagaccgtgtccaaagcaaagggaaaccttgaaaagatgtgccgcaccctcgaggaccagctgagcgagctcaaatctaaggaggaagagcagcagcgtcttatcaatgatcttacggcccagcgcggacggctccaaaccgagagcggggagttcagccggcagctggatgaaaaagaggcactggttagccagctcagcagagggaaacaagcttttactcagcagattgaggagcttaagcgtcagctggaggaggagatcaaggctaaaaatgcactggcccacgctttgcagtcatcgcgccatgactgtgatctcctgcgggagcagtacgaggaagagcaggaatctaaggcggagctccagagggcactgtctaaagccaataccgaggtggctcagtggcgaaccaaatatgaaactgacgcaattcagcgaaccgaagagttagaggaggccaagaaaaagcttgcccagagactgcaagccgcagaggaacacgttgaagccgttaatgcaaaatgcgcaagtctcgaaaaaactaaacaaagactgcaaaacgaagtcgaagatctgatgctagatgtggaaaggacaaacgccgcctgcgccgctctggacaagaaacaacgcaacttcgataagatccttgccgaatggaagcagaagtgcgaagaaacccacgctgagttagaagcctctcaaaaagaggcccgatcccttggtactgagctcttcaagataaagaacgcctatgaggagtcgttggaccaactagagacgctgaaaagagagaataaaaacctccaacaggaaatctcagatctgaccgaacagattgcggaggggggcaagcgcatccacgagttggaaaaaatcaagaaacaggtcgaacaggagaagtgtgaactccaggctgctttggaagaggcagaggcaagtttggaacacgaagaggggaagatcctgcggatccagcttgaactgaatcaggttaagagcgaagttgaccgcaaaatcgctgaaaaagatgaagagatcgaccagctgaagagaaatcacatacgcattgtggaatccatgcagtctaccttggatgcggagattagatcaaggaatgatgcaatcaggctgaaaaaaaagatggaaggtgatctcaatgagatggagatacagttgaatcacgccaatcgaatggccgccgaggctttaaggaactatcgaaacactcaggggatcttaaaggatacgcaaatccacctggatgacgccttgcgatcccaggaagacttaaaggaacagctcgccatggtggagcggcgagcaaacctgctgcaggccgagatcgaagaactcagagccacattagagcagaccgagagatctcgaaaaatcgcagaacaagagctcctggatgcctctgaaagagttcagctcctgcatacgcaaaatacttctctgattaataccaagaagaaactcgagaccgatatctcacagatgcaaggtgagatggaagatattttgcaggaagcgcggaatgccgaagaaaaggccaaaaaagccatcaccgacgctgccatgatggccgaagaactcaagaaggagcaggacactagtgcgcacttggaacggatgaaaaaaaacatggagcagaccgtgaaggacctgcagctcagactggatgaggccgagcagctcgccctcaaaggggggaaaaagcagatccagaaactcgaagcccgcgtgcgcgagttagaaggcgaggttgaaagtgaacagaagcgtaatgctgaagctgtgaagggccttagaaaacacgagcgaagagtgaaagagcttacttaccagactgaggaggataggaaaaatatcctgcgcctgcaggacctcgtggacaagctgcaggccaaagtaaaatcctataaacgccaggctgaagaggccgaggagcagagtaacactaatctggcaaagttcagaaaactgcagcacgaactagaagaagccgaagaaagagctgatatcgccgaatcgcaggtgaataagctgagagtgaaaagtcgggaggtccacactaaagtaatttcggaggagtag

SEQ ID NO: 125510 - DNA, 549 bp, Artificial Sequence
  Description of Artificial Sequence: Synthetic coding sequence
atgagttcagactcggaattggcagtgtttggggaggcagctccgtttctacgcaagagtgagcgagaacggattgaggcccagaaccggccctttgacgccaaaacctctgtcttcgtggccgaaccgaaagagtcctttgttaagggcactatacagtctagagagggtgggaaagtgaccgtcaaaacagagggaggagctaccctcactgtgaaggatgatcaagtttttcctatgaacccaccgaaatacgacaagatcgaggatatggccatgatgactcacttgcacgaaccagccgtcctatataacctgaaggagcgctatgccgcctggatgatttatacgtatagcggactgttctgcgtcacagtgaacccatacaagtggttacctgtgtacaagcctgaggtcgttacagcctaccggggaaagaaacgccaagaagccccaccccacatctttagtattagtgacaacgcttatcagtttatgctgacagacagagagaaccaatcaattctgatcacaggtgaaagcgggtag

SEQ ID NO: 125511 - DNA, 405 bp, Artificial Sequence
  Description of Artificial Sequence: Synthetic coding sequence
atgagctctgattccgagcttgctgtgtttggagaagccgcccccttcctcagaaagtcagagagagaacgaatcgaggctcagaatcggccgttcgacgccaaaacctccgtgtttgtagcagaaccgaaggagagctttgttaagggcactattcaaagtagggagggaggaaaggtgactgtcaaaactgaaggtggcgcgaccctcaccgtcaaggatgaccaggtcttccccatgaatccccccaaatacgataaaatagaggatatggctatgatgacccacctgcatgaacctgccgttctgtataatcttaaggaaagatacgcggcttggatgatttacacctatagcggactcttctgcgtcaccgttaacccctataaatggctccccgtttag

SEQ ID NO: 125512 - DNA, 2127 bp, Artificial Sequence
  Description of Artificial Sequence: Synthetic coding sequence
atgtccagcgattcagaactagcagtgtttggggaagccgcaccctttctgcgaaaatccgagcgagaacggatcgaagcccagaatcgcccattcgatgctaaaaccagcgtctttgtggcggagcctaaggaaagtttcgttaaaggaacaattcagtcaagggaggggggaaaggtcactgtgaaaaccgaaggcggggccacccttactgtcaaagacgaccaagtgtttcccatgaaccctcccaaatacgacaagatagaagatatggcaatgatgacacatcttcatgaaccagcagtcctgtataacctgaaggaacgttacgcagcctggatgatatacacttactcaggcctgttttgcgttaccgtcaatccttataagtggctgccggtgtacaagcctgaggtcgttacagcatatcggggcaagaagcgccaagaagccccaccacatatctttagcatcagcgacaatgcctatcagtttatgctgacagaccgcgagaaccagtctatccttatcacaggggagagcggtgcaggcaagactgtcaacaccaagagagtaattcagtactttgccaccatcgccgtaacgggcgagaaaaaaaaagaggaaatcactagcgggaagatccaaggcaccctcgaggaccagatcatctccgcgaatcctctgctggaagccttcggtaatgctaaaactgtccgcaatgacaattccagtaggtttgggaagttcatcagaatccatttcggcactacgggcaagttggcatcagctgacattgaaacgtacctgctcgaaaaatctcgggtagtgttccagctgaaggccgagagaagttatcacattttttatcagattacctctaataaaaagcccgagctaattgagatgctgctgatcacaactaatccatacgactaccctttcgtgtctcagggcgagatttcagtcgcatccatcgatgatcaggaggagctgatggcaaccgactctgccattgatatcctgggatttacaaatgaagagaaggtgtcgatctataaacttacaggcgcagtgatgcattatggcaacctgaaattcaagcagaaacagcgagaggagcaggctgaacccgatggcacagaggtggcagataaagcagcttatcttcagagtcttaactctgccgatctactcaaagccctgtgttacccgagggtaaaggttggcaatgagtatgtgaccaagggccagacagtcgaacaggtgagcaacgccgtgggtgccttagctaaggctgtttatgaaaaaatgtttctatggatggtggccagaataaaccagcagctggataccaaacagccaaggcagtacttcatcggagtgctagatatagcagggttcgagatcttcgactttaactcgcttgaacagctttgtatcaatttcacaaacgagaagctgcagcagttcttcaaccatcacatgtttgtgctcgaacaggaagagtataagaaggaggggattgagtggaccttcattgacttcgggatggaccttgctgcttgtatcgagttgatcgaaaagcccatgggaatatttagcatccttgaggaggagtgcatgttccccaaggcgacagacacaagttttaagaacaagctgtacgatcagcatctcgggaagtccgctaacttccaaaagccaaaagttgtgaaagggaaggccgaagcgcacttcgctttaatccattacgcaggggtggtagactacaacatcaccggttggttagagaaaaataaggatcctctgaacgagaccgtggtggggctttaccagaaaagcgcaatgaagacgttggcgcagctcttttctggagcccagaccgctgagggcgagggtgccggcggcggagcaaaaaaaggcggcaagaagaagggctctagtttccaaaccgtctctgccctgttcagagaggaacagagtaacaccaatctggcaaaattcagaaagctgcagcatgaactggaagaggccgaggaaagggcagatattgcagaatcgcaggtaaacaaactgagggttaaaagtcgggaggtacacaccaaggtgatttcagaggaatag

SEQ ID NO: 125513 - DNA, 5820 bp, Artificial Sequence
  Description of Artificial Sequence: Synthetic coding sequence
atgtcttcagacagcgagatggccattttcggcgaggccgccccttttctgcgcaagtcggagagagaaagaattgaagcccaaaacaagccctttgacgccaagacatcagtcttcgtcgtcgatcctaaggagagttttgtcaaagctactgtgcaatcacgggaaggcgggaaagtcacggcaaaaacagaagctggagcaacagtcaccgttaaagatgaccaggtcttccccatgaacccgcctaagtacgataaaattgaggatatggccatgatgacccacctccacgagcctgctgtcctctacaatttaaaagaaaggtacgcagcctggatgatttatacctatagcggcttgttctgcgtgaccgtgaatccctacaaatggttgcctgtgtacaatgccgaagtggtcaccgcctacaggggcaaaaaaaggcaagaagcccctccccatatcttttctatctccgacaatgcataccagtttatgcttacagacagagaaaaccaatccattctgattaccggcgagtccggcgcagggaaaacggtaaacacaaaaagagtaatccaatactttgctacaattgcggtcactggggagaagaaaaaagaagaggtgacttctgggaagatgcaggggacactagaggatcagattatttctgctaacccccttctggaggcgttcggcaatgccaaaaccgttcgcaatgacaatagtagtcgcttcggcaaattcataagaatccatttcggtactacggggaagttagccagcgcagatatagagacatacttgctcgagaagagccgagtgacctttcaactgaaagccgaaaggagctaccatatcttctatcaaattatgagcaataagaaaccagaccttatagaaatgctgctgatcacaactaatccatatgattacgcgttcgttagccagggagaaattacggtgccgagtattgacgatcaggaagaattaatggcaactgactccgcaatagagattttgggatttaccagcgacgaacgcgtgtccatctataaattgaccggcgctgtgatgcactatggcaacatgaagtttaaacagaagcagcgggaggaacaggccgagccagatggcaccgaggtggcggacaaagccgcctacctgcagaacctgaattcagcagatctgttgaaggccctgtgctatcctcgcgttaaagtcgggaacgagtatgtcacgaagggccagacggttcagcaggtgtacaatgccgttggtgctctggctaaagctgtctacgataagatgttcctatggatggttacacggatcaaccagcaactcgacaccaagcagccacgccagtattttattggcgtgctggacatcgctggcttcgagattttcgattttaattccttagagcaactgtgcatcaacttcacaaatgaaaaactgcagcagttttttaatcatcacatgtttgtgctggaacaggaggaatacaagaaggagggtattgagtggaccttcatcgatttcgggatggacctagccgcatgcatcgaacttattgagaagccaatggggattttctccattctggaggaagaatgcatgttcccaaaggccaccgacacgtctttcaagaataagctatacgagcaacatctcggcaaaagcaacaacttccagaagccgaagcctgccaagggaaagccagaggctcacttctccctgatccactatgccgggaccgtggactacaacatagccgggtggttggacaagaataaagatcccctgaacgaaactgtggtgggcctttatcagaaaagtgccatgaaaaccctggccctacttttcgtgggcgccacaggtgctgaggcagaagccggcggggggaagaagggcggtaagaagaagggctcatcctttcagaccgtttcagcccttttcagagagaaccttaataagctgatgacgaatcttagatcgacccaccctcacttcgtgagatgtatcatacctaatgagaccaaaacacccggcgccatggaacacgaactggttctccatcagctgcggtgtaacggtgtgttggaggggatcaggatttgtcgaaaaggcttccccagcaggatactgtatgctgatttcaagcaaagatacaaagtgctcaacgcctctgctatccccgaagggcagtttattgactcaaagaaggcaagtgaaaagctcttaggctctattgatatagatcatacacagtacaagtttgggcacaccaaggtgttctttaaggcagggctcctgggtctgttagaagagatgagagatgagaagctcgcgcagcttattacgcgaacacaggcgatgtgccggggctttctagcccgagtagagtatcagaagatggtggagaggcgcgagagcatcttctgcatccagtacaacgtgcgagcctttatgaatgtgaaacattggccatggatgaagctatattttaaaatcaaacccctgctgaagtccgccgagacagaaaaggagatggccaacatgaaggaagaattcgagaaaaccaaagaggagctggcgaagactgaagccaagcgcaaagaactcgaggaaaaaatggtcaccttaatgcaagaaaagaatgatttgcagttacaagtccaggcagaggccgactctctggccgatgccgaggagcgctgcgatcaactgattaagaccaaaattcagttagaagcaaagattaaagaagtaacagagagggcagaggatgaagaggagatcaatgccgagctaacagccaagaagaggaagcttgaggacgagtgttccgagttgaaaaaagacattgacgacctcgagctgaccctggctaaagtggaaaaggaaaagcacgcgacagagaataaggtaaagaatctgaccgaagaaatggctggactggacgaaacaatagccaagctcactaaagaaaaaaaagcattacaggaggcccaccaacagactctggatgatttacaggcggaagaggataaggtgaacacgctcactaaagctaagatcaaattagagcagcaggtcgatgacttagagggaagcctggaacaagagaaaaaaatcaggatggacctggagagagctaagcgcaaactcgagggggacctgaaactcgcccaggaaagtactatggacattgaaaacgataagcagcagctcgacgagaaactgaagaaaaaagagttcgagatgagcggactgcagtcaaaaattgaagacgagcaggccctgggaatgcagctgcagaagaagataaaagagctgcaagccagaatcgaggaattggaggaagaaatcgaagccgaacgtgcaagcagggcgaaagctgaaaaacagagatcagatcttagccgggagctcgaggagatctcggagcgattggaagaggcgggcggcgcgacatccgctcagatcgagatgaacaagaagcgcgaggccgaattccagaagatgagaagagacttagaggaagccaccctgcagcacgaggccactgctgcgacgctgcggaagaaacatgccgacagcgtcgccgagttgggggaacagatcgacaatctgcaacgagtgaagcagaaactcgaaaaggaaaagtccgagatgaaaatggaaatagacgatctggcttccaatatggagactgtgagcaaggccaagggcaatctcgagaagatgtgtcgcgcgctggaagaccaactaagcgagatcaaaaccaaggaggaggagcaacaacgcctgatcaacgaccttactgcccagagagcccggctccagaccgagtcaggcgaatactctcgccagctcgacgaaaaagatacattggtttcccagttgagccgcggaaaacaggctttcacccagcagatcgaggagctaaagcgccagttggaagaagaaatcaaagccaagtcagctcttgcacacgctctccaatcaagtcgacatgattgtgacctgttgagggaacagtatgaggaggagcaggaggccaaggccgagctgcaaagggccatgagcaaggcaaacagtgaggtcgcacagtggaggactaagtatgagactgatgccatccagcggacggaagagctggaagaggcaaaaaagaagcttgcccagcgactccaagacgcagaagagcatgttgaagccgtaaatgctaagtgcgcgagtttagagaagacgaaacagcgcctgcagaatgaggtggaggatctgatgatcgacgtggaaagaacaaatgctgcatgcgcagcattagacaagaaacagcgtaacttcgataaaatcctcgcggaatggaaacagaagtgcgaggagacccacgcagaattggaagcttcgcagaaggaatcccggagcctgtccacagagctgtttaaaattaagaacgcatacgaagagtcactcgatcaattggagaccctgaagcgggagaataagaacttgcagcaagaaattagtgacctgacagagcagatcgctgaaggtggaaagcgtattcacgaactagagaagatcaagaagcaggtagagcaggaaaaaagtgaacttcaagccgctctggaggaggccgaagccagcctcgagcacgaagagggtaagatcctgaggatccaactggaactgaaccaagttaaaagcgaagtggacaggaagatagcagagaaggacgaagagattgatcagatgaagcgcaatcatatccggattgtcgagtcgatgcaatctacacttgacgcggagatccgctcacggaatgatgcgattaggttgaagaaaaaaatggagggggatctaaatgagatggaaatacagctgaaccacgctaacagaatggcagccgaggcgctgaggaactacaggaacacccaggcaatccttaaagatacacaacttcatctcgacgacgcactgcggtctcaggaagatcttaaggagcaactcgccatggtggagcgccgggcaaatttactgcaggccgagatagaagagctacgggccacgctcgagcagacagagagaagccgcaaaatcgccgaacaggagctcctggatgcaagcgaacgggtgcagctgttgcatacacaaaatacttcactgatcaataccaaaaaaaaacttgagacagacatatcacagatccagggcgagatggaagacattatccaggaggcaaggaacgcggaggaaaaggccaaaaaggcgatcaccgacgctgccatgatggccgaggagctgaaaaaggagcaggatacttctgctcacttggagcgcatgaagaaaaatctggaacagacagtcaaggacctgcagcacagactcgacgaggctgagcagctggctttaaaaggaggcaagaagcagatccagaaactggaagcgcgggttagagagctggagggagaagtggagtctgagcagaagaggaacgtcgaggctgtgaaagggctgcggaagcatgagcgaaaggtgaaagaacttacctaccagactgaagaggatcggaagaacattcttagactacaagacttggttgacaagctgcaggccaaagtgaagtcctacaagagacaagccgaagaggctgaggaacagagcaacgttaaccttagcaagttcagaaggatccaacacgaattagaagaggcggaagaacgggccgatattgcggagtctcaggtaaacaagttgagagtcaagagccgagaagttcataccaaaattatttcagaggagtag

SEQ ID NO: 125514 - DNA, 5820 bp, Artificial Sequence
  Description of Artificial Sequence: Synthetic coding sequence
atgtcctctgatagcgagatggctatttttggtgaagccgctcctttccttaggaagtcagagaaggagcgaatcgaagcacaaaacaagccttttgacgccaagacgtccgtgttcgtagtggaccctaaagaatcctatgttaaagcaatagtgcagtctcgggaggggggaaaagtcaccgccaagaccgaggcaggagccacagtcactgtgaaggaggatcaggtcttcagcatgaatcccccaaaatacgacaagatcgaggacatggccatgatgacccacctgcatgaaccggcagtcttgtacaatctgaaggaaagatacgcagcctggatgatatatacatacagcggtttattttgtgtcaccgttaatccttacaagtggctcccagtgtataatccagaagtggttaccgcgtataggggcaagaagagacaggaggcacccccccacatattcagcataagcgataacgcgtaccagttcatgttaaccgacagagagaaccaaagtatattgattaccggtgaatcgggtgctggtaagaccgtgaataccaaacgtgtcatccagtactttgctacgatcgccgtgaccggagaaaaaaagaaagaggagccagcctccggcaaaatgcagggcactctggaagaccaaattatttctgccaatcctctcctcgaagcatttgggaacgccaagaccgtgcggaatgataatagcagtcggttcggcaagtttatccggatacattttggagctacagggaagcttgcctcggctgacattgagacatatctgctcgagaaaagccgcgtgacttttcagttgaaggcagagaggagctaccacatcttctaccaaatactgtcaaataagaagcctgagctgatcgagatgttactgatcaccaccaacccttatgattttgccttcgtgtcccaaggagagattacggtgccctctattgatgatcaggaagagctcatggcgacagattcagctgtggacatcctggggtttacggccgacgaaaaggtggctatctacaagttgactggtgcagtgatgcactatggaaacatgaagtttaaacagaagcagagagaggagcaggccgagccagatggaaccgaggtggcagataaagccgcatacctcacttccttaaactctgcagatctgttgaagtcactctgctacccaagagttaaggtgggaaacgagtttgtgacgaagggtcagaccgtccagcaggtatataatgctgtgggggccctcgccaaagctatctacgaaaagatgttcctgtggatggtcactcggattaaccagcagttagatactaagcagcccaggcagtactttatcggggtcttagatatcgccgggttcgaaattttcgatttcaacagcctggaacagctgtgcattaattttactaatgaaaagctccagcagttttttaatcaccatatgttcgtgctggagcaggaagaatacaagaaggagggcattgaatgggagttcatcgacttcggtatggacctcgctgcttgcatcgagttgatcgaaaaaccgatgggtattttttctattttagaagaggagtgcatgttccccaaggcgaccgacacgtcattcaagaacaagctgtacgagcagcatttggggaagtccaataatttccagaagcctaagcctgccaaagggaaacctgaagcgcactttagcttagtgcactacgccgggaccgtggattacaatattgcgggatggctggacaaaaataaagatcccctgaatgaaaccgtggtaggtttgtatcagaagagtgcgatgaagaccttggcgttcctcttcagcggggctcagactgcagaagcggagggcggtggaggaaagaagggcggaaaaaagaagggaagctcgtttcagactgtgagcgcgctcttcagagagaatctgaacaaactaatgactaatttgcgctccacccatccacacttcgtgcggtgtatcattcccaacgagaccaagacccctggtgccatggagcacgaactggtgctgcaccaattgcgctgtaacggcgtactggagggtattcgtatctgtcgaaagggattcccttcacggatcctttacgcggatttcaaacagcgatacaaagtgctcaacgcctctgctataccagaggggcagttcatcgactccaaaaaagccagtgaaaagttgctcggaagcatcgaaatcgatcacactcaatacaagttcgggcatacaaaagtattcttcaaagcaggtctccttggcactctagaggaaatgcgcgacgaaaagctcgcccagctcatcactcggacccaggccatttgtagagggtttttaatgagggtggagtttcgcaaaatgatggagaggcgagagagcatattttgcattcaatataacatccgagcctttatgaatgtcaaacactggccctggatgaaactgtattttaaaattaaaccgcttctcaagagcgccgaaactgagaaggagatggcgaacatgaaggaggaattcgagaaaaccaaggaagagttggctaagactgaagctaagcgcaaagaacttgaagagaagatggtcactctgatgcaggagaaaaacgatctgcagctgcaggtgcaggccgaagctgatgctctggcagacgcggaggaaagatgtgaccaactcataaaaactaaaatccagctggaggcgaagataaaggaggtcaccgaaagagccgaagatgaggaggaaattaacgctgagttgacagccaaaaagaggaagctagaggatgagtgttcagagctgaaaaaggacattgatgacctggagttgactttggccaaagtggagaaggagaagcacgccacggaaaacaaagtaaagaatcttacagaggaaatggccggcttggatgaaaccatcgcaaagttgacgaaggagaaaaaggctctacaggaagcacaccagcagacattggacgacctccaaatggaggaggataaggtcaataccctgaccaaggcaaaaactaaactcgagcagcaggttgacgacctggaaggaagcctcgaacaggagaagaagctgtgtatggatttagaaagggccaaacgaaagctggaaggggatctgaagctggcacaagagagcacaatggacactgagaacgacaagcagcagctgaacgaaaagttaaagaaaaaagagtttgagatgagtaacctccaaggaaagattgaggacgaacaggctctagctatacaactacaaaaaaagatcaaggagctgcaagccagaattgaggagttagaggaggagattgaagcagaacgagctagtcgggctaaggcagagaagcaaaggagcgaccttagccgggaacttgaggagataagtgagagactggaggaggcagggggcgccacaagcgcacagatcgaaatgaataagaaaagagaggctgagttccagaaaatgcggcgggatttagaagagtccactctccagcacgaggccaccgcagcagcccttagaaagaagcacgcggattccgtggccgaactgggggaacagatcgatagcctgcagagagtgaagcagaagcttgagaaggagaagagtgagctgaaaatggagattaacgacctggcgtccaatatggagaccgtatctaaggctaaagctaacttcgagaagatgtgccggacacttgaagatcagctgtctgagattaagacaaaggaggaggagcagcaacgacttatcaatgaactgtccgcccaaaaagcccgactccacacggagagtggagagtttagccgtcagctggacgagaaggacgccatggtgtctcaactgagccgggggaaacaggccttcactcagcagattgaagagcttaagaggcaattggaggaggaaactaaggccaaatccaccctcgcccatgccctgcagtcagcccgccatgattgtgacctgctcagggagcaatacgaagaagagcaggaggcaaaggcggaattacagaggggtatgagcaaagcaaatagcgaggtggcccagtggcgaactaaatatgaaacagatgccattcagaggacggaagaactggaagaggcaaaaaaaaagctggcacagaggctccaggacgcagaggaacatgtcgaagccgtgaatagcaagtgtgctagcctcgagaagaccaagcaacggctgcagaacgaggtcgaggatcttatgattgacgtcgagagatctaacgctgcttgcattgccctggacaaaaagcagcgtaactttgacaaggtgctggccgagtggaaacagaagtatgaagagactcaggctgagctggaggcatcacagaaggagagtcgcagtcttagcactgagttattcaaggttaagaatgcttacgaggagtctttggaccacctcgagactctgaaacgcgaaaacaagaacctgcagcaagagatttcagacctaaccgaacagatcgcagagggaggaaaacacatccatgagctggagaaggtgaagaagcagctggatcacgaaaagtcagaactgcagacatctcttgaggaggccgaagctagcctcgagcacgaagagggtaaaatcctgagaatccagctggaactgaatcaggtgaaatctgagattgaccgcaaaattgccgagaaagatgaggaacttgaccagctgaagcgcaaccacttacgagtcgtggaatccatgcagagcacactggatgcagagatccgctctcgcaatgacgctctgcggataaaaaaaaagatggaaggcgatctaaatgagatggagatacagctcaatcacgccaaccggcaggctgctgaggctctgagaaatctccgaaacacacagggaattttgaaagacacccagttgcatttggacgacgccattcgtggtcaggacgatctgaaggagcagctggctatggtagagaggcgcgcaaacctaatgcaggctgaggtagaggagctccgagccagcctggaaaggaccgaaagaggcaggaagatggccgagcaagaactgctcgatgctagcgaacgggtgcagcttttgcacacacagaacacaagtttaatcaatacgaagaagaaacttgagaccgacatcagccaaatccaaggtgaaatggaagacatagtccaggaagcaaggaacgcagaggaaaaagcaaagaaggctatcactgatgccgctatgatggcggaagagctcaagaaggagcaggacacctcagcacaccttgaaagaatgaagaagaacatggaacagacggtgaaagacctgcagctcaggctggatgaggctgagcaactcgcacttaaaggcggtaagaagcagattcagaagctggaggctcgggtgagagaactggaatcagaagtagagagcgaacagaaacataatgtggaggcggtgaagggactgcgaaaacacgagcggagagtaaaggaactgacctaccaaactgaagaggaccgcaaaaatatcttgaggcttcaggacctggtggataagcttcagacaaaagtaaaagcctataagcggcaggctgaagaggccgaagagcagagcaatgtgaacctggccaaattcagaaagttgcaacatgagctcgaagaggccaaagagagagcagacattgcagaaagccaggtgaacaagctcagagtgaaaagccgcgaagtgcatacaaaagtcatatcagaagaatag

SEQ ID NO: 125515 - DNA, 5820 bp, Artificial Sequence
  Description of Artificial Sequence: Synthetic coding sequence
atgacagatgcacagatggctgatttcggcgccgcagctcaatacctccgcaagagcgaaaaggagcgcttagaggcacagacacgcccattcgacatcagaaccgagtgttttgtgccagacgataaggaagagttcgttaaagctaaaattctgtctcgcgaaggtggcaaggtcattgccgaaaccgagaacgggaagacagtcacggttaaggaagaccaggttctccaacaaaaccccccaaagttcgataaaatcgaggacatggcaatgctcacattccttcacgaaccagccgtgctctttaacttaaaagagagatatgcagcatggatgatctatacttattccggactcttttgtgtgactgtaaatccttataaatggcttcctgtgtataacgccgaagtcgttgctgcttaccgggggaaaaagcgttccgaagccccgccacacattttcagcatatcagataacgcctaccagtacatgctgacagaccgggagaatcagagtatcctgatcactggggaatcaggggcaggtaaaacagtcaatactaagagggtgatacagtattttgcaagtatcgcagccattggggatcggggaaaaaaggacaatgctaacgccaacaaaggcaccttggaagaccagatcattcaggccaacccagccctggaggcattcggcaatgctaagaccgtgaggaatgacaactcctcccggttcggcaaattcatcagaattcatttcggagccactgggaagctggcgtcggccgacatcgaaacatacctcttggaaaagtctcgagtgatttttcagttgaaggccgaaagaaactaccacatcttctaccagatcctgtctaacaagaaacccgagctcttagatatgctcctggtgactaataacccctatgattatgcctttgtatcccagggtgaggtgtcggttgcaagtatcgacgactccgaggagctgatggcaacagactctgccttcgatgttctgggttttacatcagaggaaaaagcaggagtgtacaagcttaccggagcgattatgcattatggcaacatgaagttcaagcagaaacagcgcgaagagcaagccgagccggatgggacagaggatgccgacaagtccgcctacctaatgggtttgaattcagcagatctgctaaagggcttgtgtcacccccgcgtgaaggtcgggaatgagtacgtgaccaaagggcaatccgttcagcaggtctactactctatcggggctcttgccaaggctgtgtacgagaagatgttcaactggatggtgacccgtataaatgcgaccctggagactaaacagcctaggcagtatttcatcggtgtcctggatatagccggcttcgagatttttgacttcaattctttcgagcagttatgcattaatttcacaaacgagaaattacagcagtttttcaaccatcacatgtttgtgctggagcaggaagaatataagaaggagggcatcgagtggacattcatcgacttcgggatggacttgcaggcctgcatcgatctgatcgagaaacccatgggaattatgtcaatattggaagaggaatgtatgtttcctaaggctacagatatgaccttcaaagcaaaattgtacgataaccatcttggaaagtccaacaattttcagaaaccacgaaacatcaaggggaagcaggaggcacatttctctctgatacattatgcgggtactgtggactacaacattctgggatggttggagaaaaacaaagatcccctcaatgagactgtggtcgccctatatcaaaagtcttccctaaaattgatggctacactgttctctagctacgccacagccgacacgggcgattcaggtaagtcaaaaggtggcaagaaaaagggaagctcttttcaaactgtgtccgcactgcacagagagaatcttaacaaactgatgaccaacctccgaactacacatccccattttgtgcgttgtataatccctaatgaacggaaggccccaggggttatggataatcctctggtcatgcatcagctacgctgcaatggcgtgctcgagggtatccgaatatgccgaaaggggttcccgaacaggatcctatacggcgacttccggcagcggtatcgaattctcaaccccgttgccatcccagagggccaatttatcgacagtcgcaaaggcactgagaagctcctgtcatcactggatatcgatcacaatcaatataaattcggacacactaaggtgttcttcaaggccggtctgttaggactactggaggagatgagagatgaaagactctcccgcatcatcacccgcatgcaggctcaagcccgaggccagctcatgcgcatcgagttcaagaagatagtggaaagacgggacgctcttttggtgatccagtggaacatccgcgccttcatgggtgttaagaattggccatggatgaagctttactttaaaattaagcctctactcaagagcgcagagaccgagaaggaaatggcaaccatgaaggaggagttcggaaggatcaaggagactctggagaaaagcgaagccaggcggaaagaactagaagaaaagatggtatcactccttcaggagaaaaacgacctgcaactacaagtgcaggccgaacaggacaacctgaacgatgctgaggagcgctgcgaccaacttattaagaataagattcagttggaggctaaggtgaaagagatgaacgagcgccttgaagacgaagaagaaatgaacgccgagctgacagcaaagaagcgaaagctggaggatgagtgctccgagcttaagaaggacatcgatgatcttgagttaactctcgccaaagtagaaaaagaaaaacacgcgactgagaacaaggtgaagaatttgactgaagaaatggcagggcttgatgagattattgccaaactcacaaaggagaaaaaggctttgcaagaggctcaccagcaggcactggatgacctgcaggtcgaagaagacaaagtcaatagtctgtccaagtcaaaggtcaagctcgaacagcaggtcgacgatctcgagggctcccttgagcaggagaagaaagtgagaatggacttggaaagagcaaaacgtaagcttgagggggacctgaagttgacccaagagtctatcatggaccttgagaacgacaagctgcagttggaggaaaagctgaaaaaaaaggagttcgatatcaaccagcagaatagcaagatcgaagatgaacaggtcttggctctccagttacagaagaaattaaaggagaaccaggccaggattgaggagctagaggaggagttggaagcagaacgtaccgcccgtgctaaagtagaaaagctgcgctccgacctgagtagagagctggaggagatttctgagagactggaggaagctggaggagccacgtcagtgcaaatcgagatgaataaaaaaagagaagccgagtttcagaaaatgagaagggacctggaggaggctacactgcaacatgaggctactgctgccgcattacgcaaaaagcacgctgattccgtggcggagctgggagagcaaatcgacaacctgcagcgcgtgaagcagaaactggagaaagagaaaagcgaatttaagctggagctggacgatgttacgagtaatatggagcagataattaaagccaaagcgaatctggagaaagtatctaggacgctggaggaccaggccaatgaataccgggtgaagctggaggaagcccagcgctccttaaacgacttcacaacccagagagcaaagctccagaccgagaacggagagctagctcggcagcttgaggaaaaagaggcactaatcagccagctgaccagaggcaagcttagctacactcagcagatggaagatctgaaacgccagttggaagaagagggaaaggccaaaaacgcactggcacatgccttacaatctgctcggcacgactgtgacctccttagggaacagtacgaagaggagacagaagccaaagctgaactccagagagtattatctaaagctaacagtgaggtcgcgcagtggcggacaaagtacgaaacggatgcaatccagaggactgaggagttagaggaagctaaaaagaagctcgctcagcggctgcaggacgccgaggaggctgtagaggctgttaatgcgaaatgttcctcactcgaaaaaaccaaacatcgcctgcagaacgaaattgaggacctgatggtcgatgtggagcgttctaacgctgccgctgccgccctagacaagaaacagcgcaactttgataagatcttagccgagtggaagcagaagtatgaggagtcccagtccgagctggagtcatcccagaaagaggcacgcagtctgtctacagaactgttcaaattgaagaatgcctatgaagagtccttggagcatctggagacttttaagcgggagaataaaaacctacaggaggaaataagtgatcttacagagcagctgggggaaggcgggaagaacgtgcacgagttagaaaaagtccggaaacaattggaagtggagaagctcgaactgcaatcagcccttgaggaggcagaagcctcactggagcacgaagaaggtaaaatcctaagagcccagttggaattcaaccaaattaaggctgaaattgagaggaagctggccgagaaggacgaggagatggaacaggccaagcgaaaccaccagagagtggttgacagtctgcaaaccagcctggacgcagagacccggagccgcaacgaggtcctccgcgtgaagaaaaagatggagggcgacctgaatgagatggaaattcagcttagccacgcgaaccgaatggccgcagaagctcagaagcaggtcaagagtctacagagtctgttaaaagatacccaaattcaactggatgatgccgttcgggccaatgacgatctcaaggaaaatatcgccatcgtagagaggaggaacaatctgctccaagccgagcttgaggagttaagagctgtggtggagcagactgaaaggagcaggaagctggccgaacaggaattgatagagacgagtgaacgagtgcaacttctgcactcacaaaatacgtcgctcattaaccagaagaagaaaatggagtcggacctcacccagctgcaatccgaggtggaggaagcagtacaagagtgtaggaacgcagaggagaaggctaagaaagcaatcaccgacgctgctatgatggctgaggagctgaagaaggaacaggacacatcagcccatttggaacggatgaaaaaaaacatggagcaaacaatcaaagatctgcagcatcggttggacgaagccgaacagatcgctttgaaaggtggaaagaaacagttgcaaaagctggaggcaagagtcagagaactcgaaggtgagctggaagcggagcagaaacgcaacgctgagtctgtgaagggaatgcggaaatccgagcgtagaatcaaggaacttacctatcagaccgaggaagacaagaagaacctcctgaggttgcaggatctggttgacaagctacagttaaaggtgaaagcttataagcgccaggcagaagaggctgaagagcaagccaataccaacctctctaagtttcgtaaggtgcaacatgagttggacgaggccgaagagcgcgctgacatcgcagaatctcaggtcaacaagttgcgggccaagagccgcgacattggggctaagcagaagatgcacgatgaggagtag

SEQ ID NO: 125516 - DNA, 5820 bp, Artificial Sequence
  Description of Artificial Sequence: Synthetic coding sequence
atgacagatgcccagatggccgattttggagcagccgcccagtacctgaggaagtctgagaaagagagactggaagctcagacgagaccgttcgatattagaacagaatgtttcgtaccagatgataaagaggaattcgtgaaggctaagatccttagtagggaaggtggcaaagtcatcgcagagactgagaatggcaagacagttactgtcaaagaagaccaagtgctgcagcagaacccgccaaaatttgacaagattgaagacatggccatgctcacctttctgcacgaacctgctgtcctctttaatctgaaggaaaggtatgcagcttggatgatctacacgtacagtggcctgttctgcgtcacagtaaacccgtataagtggctgcccgtgtacaacgccgaggtcgttgccgcatatcgtggcaagaaaaggtctgaagctcccccacacatattcagcatttctgataatgcctatcaatacatgttgaccgacagggaaaaccagagtattctgatcaccggagaatccggggccggaaagaccgtcaacaccaagcgtgtaatccagtatttcgcaagtattgccgccattggggaccgaggaaagaaagacaatgccaacgccaataagggaacccttgaggaccagattatacaggcaaacccagccctagaagcattcgggaatgctaagaccgtgaggaatgacaactctagccgattcggcaaattcatcaggattcacttcggtgctaccggaaagttggcctcagctgacatcgagacgtatctgcttgaaaaaagccgagttatctttcaactgaaggccgagcgaaactatcacatcttctaccagattctgagcaacaagaagccggaactgctagatatgttgcttgtaaccaataatccatatgattatgcttttgtgtctcagggcgaagtctccgtggcctctatcgacgatagcgaggaactcatggccacagacagtgcgtttgacgtgctgggtttcactagcgaggagaaagccggtgtgtataagctaacaggggccattatgcattacgggaacatgaagttcaagcagaagcagcgggaagaacaggccgaacctgacggcactgaagatgccgacaaatcagcctatctcatgggtcttaatagcgccgatctgctgaaggggttgtgtcaccccagagtgaaagtgggaaacgagtacgtgaccaagggacagtcagtccagcaggtttattacagtatcggagctcttgctaaggctgtgtatgagaagatgtttaattggatggtgacacgtattaacgcgactctggaaactaaacaacccaggcagtactttatcggtgtgctggatatcgcgggcttcgaaattttcgactttaactctttcgaacagctgtgcatcaacttcaccaacgagaagttgcaacagttttttaaccaccacatgtttgtcctggagcaggaagagtataaaaaggaggggatcgaatggacttttatcgattttgggatggatttgcaggcctgtatcgatctcatcgaaaagccaatgggtattatgtccatcctagaagaggagtgtatgttcccgaaagccacagacatgacttttaaagcgaaactctatgataatcacctggggaaatccaacaattttcagaaacccagaaacatcaaaggcaaacaggaagctcatttctccttgatacactacgctggcactgtggactacaacatcctcggatggttggaaaaaaataaagatccgctgaatgagacagtcgtggctctgtatcagaagagttccctgaaacttatggccaccctgttttcttcttatgccactgctgacacgggagacagtggaaagtcaaagggagggaaaaaaaaaggctcgtctttccagacagtaagcgccctgcaccgcgagaacctgaataagctgatgactaaccttagaacaacacacccccattttgtgcggtgcataatcccaaacgagcgcaaggccccaggcgtgatggataaccccctagtcatgcaccagttgagatgcaatggcgtgctggagggcattaggatttgtaggaaggggttcccaaatcgcatactgtacggggactttcgccagcggtatagaattctgaatccagtcgctatccccgaaggacagtttatagacagtcggaaaggaactgagaaattgctctcatctctcgacatcgaccataaccagtataagtttgggcataccaaagtattctttaaagccggactgctgggactgttggaagagatgcgcgatgagcgcctatcccgcatcataactcgcatgcaggcccaggcgcgcggtcagctgatgagaatcgaatttaaaaaaatcgtagaaaggcgggacgccctcttggtaatacagtggaatatccgtgcattcatgggtgtaaagaattggccgtggatgaagctgtacttcaagattaagcctttgctgaagtccgctgaaacggagaaagaaatggcgactatgaaggaagaatttggccggatcaaggagaccttggagaagtctgaggccaggcgtaaggaactcgaggaaaagatggtttcgcttctgcaggagaagaatgatcttcagctgcaggtccaggccgagcaagataacctgaatgatgcagaggaacgatgtgaccagttgattaagaataagattcagctcgaggccaaagtcaaggaaatgaatgaacggctggaggacgaggaggagatgaacgcagagctgacagctaagaagaggaagctcgaagacgagtgctccgaactgaagaaggatatcgacgatctggaactgactctggcaaaggttgagaaggaaaagcatgccactgagaataaggtgaagaatcttacggaggaaatggccgggttagatgaaattatcgctaagctcaccaaggaaaaaaaagcgctgcaggaagctcatcagcaggctctcgacgatttgcaggttgaggaggacaaggtgaactcgctgtccaagtcgaaagtcaaactagaacagcaagtggatgacctggagggctcactggaacaggagaaaaaggtgcgtatggatcttgagagggccaaacgtaaactggaaggtgatttgaagctgacccaggaaagcatcatggacctggagaacgacaaattacagctggaggaaaagctcaaaaaaaaggagtttgacattaatcagcaaaatagtaagatcgaggacgaacaagtgctggctctgcaactccagaagaaattaaaggagaatcaggctaggatcgaggaattagaagaggaactcgaagcagagaggacagctagagctaaggtggagaagcttaggagcgacctctctcgtgagttagaggagatcagtgagagactcgaggaggctggcggcgccacctccgtacagatcgaaatgaataaaaaacgcgaagccgaattccagaagatgaggcgcgatctggaagaggctactctgcaacacgaagccacggcagcagccctaaggaaaaagcacgccgactccgtggccgaactcggcgagcagatcgacaatttgcaaagggtcaaacagaagttggaaaaggagaagtccgagttcaaactcgaattggatgacgtgacttccaacatggaacagattattaaagccaaggccaacctagagaaggtttctaggactttagaggatcaagctaatgagtacagggtaaagctggaagaggcgcaacgaagtctcaacgattttacaacccaacgcgcgaaactgcagaccgaaaatggagagctggccaggcagctggaagaaaaggaggcactaatttcccagctgacacggggaaaactatcttatacacagcagatggaagacttgaagagacagctggaggaggagggaaaggccaaaaatgctctggctcatgctctgcaaagtgccagacacgactgcgacttattgagagagcagtatgaggaagagaccgaggcaaaagccgaactccagagagtactctctaaggccaattccgaggtagcccagtggcgaaccaagtacgagactgacgctattcagcgtaccgaagaattggaagaagctaagaaaaagctagcccagcgcctgcaggatgctgaagaggctgttgaagctgtgaatgcgaagtgttcctcactcgaaaaaaccaagcataggctgcagaacgaaatcgaagacctcatggttgacgtggagcgcagtaatgctgctgcggcagccctcgataagaagcagcggaactttgacaagattctagcagaatggaagcagaaatatgaagagagccagagtgagctagagtcatctcaaaaagaggcgagaagcctttcaaccgaactgtttaaattgaagaatgcatatgaagaaagtctggagcacctggagacattcaaaagagaaaacaaaaacctgcaggaggagatttctgatcttactgagcagctcggggagggagggaagaacgttcacgaactcgagaaagtgaggaaacagctggaggtcgaaaaactggagcttcaaagtgccctggaggaagccgaggcatccctggaacacgaggagggcaagattctgcgtgcccagctggaattcaaccagattaaagctgagattgagcggaaactggctgagaaagacgaggagatggagcaggccaaacgaaaccaccagagagtggtcgacagcctgcagacgtcactagacgcagagacaagatccaggaatgaagtgctccgtgtgaaaaaaaaaatggaaggagatctcaacgaaatggagatacagctgtcacacgctaatagaatggccgcagaggcacaaaaacaggtgaagtctttgcaaagcctcttgaaagatacccaaattcagctcgacgatgcagttagagccaatgacgacctcaaggagaacatcgctatagtcgaaagacggaacaacctgctacaggcggaacttgaagaactgcgagctgtcgttgagcaaaccgaacggagtcgcaagctcgctgaacaggaattgattgagacttctgagagagttcagctactgcacagtcagaacacctctctgatcaatcagaagaagaaaatggaatccgacctgacccagctccaatcagaggtggaggaagccgtacaggagtgccggaatgcggaagagaaagcaaagaaggccattacggatgccgccatgatggccgaagaactcaagaaagagcaggacacctcagcccatctcgagagaatgaagaaaaacatggagcagacaatcaaagatctacaacaccgcctggatgaggccgagcagatcgcccttaagggcggcaaaaaacagctgcagaagctcgaagccagggttcgagagctcgagggtgagctggaggctgaacagaaacggaatgcagaatcagtcaagggaatgcggaagtccgagagacggatcaaagagctgacatatcaaactgaggaggataagaaaaacctgttgcgactgcaagatctggtggacaagttacagctgaaggttaaagcgtataagagacaggctgaagaggcagaagaacaggccaacacaaacctgtctaagtttagaaaagttcagcatgagcttgacgaagccgaggaacgggctgacattgctgaatcccaggtgaataaactgagggctaaaagccgggacatcggggctaaacagaagatgcacgatgaggagtag

SEQ ID NO: 125517 - DNA, 5808 bp, Artificial Sequence
  Description of Artificial Sequence: Synthetic coding sequence
atgggcgattcggaaatggccgtatttggggcagctgcaccttatctgcgaaagagtgaaaaggaaaggcttgaagctcagactaggccgtttgacctcaaaaaagatgtgttcgtgccagacgacaagcaagagttcgtcaaagcgaagatcgtgagcagggagggcggtaaggttaccgccgaaactgagtatgggaaaaccgtcactgtcaaggaagaccaggtgatgcagcaaaatccacccaaatttgacaagattgaggacatggctatgctgacatttctgcacgaacccgcagtcctttacaatctaaaagaccgatatggctcttggatgatctacacatacagcggcctgttttgtgtgacagttaacccctacaaatggctccccgtatatactccagaagtagtggcagcctatagggggaaaaagaggtccgaagcccccccgcatattttttctattagcgacaatgcatatcagtacatgttgaccgaccgtgaaaatcagtcgatcttaattaccggcgagtcgggtgcaggaaagaccgtaaacaccaagagggttattcagtattttgctgtcatcgctgctataggcgaccgttccaagaaggatcagtctccgggcaagggcaccttagaggaccagatcattcaagccaacccggctcttgaggcgtttgggaatgccaagactgtgaggaacgataacagctcacggtttggcaaatttatccgtattcacttcggcgctactggaaaattagccagtgcagatatcgagacgtatctgctggagaagagccgagtgatattccagttgaaagctgagagggactatcatatcttctatcagattttgtcaaataaaaaaccagaacttttggacatgttgctgattacaaacaacccatatgactatgcctttatctcccagggcgagactacagtggcgtcaatcgatgatgccgaggaattaatggcaacggacaacgcctttgacgtcctcgggtttacctccgaagagaagaactcaatgtacaagctaaccggcgctataatgcactttggtaatatgaaatttaagcttaagcaaagggaagaacaggcagagcctgatggaactgaagaagcagacaagagcgcctaccttatgggactgaattcagccgacctgctcaaaggcctatgtcatccccgggtgaaagtcggcaatgaatatgtgactaaagggcaaaacgtgcaacaggtgatctacgcgacaggggccctcgccaaggcagtgtatgagaggatgtttaactggatggtgacaaggataaacgcgaccctcgagactaagcaacctaggcagtattttatcggagttctggatattgccggcttcgagatttttgattttaattcattcgagcagttgtgcattaactttaccaatgagaagctacagcagttttttaaccaccacatgtttgtattggagcaggaagagtataaaaaagaggggatcgagtggacattcatagattttggtatggacctacaggcctgcatcgacctgatagaaaagccaatggggatcatgagtattctagaagaggagtgcatgttccctaaagcaaccgatatgacctttaaagctaagttattcgacaatcatctcggaaagtcagctaattttcagaagccacgcaacatcaaaggaaaacctgaagcacacttcagcctgattcattacgcagggatagtggactataatattatcggctggctccagaaaaataaagacccactgaatgagactgttgtgggcttataccagaagtcgagcttaaagctcctcagtacactattcgctaactatgccggagctgacgcccctatcgaaaaaggtaaggggaaggccaaaaagggaagcagttttcagacagtgagcgctttgcatcgagagaatctgaacaaactgatgactaatctgcgcagcacacatccccattttgtacgatgcatcattccgaatgaaacaaagagccccggcgtcatggataaccctcttgtcatgcaccagctgcgttgtaatggggtacttgagggcatccggatatgccggaagggcttcccaaatagaattctgtacggagattttaggcaacggtatcgaattttgaatcccgccgctatccctgaagggcaattcatcgatagcaggaaaggtgctgaaaaactactgtccagccttgatatcgatcataaccagtataaatttggacatacgaaggtattcttcaaagcggggctccttggactgctggaagagatgcgggacgagcggctatcacgcattatcacccgcatccaagcgcaatcaagaggcgtcttagcgaggatggagtacaagaagcttttggagcgcagagacagtctccttgtgatccagtggaacatacgagctttcatgggtgtgaaaaactggccatggatgaagttgtatttcaaaatcaagcccctcctgaaatccgcagagagggagaaggaaatggcatcaatgaaggaagagttcacacgactaaaggaggctctcgaaaagtcagaggcaagacgcaaagaattggaagaaaaaatggtttctttactccaggagaaaaacgatttacagctacaagtgcaggcggagcaggataatttggcagacgctgaagagcgatgcgatcagctgatcaagaataagatacaattagaggctaaggtcaaagagatgaacgaaagacttgaagacgaagaggaaatgaacgccgaacttaccgctaagaagagaaagctcgaggacgagtgcagcgagctgaagagggatatagatgatctggagctgacgcttgccaaggtcgaaaaagagaagcacgctactgaaaataaagtcaaaaatctaacggaggagatggctggcctggacgagatcatagccaagttgactaaagaaaagaaggctttacaggaagcccaccagcaggcactcgacgacctgcaggcagaagaggataaagttaacaccctgaccaaggctaaagtgaagctcgagcagcaggttgacgacctcgaagggagcctcgaacaggagaaaaaggtcaggatggatctggagagagccaagcgcaagctagaaggtgatctgaagctcacccaggaaagcataatggatttagagaacgacaaacagcagcttgacgagaggctcaagaagaaagatttcgaactcaatgctcttaacgcacgtattgaagatgaacaggccctcggtagccagctccagaaaaagctgaaagaacttcaggcacgcattgaagaacttgaagaggaactagaagcagagcgtacagcaagagctaaggtagaaaagctcaggtctgacctctcacgcgagttggaggagattagtgaacggttagaagaagctggtggcgccacatcagtccaaattgaaatgaataagaaacgagaagccgagtttcagaagatgcgcagagacctagaagaggctaccctgcagcatgaagctaccgccgccgccctcaggaaaaagcatgccgacagtgtcgcagagcttggggagcaaatcgacaatctccagagggttaaacagaagcttgagaaggagaaaagcgaattcaaacttgaactagacgatgtgacctccaacatggaacaaatcattaaggcaaaggccaatctggagaaaatgtgccgcacactcgaggaccagatgaacgagcatcgttccaaggccgaagaaacccagcgcagcgttaatgacctcacttctcagcgggctaagcttcaaactgaaaacggtgagctgagtaggcagctggatgaaaaagaagcactgatctcccagttgactagaggtaagcttacctacacccagcagctggaggatttaaaacgccagctagaggaggaggtaaaggcaaagaacgccctggcgcacgccctccagtccgccaggcacgactgcgatctgctacgggagcagtatgaggaggagacagaagctaaggcagaactgcaaagagtgctgtctaaggcgaatagtgaggttgcacagtggcgtaccaagtatgagaccgatgcgattcagagaaccgaggaactggaagaagccaagaaaaagctggctcagaggctccaggaggcagaagaggcagtggaggcagtgaacgccaagtgttcaagcctggagaagaccaaacaccgtttacagaacgagattgaagacctgatggtcgatgtggaacgaagtaacgccgctgccgcagctttggataaaaagcagcgtaacttcgataagatattggcggagtggaagcagaagtacgaggaatcacagtcagagctggagagctcgcagaaagaagcacggagtctgtctactgaactgtttaaactgaaaaacgcgtacgaggagtcactagaacacttggagacatttaagcgagagaataagaatctccaggaagagatctcagacctcactgaacagttgggtagttccggcaaaacaatccacgagcttgagaaggttcgcaaacaacttgaagccgaaaagatggaactccagagcgctttggaagaagcggaggccagccttgaacacgaggaggggaaaattcttagagctcagttagaattcaaccaaattaaggctgagatagaaaggaaattggctgagaaggacgaggaaatggagcaggctaagcgcaaccatctgagggtagtggattccctccagacttcactcgacgcagagactcgttcccgaaatgaggctctgcgtgtgaaaaagaagatggaaggagacctgaacgagatggagattcagctgagccacgctaacagaatggccgccgaagcccagaagcaggtaaaatcattacagtcattgctcaaggacacccaaattcagcttgatgatgctgtgcgcgcgaatgacgatcttaaggagaacattgccattgtggagcggagaaacaatctgttgcaggctgagctggaggaactgcgcgccgtcgtagaacagaccgagcggtcccgaaaattggctgagcaggaactgatcgaaacctccgaacgcgttcagctgttacatagtcagaacacctccctgatcaaccagaagaaaaagatggacgctgacctttcacaactgcagaccgaagttgaggaagccgtgcaggagtgccgaaatgcagaggaaaaagctaagaaggctattacagacgccgccatgatggccgaggaactcaaaaaggagcaagatacatcagcgcatttggaaagaatgaagaagaacatggagcaaactatcaaagacctgcagcaccggcttgatgaagccgaacagattgctttgaaaggtgggaaaaagcagctgcagaaattagaggcccgggtgcgagagctagagaatgagctggaagccgaacagaaacggaacgctgagagtgtgaagggcatgaggaagtccgaacgcagaatcaaggaactgacatatcaaacagaagaggatcgaaagaatttgctccgacttcaagaccttgtagacaaactccaactgaaagtaaaagcctataagcgccaggcggaggaggcagaagagcaagctaacactaacttgtccaagttcagaaaggttcagcatgagcttgacgaggccgaagagagagccgatattgccgagagccaggttaataaactgcgtgcaaaaagccgggatattggcacaaaggggcttaacgaggagtag

SEQ ID NO: 125518 - DNA, 5823 bp, Artificial Sequence
  Description of Artificial Sequence: Synthetic coding sequence
atgggcgattctgagatggccgtgttcggcgctgccgccccttacctccgcaagagcgagaaagaaagactggaggcacagactagacctttcgacctgaagaaagatgtgttcgtacccgatgataaacaggagttcgtgaaagcgaagattgtctcgcgagaggggggaaaggtaaccgcagagaccgaatatggaaaaaccgtcaccgttaaggaggaccaggtcatgcaacagaacccacctaagtttgataagattgaagatatggcgatgctaacgttcttacacgaacctgccgtgctctacaatttgaaagatcgctatggttcctggatgatctacacctattctgggttgttctgcgtcaccgtgaacccttataagtggttgccggtgtacacacctgaggtcgtcgccgcgtaccgggggaagaagcgtagtgaagccccgccacatatatttagtatttccgataatgcgtaccagtacatgctgacagatagagaaaatcagtcaatcttaatcaccggcgaaagcggggccggcaagaccgttaacactaagcgagtcattcaatattttgccgtcattgccgctatcggcgatcggtctaagaaagatcagtctccggggaaagggacgctcgaagaccagatcattcaggctaacccagccctggaagccttcggcaatgcaaaaacagtccgcaatgacaacagttcccggtttgggaaatttatccggattcacttcggggctactgggaagctggcatctgcagacatcgaaacgtatctactggaaaagtccagggtgatctttcagctcaaggcagaaagagactaccatatcttttaccagatactgagtaacaaaaaacccgagctgctggacatgctgctgataaccaataacccatatgattacgcattcatctctcagggagagacgacggtcgccagtatcgacgatgcagaggagctgatggctaccgacaatgccttcgacgttttgggcttcacctctgaagagaagaacagcatgtacaaattgacaggagccatcatgcattttggcaatatgaagtttaagctcaagcagcgcgaagaacaagccgagcctgatgggaccgaagaagctgataaatccgcttatctgatgggcttaaattctgccgacctgctgaaaggtttgtgccaccccagggtcaaggtagggaatgagtatgtgactaaaggacagaatgttcagcaagtgatttacgctactggagcactcgctaaagccgtgtacgaaagaatgttcaactggatggtcacacgcattaacgcgacactggaaacgaaacagccccgtcagtatttcattggagttttggatatcgctggctttgagatttttgactttaactcttttgagcagctttgcatcaactttaccaatgaaaaattgcagcagttcttcaatcaccacatgttcgtgttggaacaggaggagtataaaaaggaggggattgagtggacttttattgactttggcatggatctgcaagcttgcatcgaccttatagagaagcccatggggatcatgtctatcctcgaggaggaatgtatgtttcctaaggcaacggacatgactttcaaggctaagctatttgataaccacttgggaaaatctgccaatttccagaaaccacgtaacatcaaaggcaaacctgaagctcactttagcctcatccattacgcaggaatagttgactacaatattatcgggtggctccagaagaataaagaccccttaaacgagactgtggtgggtctctaccagaaatcttccttgaaactgctgtccaccctcttcgccaattatgcgggcgccgacgcccccattgaaaaagggaagggtaaagccaagaagggctcctctttccagactgtgtcagccctgcacagagaaaatctcaacaagcttatgactaacctaaggtcaacacaccctcactttgttcggtgcatcattcctaacgagactaagtccccaggagtaatggacaacccattagtcatgcaccagttaagatgcaacggagtcctggagggaatccgtatttgccgcaaggggtttcccaatcgtatcctctacggagacttcagacagcggtatcgaattctgaacccagcggcaatccctgaagggcagttcatcgactctagaaagggggctgaaaagctcttaagcagtcttgatattgatcacaaccagtacaagtttggacataccaaggtctttttcaaggcgggtctacttggattgttagaggagatgagggatgaaagattgagccgaatcatcacacgaattcaggcccagtcgaggggggtattagcaagaatggaatacaagaagctgctagagcgacgagatagtctgctggtgattcagtggaatattcgcgcctttatgggggtcaaaaattggccatggatgaagctttacttcaaaatcaaaccactgctgaagagcgccgaacgggaaaaggagatggcatctatgaaagaagagttcacccgcctgaaggaagccctggaaaagtccgaggcaagaagaaaagagctggaggagaagatggtaagtcttttgcaggagaagaatgaccttcaactgcaagtgcaggccgagcaggacaacttagcagacgctgaggaaagatgtgaccaactaatcaagaacaaaatccaactcgaagccaaggtcaaagagatgaacgaacggctggaagatgaagaagaaatgaatgctgaactgacggcgaaaaaaagaaaactggaggacgaatgtagtgagctcaaaagagacatcgatgacctggagctaaccttagcaaaggtcgaaaaagagaaacacgccacggagaacaaagtcaaaaaccttaccgaggagatggctggcctggacgagattatagccaagctgaccaaggaaaaaaaggccttgcaggaagcacaccagcaggctctggatgatctacaggctgaagaggataaagtgaataccctcactaaagccaaagtcaagctcgagcagcaggtggatgatctggaaggtagtttagaacaggagaagaaggtgagaatggaccttgagcgcgcaaaaaggaagctggaaggggatctgaagctgacccaggagtccattatggatctggaaaatgacaaacagcagcttgacgagcgtctcaagaagaaggatttcgagctgaacgctctgaacgcacgcatagaagacgaacaagcgctgggtagccagcttcagaagaaactcaaggagctgcaggcgagaatagaggagctggaggaggaacttgaagccgaacgaacggctagagcaaaagtagagaaactcaggagtgatctttctcgcgaacttgaggagataagtgaacggctggaagaggcaggaggagcaacgagcgttcagatcgaaatgaacaaaaagagagaggcagagttccagaaaatgcgacgggatctcgaggaggccaccctgcagcatgaggccactgctgcagctctccggaaaaagcacgcagactcggtagcagagctgggggagcagattgataatttgcaaagggtgaaacagaagctggagaaagaaaaatctgagttcaagttggaactcgatgatgctctcctcggactgccaagctcaaactttctcctgcccccaccattgtccgccaacctagagaaaatgtgcaggacactggaagatcaaatgaacgagcaccgctcaaaggccgaagagacacaacggagtgtgaacgatctcacttcacagcgcgctaaacttcagaccgagaatggcgaacttagccgacaactggacgagaaagaggccttaatttcccagctgacgcgtgggaaactgacctatactcaacagctggaagacctgaagcggcagcttgaggaggaggttaaagccaaaaatgccctggcacacgctttacaatcggcacgccatgactgtgacctgctgcgggagcagtacgaggaggagacagaagccaaggccgaattgcagcgggtgctgtccaaagccaatagtgaagtcgcgcagtggcggacaaagtacgagaccgacgcgatccagcggactgaggaactcgaggaggctaagaagaagctggcccaaagactccaggaggcagaagaagctgttgaggctgttaatgctaagtgtagctccctcgagaagacgaagcatcgcctccagaacgaaatcgaggatctaatggtggatgtggaacgcagcaacgctgcagccgccgcgctggacaaaaagcagaggaactttgataagattcttgctgagtggaaacagaaatacgaggagtcccagtcggaactggaatcatcccagaaggaggcgcggtctttgtccactgagctgttcaagttgaagaacgcttatgaagaaagtttagagcatctcgaaactttcaaaagggaaaacaagaacctgcaggaagagatttcggacctgactgagcaacttgggagctcgggtaaaaccattcatgagctggagaaggtgaggaagcagttggaggctgagaagatggagctccagtcagcactggaagaggcagaagcatctctggaacatgaagaagggaagatcctcagggcgcagctggaattcaatcagattaaggcagaaattgaaaggaaactggcagaaaaagacgaggagatggagcaggccaagcggaaccacctgcgagtggtggattccttgcagacaagtcttgatgccgagacccggagtaggaatgaagccctccgggtgaaaaagaaaatggagggagacctcaacgagatggagattcagttgagtcacgctaaccgaatggcggccgaagcccagaagcaagtcaagtcactgcagtcactcctaaaggacactcaaattcagttagatgatgccgttcgtgccaacgacgacctgaaagaaaatatcgcgatcgtggagaggcgtaacaacctgttgcaagccgagctcgaagaactgagggcggtggtggagcaaaccgaacgcagcagaaagctcgcggaacaggagctgattgaaacatccgaacgggtgcagctgctgcatagccagaatacaagtttgattaaccaaaagaaaaaaatggatgccgatctgtcacagctgcagacagaagtggaggaagctgttcaagagtgcagaaatgccgaagagaaagccaagaaggccattaccgatgctgctatgatggctgaggagctgaaaaaggagcaggacaccagcgcccacctggagcggatgaagaagaatatggagcagactatcaaggatctccagcaccggctcgatgaagcagaacagatagccctgaaagggggaaagaaacaactgcagaagctcgaagccagagtaagggaactggaaaatgagcttgaggccgagcagaaacgcaacgcagagagtgtgaaggggatgcggaaaagcgagcgaagaattaaggagctgacataccagaccgaagaggaccgcaaaaaccttctaaggcttcaggacttggtagacaaactgcagctgaaagtcaaggcttataagaggcaagctgaggaagccgaggaacaggctaatactaatctgagcaaattcagaaaagtacagcacgagctggacgaggctgaggagcgtgctgatattgctgagtctcaggtgaacaagctgcgcgctaaaagtcgggacatcggaaccaaaggtctgaatgaagaatag

SEQ ID NO: 125519 - DNA, 5814 bp, Artificial Sequence
  Description of Artificial Sequence: Synthetic coding sequence
atgtcagccagctcggatgccgaaatggcagtgttcggcgaagccgcgccttatctcagaaaaagcgagaaggagcggattgaggcacagaataaaccattcgatgccaaaacgtctgtgttcgtagcggagcccaaagaatcctatgttaagtccactattcagtctaaggagggcggcaaggtcacagtcaagactgaagggggggctactctcaccgttcgggaggatcaggtattcccaatgaatccaccaaaatacgacaaaatcgaagacatggccatgatgacccacctacatgaaccaggcgttctttacaacctaaaggaacgctacgcggcctggatgatttatacctattcaggcctcttctgtgtgactgtcaatccctacaaatggcttcccgtatacaaacctgaagtggtggcagcttatcgaggaaagaaacgccaggaggctcctcctcatatcttcagtataagcgacaacgcttatcagtttatgcttactgaccgcgagaaccaatccatcctcatcactggggagtctggagccggtaagacagtaaatacaaagcgagttattcagtacttcgccactatcgccgtgacgggagagaaaaagaaggatgaaagcgggaaaatgcaggggacactagaagatcagataatatccgccaatcctctgctcgaagccttcggtaatgctaaaaccgtcaggaacgataatagctcgcggtttgggaagtttataagaattcatttcggaaccactggcaagcttgcttcagccgacatcgaaacctatctcttggaaaagtcccgtgttacctttcaattgaaagccgagcgctcttatcacattttttaccagatcaccagcaataaaaaacccgatctaattgagatgttgctgataactacaaacccctacgactatgcctttgtgtctcaaggcgaaattaccgtgccatcaattgacgatcaggaggaactcatggccaccgactctgctatagacatcttggggttcactcctgaagagaaggtttctatttataagctcactggtgccgtaatgcattatggtaatatgaaatttaaacagaaacagagagaggagcaagctgaaccagacggcacggaggttgcggataaagccgcgtacctgcagtcactcaattccgccgacttactgaaagccttatgttatccccgcgtgaaggtaggaaacgaatatgtgacgaaaggtcaaacagtccagcaggtgtataacgctgtgggcgccctggctaaggcagtgtacgaaaagatgtttttgtggatggtgactcgcatcaaccagcagctagatactaagcagcccaggcaatacttcatcggtgtgctagatatcgccggatttgagatttttgatttcaactccctcgaacagctgtgcatcaacttcacaaacgagaagctccaacaatttttcaatcatcatatgtttgtactcgaacaggaggagtacaagaaagaaggaattgagtggacattcatcgatttcggaatggatctggccgcttgcattgagttgattgaaaagcctctgggaatctttagtattctcgaagaggaatgcatgtttcctaaggctaccgacactagcttcaagaataagctgtacgatcaacacttggggaagagcgccaattttcagaagcccaaggtcgtgaaaggaaaggcagaggcccacttctctttaattcactacgccggtaccgtggactataatatcaccggttggttggataaaaacaaggaccccctgaatgacacagtcgtgggcctctatcagaagagcgccatgaagactctggcctcactgttctccacctacgcatccgctgaagctgatagctcggccaagaagggcgcgaaaaaaaagggaagtagcttccaaaccgtgagcgctctgttcagggagaatcttaataaacttatgacaaaccttcgctctacccatccacatttcgtgaggtgtattattcccaacgaaaccaagacccccggagccatggagcatgagctcgtgctacatcagctgcgctgtaacggtgtgctggaaggtatccgcatttgccggaagggctttccatccaggattctctatggtgactttaaacagagatacaaggtgctcaacgcttctgccataccggaaggccagttcattgattcaaagaaagccagcgaaaagctgctcgcgtccattgacatagaccatacacaatacaagtttggacataccaaggtcttctttaaggcaggcctccttgggctgctggaggaaatgcgggacgaaaagctcgcccagatcatcacccggacgcaggcagtttgccggggcttcttaatgcgggttgaatatcaaaaaatgttacagcggcgggaggcccttttctgcatccagtataacgtcagggccttcatgaatgtgaagcattggccatggatgaagctgttctttaagatcaagcctcttctgaaaagcgcagaaactgaaaaggaaatggcaaccatgaaagaggagttccagaagacaaaggacgagcttgccaagtcggaggctaaacggaaggaattggaggagaagatggtaactctcctcaaggaaaaaaacgatctacagctgcaagtccagagtgaggcagattccctggccgatgccgaagaaaggtgcgagcagctaatcaaaaacaagatccaattagaggctaaaataaaggaggtgactgagcgggccgaggaggaggaggaaatcaacgcagagcttacggccaaaaagaggaagctggaggacgaatgctccgagctgaagaaagacatagatgacctggagttgactctcgcgaaggttgagaaggagaagcacgccaccgaaaacaaggtaaagaatctcaccgaggagatggcagggctggatgaaactatcgctaaactctctaaggagaaaaaagccttgcaggagacccaccagcaaaccctagacgatctgcaagccgaggaggacaaggtgaacatcctgaccaaggctaaaaccaagttagagcagcaagtggatgatctcgagggaagtctggagcaggaaaaaaagctgagaatggacttagagagggctaaaaggaagctagaaggagacttgaagttggcacaagagagcacgatggatatggagaacgacaaacagcagctcgatgaaaagctcgagaagaaggaattcgagatctcaaacctgatttccaagatcgaagatgagcaagcggttgagatccagttacagaagaagatcaaggagttacaagccagaatagaggagctgggggaagagatagaggccgagagggcatctcgggccaaggctgaaaaacagcgctcggacttgagccgggaacttgaagagatcagcgaaagactagaggaggccgggggcgccacctctgcccaggtggagcttaacaaaaagcgcgaagctgaatttcagaagctcaggcgagatctcgaggaggcgacattgcagcatgaagccatggtggctgctttgcggaaaaagcacgccgactcaatggctgaactgggcgaacagatcgataatctgcagagggttaaacagaagttggaaaaagaaaagtccgagttgaagatggaaacagatgacctttcctccaatgccgaagctattagtaaggcgaaaggcaacctcgagaagatgtgtcgaagcctggaagaccaggtgtccgaacttaagaccaaggaagaggaacaacagcgcctgatcaacgatcttacagcccagcgcgcaaggctacaaaccgaggctggcgaatacagtcgccaactcgatgagaaggacgccctggtcagccaactctcgcgttcaaaacaggccagcacgcagcaaatagaggagctgaaacatcagttggaagaggaaactaaggctaagaacgccctagcccacgctctccagtcgtcccggcacgactgcgatcttctgcgggaacagtacgaagaggagcaggaaggaaaggctgagctgcaacgggccctgagcaaggccaactcagaagtggcccagtggcgcactaagtacgagacagatgcaattcagcgtaccgaagaactcgaggaggctaagaagaagctagcccaaaggttgcaggaggccgaagagcacgtcgaggccgtcaatgcaaagtgtgccagcctggaaaagacaaagcaacggttacagaacgaagtagaagacctcatgttggacgttgaacgatccaatgctgcttgtgctgccctggacaagaaacagcgtaatttcgataaagtgctttccgaatggaaacagaagtatgaggagactcaggccgaacttgaagcttcccagaaagagtcccgctcgttgagtacagagctgttcaaggtgaagaacgtgtacgaggaaagcctggaccagctagaaaccctgaggcgggagaataagaatcttcagcaagagattagcgatctgaccgagcagatcgctgaagggggcaaacagattcacgaactggagaagattaaaaagcaggtggagcaagaaaaatgcgaaatacaagccgccttggaggaggcggaggcctccctggaacacgaggaaggcaaaatcctgcggatccaacttgaattaaaccaagtgaaaagcgaggtcgacaggaaaatcgctgaaaaggatgaggaaatagatcagctgaagcgcaatcatacaagggtcgtggagacgatgcaaagtaccctggacgcagaaatacgatctcgaaacgacgcgcttagagtgaagaaaaaaatggagggggatctgaacgagatggagatacagctgaaccacgcgaaccggctggcagcagagtccctaaggaattacaggaatacccagggaattctcaaggagacacaactgcacctggacgatgctttacgggggcaagaggacttgaaagagcaactagccatagtggagcgacgagctaacctgctgcaggccgagatcgaggagctatgggctacactggagcagacagagcgctctagaaagatcgctgaacaggagttactggacgcatcagaacgagtgcagctcttacacacccagaacacctctctgattaacacgaaaaaaaagttggagaatgatgtgtcccagctccagagcgaagtcgaggaggtgatccaggagagcaggaacgcagaggaaaaagcaaaaaaggccattacggacgctgctatgatggctgaggagctgaagaaagagcaggatacaagcgcccacctggaacgcatgaagaagaatctggagcagactgtgaaggacttgcaacaccggttggacgaagcagagcaacttgcgttaaaaggtggaaagaaacagatccagaagctggaagcacgcgtacgcgaactcgagggcgaagtagaaaacgaacagaagcggaacgcagaggctgttaaaggtcttaggaaacatgagagaagggtcaaggaactcacataccagacagaggaagaccgcaaaaacgtgttgcgacttcaagacttagtggataagttacaagccaaggttaagtcgtataaacggcaggccgaggaggctgaggaacagtctaacgccaacctatctaagtttaggaaattgcagcacgaactcgaggaggctgaggaaagagccgatattgctgagtcacaagtcaacaagctgagagtcaagtctcgggaggtgcacaccaagatttctgccgagtag

SEQ ID NO: 125520 - DNA, 5814 bp, Artificial Sequence
  Description of Artificial Sequence: Synthetic coding sequence
atgtccgcttcttccgacgctgagatggcagtgtttggtgaggcggccccatacctgcgcaagtccgaaaaggaaaggatcgaagcccagaataagccctttgacgccaagacatccgtatttgtggccgagcccaaggagagctatgtgaaaagtactattcaaagcaaagaaggtggtaaagtgacagtgaaaactgaagggggggctaccttaactgtgcgtgaggatcaggtgttccctatgaacccaccaaagtatgataagatagaggatatggctatgatgacgcatctccacgagcctggagttctgtataaccttaaggagcgttacgccgcatggatgatttatacctatagtggcctgttttgcgtgaccgtgaacccctataagtggttgcccgtctacaagccggaggtggttgccgcgtatcgaggcaaaaaaagacaggaggcccctccccatatcttctccattagcgacaatgcttatcaatttatgttaacagacagggaaaaccaatcaatcctgatcaccggcgagtcaggcgctggtaaaacagtcaatacaaaaagggtcatccaatatttcgctactatagccgtcactggcgagaaaaaaaaagatgaaagcggtaaaatgcagggtacactggaggaccagattatctcggctaatccactactggaggctttcggcaatgctaaaacggtgagaaatgacaactccagccgatttggaaaattcattaggatccatttcggaacaacagggaagctggcatctgccgacatagagacctacctcctcgaaaaatcgagagttacgttccagttaaaagccgagcgcagctatcacatcttctaccagatcacttccaacaagaagcctgatctcattgaaatgctgcttatcaccactaacccatacgattatgcctttgtgagtcagggggaaatcacagtgccatctatcgatgaccaggaggagcttatggctactgatagtgctatcgacattttagggtttacccctgaggaaaaggtttccatctacaaactcacgggggccgttatgcactacggaaatatgaagttcaagcagaaacaaagagaagagcaagccgaaccggatggaaccgaggttgctgataaggcggcttatctccagtcgctgaatagcgcggacctcctgaaggcgctctgttacccccgggtcaaagtaggtaatgagtatgtgacgaaaggccagacggttcagcaggtctataatgcagttggcgcgctcgccaaggctgtgtatgagaagatgttcctgtggatggtgacccgcatcaatcagcagttggatacaaaacagcctaggcagtacttcattggcgtacttgatattgcaggtttcgagatatttgattttaactcactggaacagctgtgcatcaactttacaaacgaaaaattgcagcagttcttcaatcatcacatgttcgttcttgagcaggaagaatacaagaaggagggcatcgagtggaccttcattgacttcggcatggatctggcagcttgcatcgagctcatcgagaagcccctggggatctttagtatcctggaagaagaatgtatgttcccgaaggctaccgatacaagcttcaagaacaagttatatgatcagcacttgggaaagtctgccaattttcagaagcctaaagtggtgaagggtaaggcggaagcacatttttcacttattcactacgcaggcaccgtcgattacaacataaccggatggctggataaaaataaagaccccctgaatgatacagtagtaggactgtaccaaaaaagcgctatgaagaccctcgcctccctgtttagcacttacgcatcagcagaggccgactcgagcgccaagaagggagcaaagaaaaaggggtcatcattccaaacagtgtcagctctgttcagggaaaaccttaataaattaatgactaacctgcgatccacacatcctcatttcgtgcggtgcattattccaaatgaaaccaagacaccaggtgcaatggagcacgagttagtgctacaccagctgcgatgcaacggagtattggagggaatccgtatatgccgcaagggtttcccatcaagaatactgtacggagactttaagcagcgatataaggttctcaacgcgagcgcaattcctgagggccaatttattgactccaagaaagcttctgagaagctgctggcttcaattgatattgaccacacccagtacaagttcggccatacaaaggtgtttttcaaagccggactgttgggtctgctggaggaaatgcgagacgagaagttagcgcagattatcactagaacgcaggctgtatgtcgggggtttctgatgagggtggagtatcagaagatgctgcagaggcgagaggccctgttttgcattcagtataacgtgcgtgccttcatgaacgtgaaacactggccgtggatgaagttgttttttaagatcaagccgctcttaaaatctgctgagactgaaaaggagatggctaccatgaaggaggagttccagaaaacaaaggatgagctagccaagagcgaggctaaaagaaaagaactggaggagaaaatggtgactctgctcaaagaaaaaaatgacttacaactgcaagttcagtccgaggctgatagtttggccgacgccgaagagcgatgcgagcagctcattaagaataagatacaactggaagccaaaattaaggaggtgaccgaaagggccgaagaagaggaggagattaatgccgaactgacagccaagaagcggaagttggaggacgaatgttcagaactaaagaaggacatcgacgacttggaacttacactggctaaggtcgaaaaagaaaagcatgccactgagaacaaagtgaagaacctgaccgaagagatggctggcctcgatgagaccattgccaagttgagcaaagagaaaaaagctcttcaggaaacccaccaacagaccctagatgatctgcaagccgaggaagacaaggtcaacattctgaccaaagccaagactaagctggaacagcaagtcgacgacctcgagggcagtttggagcaggagaaaaagctgaggatggatctcgagcgggcaaaacgcaaactggagggggatctcaagctagctcaggagtccaccatggacatggagaacgataagcagcaactggacgagaaattggagaagaaggaatttgagatctctaatttgatctcaaaaatcgaagatgaacaagcggtagaaattcagctgcagaagaaaataaaggagctgcaggctcgcatcgaggagctcggggaggagatcgaggctgaaagagctagtagagctaaagctgagaagcaaaggtccgacttgagccgtgagcttgaggagatctccgagcgcctcgaggaagcagggggcgccactagtgcccaggtagaacttaataagaagcgcgaggccgaatttcaaaagttgagacgggacctggaggaggctaccctccagcacgaagcaatggtagcggcgctaagaaaaaagcatgccgacagcatggctgagctcggagagcaaattgataacctccagagggttaaacagaaactggagaaagaaaaaagcgaacttaagatggaaaccgacgacttatcgtccaacgcagaggcgataagtaaggcaaagggaaacctggaaaaaatgtgccgtagtctcgaggaccaggtcagtgaactaaagactaaggaggaagagcaacagagattaattaacgaccttacagcacagagagctaggctccaaacagaggccggcgagtattcccggcagctcgacgaaaaagatgcactggtgtcacaactctctagatcaaagcaagcatctacgcagcagatcgaggaactgaagcatcagctcgaggaggagaccaaggcgaagaacgcattagcgcatgcccttcagtccagtcgacacgactgcgatctgctgcgggaacagtatgaggaggagcaagagggaaaagcagaattgcagagagctctcagtaaagctaactctgaagtggctcagtggcgaacgaagtatgagaccgatgcaattcagcgcaccgaagagctcgaagaggctaagaagaagctcgcccaacgcttgcaggaagctgaagagcatgtggaggcagtgaatgcaaagtgtgcttccctagaaaagacaaagcaacggttgcagaatgaggttgaggatctgatgttggacgtggagagatcaaacgccgcttgtgctgcccttgataaaaaacagcgtaactttgataaggtactctcagaatggaaacagaagtacgaagagacgcaggccgagctcgaggctagccagaaagagtcccgatctctgagcactgaactgtttaaagtcaagaacgtctatgaagaatcactggatcagctggagactttgaggcgcgagaataagaatctccaacaggagatctccgatctgaccgagcagatcgctgaaggtggcaagcagatacacgagcttgagaagatcaagaaacaagtggaacaggagaagtgcgagatccaagcggcgctggaggaggctgaggccagcttggaacacgaggaggggaaaatattgagaatccaactcgagttaaaccaggtaaaaagtgaagtggataggaaaatcgcggagaaggatgaggaaattgatcagctgaagcgcaatcacacgagggtggtggagaccatgcagtccaccctggatgccgaaattcggtccagaaacgacgccctgcgcgttaagaaaaagatggagggggacttgaacgagatggaaatccagctgaaccacgcgaataggctagccgccgaatctctccgtaattataggaacacgcaggggatactgaaggagacccagctgcacctggacgacgcacttcgcggtcaggaagacctaaaggaacagcttgccatagtcgaacgtagggcgaacctcctccaggccgagatagaagaactgtgggcaacactggagcaaaccgaacggtctaggaaaatcgcggagcaagagcttctagacgcttccgagcgcgttcagctgctccacacccaaaacacctcactgataaatactaagaagaaactggagaatgatgtatcccaactacagtccgaggtggaggaagtgattcaagagtctcgcaacgcagaagagaaggccaaaaaggcgatcactgacgctgccatgatggccgaggaactgaagaaggaacaggacacctcagcccacctagagaggatgaaaaaaaatctcgaacaaactgtgaaggacctgcagcaccgcttggatgaagccgagcagctggctcttaagggcggtaagaaacagatccagaaactggaggctagagtcagggagctcgaaggcgaggtggagaatgagcagaaaaggaatgcggaagctgtgaaaggcctccggaagcacgaacgcagggtgaaagaactaacatatcaaaccgaggaagaccgtaagaatgttttacgattgcaagacctggtggacaagctacaggcgaaggttaaatcctacaagcgacaggctgaggaagctgaggagcagtccaatgctaatttgagcaaattccggaagctgcagcacgagctagaagaagccgaggaacgggccgatatcgcagagtcacaggtcaacaaattaagggttaagtcacgtgaggtgcatacaaaaatttcagccgagtag

SEQ ID NO: 125521 - DNA, 453 bp, Artificial Sequence
  Description of Artificial Sequence: Synthetic coding sequence
atgtctttttctgcagatcagattgcggaattcaaagaggcgttcctactgttcgatagaaccggagatagcaaaatcaccctcagccaggtaggggatgtgctgcgggctctcgggaccaatcccacaaacgcagaagttagaaaggtccttgggaaccctagcaatgaagaacttaacgctaagaagatcgaattcgaacagttcctgcccatgatgcaggcaatatcaaataataaagatcaagcgacctatgaggactttgtagaaggtttacgtgtgttcgataaggagggcaacggtacggtaatgggggctgaactccggcacgtgctcgccaccctgggcgagaaaatgaaggaggaggaagtagaggctcttatggctgggcaagaggactctaatgggtgcatcaactacgaggctttcgtgaaacacattatgtctatttag

SEQ ID NO: 125522 - DNA, 585 bp, Artificial Sequence
  Description of Artificial Sequence: Synthetic coding sequence
atggctcccaaaaaagatgtcaaaaaacccgtagccgctgccgccgccgccccagcgcctgccccagcccccgccccagctccagctcctgcaaagccaaaggaggaaaagatcgatttatcagcgatcaaaatcgaattttccaaagagcagcaggacgaatttaaagaggcttttctgctattcgacagaaccggcgattccaagattacgttatcacaagttggggacgtgcttcgtgccttaggtactaaccccaccaatgcagaagtgcgcaaggtgctggggaatcctagcaacgaggagctcaatgcgaaaaaaattgaattcgagcaattcctaccgatgatgcaggccatctccaacaataaggaccaggcaacctatgaggacttcgtggagggacttagagtcttcgataaggaggggaatgggacggttatgggagccgagctgcggcacgtgctagccactctgggggaaaaaatgaaagaggaagaggtcgaagctttgatggccgggcaggaggactccaacggttgcattaactacgaggcctttgtaaaacatatcatgtctatctag

SEQ ID NO: 125523 - DNA, 519 bp, Artificial Sequence
  Description of Artificial Sequence: Synthetic coding sequence
atgtcatccaagaaggcaaaaacaaaaactaccaagaagaggcctcagagagctacatctaacgtgtttgccatgtttgaccagtcacagatccaggaattcaaagaagctttcaatatgatcgatcagaaccgggacggatttatcgacaaagaggatcttcacgacatgctggcctctcttggaaaaaaccctacagatgcttacctggatgcaatgatgaacgaagctcctggtccaatcaattttaccatgtttttgaccatgtttggggaaaaactgaacggaacagatccagaagatgttatccgtaatgcgttcgcttgttttgatgaggaagcaacaggaaccatccaggaagactacctgcgcgaactgctgacaacaatgggcgatagatttaccgacgaggaggtggatgagctctacagagaagctcctattgacaaaaaggggaatttcaactacattgaattcaccaggatcctgaagcacggcgccaaggacaaggatgattag

SEQ ID NO: 125524 - DNA, 519 bp, Artificial Sequence
  Description of Artificial Sequence: Synthetic coding sequence
atgtcctctaaaaaggccaagactaagactaccaaaaagagacctcagcgggccacttccaatgtatttgctatgtttgatcaatcccagatccaagagtttaaggaggcctttaacatgatcgatcagaatcgagacggattcatcgacaaagaggacctgcacgacatgttagcctcccttgggaaaaaccctacagacgcctaccttgacgcaatgatgaacgaagctcccggtcccattaactttacaatgttcctcacaatgttcggcgaaaaactaaacggaacagatcccgaggatgtgatacggaacgcattcgcatgcttcgacgaggaagccaccggcacaattcaggaggattatcttagggagctgctgaccacaatgggtgacaggttcacagacgaagaagttgacgaactctaccgagaagcccccatcgataaaaaagggaactttaattatatcgagtttacaaggatcctgaagcatggtgccaaagataaagatgattag

SEQ ID NO: 125525 - DNA, 519 bp, Artificial Sequence
  Description of Artificial Sequence: Synthetic coding sequence
atgtcatccaaaaaagctaaaacaaaaaccacaaagaaacgcccgcaaagagctacttcgaatgtcttcgctatgttcgatcagagccagatccaggagttcaaagaggcgttcaacatgatagaccagaatcgggatggctttatagataaggaagacctccatgatatgcttgccagcctgggcaagaaccctaccgatgcttacctggatgctatgatgaacgaggccccagggccaataaacttcactatgtttcttacaatgttcggtgaaaaactcaacggcacagatcccgaagatgtgattcggaacgccttcgcttgctttgacgaggaggccaccggaacaatacaggaggactacttgcgggagctgcttacaacaatgggcgaccggtttactgatgaagaagtagacgaactgtaccgggaagcacctatcgacaagaaaggtaattttaactacattgagttcactcgtattctcaagcatggagccaaggataaagacgactag

SEQ ID NO: 125526 - DNA, 519 bp, Artificial Sequence
  Description of Artificial Sequence: Synthetic coding sequence
atgtcctccaaaaaggctaaaactaaaactaccaagaaaagaccacagcgcgcaacttcgaatgttttcgcaatgttcgatcaaagtcagatacaggaattcaaggaggcatttaatatgattgaccagaacagggatggttttattgataaggaggacctacatgatatgctcgccagccttggtaagaatcctacggatgcctatctcgatgcgatgatgaatgaggcccctgggccaatcaatttcaccatgttcttaacaatgtttggtgagaagcttaacggaacagacccggaggacgtgattagaaacgcattcgcctgcttcgacgaagaagccaccggtacaattcaggaggactatctgagggaacttctcaccacaatgggagaccggtttacggatgaagaagttgacgagttgtatagggaggctcccattgacaaaaaaggaaatttcaactatattgaatttacaaggatcctcaaacatggagccaaagacaaagatgactag

SEQ ID NO: 125527 - DNA, 627 bp, Artificial Sequence
  Description of Artificial Sequence: Synthetic coding sequence
atggcactggggcagaaactgttcataacgatgagtagaggggccggccgtctccagggcactctatgggccctcgtcttcttaggtatcctggttggaatggtcgttccttctcccgcagggacaagggccaacaatacactgttagatagcaggggctggggcacgctcctcagccggtctcgggccgggctggcaggagaaatcgcaggcgtgaactgggagtccgggtacctcgtgggcatcaagagacagagaagactatactgcaatgtgggaatcggattccaccttcaggtcctgcctgatggccggatctctggaacccatgaagagaatccatacagcttgcttgagatctctacagttgaacgcggggtcgtgtcattgttcggtgtcagatcagcgttgttcgtggcaatgaattctaagggtcgtctgtatgccactcccagcttccaggaggagtgtaaattccgagagacactccttcccaataattacaacgcatatgaatcagatctgtaccagggcacctatatcgctctgagcaaatacggccgcgttaaacggggctcaaaggtaagcccaatcatgaccgtgacccacttcctgccacggatctag

SEQ ID NO: 125528 - DNA, 588 bp, Artificial Sequence
  Description of Artificial Sequence: Synthetic coding sequence
atggcccctaaaaaaccagagcccaagaaagacgacgctaaggccgcgccgaaagccgccccggctcctgctcctccgcccgaaccagaacggccaaaggaagtggaatttgatgccagcaaaatcaagattgagtttactcctgaacagattgaagagttcaaggaggccttcatgctgttcgacagaactccgaaatgcgaaatgaaaattacttatgggcagtgtggggacgtgctcagagctctcggtcagaacccgactcaggccgaggtcctgcgagtgctgggcaagccacggcaggaggagcttaacacgaaaatgatggatttcgaaaccttcttgcccatgctccagcatatcagcaagaataaagacacagggacttatgaggattttgtagaagggctgcgtgtcttcgacaaggaggggaacggcaccgttatgggggctgaactccgccacgtgctggccacgctcggcgagcgcctgaccgaggatgaggtcgagaagctgatggccggtcaggaggactctaatggatgtatcaactatgaagcgtttgttaagcacattatgagcagctag

SEQ ID NO: 125529 - DNA, 588 bp, Artificial Sequence
  Description of Artificial Sequence: Synthetic coding sequence
atggccccaaagaagcccgagccaaaaaaagacgatgctaaagccgcaccaaaagccgcccccgccccagcaccaccccctgagcctgagagacccaaggaggtcgagttcgacgcctccaagatcaaaattgagtttacccctgagcagattgaagagttcaaggaagccttcatgctgttcgatcgcacaccaaagtgcgagatgaagatcacatacgggcaatgtggcgatgtgttgcgagccctgggtcagaaccccacacaggccgaagtgctgcgcgtgctcggaaaacctcggcaggaagaactcaataccaaaatgatggattttgagactttcttgccgatgctgcagcatattagtaaaaataaagacaccggcacatatgaggactttgtcgagggcttaagagtgtttgataaagaggggaacggaaccgtcatgggagccgagctgcgccatgtgctggcaaccctcggcgaacgcttgaccgaggatgaggttgagaaactgatggccggccaggaggattcaaacgggtgcataaattatgaggctttcgttaagcatatcatgtcaagctag

SEQ ID NO: 125530 - DNA, 141 bp, Artificial Sequence
  Description of Artificial Sequence: Synthetic coding sequence
atggccccaaagaaaccggagcctaagaaagacgacgctaaagctgcaccaaaggcggctccagcccctgcgccccctcctgagccggagcggccgaaggaggtggaatttgatgcttcgaaaataaagatcgaattctag

SEQ ID NO: 125531 - DNA, 594 bp, Artificial Sequence
  Description of Artificial Sequence: Synthetic coding sequence
atggcacctaaaaaacctgagccgaagaaagaagcagcaaagcctgccccagctcccgcccccgcccccgctccagcccccgcccccgcaccagaagctccgaaagaacctgcatttgaccctaagtccgtcaagatcgattttaccgccgaccaaatcgaggagtttaaggaggctttttctctttttgacagaacaccaacaggagaaatgaaaattacctatggacaatgcggagatgtgctgcgggcactcggtcagaatccgacaaacgctgaagtgttgagagtgttgggcaaaccaaagcctgaagagatgaacgtgaagatgttggatttcgagacattcctgccaattttacagcatataagtaggaataaggaacaggggacctacgaagacttcgtggaaggtctgcgtgtgtttgacaaggaaagcaacggaactgtgatgggtgcggaactgaggcacgtgctcgcaaccttaggcgagaagatgacagaagctgaagtggagcagttgctcgccggccaggaggacgctaatggttgcattaattacgaagcttttgttaagcatatcatgagcgggtag

SEQ ID NO: 125532 - DNA, 594 bp, Artificial Sequence
  Description of Artificial Sequence: Synthetic coding sequence
atggcaccaaagaagccagaacctaagaaagaggccgctaaacccgcacctgctcccgcacccgcccccgctccagcgcctgctccggccccggaggcacccaaagaacccgccttcgatccaaaatctgtgaagattgattttaccgctgatcaaatagaagagtttaaggaggcgtttagcctgttcgatcgaacccccactggagagatgaagatcacttacggccagtgcggggatgtactgcgcgcccttggccaaaatccaacaaacgcagaggtccttagggttttaggaaaaccaaaaccagaagaaatgaatgtgaagatgttagatttcgagacgttcctgccgattttgcaacatatcagccgaaacaaggaacagggcacgtacgaggacttcgtcgaagggctgagggtttttgacaaggaatctaacggtactgtgatgggtgccgagctgaggcatgtgctggccacccttggcgaaaagatgaccgaggccgaggttgagcagctcctggctggccaagaggacgcgaacggatgcattaactacgaggcctttgtgaaacatatcatgtccggatag

SEQ ID NO: 125533 - DNA, 264 bp, Artificial Sequence
  Description of Artificial Sequence: Synthetic coding sequence
ccagaggctcccaaggagccagcattcgatccaaaaagcgtgaaagttattggatgtccctgtccccgctctcagtctcatggggctgtgatcgacttcacagctgaccagatcgaagagttcaaggaagccttcatgggagctgagctcaggcacgtgctggcaaccctggtcattaagtcagctcctccgcctaaaccaaccgccggagagaagatgaccgaggcagaagtggaacagttgctggctggacaggaagattag

SEQ ID NO: 125534 - DNA, 522 bp, Artificial Sequence
  Description of Artificial Sequence: Synthetic coding sequence
atggcaagccgaaaaacaaagaagaaagagggcggcgctctgagggcccaaagagcctcatccaatgtgttctctaactttgagcaaacacagatccaagaattcaaagaggctttcaccctcatggatcagaatcgggatggcttcattgacaaagaggatttgaaggatacttacgccagtctcgggaaaaccaacgtgaaagacgatgaactggacgccatgttaaaggaggcctctggaccaataaatttcacgatgttccttaatctgtttggggaaaaacttagcggtacagacgctgaagagactattctgaatgcgttcaagatgttagaccctgacgggaagggcaaaataaataaggaatacattaaaaggcttcttatgtcccaggccgacaaaatgacagccgaagaagtagaccaaatgtttcagtttgcaagtattgacgtggcagggaacttggattacaaggcacttagctatgtaatcactcatggcgaagagaaggaggaatag

SEQ ID NO: 125535 - DNA, 399 bp, Artificial Sequence
  Description of Artificial Sequence: Synthetic coding sequence
atggaccagaatcgggacgggttcatagataaggaggacctgaaggatacttacgcatctcttggcaagacaaatgttaaggatgacgagttggacgccatgctcaaggaggctagcggaccaatcaattttactatgttcctgaacttgtttggcgagaagttgtccggaacagacgccgaggagaccatcctgaatgccttcaagatgttggatcctgatgggaaagggaaaataaataaagagtatattaaacgacttttgatgtctcaggcagacaaaatgacagccgaagaagtagatcagatgttccagtttgcttctatcgacgtcgccggtaacctagattacaaagccttaagttacgtcatcacgcacggcgaagaaaaggaggagtag

SEQ ID NO: 125536 - DNA, 399 bp, Artificial Sequence
  Description of Artificial Sequence: Synthetic coding sequence
atggatcagaatcgggatggcttcatcgataaggaggacctcaaggacacctacgcctcactgggcaagacaaacgtcaaagacgatgagttggatgcgatgctgaaggaggcgtctggtcctataaacttcaccatgtttcttaacctatttggggaaaagctctctggcactgacgccgaggagacaatcctaaacgcttttaagatgctggacccggacggtaaggggaaaattaataaggagtatatcaaaagactgctgatgtcacaggccgataagatgactgcagaggaggtagaccaaatgttccagttcgcctctatcgacgtggccgggaacctcgactacaaggcgttatcctatgtcatcactcacggggaagaaaaagaggagtag

SEQ ID NO: 125537 - DNA, 399 bp, Artificial Sequence
  Description of Artificial Sequence: Synthetic coding sequence
atggatcagaatagggatgggttcatcgacaaggaagaccttaaagacacctacgcctctctggggaagacgaacgttaaggacgacgaactggatgccatgctgaaggaggcgtctggccccatcaattttaccatgtttctaaatctgtttggagagaagctatctggtacagacgctgaagaaaccatcctgaatgctttcaagatgcttgaccctgacggcaaaggcaaaattaataaagaatatattaagagactcctgatgtctcaggcggataaaatgaccgctgaagaggtagaccagatgttccagtttgcttctatcgacgtcgccggcaacctggactacaaggcccttagctatgtgattacccacggtgaagagaaagaagagtag

SEQ ID NO: 125538 - DNA, 456 bp, Artificial Sequence
  Description of Artificial Sequence: Synthetic coding sequence
atgtgtgactttaccgaagatcagacggctgagtttaaggaagcattccagctctttgatcgtaccggcgacgggaaaatcttatatagtcagtgcggggatgtaatgagagctctcggtcagaatcctacaaatgccgaagttttgaaggtgctaggaaatcccaagtcagatgaaatgaatgtcaaggttctggacttcgagcacttcctccctatgctccagacagtggccaagaataaggaccaggggacttatgaagactacgtggaggggctcagggtgttcgacaaagaaggcaatggcacagtgatgggtgccgaaatcaggcacgttctagtgacactgggggagaaaatgacagaagaagaagtggagatgctggtggcggggcatgaagatagcaatggatgcatcaactacgaagagctcgtgcggatggtgctgaatggctag

SEQ ID NO: 125539 - DNA, 456 bp, Artificial Sequence
  Description of Artificial Sequence: Synthetic coding sequence
atgtgcgacttcaccgaagaccaaaccgctgagtttaaggaggcctttcagctgtttgacagaacaggagatggcaaaatcctgtacagccagtgcggggacgtgatgcgcgctcttgggcagaaccctaccaacgccgaggttcttaaagtgctggggaaccctaaatctgatgagatgaacgtcaaggttctggatttcgaacactttctacccatgttgcaaactgtggccaagaacaaggatcagggcacctatgaggactatgttgagggcttacgggtttttgacaaagagggaaacgggactgtcatgggggccgagatccgccacgtcctggtgactctcggcgagaagatgacagaagaagaagtggaaatgctggtcgctggccatgaggacagtaatggatgtatcaactatgaagcctttgtccgtcacatattgagcggatag

SEQ ID NO: 125540 - DNA, 456 bp, Artificial Sequence
  Description of Artificial Sequence: Synthetic coding sequence
atgtgtgactttacagaggaccagaccgctgagttcaaagaggcatttcagctgtttgacagaacaggcgatggtaagatactgtatagccagtgcggtgatgttatgcgtgccctcggccagaaccctaccaatgccgaggtgttaaaagtgttaggcaaccccaaaagcgatgagatgaacgttaaggttcttgacttcgagcacttcttacccatgctccaaactgtggccaagaataaggatcaagggacatacgaggattacgtggagggactgcgggtgttcgataaggagggcaatggaacagtcatgggcgccgaaatcaggcatgtactcgtgacgctcggtgagaagatgaccgaggaggaagtagaaatgctcgtggccggccatgaagattctaatggatgtatcaattacgaggctttcgttagacacatcctatccggatag

SEQ ID NO: 125541 - DNA, 1491 bp, Artificial Sequence
  Description of Artificial Sequence: Synthetic coding sequence
atgtcatccatggaggaaatacaagtagaactgcaatgcgctgacttatggaaacggtttcacgacatcggcaccgaaatgatcattaccaaggctggacgccgcatgttcccagccatgcgggtgaagatcactggcttggacccccatcagcagtactatatcgctatggacatcgtacctgtagataacaaaagataccgctatgtgtaccacagtagtaagtggatggttgcaggaaatgccgactcccccgtcccgcctagggtttacatccatcccgactctctggctagtggagacacctggatgcgacaggtggtctccttcgataagctaaagttgacaaataacgagctcgatgaccaaggccacattatcttgcattccatgcataagtatcaacccagagttcatgtcattcgtaaggactttagttctgacctgagcccgacaaaacccgtccccgtcggggatggcgttaagacatttaactttccagaaaccgtattcactaccgtaacagcgtaccagaatcaacagataacccggctgaagatagataggaacccattcgccaaaggattccgggacagtggacgaaaccggacaggtctcgaagcaataatggagacttacgcattctggcgtcctccagtcaggactctgacatttgaggatttcactaccatgcaaaaacagcagggcgggtccactggtacctctcctacaacaagctccacaggaacgccctcgccgagtgcctcatctcacctactgagcccatcctgctcccccccaacattccacttagcaccaaacaccttcaatgtagggtgcagggagtctcagctgtgcaatctgaatctcagtgactaccctccttgtgcccggagcaacatggccgccctgcagagctatcctggcttatcagacagcggatacaacagactgcagtcagggactacatctgccacacagcccagtgagacgtttatgccccaaagaacgcctagcctgatctcagggattcccactcccccttcacttccagggaatagtaagatggaggcctatggaggccagctgggaagctttccgactagccagttccagtatgttatgcaggctgggaacgctgcgtccagctcctcatccccccacatgtttggcggcagccacatgcaacagtcatcttataacgcattttcacttcataacccttataacctgtacggctacaactttcctacgtcacccagactcgccgccagcccagagaagctgtctgcttctcagtccaccctgctgtgcagtagcccgagcaacggggcctttggggagcggcagtatctgccctcaggcatggaacactccatgcatatgatatccccatcacccaataaccagcaggcgaccaatacatgtgacggcaggcagtatggggctgtccccggctcaagcagccaaatgtccgttcacatggtctag

SEQ ID NO: 125542 - DNA, 627 bp, Artificial Sequence
  Description of Artificial Sequence: Synthetic coding sequence
atgccccctaagaaggacgtgccagtgaagaaacccgcgggtccgtccatctccaaacctgcagccaagccggcggccgcaggcgcacctcccgcaaaaacaaaggcagaacctgccgtaccccaggctccgcagaaaacccaggagcccccagtggacttatcaaaagtagttattgaattcaataaggaccagcttgaggaatttaaggaggcatttgagctctttgatcgtgtgggggatggcaagatcctgtacagtcaatgcggcgatgtgatgcgcgccctcggacaaaatcctacaaacgcagaagtcctcaaagtcctgggcaatccaaaaagcgacgaactcaagagccgccgagttgacttcgagaccttcttacctatgctccaagctgtggccaagaaccgtggccaagggacctacgaagactacttggagggattcagagtcttcgataaggaaggaaatggcaaggttatgggggccgagctccgccacgtgctgacaactctaggagagaaaatgacggaagaggaagtggaaaccgttctggcaggccatgaggactcgaatggatgtattaattatgaggctttcctgaaacatatcttgtctgtgtag

SEQ ID NO: 125543 - DNA, 90 bp, Artificial Sequence
  Description of Artificial Sequence: Synthetic coding sequence
atgccacccaagaaggacgtccccgtcaaaaaacctgccgggccttccattagcaagcctgcggctaagccagcagctgccggggcctag

SEQ ID NO: 125544 - DNA, 627 bp, Artificial Sequence
  Description of Artificial Sequence: Synthetic coding sequence
atgccccccaagaaggacgttccagtcaagaagcccgcaggcccctcgatttccaaacctgcggccaagcctgcagccgcgggggcaccacccgccaagactaaggcagaaccggcggtgccacaagcaccacagaaaacccaggaacccccagtggatttgtccaaggtagtgatcgagttcaacaaagatcaactagaagaattcaaggaagccttcgaactgtttgaccgggttggtgatggtaaaattctatattcccagtgtggggatgtgatgcgcgccctggggcaaaatcctactaatgcagaggtgctcaaggtgcttggaaacccaaagagcgacgaacttaaatcccgccgagtcgattttgaaaccttcctgcctatgctccaggcagttgcgaaaaatcgcggacaaggcacatatgaggactatctggaggggttcagggtcttcgacaaagaggggaacggcaaagtgatgggtgcagagttgcgccacgtgctaacgacactgggcgagaaaatgactgaagaagaggttgagaccgttctagcgggccacgaagactccaatggctgcattaactatgaagcatttctcaagcacatcctgtctgtttag

SEQ ID NO: 125545 - DNA, 3477 bp, Artificial Sequence
  Description of Artificial Sequence: Synthetic coding sequence
atggctgcagtccggggcgcccctttattgagctgcctgctcgcattgctcgctctgtgcccaggcggccgacctcagaccgttctcactgacgacgagattgaggagtttttggaaggctttctctcagaactggagccggagccccgggaggacgatgtagaagcaccaccaccacctgagcccactccccgggttagaaaagcacaggcaggaggaaagcctggcaaaaggccagggaccgcagccgaagtgccgccagaaaagactaaggacaaggggaagaagggcaagaaagataagggccctaaagttcctaaggagtctctcgaaggctcgccaagaccacctaagaaggggaaagaaaagcctccaaaggccacaaagaaaccgaaggaaaaaccgccaaaggcaacaaagaaacctaaggaaaaaccccctaaagcaaccaaaaagcctaaagaaaaacctcccaaagccacgaagaagccaccgtctggcaagaggcctcccatcctggccccctctgaaacccttgagtggccgctgcccccacctccgtcccctgggcccgaagagttacctcaggagggaggggccccactatcgaataactggcagaaccccggggaggaaactcacgtggaagcccgcgaacatcagcctgaacctgaggaagagaccgagcagcccaccctggactacaatgaccagatcgaacgtgaagattacgaggacttcgaatacatcagaagacagaagcagccacggccacccccaagcaggcggaggagaccggagcgagtatggcccgaacctccagaagaaaaggccccagcacccgcccccgaggagcgtatagaaccaccagtcaagcctctgctgcctcccctaccacccgattatggcgacgggtacgtgataccgaactacgatgatatggattactacttcggcccccctccaccacagaaaccagacgcagaacgacagacggatgaagagaaggaggagctgaagaagccaaagaaggaggactccagccctaaagaagagactgacaaatgggccgtcgagaagggcaaagatcacaaggagccccggaaaggagaagagctggaggaggaatggaccccaacagagaaggtgaaatgtccacccattggaatggagtcccatcgaatagaagacaatcagatacgcgcatcatccatgcttagacacggccttggggcgcaacgtggccgattgaacatgcagacaggcgcgactgaggacgactactacgacggtgcctggtgtgccgaggacgacgcaagaacccagtggatcgaggttgacaccagacgcacaacaagatttacgggggtcataactcagggcagagattcgtccattcacgacgattttgttaccacatttttcgtgggcttcagcaatgatagtcagacctgggtgatgtataccaacggttatgaagaaatgacttttcacgggaatgtcgataaagacacgcctgtgctgtcagagcttcctgaaccggtcgtcgctaggtttatccggatctatccactgacatggaatggcagtctttgcatgaggctggaggttctaggatgtagtgtggcacccgtgtactcttactacgcacagaacgaggttgtggccaccgatgacttagacttccggcatcatagttacaaagacatgcggcagcttatgaaggtggtgaatgaagagtgcccgactatcactaggacatacagtctggggaaaagctctcggggactcaaaatttacgcgatggagattagtgataacccaggagaacacgagctaggcgagcctgaattccggtacactgccggaattcatggaaacgaggttcttggcagggagctcctgctgctgctgatgcaatacttatgtcgagagtatagagatggcaatccacgggttcgcagcctggttcaggacacccgcatccatctagttcctagcctcaatccagatggctatgaagtcgcagcccagatggggagcgagtttggcaattgggcactgggtttatggactgaggagggatttgacatattcgaagacttcccagacttgaactctgtactgtggggcgcagaagaaaggaagtgggtcccctatagagtcccgaacaacaacctccccatccctgagaggtatttatcaccggatgccacagtcagcaccgaagtgcgtgccattattgcctggatggaaaagaaccctttcgttctcggggcaaacctgaacgggggggaaagattggtctcatacccttatgacatggccaggacaccaacacaggagcagttgttggcagcagcaatggccgcagccaggggggaagacgaagacgaggtcagcgaggcccaggagacccccgaccacgccatctttcgctggttagccattagctttgccagcgctcacctgactttaaccgaaccctaccgaggcggttgccaggctcaggactatacaggcggaatgggaatcgtgaatggggccaaatggaatccccgtacaggaaccatcaacgatttctcctatcttcatactaattgtctggagctgtccttttaccttggctgcgataagttcccccacgagagcgagctccctcgtgagtgggagaataacaaggaggctctgctcaccttcatggagcaggtgcaccgggggatcaagggagtggtgaccgacgagcaaggaattcccatcgccaatgctaccatatctgtgtccggtatcaatcacggcgttaaaacagcatcaggcggagattattggcgtatattgaaccctggcgaatatcgcgtaacagcccatgctgagggctatacaccgtccgctaagacctgtaatgtggattacgacattggagccactcagtgcaatttcattctggctaggagtaattggaagcggattcgcgaaattatggcaatgaatgggaatcgacctattccccatatcgatcccagccgaccgatgactccacagcaaaggcgtttgcaacaacggaggctgcagcatcggctcaggctgagggcacagatgagactccggagattgaatgcgactaccactttaggcccacacaccgtgccccctacgctccctcccgcacctgcgaccactctctctacaacgatcgagccctggggcctaatccccccgaccacagcagggtgggaggaaagcgaaaccgagacatatactgaagtggttacggagttcggaaccgaagtggaacctgaatttggaactaaggttgaacccgaattcgaaactcagttggagccagaattcgaaacccaactcgaacctgagttcgaggaagaagaggaagaggaaaaagaagaggagatagcaacgggccaagcattccccttcacaaccgttgaaacgtacaccgttaatttcggcgatttctag

SEQ ID NO: 125546 - DNA, 447 bp, Artificial Sequence
  Description of Artificial Sequence: Synthetic coding sequence
atgttcgaacaggcccagatccaggagtttaaggaagcatttagttgcatcgatcagaatcgagatggcattatctgcaaggccgatttgcgcgaaacctatagtcagctgggcaaagtgagtgtgccagaagaggagctcgacgcaatgctgcaggaaggcaagggccccattaactttaccgtgttccttacgctgtttggagagaaactgaacgggaccgaccccgaggaagccatcctctccgccttccgcatgttcgaccctagcggaaagggcgtggtgaacaaggacgagttcaagcagctgttactcactcaggctgacaagttttccccagccgaggtcgaacagatgtttgcactgacacccatggatctggcgggtaatattgattacaagtctctttgctatatcatcactcacggagacgagaaagaagaatag

SEQ ID NO: 125547 - DNA, 1128 bp, Artificial Sequence
  Description of Artificial Sequence: Synthetic coding sequence
atgcagaaactgcaactctgcgtgtacatctatctgttcatgcttatcgtggccggacccgtcgatttgaacgagaatagcgagcaaaaggaaaatgtcgagaaagaagggctctgcaatgcttgtacatggagacagaacacaaaatctagcagaattgaagccatcaaaatccagatattgtccaaactcaggcttgagacagcccctaatattagtaaagatgtcatcaggcagctcttacctaaggctccaccactccgggagctcatcgaccagtacgacgtccagcgcgacgattcatccgatggttcgctggaagacgatgactaccacgccaccaccgaaacaattatcaccatgcctacggagtccgattttcttatgcaggtggacggcaaacctaagtgctgctttttcaaattcagctctaaaattcagtataataaagtagtcaaggctcaactgtggatttatcttcggcctgtggagacgccaaccacagtgttcgtgcaaattcttcggcttattaaacctatgaaggacggcacaagatataccgggatcagatctctgaagctggatatgaaccccgggactgggatctggcagtctatcgacgttaagaccgtgctgcagaattggctcaagcagcctgagagcaaccttggaatagagatcaaggcgctggacgagaacgggcatgacctggctgtgacattccccgggcctggtgaggatggactgaatccgttcctggaggtcaaagtcaccgacaccccaaaacgctcacggcgggatttcggcttggactgcgatgaacacagcaccgagtcgcgctgttgccgttatcccctgaccgtagatttcgaggcatttggctgggactggatcatcgcgccaaaacgttacaaagccaattattgctccggagaatgcgaatttgtgtttctccagaagtatccacatactcatctggtgcaccaggccaacccaagaggatcagcaggcccttgctgtactcccacaaagatgtcacccatcaacatgctttacttcaacgggaaggagcagatcatctatggaaagattcccgctatggtggttgaccgatgcggctgttcctag

SEQ ID NO: 125548 - DNA, 1497 bp, Artificial Sequence
  Description of Artificial Sequence: Synthetic coding sequence
atgttcaactacgaaagaccaaagcacttcatccagtcacagaatccctgtggttcaagattacaaccgcccggacccgagacgtcatccttttccagccaaaccaagcagtctagcatcataatccagccccggcaatgtaccgaacagcgcttcagcgcctccagcacactgagtagtcatatcaccatgtcttcctctgcttttcctgcaagtcccaaacagcacgccggcagcaacccgggacagcgcgtgactactacctacaaccaatcacccgcctcctttctcagtagcatccttccatcacagcctgattataattcgagcaagatcccttctgccatggattcaaactaccagcaatcctctgctgggcagccgatcaacgccaaaccaagtcagacagccaatgccaagcccatccctcgcactcctgaccatgagattcagggttccaaggaagctctgatacaggaccttgaaaggaaacttaaatgtaaggatacgctcctccataatgggaatcaacgcctgacatatgaggagaaaatggcccgccggttactcggcccccagaacgctgctgctgtcttccaggcgcaggacgacagtggggcccaggactctcagcagcataacagtgagcacgcgcgactacaagtccccacgagtcaggtgagatctcggagtacgtcccggggggacgtgaatgaccaggacgctatccaggagaaattttatcctcctaggtttattcaggtgccagagaatatgtccattgatgaagggcgcttttgccgaatggattttaaggtatctggtctccccgctcccgacgtgtcttggtatctaaacggccgcacagtgcagagtgatgacctccacaagatgattgtctcagaaaaaggtttacactcgctgatattcgaagtcgtaagagccagcgacgctggagcctacgcctgtgtggccaagaatagagccggtgaggccacctttacggtccaactggacgtccttgcaaaggagcataaacgggctcccatgtttatttacaaaccacagagtaaaaaagtcctggaaggcgattccgtaaagctcgaatgtcagattagcgctatcccacctcctaagttattttggaagcgcaacaatgaaatggtgcagttcaatacagatcgcatcagcctctatcaggataatactgggcgagtgactctcctaatcaaggacgtcaataaaaaggacgcaggttggtacaccgtttctgccgtgaacgaggcaggcgtaactacctgtaataccaggttagatgtgaccgctcgccccaatcagaccctacctgcacctaaacagctccgggtcaggccaacattcagcaaatatctggcactgaatggaaagggcctgaatgtgaagcaggccttcaacccagaaggcgaatttcagcgccttgccgcgcaatcgggcctatacgaatccgaggagctgtag

SEQ ID NO: 125549 - DNA, 945 bp, Artificial Sequence
  Description of Artificial Sequence: Synthetic coding sequence
atggctcggagactgttaggcccccagaatgccgccgccgtttttcaagcacaggacgactccggagctcaagactcacagcagcacaacagcgagcatgcccgcctgcaggtgcccacgtctcaggttcggtctcgatctacctcacgaggagacgtgaatgatcaggacgccatccaagaaaaattctaccccccgcggttcattcaggtccccgaaaacatgtcaatagatgaggggaggttttgccgtatggactttaaagtgtcggggttgcctgccccagatgtctcttggtacctgaatggaagaacggtccaatcagatgacctgcacaagatgatcgtctcagagaaaggcctgcacagcctaattttcgaagtagtgagagcaagcgatgcgggcgcatacgcttgcgtagccaagaaccgggccggagaagccacttttaccgtgcagctcgatgtgctggcgaaagaacataagagggcccccatgttcatttacaagccccagtctaagaaagttctagagggagacagtgtcaagctggagtgccagatctctgcaattcctccccccaagttgttctggaaacgaaataacgaaatggtgcagttcaataccgaccgaatctccctttaccaagataacacagggcgggttacactgctcattaaagatgtgaataaaaaagacgcaggatggtataccgttagcgccgttaacgaggccggggtcaccacatgcaacacccgtctcgacgttaccgcccggcccaaccagaccctgcccgcaccgaagcagttgagggttcggcccacattctctaaatacctggccctcaatggcaagggattgaatgtaaaacaggcatttaatcctgaaggcgagttccaacgcctggccgctcagagtggattgtatgagagtgaggagctctag

SEQ ID NO: 125550 - DNA, 357 bp, Artificial Sequence
  Description of Artificial Sequence: Synthetic coding sequence
atgtgtgataaagaatttatgtgggcgctgaagaatggagacttagatgaggtgaaggattatgttgccaagggagaggacgtgaaccggacactcgagggaggtcgcaagccactgcactacgccgcggactgtggacaattagagattcttgaattcctcctgttaaaaggcgctgacatcaacgctcctgacaagcatcacataacacccctgctgtccgccgtgtatgagggtcatgttagctgtgttaaattgctattatcaaagggggctgataagaccgttaaggggccggatggactaaccgcattcgaggcaacagacaatcaggcaattaaagctctgcttcagtag

SEQ ID NO: 125551 - DNA, 1812 bp, Artificial Sequence
  Description of Artificial Sequence: Synthetic coding sequence
atggcatcagcctctacttccaaatacaacagccactctctcgagaacgagagcatcaaaagaacaagtcgtgacggtgtgaatcgcgacctcaccgaggccgtcccaagattacctggggagactctgataaccgacaaggaagtgatttacatctgcccgtttaatggaccaataaagggcagagtgtacattaccaactacaggctgtacttaaggagtctggaaactgacagctctctcattctcgacgtgcccctgggcgtcatttctagaattgagaaaatggggggggccacgagccggggtgaaaattcttacggtctcgatataacatgtaaggacatgaggaatctgcgcttcgccctgaaacaggaaggccattccagaagggatatgttcgagatactcacacggtacgcctttcctctggctcatagcttaccattattcgcctttctgaacgaggaaaaattcaatgttgacggctggactgtgtataaccccgtggaagaatacaggaggcagggccttcctaatcatcattggcgcattaccttcatcaataaatgttacgaactgtgcgacacctatccggctcttctcgtcgttccctaccgcgctagtgacgatgacctgaggagggtggccacctttcgatcccgcaatagaatcccagtgttgagctggattcaccctgagaataagactgttatcgtcagatgctcgcagcctctggtggggatgagcggcaagcgcaacaaagatgacgaaaagtatctggatgtaattagggagaccaataagcagatcagcaagttaacaatctatgatgctcggccatccgtcaacgctgtggccaataaggccactggaggcggatacgagagtgatgatgcttaccataacgccgaactgttttttctggatattcacaatattcatgtcatgcgggaatcacttaagaaggttaaagatatcgtctatcctaatgtcgaagagagtcactggcttagctcactcgaatctacgcactggctggagcacattaaattagtgctgaccggggccatacaggtggccgataaggtctcttctggcaaaagctctgtactggtgcactgttctgacggatgggaccgaacggcgcagctgacttccctagccatgttgatgttagattcgttctatcgcagcatcgagggctttgagatcctggtccagaaagagtggataagtttcggacacaagttcgcttctaggatcggacacggtgataagaatcacaccgacgcagaccgtagtcccatcttcttacagtttatagactgcgtctggcaaatgtctaaacagttcccgaccgccttcgagtttaacgaacaatttctcatcattattttagaccacctttactcctgccgattcgggacttttctctttaattgtgaaagtgctcgtgagagacaaaaggtgacagaacgcaccgttagcttatggagcctcattaatagcaacaaagagaagttcaagaatccgttctacaccaaggagattaaccgcgtgttgtaccctgtagcgtcaatgaggcacctggagctgtgggtgaactattatataaggtggaatcccagaattaagcagcagcagccaaatccagtagaacagcgctacatggaacttcttgccctgcgtgacgaatacatcaaacgcctggaagaactccaactcgctaactcagccaagctgtccgacccacctacaagtcccagtagccccagccaaatgatgcctcacgttcagacacacttctag

SEQ ID NO: 125552 - DNA, 1701 bp, Artificial Sequence
  Description of Artificial Sequence: Synthetic coding sequence
atggctagtgcctcgacctctaagtacaacagtcattcgctggaaaatgaaagcattaagcgcacgtcccgggatggggttaaccgagatctcaccgaagctgttccccgcctccctggcgaaactcttatcaccgataaagaggtcatctatatatgtcctttcaatggaccaatcaagggcagggtgtacataactaactaccgcctttatctgagatccttggaaacagacatgcgcaacctcagattcgcactgaaacaggagggccacagccgaagagatatgttcgagattctcacaagatacgcattcccgcttgcccacagcctgcccctgtttgcttttctgaatgaggagaagttcaatgttgatggctggacagtctacaaccctgttgaggaatatcggcggcagggactccctaatcaccattggcgcataacgtttatcaacaaatgctacgagctatgtgatacttacccagccctcctcgttgtgccttacagagcttcagatgatgatctcagaagggttgctacttttagatcccgcaatcgaattccagtactgtcttggatacaccctgagaacaagaccgtaatcgtgagatgctcgcagccattggtggggatgtcaggaaagcgcaataaagatgacgaaaaatacctggacgtgattcgcgagactaacaagcagatctctaaattgactatttacgacgcaaggcccagcgtcaatgccgttgctaacaaggccaccggaggtggttacgagagcgatgatgcctatcataacgctgagctcttctttcttgacatccataacatacacgttatgcgcgaatccctcaagaaagttaaagatatcgtgtacccgaatgttgaggaatcacattggctttcttcactggaaagcacacactggctggagcatatcaaacttgtcctcacgggagctattcaagtggctgacaaggtgagctctggcaagtccagtgtgctagtgcactgcagcgacggctgggaccgcaccgctcaactgacgagtctagccatgctgatgctcgactctttttacaggagcatcgaaggttttgagatcctggtccagaaggagtggataagctttgggcataaatttgcatcccgtataggtcatggggacaagaaccatacggatgctgatcggagccctatcttcctccaatttattgattgcgtgtggcagatgtccaagcagttccctaccgccttcgagttcaacgagcagtttcttatcatcattcttgaccacctctatagctgccgctttggaacctttctgtttaattgcgaatcagcccgagaacggcagaaggtgaccgaacggacggtctcgctgtggtcactcatcaatagcaacaaggaaaaatttaaaaatccattctatacaaaagagatcaatcgagttctttaccccgtagcaagtatgagacacctggaactttgggttaattactatatcagatggaaccctaggatcaagcaacagcagcccaacccagtcgagcaaagatacatggagctgctggcgcttagagatgaatatatcaagaggcttgaggagctccaattggcaaatagtgccaaattgtcagacccccctacgtccccctccagtccttctcagatgatgcctcacgtgcagacccacttttag

SEQ ID NO: 125553 - DNA, 1251 bp, Artificial Sequence
  Description of Artificial Sequence: Synthetic coding sequence
atgggtggcgccacttctaggggtgaaaattcctacgggctggacataacttgcaaagatatgcgcaacctgcgctttgcattgaagcaggagggccactcccggcgcgatatgttcgagatcctgacccggtacgcctttcccctggcgcatagcctacctctgtttgcttttctgaatgaggaaaagttcaacgtggacgggtggactgtctataacccagtagaggagtaccgtaggcaggggctccctaatcatcattggagaatcacatttatcaacaaatgctatgaactctgcgacacctaccccgctctcctggtcgtcccctatcgcgcctccgatgatgaccttaggagggtggccacattccgaagccgtaatcgaatccccgtcctgtcttggattcacccagaaaataaaacagtgattgtccgctgtagtcagccgctggtaggcatgagcggcaaaagaaataaggacgatgagaaatacctggatgtgatacgggagacgaacaagcagatcagcaagctgaccatttacgacgcccgcccatccgtcaatgctgttgcaaacaaggctacaggtggtggctatgaatccgatgatgcataccacaatgctgaactgttctttctcgacatccacaacatccacgtgatgcgggaatctctgaaaaaggtgaaagatattgtgtaccccaacgtggaggagtcacactggctgtccagcctggagtccacgcactggcttgaacacattaagctcgtgctcaccggtgccattcaggtggctgataaggtctcttccggaaagtcctctgtgctggtgcactgctctgatggctgggaccgcacagcccagctgacttccctggcaatgctgatgctggatagtttctacaggagcatcgaaggctttgagatcctcgtccagaaggagtggatcagcttcggacacaagtttgcaagtcggatcggccacggagacaaaaatcacaccgacgctgataggtccccaatattcctgcagttcattgattgtgtgtggcaaatgtccaagcagttccccactgcgtttgagttcaatgagcagttccttatcatcatcctagaccacttgtatagttgccgtttcggtacctttttgtttaattgcgagtccgctcgagaaaggcaggccctccacttcctgtctctgtcactctgtagacgcctacaaaaaggtctgtttctttacggccactag

SEQ ID NO: 125554 - DNA, 1467 bp, Artificial Sequence
  Description of Artificial Sequence: Synthetic coding sequence
atgcgtaacctacgatttgcgctgaagcaggaaggtcattcccgccgggatatgtttgaaatactgacccgctacgcattccccctcgcccactccttgccattgttcgctttcctcaatgaagagaaatttaacgtggatgggtggaccgtgtataaccccgtggaggaatacagacgccagggtcttcccaaccaccattggagaatcacctttattaacaaatgttatgaactgtgcgacacttaccctgcattgttggtagtaccctaccgcgcatcagacgatgacctccgcagagtggctacatttaggagtaggaacagaatcccagtactctcatggatccatcccgaaaataaaacggtgatagtgcggtgctcgcagcctctcgtgggcatgagcggcaaaaggaataaagatgatgagaagtatctggacgttatcagagagacaaataaacaaatatcaaagctcacaatctacgatgcacgaccttctgtcaatgcggttgctaataaagcaacagggggaggttatgagagcgatgatgcataccacaacgcggagttattctttctagatatacacaacatccatgtgatgcgggagtctttgaaaaaggtcaaggacatcgtttaccctaatgtggaggagtcacactggctctcctcactagaatctactcactggctggaacacatcaagttggtgcttactggcgcaatccaggtggccgacaaggttagctccggtaagtcttccgtgctggtgcattgttccgacggctgggaccgaactgcccagctgacatccctcgcgatgctgatgttggatagcttctacagatcaattgaaggattcgagatcctggtccagaaggagtggatatcttttgggcacaaattcgccagcagaattggacacggagacaagaatcatacagacgccgaccggtcaccaatatttcttcagttcatcgattgcgtgtggcagatgtccaagcaattccccacagcattcgaatttaatgagcagttccttatcatcattctggatcacctttattcatgtaggttcggcactttcctctttaactgtgagagcgcccgtgagcggcaaaaggttacagagcgcacagtgtcgctgtggagcctcatcaatagtaacaaagagaaattcaagaaccccttctacactaaagagatcaatagggtgctgtatcctgtggctagcatgcggcacttggagctgtgggtgaattactacataagatggaacccccggatcaaacagcaacagcctaatcccgtagaacaacgatatatggaattgctggctctgcgcgatgagtacattaaaaggctcgaggaactacagttagctaactctgccaagctgtcggacccacccacgtcaccgtcctcacccagtcagatgatgccccacgttcagacccacttttag

SEQ ID NO: 125555 - DNA, 1998 bp, Artificial Sequence
  Description of Artificial Sequence: Synthetic coding sequence
atggatcgccctgctgccgcagccgccgcaggctgtgaaggggggggcgggccaaatcctggccctgccggggggcggagacctccccgcgcagctggaggtgctaccgccggttcaagacagccctccgtggagacattggactctcctacaggatcacatgtggaatggtgcaagcaattaatcgccgcgacgatttccagtcagatctctggctctgtcacctccgaaaacgtgtccagggactataaggctctacgggacggtaataagctggctcagatggaagaagctcctctctttccaggtgagagtatcaaggccattgtcaaggacgtaatgtatatctgtcctttcatgggcgccgtgtccggaacccttacggtgaccgattttaagctgtattttaaaaatgtggaaagggatccacatttcatcctggatgtgccgctgggcgttatttcccgggttgagaagatcggagcccagtcccatggcgacaattcctgcggcatagaaattgtatgtaaagacatgcgcaacctcaggctcgcgtataaacaagaagaacagagtaaactaggaattttcgagaacctcaacaaacacgcattccctctgagcaatgggcaggctctgtttgcattttcttataaggagaaattccccattaacggctggaaggtgtacgatccagtgagtgagtacaagcgtcagggcctgcccaacgaaagctggaaaatcagtaaaattaacagtaactacgaattttgcgatacctatcccgctataattgtggtgcctactagcgtgaaagatgacgacttgtccaaagtggccgctttccgcgctaaggggagagtccccgtgctgagttggatccaccctgaaagccaggccacaataacccgttgttctcagcctttggtcggacccaatgacaaacggtgtaaagaggacgagaaatacctgcaaaccattatggatgcaaatgcgcagagtcataagctgattattttcgatgccagacaaaattcagtcgccgatacaaacaaaacgaaaggcggcgggtacgagtcagagtcggcttaccccaacgctgaactcgtcttcctcgagatccacaacatacacgtgatgcgagagagtcttcgcaagcttaaggagatcgtctatccctcaatagatgaggctaggtggctgagtaatgtggacggcacacactggctggagtatatcaggatgcttctggccggggcggtaaggattgccgataagattgagagcgggaagaccagtgtcgtggttcattgttctgacggctgggaccggactgcacaattgacatccctggctatgttaatgctcgactcatactatagaactattaaggggtttgaaactttggtcgagaaagagtggatctctttcgggcaccgcttcgccttaagggtaggtcatggcaacgataaccatgcagatgctgaccgatcaccaatttttcttcagtttgtcgattgtgtgtggcagatgacacggcaattcccctccgccttcgagttcaatgagctctttctcataaccatcttagatcacctatattcgtgtctgtttggcactttcttgtgcaattgtgagcagcagagatttaaagaagacgtctataccaagactataagcctgtggagttatattaattcacaactagatgaatttagtaatccattcttcgtgaattatgaaaatcacgtcctatatccggttgcgtcacttagccacctggaactttgggtgaactactacgtgcgctggaacccccgaatgcggccgcaaatgccaattcatcagaatctcaaggaattactagctgtaagggctgagttacagaaacgtgtcgaggggctgcagagggaggtggccacccgtgcggtctccagcagttccgagagaggaagctccccatcccattccgctacttcagtgcatacaagcgtctag

SEQ ID NO: 125556 - DNA, 264 bp, Artificial Sequence
  Description of Artificial Sequence: Synthetic coding sequence
atggaggaggctcctctgttccccggtgaaagcattaaggcaatcgtcaaggatgtcatgtacatttgcccgtttatgggcgcagtgagtggtacccttaccgtgaccgattttaagctctatttcaaaaacgtggagcgggacccccactttatcctggatgtgcctctgggggttattagtagggtagaaaaaataggcgctcagagtcatggtgataactcttgcgggattgagatcgtttgtaaggatatgcgcaattag

SEQ ID NO: 125557 - DNA, 264 bp, Artificial Sequence
  Description of Artificial Sequence: Synthetic coding sequence
atggaggaggcccctctttttccgggagagagcataaaggcgattgtaaaagacgtgatgtacatttgtccctttatgggagctgtgtctggcacgctgaccgtgacagactttaaactatactttaaaaacgtagaacgtgatccgcacttcatactcgacgtccccctgggtgtgatctctcgagtcgagaagattggcgcacagtcccacggagataactcctgcggtatcgagatcgtgtgtaaagacatgcggaactag

SEQ ID NO: 125558 - DNA, 273 bp, Artificial Sequence
  Description of Artificial Sequence: Synthetic coding sequence
atggaggaggcccctctctttcctggggaatccatcaaggcgattgtgaaggacgtgatgtatatttgcccattcatgggggctgtctcaggtactctgacagtcactgactttaagctttatttcaagaacgtagagagggacccccactttatcttagatgtgcctctaggagttatctctcgcgtggaaaaaattggtgctcagagccacggtgacaattcctgcggtattgagattgtctgtaaggatatgcgaaacctgcgcctgtag

SEQ ID NO: 125559 - DNA, 2022 bp, Artificial Sequence
  Description of Artificial Sequence: Synthetic coding sequence
atggaccggcccgccgcagctgcagccgccggctgtgagggaggcggaggcccaaacccgggccctgcaggtggacggcggcctccccgcgccgcggggggcgctaccgccggatccagacagcctagcgtagagacactggattcaccgacaggcagccacgtagagtggtgtaagcagctgattgccgccactattagcagtcaaatctctggcagtgtgacatccgagaatgttagccgcgattataaggtctttagaagacctgatcttcgcgctttgcgggatggcaacaaactcgctcagatggaggaagcaccactgttccctggggaatccatcaaagccatcgtgaaggatgtaatgtatatctgtccttttatgggcgcagtatcaggtactttgacggtaacggatttcaagctatactttaagaatgtggagcgtgatccgcattttatcctggacgtgccattgggcgtgatctcaagagttgaaaagatcggagcacaatcacacggggacaactcatgcggcatcgagatcgtgtgtaaggatatgaggaatttgaggctggcttacaaacaggaagagcagtctaagctcggtatattcgaaaatcttaataaacatgcttttcctctgagtaatggtcaggctttgtttgcttttagttacaaggaaaaattcccaatcaacgggtggaaagtgtacgatcctgtctccgaatataagcgccagggactgccaaacgaatcttggaaaatcagcaagatcaactctaactacgaattttgtgacacctacccagccattatcgttgtcccgactagcgttaaagatgacgacctctccaaagtggcagccttcagggccaagggcagggtgcccgttctcagctggatacacccggaaagccaggcgaccattactcgctgttcacagccattggtggggccaaacgacaagagatgcaaggaggacgaaaaatacctacagaccatcatggacgccaacgcccagagccataagctgataattttcgacgcaagacagaactctgtggctgatacgaataaaaccaagggaggtgggtatgagtcagagtcggcatacccaaacgccgaactagtgtttctcgagatccacaatattcacgtgatgcgcgaatctctccgtaagttgaaagagattgtgtatccctccatcgatgaggctcgatggctatcaaatgttgacgggacccactggctggaatacattagaatgctgctcgcgggcgctgtcagaatcgccgacaaaattgagtcaggtaagacgtccgtagtcgtccactgctccgatggctgggatcgcactgcccagctcaccagcctcgccatgctaatgctggactcatactacaggacgatcaagggtttcgagactttagtggagaaagaatggatctcctttgggcatcggtttgccctcagagtcggacacggcaacgataaccacgcagacgctgaccggagtcccattttcctgcagttcgtggactgcgtgtggcaaatgactcgacagtttccgagcgcctttgaatttaatgagctgttcctgatcactattctggatcatctatactcctgcctatttggtacattcctttgtaattgcgagcagcagcggttcaaagaagatgtctatacaaaaacaatttcactgtggtcttatatcaactcccagctggacgaattcagcaaccccttctttgttaactatgaaaaccacgtgttgtaccctgtggcttctctgtcccacttggagctgtgggtgaactactacgtgcgttggaatccccgtatgcgcccccaaatgcctatacatcagaatctgaaggagctattagctgtgagagcagagctccagaagagagttgagggactgcagcgtgaagttgccactcgagcggtgtcctcatcgtctgagagggggagttctccttcgcactccgccacttccgtccatacatccgtgtag

SEQ ID NO: 125560 - DNA, 1707 bp, Artificial Sequence
  Description of Artificial Sequence: Synthetic coding sequence
atggacaggcccgccgccgccgctgccgccgggtgcgaggggggcgggggaccgaatcccggcccagccggggggcgccgacctccgcgcgctgctgggggagctacagccggatccagacagcccagcgtggaaaccctggacagtcccactggttctcatgtagagtggtgcaagcagctcatcgctgctactatctcatctcaaatcagcggatccgtgactagtgagaatgtcagtagagattataaagcgctccgcgacgggaacaaacttgctcagatggaagaagcacccctatttcccggcgagtctataaaggccatcgtgaaggatgtcatgtatatttgtcctttcatgggtgcagtgtccgggacactcactgtcacagatttcaaactgtatttcaaaaacgtggagcgtgaccctcatttcatccttgatgtaccactgggtgtcattagccgtgtggagaagattggagcccagtcacatggcgacaattcatgcggaatagaaatcgtgtgcaaggatatgagaaacctaaggttggcctacaagcaagaggaacagtccaagctggggatcttcgagaatctgaacaagcatgcattccccctgtcgaacggtcaagcattgtttgcatttagttataaggagaagtttccaataaatggctggaaagtgtacgaccctgtgtccgagtataagcggcagggacttcccaacgaatcatggaagatttctaagatcaactccaattatgaattctgcgatacttaccccgcaatcattgtcgttcctacgtctgtaaaggacgatgacttgtccaaagtggctgcttttagagcaaaaggcagggtcccggtgctgagctggatccatcccgaatcgcaggctacaattacacgatgtagccagcctttagttggccctaatgacaaacgatgcaaagaggatgaaaagtacctccagacaatcatggatgccaatgcccaaagccacaaactcatcatatttgatgcgcggcagaatagtgtggctgataccaataaaaccaaaggaggtgggtacgaaagtgagtctgcttaccccaatgctgagctggtgtttcttgagatacataacattcacgtcatgcgtgagtccctcagaaaactcaaggagattgtgtacccttccatcgacgaggcacggtggctgagcaatgtggatggcacccactggttagagtacattagaatgctcctggccggtgcggttcggatcgccgataaaattgagtcaggcaaaacaagcgtggtggtgcattgctcggatggatgggacaggactgcccagctaacctccttagctatgctgatgctggactcttactatcgaacgatcaaggggttcgaaacattggtagaaaaggagtggatatcgttcggtcacaggttcgcgctccgcgtgggacatggcaatgataaccatgcggacgccgacagatcgcccatatttctgcagttcgtagattgcgtctggcagatgacaagacaattccctagtgccttcgagtttaatgaactctttctgattactatccttgaccatctctactcctgccttttcggcacttttctgtgcaattgcgaacagcagcgctttaaggaggcatggggggccgggacccaacgggcccgtggtagtcttcggagtagatag

SEQ ID NO: 125561 - DNA, 444 bp, Artificial Sequence
  Description of Artificial Sequence: Synthetic coding sequence
atggaagaagcaccgctctttcctggggaatcgataaaagcgattgtcaaagatgtgatgtatatctgtccttttatgggcgccgtgtccggcacgctgacggttacggatttcaagttgtactttaagaacgtagagcgtgaccctcattttatcctggacgtgcccttgggggtcatctctcgtgtagagaagataggggcccaatctcatggagataactcttgcggcatcgaaatagtctgcaaggatatgaggaatctaaggctggcatacaagcaggaggagcagagcaagctgggtatcttcgaaaacctaaacaagcacgcctttcctctgtcgaacggccaggctctgttcgctttcagctacaaagaaaaattccccattaatggctggaaggtgtacgatcccgtgagcgaatacaaacggcagggtctttag

SEQ ID NO: 125562 - DNA, 1182 bp, Artificial Sequence
  Description of Artificial Sequence: Synthetic coding sequence
atgtatatctgccccttcatgggggccgtaagcggtaccctcacagtgacagattttaaactctatttcaaaaatgtcgaaagggacccacattttattctggacgtgcccctcggcgtgatttcccgagtagagaagatcggagcccagagtcatggagacaattcttgcgggattgagatcgtttgcaaggacatgcgaaaccttagacttgcatacaagcaagaagagcaatctaaacttgggatcttcgagaacctgaacaagcacgcttttcctttatctaatggccaggcgctcttcgcgttcagttacaaggagaaatttcccataaatgggtggaaagtgtatgacccagtgtccgagtataagcgacagggactgccaaatgagtcttggaaaatcagcaaaattaattcgaactatgagttttgcgacacatatccggctattatcgtcgttcctacttcggttaaagatgacgatctgtctaaagtggctgcgtttagagccaaaggccgtgtgccagtattgtcttggattcacccagagtcacaggccacaatcacaaggtgttctcagcccctggttggtcctaatgacaaaagatgtaaggaagacgaaaagtatctccagaccataatggacgcaaacgcccagtcccataaactaattatctttgatgccaggcagaattccgtcgctgacacaaacaaaatgttgctggcaggagcagtgagaattgctgacaagattgagtcagggaagaccagcgtcgtggtgcactgctcagacggatgggatagaactgcccagctaacctcccttgccatgctcatgctcgactcttattatcgaaccattaagggattcgagacactcgttgaaaaggagtggatttccttcggccataggttcgccctgagggtgggccacggcaacgataaccatgcagatgccgataggtcaccgatattcctacagttcgtggattgcgtttggcagatgaccaggcagttccccagcgctttcgagtttaatgaactctttctgatcacaatcctcgatcatttatactcctgtttatttggcacctttttgtgcaactgtgagcagcagcgattcaaggaggcatggggggctggaactcagagagcccgcggctccctgcggtcacggtag

SEQ ID NO: 125563 - DNA, 1716 bp, Artificial Sequence
  Description of Artificial Sequence: Synthetic coding sequence
atggaagaggctcctctctttcctggagagtctatcaaggccatagtcaaggacgtgatgtatatctgcccttttatgggagccgtctcaggcacactcaccgtcaccgacttcaagctgtattttaagaatgttgagcgggatccccactttatactggacgtgccactgggagtgatctcgcgggtggagaagattggcgcccagagtcacggcgataatagctgtggcatcgaaattgtgtgcaaagacatgcggaacctgcggctggcctataagcaggaggagcagagcaaactgggtatattcgagaatcttaataagcacgcttttccgcttagtaatgggcaggcattgttcgcttttagttataaggagaagttcccaattaacgggtggaaggtctatgaccccgtcagcgagtataagcgccaggggctacccaacgagagctggaagatcagcaaaattaactcaaactacgagttctgtgatacctaccctgccatcatagtcgtccccactagcgtgaaggacgatgatctctccaaggtggcggccttccgggccaaggggagagtcccggtgctgtcatggatccacccagagagtcaggccactatcacacgatgttcccagcctcttgttggtcctaacgacaagcgatgtaaggaagacgagaagtatctccagaccattatggacgcaaacgcccagtcccacaaactcattatcttcgatgctagacagaactccgtagcagacacaaataagacaaagggcggaggctacgagtccgagtccgcctatccaaacgccgaactcgtgtttctcgagattcataatatacatgtgatgagggagtccctcaggaagcttaaagagatcgtttatccctccattgacgaggctcgatggctgagcaatgtggatggcactcactggctagagtacatcaggatgctgctagccggagccgtgcgcatagcagataaaatcgagagcggcaagacgtcggttgtggtgcattgtagcgatgggtgggacaggaccgcacagttgacatccttggcaatgctcatgctggattcatactataggactataaagggcttcgaaacgttggtggagaaggaatggataagctttgggcaccgctttgcattgcgggtcgggcacgggaacgataaccacgctgacgctgataggtctcctatattcctgcagttcgtggattgtgtttggcaaatgactaggcagttcccaagcgcttttgaattcaacgagctctttctgatcacaatcctcgaccacttgtacagctgtcttttcggtaccttcctctgtaactgtgaacaacagcgatttaaagaggatgtgtatactaagacaatcagcctctggagttatattaactcccagctggacgagtttagtaatcccttttttgttaactacgaaaaccatgtcctgtatcctgtcgccagcttgagtcatctggagctttgggtaaattactatgttcgctggaatcctaggatgaggccccagatgccaatacaccagaatctcaaggaactgttggccgttagagccgaactgcagaaaagggtcgaaggcttgcagcgtgaggtggctaccagagcagtgagtagctcaagcgagaggggatcctcgcccagccatagcgcgacctcggtgcatacaagcgtgtag

SEQ ID NO: 125564 - DNA, 1092 bp, Artificial Sequence
  Description of Artificial Sequence: Synthetic coding sequence
atggatagaccagcagcagccgctgcggctggctgcgaaggcggcggcggaccaaatcccggccccgcaggcggaaggcgaccccctcgagcggcaggtggggccacagccggctcccggcaaccttctgtggagaccctggactcaccaacaggctcccatgtcgaatggtgcaagcagcttattgctgccacaatctcttcccagatatcaggctctgttaccagtgaaaacgtgtcccgggattataaggcactgagagatggcaacaagctggcacaaatggaagaggcccctctgttccccggcgaaagcattaaagccattgtgaaggacgtgatgtatatttgcccttttatgggcgctgtgtcaggaacattgacagtgactgacttcaaactctactttaaaaacgtagaacgggacccacactttatactggatgtcccgctgggagtgataagtcgcgtggagaagattggcgcacagtcacacggggataattcatgcggaatcgagatcgtgtgcaaagatatgcggaatctgcgactggcctacaaacaggaggaacaatcaaagttggggatcttcgagaatctcaacaagcatgccttccctctgtccaatggccaggccctgtttgctttttcgtataaggagaagttccctattaacgggtggaaagtgtacgaccccgtttccgagtataaacggcaggggctgcccaacgagagttggaagatcagcaaaattaactccaactatgagttttgcgatacttatcccgcaatcatagtggtgcctacatccgtgaaagacgacgatctctctaaggttgcagccttccgcgcaaagggtagagtgcctgttttgtcctggattcacccggaaagtcaggccactatcactcggtgctcacaaccactggtggggcctaacgacaagagatgtaaggaggatgaaaagtacttgcagactattatggacgctaatgcccagtctcataaactgattatattcgacgcacgacagaacagtgtggccgacacaaataaactgtggtatcaggacactgcaagcctgatggagtag

SEQ ID NO: 125565 - DNA, 1998 bp, Artificial Sequence
  Description of Artificial Sequence: Synthetic coding sequence
atggaccggcccgcagctgctgcagcggctggctgcgaggggggcggcggtcctaaccccgggccggctggtggcaggagaccccctcgggccgcaggcggcgctaccgccggtagtaggcagccaagcgttgagaccctggactcccctacggggtcacatgtagaatggtgcaaacagttgattgcagctacaataagcagccagatctcaggctctgttactagcgagaatgtgtcacgcgactataaggcacttcgggacggcaacaagctcgcacagatggaagaagcaccattgtttccaggggaatcaatcaaggctatcgtcaaagacgtgatgtatatctgtcctttcatgggagccgtgtccggtacactgacagtgacagattttaaactctacttcaagaacgttgagagggaccctcatttcatactcgacgtccctttgggcgtgattagccgggtcgagaagattggagctcagtctcatggagacaacagctgcggaatcgagattgtgtgcaaggacatgaggaaccttcggctagcttacaagcaagaggaacagtcaaaacttggcatcttcgagaatctgaacaagcatgcttttcctttaagtaatggtcaggccctctttgcgttctcctataaagaaaaattcccgatcaacggctggaaagtgtatgacccagtctccgagtacaaacgccaggggctgcctaacgaatcgtggaagattagtaagatcaattccaactatgagttctgtgatacataccccgccatcattgtagtgcccaccagcgttaaagatgatgatcttagcaaagttgctgccttccgcgcaaaagggagagtgcccgttctgtcttggatccacccagaatcacaggctaccatcacacgctgctcacagcccttggtcggacctaatgacaaacgatgcaaagaagatgaaaagtatctgcagactatcatggacgccaatgcccagtcccacaagctcattatcttcgatgccagacagaacagcgtggctgataccaacaagaccaagggcggagggtacgaatctgaatctgcctacccaaatgccgagctcgtgtttctggagatacataatattcatgttatgagagaaagtcttagaaaacttaaggagatcgtgtatccaagcatagatgaggccaggtggttgtccaatgtggatggaactcactggctcgagtatattagaatgctcctcgccggcgcggtgaggatagctgataagatcgaaagtggaaagactagtgtagtggtccactgctctgatggctgggacagaactgcacagcttacaagcctggctatgctgatgcttgactcgtactataggactattaagggatttgagacgttggtggagaaggagtggataagcttcggtcatcgctttgcactcagggtgggccatggcaatgataaccacgcagacgctgatcgttctccaattttcctccagtttgtagattgtgtctggcaaatgacacggcagttccctagcgcgtttgaattcaatgagctatttctgattactattctcgatcatctgtattcctgtctgtttggaacttttctctgcaactgtgagcagcagcgtttcaaagaggacgtttacacaaagacgataagcttgtggagttacatcaattcgcagctcgacgaattctcaaacccattcttcgttaactacgagaaccatgtactatatcccgtcgcctctctttctcatcttgagctgtgggtgaactactacgtgcgttggaatcctagaatgaggccacagatgccaattcatcagaaccttaaagagttactggctgtgagggccgaactgcagaagcgggtcgaaggactgcagcgggaggtggccacccgggcagtttcaagttcctcagaaagaggatctagcccgtcgcattcggctacttctgtgcataccagcgtgtag

SEQ ID NO: 125566 - DNA, 1914 bp, Artificial Sequence
  Description of Artificial Sequence: Synthetic coding sequence
atgttaggaaaaggggtggtgggtggtggtggtggcacaaaggccccaaaaccatctttcgtctcttacgtacggcctgaagaaatacatacaaatgaaaaggaggtgacggagaaggaggtgactctgcatctgttaccaggagagcagctgctgtgcgaggcctccactgtcctgaaatacgtgcaggaggactcttgtcagcacggggtgtacggccgtctggtctgcacagattttaagatcgcctttctaggcgatgacgaatcagccctggataacgatgagacccagtttaaaaacaaagtaatcggcgagaatgacatcactctacattgcgttgaccaaatatatggtgtctttgatgaaaagaagaaaacactttttgggcagctgaagaaatacccggaaaagcttattattcactgcaaggatctgagagtgttccagttttgtctgagatatacaaaagaggaggaggttaagaggatcgtgtcaggaattattcaccacacacaagctccaaagctcctcaagaggctgtttttgttttcgtatgccaccgctgcccaaaataataccgtaactgatccgaagaatcacaccgtgatgtttgacactctaaaagattggtgctgggagctggagcgtacaaaggggaacatgaagtataaagccgtgagcgtcaatgagggatacaaagtgtgtgaacggttgccggcttatttcgtcgtgccgacacccctgcctgaggagaatgtccaacggttccaggggcatggcattcccatttggtgctggtcttgccacaacgggagtgcccttctaaaaatgagcgcactcccaaaagaacaagacgacgggatccttcagatacaaaaaagctttctggatggtatatataagaccatccatcgtccaccctacgagattgtcaagaccgaagacttatcctccaatttcctgagccttcaggagattcagactgcatactccaagtttaagcagctctttctcatcgacaacagcacagaattctgggatacggatataaagtggttttccctgttggagagctctagctggttggatattatccgccggtgcctgaaaaaggccatcgagattaccgaatgcatggaagctcagaacatgaacgtgctgttgttggaagaaaatgccagcgacctctgctgcctgatttcctctctcgtgcagctgatgatggacccacattgtagaacccgaattggctttcagagcctcatccagaaagaatgggtgatgggtggacactgctttctggatagatgtaaccacctcagacagaatgacaaggaagagcatcagagacaacttagcttgccactgacccagagtaagagctcccccaaaaggggatttttcagggaggaaactgaccatctcatcaaaaacctgctcgggaagaggatatcgaagctcatcaattcttccgacgaacttcaggacaacttccgcgagttctacgattcctggcattccaaatcaacagactaccacgggcttctgctgcctcacatcgagggtcctgaaataaaggtctgggctcagaggtatcttcggtggatccctgaagcacaaattctggggggagggcaggtggcaaccttgtctaaactactggagatgatggaggaagtacagagcttgcaggagaaaatagatgaacggcatcacagtcaacaggctccccaggccgaagctccttgcctgctgagaaattctgcgcgcctgtcttcgctgttccccttcgcactcctacagcggcacagctcgaaacccgtgctccctacctccggctggaaggctctcggagatgaggatgatctggcgaagcgcgaggacgagttcgtcgacctgggggacgtgtag

SEQ ID NO: 125567 - DNA, 2082 bp, Artificial Sequence
  Description of Artificial Sequence: Synthetic coding sequence
atgctgggcaagggcgttgtcggaggaggtgggggaaccaaagctccaaagccgtctttcgtatcctatgtgaggcccgaagaaatccacaccaacgaaaaagaggtgacggagaaggaggtaaccctccacttgcttccgggggaacagctcctctgcgaggcctctaccgtgctgaaatatgttcaggaggatagttgccagcacggtgtctacggcaggctagtgtgcacagattttaagatagcattcctgggtgacgacgaatcagcactggacaacgatgagacacagtttaagaacaaggttatcggagagaacgacatcaccctccactgtgtggaccaaatttatggagtctttgacgagaagaaaaagaccttgttcggtcagctgaaaaaatacccagagaaacttattatccattgcaaggacctcagggtttttcagttctgcttgcgatatacaaaagaagaggaggttaagcgaatcgtgagcggtattatccatcacacgcaggcaccaaagttgctgaagcgcttgttcctgttctcctatgctaccgctgcccagaataacaccgtaacggatcctaagaatcacactgtcatgttcgacaccctgaaggattggtgctgggagctcgaaaggacaaaaggcaatatgaagtataaggcagtctccgtcaacgagggctacaaagtgtgcgaacggcttcctgcgtatttcgtggtgcccaccccccttccggaagaaaatgttcagcgcttccagggccacgggatcccaatctggtgctggtcatgtcacaacggatctgccctgctcaagatgtctgcattacccaaggagcaggacgacggcattcttcagattcagaaatctttcctggacgggatctacaaaaccattcatcgaccaccttacgagatagtgaaaaccgaagacctaagttcaaattttctgtccctccaggagattcagaccgcttattctaagttcaagcagttgttcttgattgacaactcaactgagttttgggacacggatattaagtggttttccttgttagagtcttcatcctggctggatatcattagacgatgcctgaagaaagctatcgagatcaccgaatgtatggaggcacagaatatgaacgtgctccttcttgaagagaatgcctcggacctgtgctgcctgatctcttcgctggtgcagctgatgatggaccctcactgtcggaccagaatcggattccaaagtctgattcagaaggaatgggtgatgggtggacattgtttccttgataggtgcaatcatctacggcaaaacgacaaggaagaagtgccagtattcttgctctttctggattgcgtgtggcagctagtccaccagcacccccctgccttcgagtttactgagacctacttaaccgtgctgagcgactcactgtacatccctatctttagtacctttttctttaactcccctcaccagaaagacacaaacatgcaccaacgtcagctgagccttccactgacacagagtaaaagcagtcccaagcgtgggtttttccgggaggagacagatcacctgataaaaaacctgttgggcaagcggatctccaagctgataaattccagtgacgagctgcaggacaactttcgggagttctatgacagctggcatagtaaatccacagactaccatggcctgctgttaccccacattgagggcccagagatcaaagtttgggctcaacgctaccttcggtggattccagaagcgcagatattgggcggtgggcaggtggccacactctctaagctgctggaaatgatggaggaagtgcagagcctgcaggagaagatcgacgagcggcatcacagtcaacaggccccacaggcggaggctccttgtctattgcggaacagtgcccgactgtcatctctgtttccctttgcgctccttcagcgccatagttcaaagcccgtgcttccaacatcaggatggaaagccctgggcgatgaggacgacctcgcaaaacgcgaagacgagttcgtggacctgggggacgtgtag

SEQ ID NO: 125568 - DNA, 2244 bp, Artificial Sequence
  Description of Artificial Sequence: Synthetic coding sequence
atgcttggaaagggtgttgtgggagggggagggggtacaaaggcaccaaaaccaagttttgtgtcctacgtgcggccagaagaaatccacacaaacgagaaggaggtcacagaaaaggaagtgaccctgcacttgctacccggcgagcagctcctgtgtgaggcatccacagtgcttaagtacgtgcaagaggattcttgccaacacggggtgtatggtaggctggtgtgtaccgacttcaaaatcgccttcttaggggacgacgagtcagcccttgacaacgacgagacccagttcaagaataaagtgatcggcgagaacgacatcacccttcattgcgtcgaccaaatttacggagtattcgatgaaaaaaagaagacactgtttggccaacttaaaaaatacccagagaaattgattatccattgcaaagacctgcgcgtgtttcaattctgcctgaggtatactaaggaggaggaggtaaagagaatcgtctctgggattatccatcacacacaggcccccaaattgcttaaacgactcttcttgttcagctacgccacagcggctcagaataatacagtgacagaccccaaaaatcacacggtgatgttcgacacgctcaaagattggtgctgggagctggaaagaacaaagggaaacatgaagtataaggcggtgtcagtgaatgaaggttataaggtgtgcgagcggttgccagcatactttgtagtgcctactcctcttcccgaagagaacgttcagcgatttcaagggcacggcattcctatatggtgttggagctgccataatggctctgccctgctgaagatgagcgccctccccaaagagcaggatgatggaatcctccagatccagaaatccttcctcgatggtatctacaaaacaatccaccggcctccctatgaaatcgtgaagaccgaggatcttagttctaacttcctgtctcttcaggagatccaaacagcctattcgaagttcaagcagcttttcctgattgacaacagtacagaattctgggataccgacataaaatggttctctttattggagtcctccagttggcttgacattatccgaaggtgcctcaaaaaggctatcgaaatcactgaatgtatggaagctcagaacatgaacgtgctgttgctggaagagaatgccagtgacctgtgctgtctcatctcatcgcttgttcagcttatgatggatccacactgtagaacaaggatcggattccaatccctgattcaaaaggagtgggtaatgggcgggcattgttttcttgatcggtgtaaccacttaaggcaaaacgataaggaggaggtgcccgttttcctgttattcctggattgcgtatggcaactcgtccatcaacaccccccggcttttgaattcacagaaacctacctcactgtcctttcagattccctttacatccccattttctcaacctttttttttaacagtccccaccagaaggataccaatatgggccgggagggccaggatacccaatccaagccacttaatctgctgaccgtgtgggactggtctgttcagtttgaaccaaaggcacagacgttgttgaaaaatccactgtacgtcgagaaaccaaagttggataagggacagaggaaggggatgcgtttcaaacatcagagacaactgtctcttcccttaacacagtccaagtcctcaccaaagcggggatttttcagagaggaaacagatcacctcattaaaaatctcttgggcaagagaatttctaaactgatcaacagttctgacgagctgcaggataattttagagagttctacgacagctggcactccaaatccactgattaccacggcctattattgcctcatattgagggtcctgaaattaaagtgtgggcccagcgctatttgcggtggattcccgaggctcagatcctcggcggggggcaggtggccacattatcgaagctgcttgagatgatggaagaggtgcagtccttacaggagaaaattgacgaaagacatcacagccagcaagccccacaggcagaggccccgtgcctgctgagaaatagtgcccgcctgagcagcctctttccattcgccctgctgcaacgtcactcttcgaagcctgtgctacctacgtccggctggaaggccctgggagacgaggacgatctggccaagcgggaggatgaattcgtggacctgggtgatgtatag

SEQ ID NO: 125569 - DNA, 1953 bp, Artificial Sequence
  Description of Artificial Sequence: Synthetic coding sequence
atggccggagcgagagccgcagccgcagcagctagcgcaggatctagtgcatcgtctgggaaccagcccccgcaggagctagggctgggagagctgctggaagaattttctcgaacgcaatatcgtgctaaggacggctctggtaccgggggctcaaaggtggagcgcatcgagaagagatgccttgagctgttcggtcgcgattattgtttttcagttatccctaacacaaacggtgacatctgcggacactatccacggcatattgtcttcctggaatacgaaagctccgagaaagaaaaggatacctttgagtccaccgttcaggtcagtaagcttcaggatctgatccataggagcaaaatggctcgatgtcggggaaggttcgtatgccccgtcatcctgttcaagggcaagcacatctgtcgctcagcgactctggcagggtggggagaactgtacggtagatccggttacaattattttttcagcggcggggctgacgacgcctgggctgacgttgaggatgtgacggaggaagactgcgctctgcgctctggtgacactcacctattcgacaaggtgcgtgggtacgatattaagctcctgcgctacctgtcagttaaatacatttgtgacctgatggtggaaaacaaaaaagttaagtttgggatgaatgtcaccagttcggaaaaagtcgataaggcacagagatacgccgacttcacgctgctgtccattccctaccccggatgtgagttcttcaaggagtacaaagacagggactacatggctgagggccttatttttaattggaagcaagactatgtcgacgcacctctaagcattcctgattttcttacacatagccttaacattgactggagtcagtaccagtgctgggacctagtgcagcagacccagaattatctcaagctgttactgtcccttgttaactctgatgatgactcaggcctgctggtgcattgtatcagcgggtgggaccggacgccacttttcatatcgctgctgaggctgtcactctgggctgacggcctgatccatacgagtcttaagccaacagagatcctttatttgaccgtggcatatgactggtttttgtttggccacatgctagttgatcgcctgagtaaaggggaggaaatcttctttttttgcttcaattttcttaaacatatcacttctgaggagttcagcgccctgaaaacgcaaagaaggaagagtctacctgctcgcgatggtggctttactctggaggatatctgtatgctgagaagaaaggatagggggagcacgacatctctaggaagtgacttttcactggtcatggagtcttctcccggggctacaggctcatttacatacgaggccgtggaacttgtaccagcaggggcccccacccaggcagcatggagaaaatcccacagctcttccccccaatcagtcctgtggaaccgaccacagccatccgaagatcggctgccttcccagcaaggcctcgccgaggctcgttcgagcagttcgagcagctctaaccactcagacaattttttccgtatggggtcttcccccctcgaggtgcctaaaccacggagcgtggatcaccctctgcccggctccagtctgtcaaccgactatggttcgtggcagatggtgacggggtgtggatcaatacaggagagggccgtgttgcatacggacagttctctgccatttagttttccagatgagctgcccaacagctgtctcctggcagccctgtccgatagggaaacgaggctgcaagaagtgagaagcgcctttctcgcggcttactctagtacagttggtctgcgcgcggttgctccttcacctagcggcgccattggcggacttctagagcagtttgctcgaggggtgggcctgcgctccattagcagcaatgccttgtag

SEQ ID NO: 125570 - DNA, 1617 bp, Artificial Sequence
  Description of Artificial Sequence: Synthetic coding sequence
atggcaggcgcccgagcagctgcagcggctgcatcagccggctcatctgctagtagtggcaaccagcctccgcaggaattgggattaggggagttactggaggagttctctcgtacgcaatatcgggcaaaggacggctcgggaacgggtggtagcaaggtcgagcgtatcgagaagaggtgcctcgaactgtttggacgggattactgtttcagcgtcatccctaataccaatggcgatatctgtggccattacccccgtcatatcgtttttctggaatatgaatcctctgagaaggagaaagatacatttgaaagcaccgtacaggtgtccaagttacaagacctgatccacaggtctaaaatggccaggtgtaggggccgattcgtgtgtccagttattctattcaaaggaaaacatatttgcaggtcggccaccttggctggttggggcgagttgtacggccggtccggctataactatttcttttccggaggcgcggacgatgcctgggccgacgtggaagatgtgacggaagaggactgcgccctgcgttcgggagacactcatctgtttgataaggtgcgcggctacgacatcaagctcctccggtatctctccgtcaaatacatctgcgacctcatggtcgagaataagaaagtcaaatttggcatgaatgtaacctcctccgagaaagtggataaggcccagcggtacgccgactttactctcctctcaataccataccctggatgcgaatttttcaaggagtacaaggatagagactacatggcagaaggattgatctttaattggaagcaggattatgtggatgcgccgttgagcatccctgactttctgacccactccctcaacattgattggagccagtatcagtgctgggaccttgtccagcagacgcagaactacctaaagctgctgctgtcactcgtaaactccgatgacgattccggcctgctagttcattgcatctccgggtgggaccggacacctttgttcatatctttgcttagactgagcctgtgggcggacggactcattcatactagcctgaagccgacagaaatcttgtacttgacagtggcatatgattggttcttgttcggccacatgctggttgacaggctcagcaaaggagaggaaatcttttttttttgctttaacttcttgaagcacataacctcagaggagttttccgccttgaagacacaaagacgcaaatccctcccagccagagatggtgggtttacgctggaagacatctgcatgcttcggcggaaggatcgtgggtctactacgagtctggggagcgattttagcctggttatggaatcttctcctggcgccaccggatcattcacatatgaagccgtcgaactggtgccagctggcgcacccacccaagccgcatggctagcagccttatccgaccgagagacccggctgcaagaggtcagaagtgcattcttagccgcttattcttcgacagttggcctgcgtgccgtggccccaagtcccagcggggcgattggtggcctgctggaacagtttgctagaggtgtcggtctaaggagtatcagctccaatgccctctag

SEQ ID NO: 125571 - DNA, 1797 bp, Artificial Sequence
  Description of Artificial Sequence: Synthetic coding sequence
atggctggtgcccgggccgccgcggccgccgcttccgcaggatccagtgcctctagtgggaatcagcccccgcaagaactcggtctcggcgaactcctggaagaattctctcggacccaataccgcgcgaaggacggatctggtacaggcgggagtaaagtggaaagaattgagaaacggtgtctggagcttttcggcagggattattgcttttcagtcattccaaacacaaatggagatatctgtggccattatcctagacacatagtatttctcgaatacgagtcatctgagaaggaaaaggacacgtttgagagcacagtgcaggtgtccaagctacaggacttgatccaccgcagcaagatggcccggtgccgagggcgctttgtctgccctgtgattctgtttaaggggaagcacatctgtcgttcagccaccttggcggggtggggcgagctgtacgggagaagtgggtacaattatttcttttccggcggtgccgatgatgcttgggctgacgtggaggatgtgacggaggaggattgtgcattaaggtctggcgacactcatcttttcgataaggtgagaggatacgatataaaactcttgcgctacctttctgtaaaatacatctgtgatctgatggtggagaacaaaaaggttaaattcggaatgaacgtgacctcatctgaaaaggtggacaaagcgcagcgttacgctgacttcacattgctgtctattccctaccccggctgcgagttcttcaaggagtataaggatcgagattatatggcggagggcctaattttcaattggaaacaggattatgtcgatgccccactgtccattcctgactttctgacccactcactgaatatcgactggagtcagtatcagtgctgggacttagtgcagcagacacagaactatctgaagctactgctgtcgctagtcaactccgacgatgatagcggactgctggttcattgtattagcgggtgggaccgaaccccattgtttattagtctactgaggctctctctctgggctgacggacttatccacaccagcctaaaacccaccgaaattttgtatcttaccgtcgcctacgactggttcctcttcgggcatatgctggtagatagactgtctaagggagaagagatttttttcttttgcttcaacttcctgaaacacatcacatctgaggaattctcagcactcaaaacacagcgtaggaagagtctccccgctcgcgatggcggattcacactggaagacatttgtatgctccgccggaaggatagggggtcaactacttcgctaggctcagatttctccctggtgatggagagcagtcctggagccaccgggtcctttacctacgaagcagttgaactggtgccagcaggagccccaacacaggccgcttggaggaaatcccacagctcttcaccccaatccgtgctgtggaacaggccacagcccagcgaagaccggttaccaagtcagcaaggcctggcggaagccaggagttcctcctcttcctcctcgaatcattctgataactttttccggatgggatcctcacccttggaagtaccaaagccccggcttgccgccctgagcgacagagagacaagactgcaagaggtgagatcggcctttctggcggcttactcttctacagtcggacttagagccgtggccccttcaccatccggtgccataggcggcctcctcgagcaatttgctcgcggcgtcggactccgcagcatatctagtaacgcactgtag

SEQ ID NO: 125572 - DNA, 1563 bp, Artificial Sequence
  Description of Artificial Sequence: Synthetic coding sequence
atggccggggcccgggctgcagcagcagccgcctctgcgggatcttctgcctcctccggcaatcaaccccctcaagagttggggctcggtgagctactggaggagttcagccgtacccagtatcgggccaaggatggatctggaaccgggggcagcaaagtcgaacggatcgaaaaaagatgcctggaactcttcggacgagattattgcttttctgtaattcccaacacaaacggagacatatgtggccactatccaaggcatattgtgttcctcgaatatgaatcgagcgaaaaggagaaggacacgtttgaatcaactgtgcaggtttcaaagctgcaagatcttatccataggagtaagatggcaagatgtcgggggaggttcgtttgcccagtgatccttttcaagggcaaacacatctgtagatccgcaacccttgccggctggggtgaactctacggtagatctgggtacaactattttttcagcggcggagccgacgatgcctgggccgacgtcgaagatgtcaccgaggaagattgtgccttgagatccggagacacgcacctctttgacaaggttcgggggtacgacatcaagcttctgaggtacctgtccgtcaaatatatttgcgacttgatggtcgagaacaaaaaagtgaagttcggaatgaacgtgacctcctcagagaaagttgataaggcgcagcggtacgctgattttacactgctttctatcccctaccctgggtgtgagttcttcaaagagtacaaggacagagattatatggcagaggggctgatctttaactggaaacaggactatgtcgatgctccacttagtattcccgactttttaacccacagccttaatatcgattggtctcagtatcagtgctgggatctggtgcagcagacacagaactatctgaaacttctactgtccttggtgaactccgacgacgatagcggtctgctcgtgcattgcatatcagggtgggatcgaacacctctctttatctcattattacggctgtctctctgggcagacgggctcatacatacgagtcttaagccaacggagattctgtacctgaccgtggcttatgactggtttttattcgggcatatgttagttgacaggctttcaaaaggagaagagatctttttcttctgcttcaattttcttaaacacatcacttccgaggaattctcagctctcaagacgcagaggagaaaatccctgccggccagagacggcgggtttacactggaagatatatgtatgctaagaagaaaggatcgagggtccaccacctcccttggctcagactttagcctcgtcatggagtcttcccctggcgccaccgggtcattcacatatgagcgcggcgcaggtccgtcccgtagcgcaaattccggatccttggaggaggagccactgatcctttctactgaatgtcctctagaacccgcaacaaccctgaggggtcctctggcctttcccgcaggtgctggaggatcccaagtatttcaactgctctttcttaaacctttctag

SEQ ID NO: 125573 - DNA, 1932 bp, Artificial Sequence
  Description of Artificial Sequence: Synthetic coding sequence
atggagaagagcagctcttgcgaatctctcggcagccaaccagctgctgcccgccctcccagcgttgactcactcagttcagcttccacttcacatagcgaaaattcagtccacacaaagtccgcaagcgtggtctccagtgacagcatttctacatccgccgataatttctccccagacctgagagtgttgcgggagtctaacaagctagctgaaatggaggaaccgccactccttccaggagagaatatcaaagatatggctaaggacgtgacatatatttgtcccttcacaggcgccgtacgggggacactgacggtgacgaactatcgcttatatttcaagtccatggaacgagatcctccattcgtgctggatgcttccctgggcgtgatcaacagagtcgaaaagattggtggagcttcatctagaggcgagaacagttatgggctggagacagtgtgtaaagatatccgtaacctgcgctttgctcacaagcctgaaggccgtactcggaggtctatttttgaaaatcttatgaagtacgcctttcctgtgagtaacaatctgcccctgtttgcattcgaatataaggaagtgtttccggagaatgggtggaagctgtacgaccccttactggagtatagaagacaggggatcccgaacgaaagctggcggatcacgaagatcaatgaacgttatgaactgtgcgatacctacccagcattgctggtggtccctgccaacatcccagacgaagaactgaaacgggttgccagtttccgttcccgagggcgcattcccgttctgtcctggattcaccctgaaagccaggcgacaatcacaagatgctcccagcccatggttggtgtgtcagggaagaggtctaaggaggacgagaaataccttcaggcaataatggactccaacgcccagagccacaaaatcttcatctttgacgcccgcccttcggtgaatgctgtggccaataaggccaagggcggaggatacgaaagcgaggatgcataccagaacgccgagttggtctttctcgatattcataacatccatgtgatgcgggaatcactccgcaaactgaaagagattgtgtaccccaacatcgaagaaactcattggctgagtaacctcgagtccacccattggctggaacacatcaaactgattctggctggtgccctccggatcgccgataaagtggagagtggaaaaacctctgtggtggtccattgttccgacgggtgggatcgcactgcacagctgacttctcttgctatgctgatgcttgatggatattatagaaccatcagaggatttgaggtactggtggagaaagaatggctgtccttcggtcatagattccagctgcgggtgggtcacggcgataagaatcacgccgatgccgatcgaagcccagtctttctgcagttcatcgactgtgtgtggcagatgacacgacagtttcccacagcttttgaatttaatgaatatttcctgattaccattttggaccatctttacagttgtctctttggaacattcctgtgtaactccgaacaacagaggggaaaggagaacctgcccaaacgcacggtttctctgtggtcctacataaacagccagctggaggatttcaccaaccctctctatggctcatattcgaatcacgtcttgtatcctgtggcgagtatgcggcacctcgaactgtgggtggggtactacattagatggaacccacggatgaaaccccaagagcccatccataatcggtataaggagctgctcgcaaagcgtgctgaactgcagaaaaaagtggaagaattacagagagaaattagcaataggagtacctctagctccgaaagagcatcaagccccgcccaatgtgtgactcccgtacagactgtggtgtag

SEQ ID NO: 125574 - DNA, 1716 bp, Artificial Sequence
  Description of Artificial Sequence: Synthetic coding sequence
atggaggagccacccctacttccaggagagaacatcaaagacatggcgaaagatgtaacctacatttgcccgttcactggggcggtgagaggaaccctgaccgtgaccaattatcgcctctattttaaatcgatggagcgggaccctccatttgtgctggacgcctctctcggcgtgatcaatagggttgagaagattggaggcgcttcttcccggggtgaaaacagctacgggttggaaacagtgtgtaaggacattagaaatttgaggtttgcacacaagcctgaagggcgcacaaggaggagcatctttgagaacttgatgaagtacgccttcccagtatctaataacctgcctcttttcgcctttgaatacaaagaggtttttccagagaatggatggaagttgtatgatccactgttggagtacagacgccagggtattcccaacgaatcctggagaatcaccaagatcaatgagaggtacgaattatgcgatacctacccagcactgctggtggtaccagccaatatccctgacgaggaactgaagagggtagcgagttttaggtcccgcggccggattccagtgttatcatggatccaccctgagagccaggctacaattacgcgctgcagccagcccatggtcggagtgtctgggaagagatcaaaggaggatgagaaatacttgcaagctatcatggattcaaacgcgcagagccataagatctttatttttgacgccaggccctccgtgaacgcagtagccaacaaggctaaaggaggcggatatgaatccgaagatgcctatcagaatgccgagctcgtgttcctggatattcataacatccatgtcatgcgcgaatccctgcgaaaactaaaagaaattgtgtatcccaatattgaagaaactcactggctctccaatctcgagtcaacccactggctggaacacataaaactcattctggcaggcgccctacggatagccgataaggttgagtccgggaagacatctgtggttgtgcactgctcagacgggtgggaccgaaccgcgcaactcacgagtttggcaatgctgatgctggatggctattacagaacaattcgcggcttcgaggttctagtggaaaaggaatggctcagctttggccacaggttccagcttagggtaggacacggggacaagaatcacgcagacgcggatcgctctcctgtgtttttgcaatttattgactgtgtttggcaaatgactcgtcagttccccaccgctttcgagttcaacgagtactttctaatcacaattctcgaccacctgtattcctgcctgttcggcaccttcctgtgcaattccgaacagcagaggggcaaggagaatctacccaagcgtacagtttccctgtggagttatattaattcccaactggaagactttactaaccccctgtacggttcttattccaaccacgtgctataccccgtggctagtatgcgccacctggagctgtgggtgggctattacatcaggtggaatcctagaatgaagccacaagaaccgattcataaccgctataaggagttgttggctaaacgcgcagaattgcagaagaaggttgaggagttacagagggagatcagcaaccgtagcacctctagtagcgagcgggcaagcagtccagctcagtgtgtaactccagttcagaccgtggtatag

SEQ ID NO: 125575 - DNA, 1716 bp, Artificial Sequence
  Description of Artificial Sequence: Synthetic coding sequence
atggaggagccacccctgttgcctggcgagaacataaaggacatggcaaaggatgtcacatatatctgcccctttaccggcgccgtcaggggtaccctaactgttaccaactaccgactgtacttcaagtccatggaaagggacccaccgtttgtgctcgatgcatcactgggcgttataaatagggttgaaaagattgggggggcgagttcaaggggcgagaacagttatggtctggagacagtgtgcaaggacatccgcaatctcagatttgctcataagcccgagggaaggacacgaaggtcaatctttgagaatctgatgaaatatgcctttcctgtctcaaacaacctccctctttttgctttcgaatacaaggaagtgttccctgagaacggttggaagttgtatgacccgctgttggagtatcgtagacagggcataccaaacgagtcctggcggattaccaaaattaatgaaagatacgaattgtgcgatacataccccgccctgctcgtggttcccgcaaacataccggatgaagagctgaagcgtgtggcctccttcagatctaggggcaggatcccagtcctatcatggatccatcccgaatcccaagccacgattacccggtgctcccagcctatggtaggcgtgagcggcaagaggtcaaaggaggatgagaagtacctgcaagccataatggactcaaacgcgcagtctcacaagatcttcatattcgacgctcgccccagcgtcaacgcagtcgcgaacaaagcaaagggcggaggatacgagtcagaggacgcctatcagaacgctgagctggtcttcctggacatacacaacatacacgtaatgcgcgagagtctccgcaagctgaaggagattgtatatcccaatatcgaggagacgcactggttgagcaacctggaatccacccactggcttgaacatataaagctgatcctggccggtgcgctgcggattgccgacaaagtcgagtcagggaagaccagcgttgtagtgcactgcagtgatggctgggatagaaccgcccagcttacctctctcgcaatgctgatgctggacggttattaccggacaattcgcggttttgaggttctggtggagaaggagtggctctcattcggccatcgatttcaactgcgggtcggacacggagacaaaaaccatgctgatgccgatcgatcaccagtattcctgcaatttattgactgtgtttggcagatgacccggcaattcccaaccgcattcgaattcaacgagtattttctgattactatcctcgaccatctatactcttgtttattcggcacatttctttgcaactcagaacaacagaggggcaaggagaatctgcccaagagaactgtgtccttgtggtcttacattaactctcaacttgaagatttcaccaatccactttacggctcgtattccaaccacgtactgtatcccgtggcatcaatgcggcacctcgagctgtgggtggggtactatattaggtggaacccccggatgaaaccacaagaacccattcacaacagatataaagaactgctcgctaagcgggccgagttacaaaagaaggtggaagagcttcagagagaaatatcaaatcggagtacatcaagttctgaacgagcttcatcacctgcacagtgcgtcacacccgtgcaaactgttgtgtag

SEQ ID NO: 125576 - DNA, 1716 bp, Artificial Sequence
  Description of Artificial Sequence: Synthetic coding sequence
atggaagaacctcctctgctcccgggagagaacatcaaggacatggctaaggatgtgacttacatttgccctttcacaggagcggtgcgcggcacgctgaccgtaacaaactaccgcctttattttaagtctatggagagagatccacccttcgttctggacgccagtcttggcgtcatcaaccgagtggagaagattggaggagcttcgagtagaggggagaattcttatgggctcgaaactgtatgtaaagacatcagaaatctgcgttttgctcataaaccagagggccgcacccgccgctctatctttgagaacctgatgaaatatgcctttccagtgtcaaacaacctgccactcttcgcatttgaatataaggaggtattccccgagaatggttggaagctgtacgacccattgctcgagtaccgcaggcaaggcataccgaacgagtcctggagaattaccaagatcaatgagcggtatgagctttgcgatacttaccctgccctgctcgttgtacctgcgaacatcccggacgaggagcttaagcgggttgcctcctttcgctctcggggccgcatccctgtgctgtcttggattcatcctgagagtcaagcaacgataactcggtgcagtcaacctatggtgggagtgagtggaaagcgcagcaaagaagatgaaaagtatcttcaggccatcatggattcaaatgcgcaatcacataagattttcatctttgatgctagacctagtgtgaacgccgtggccaataaagccaagggaggtggatacgagagcgaagacgcctatcagaatgctgaactggttttcctggatatccacaacattcacgtgatgagagagtctctacgcaaactgaaagaaatagtctatccaaatatcgaagagacacactggctaagtaacctggagtctacacattggctggagcacattaaactgatccttgcaggagccctgagaatcgccgacaaggtcgaatcagggaaaacctcagttgtagtgcactgttcagacggctgggatagaaccgctcagcttacctctctcgctatgctcatgctggacgggtactaccgtacgatcaggggcttcgaagttctcgtggagaaggaatggttgtcttttggtcacaggttccagcttagagtgggacatggagacaaaaatcacgctgatgcagacagatcaccggtcttcctgcaattcatcgactgcgtttggcagatgactcggcagtttcctacagcgttcgaatttaatgagtacttcctgattaccatcttggaccatctctacagttgtctgtttggtacgttcttatgcaactctgagcagcagcgtgggaaagagaacctgcctaagcggaccgtgtcactgtggagctacattaatagccagctagaagatttcactaatcctctgtacgggtcttattctaaccatgtgctttatccagtggcctcaatgcgccacctggaattgtgggtcggctactacatacgatggaacccccgcatgaaaccccaggaaccgattcataatagatacaaggaactgctggccaagagggctgaactgcagaagaaggtggaagagctccaaagagaaataagtaataggagcacctcaagctcagagagggctagctctcccgctcaatgcgtaacccccgtacaaaccgtggtttag

SEQ ID NO: 125577 - DNA, 981 bp, Artificial Sequence
  Description of Artificial Sequence: Synthetic coding sequence
atgctggcggtcgccctgaccatcttgtctgctagtaccagtcatagcgaaaatagtgtccacactaagtccgcctcagtcgtctccagcgattcgattagtacttcagccgacaactttagcccggacctccgagtgctgagagagtctaacaagctggctgagatggaggagcccccgttgctgccaggggagaacatcaaagatatggccaaagatgtaacatatatctgtccattcactggagcagtgcgggggaccttgacggtcacaaactacagactgtacttcaaaagcatggaaagagaccccccatttgtcctcgatgcatccctgggcgtgatcaaccgggttgaaaagatcggaggggcttcaagtaggggcgagaactcttacggcttggaaaccgtgtgtaaagacattaggaacctacgatttgctcataaaccagagggccggactcgccgctcaatatttgaaaacctgatgaaatatgcctttcctgtcagcaacaacctgcctctcttcgcttttgaatataaagaggtttttccagagaacgggtggaaactgtacgaccccctgctggagtataggcggcagggcatccctaacgagtcttggaggatcactaaaataaacgaacgctatgaactgtgtgatacctacccagctctgctcgttgtgcccgccaacattccggacgaggagctcaagcgcgtggctagtttccgcagtcggggacgaattccagtcctctcctggatacaccccgagagtcaggcaacaattaccaggtgtagtcagccgatggttggtgtgtccgggaagcggtctaaagaggacgaaaagtacctccaggccattatggatagcaacgctcagagccacaaaatctttatctttgatgcccggccatctgttaatgcagtagccaacaaggcaaaaggaggcggctatgagagtgaggacgcctactag

SEQ ID NO: 125578 - DNA, 3513 bp, Artificial Sequence
  Description of Artificial Sequence: Synthetic coding sequence
atggatgaagagactagacactcactcgagtgtatacaggcaaaccaaatctttccaagaaaacagctcatccgtgaggacgaaaatttacaggtccccttcctcgagctgcacggggagtccactgaatttgtgggcagggccgaagacgccatcattgccctgtccaactaccggctccacattaaatttaaagaaagtctggtgaatgtgcccctccagctgatcgagagcgtggagtgccgagacatcttccagctgcacctgacttgcaaggactgtaaagtaattaggtgccaattttctacttttgaacagtgccaagagtggttgaaaaggttaaacaatgccataaggccaccagccaagatcgaagacctcttttcctttgcctaccacgcttggtgtatggaagtgtatgcatctgagaaagagcagcacggggatttatgccggcctggcgagcacgtgacttcacgctttaaaaacgaagtggagaggatgggatttgatatgaacaacgcctggcgcatcagtaatattaacgagaagtataagctgtgtggcagctacccccaggaactcatagtgccagcttggattaccgataaagagctagagagcgtcagttcattcagaagctggaaacgtattccggccgtaatctaccgtcaccaaagtaacggtgccgtgattgcacggtgcgggcagccagaggtgtcatggtggggttggaggaatgccgacgacgaacatctggttcagtcagtggccaaggcgtgtgcctcagatagtaggagctccggttctaaattgtcaaccaggaatactagtagagattttcctaatggcggtgacctgtccgacgtggaattcgattcgagtctaagtaacgcctctggtgcggaatcccttgcaattcagccccaaaaactacttattctggacgcccgatcttacgccgccgctgtggccaacagagcaaagggcggagggtgtgaatgtcctgaatactatcccaattgcgaggtcgtgttcatgggtatggccaacatacacagtatccgtaggagcttccagagcttgcggcttctatgtacgcagatgccggatcccggcaattggttgtcagctctggagtcgactaaatggttacatcatcttagtgtccttcttaaatctgccctgctcgtcgtccacgccgtcgatcaggaccagaggccggttctagtgcactgttccgatggttgggatagaacaccacaaattgtggctctagccaaactgctgctcgacccttactatcggaccatcgaaggcttccaggtcctcgtagaaatggagtggctcgattttggccacaaattcgccgatcggtgcggacatggggaaaacagtgacgatctgaacgaaaggtgtcctgtgttccttcagtggctagactgtgtccatcagcttcagcgacagtttccttgctccttcgaatttaacgaggcctttcttgtcaagctagtacagcacacctacagctgtctgttcggcaccttcctgtgtaataacgccaaggaaaggggcgagaaacatacccaggagcgaacgtgtagcgtctggagcctgctgagagccggcaataaggcattcaagaatttactgtacagctctcaatcagaagccgtgctgtaccccgtatgccatgtaaggaatctcatgctttggagcgctgtgtacctcccgtgcccatcacccaccacccccgtggatgactcttgcgccccgtaccccgcccctggtaccagtcccgatgacccaccattgtctcggctgcctaaaacacggagttacgataacttgactacagcctgtgacaatactgtgcctttggcctctcgccgctgcagtgacccaagcttaaacgagaagtggcaagagcacagaaggtctctagaattgtcgtcattggccggcccaggcgaggaccctctaagcgccgacagcttgggcaaacccacgagggtgcctggcggagccgagctgagcgtcgccgccggcgttgccgagggacagatggagaatattctacaggaagccacaaaggaggagagcggtgtcgaggagcccgcgcaccgagccggcatcgaaatacaggagggcaaggaagatcctctgctggagaaggagtcaagacgaaagacacccgaagcatcagctatcggcctgcatcaggaccctgagttaggcgatgcagcccttcgatcacacctggatatgagttggcctctattctcacagggaattagtgagcaacagtctggactatccgtgctgttgtcctcccttcaggtcccaccaaggggggaagactcactggaggtgccggttgagcaattccgaatagaggagatcgctgaggggagggaagaagccgtcttaccgatcccagtcgacgccaaagtgggttacggaacatcacaaagttgttccctgctccccagccaggttccttttgagactcgaggacctaatgtggatagctctactgatatgcttgtggaggacaaagtcaaatccgtgtctggaccgcagggacaccaccgcagctgcctcgtgaactcgggtaaagaccgacttccccagacaatggaaccatcgccatccgagaccagcttagtggaacggccccaagttgggtcggtggtccatcgcaccagcctcggctccacgctgtccctcacccggtcaccgtgcgctctgccccttgctgaatgtaaggaaggactggtctgtaatggcgcaccagagacagagaatagagcctcagaacagccccccggcctgtcaaccctgcagatgtacccaacccccaatggtcattgcgccaatggagaggcggggcgcagtaaggattcactcagtcggcagctatccgccatgagctgctcgtcggctcacctgcactcccgcaacctgcatcacaagtggctgcacagccatagcggacgcccctcagccactagcagccccgatcaacccagccgtagtcacctcgacgatgatgggatgtcagtctataccgataccattcagcagcgacttcggcaaatcgagtcgggccaccagcaagaggtggagaccttaaaaaagcaggttcaagagctaaagtcaaggctcgaaagtcaataccttacaagtagtctgcactttaatggggattttggcgacgaagtgatgactcgatggctccccgaccacctggccgcccactgctacgcatgcgacagtgcattttggctcgcttcgcgtaagcaccactgtagggatacggaccgcgtggaccagacctggaactgcggtaacgtcttttgctctagctgctgcaaccagaaagtgccggtgccaagccagcagcttttcgagccatccagagtatgtaagagctgctacagctccctccacccaacaagtagcagcatcgatctggagctagataagccaattgcagccacctccaactag

SEQ ID NO: 125579 - DNA, 3486 bp, Artificial Sequence
  Description of Artificial Sequence: Synthetic coding sequence
atggacgaagaaactcgacactccttggaatgcatccaggctaaccagatcttccccagaaaacaattgatccgagaagatgagaatctgcaggtgccttttttggaactgcacggtgagtcaacagagtttgtgggacgtgcagaagatgccattatcgccctgtcgaactatcgactgcacatcaaatttaaagagagccttgtcaatgttcctctccagctgatagagtctgtcgaatgtcgagatatcttccagctgcatctcacctgcaaggactgcaaagtcatcaggtgtcagttctccacattcgagcaatgtcaggagtggcttaaacgtctcaataacgccattaggcctccagctaagattgaggatctgttcagtttcgcctaccatgcatggtgtatggaagtgtacgcttccgagaaagagcagcacggtgatctctgcaggcccggcgagcacgtgacctctagattcaaaaacgaagtcgaacgtatgggctttgacatgaataatgcatggaggatcagtaatataaatgagaagtataaactttgtggcagctacccacaggaactgatagttcccgcttggatcacagacaaagagctggagtccgtcagctctttccgtagctggaaaagaatccccgccgtgatttatcggcaccagtctaacggagcagtaatcgctagatgtggccagcctgaggtctcctggtggggttggcggaatgctgacgatgaacatctagtgcagtccgttgccaaggcctgcgcctcggacagtaggagctcagggtcaaaactgagtaccaggaatacctcacgggactttccgaacggcggagacctcagtgatgtcgagttcgacagcagcctgtccaatgcaagcggggcggagtctctggctatacagccacagaaactactgattctggatgctcggtcttatgcagcggcagtggctaatcgcgcaaaagggggaggctgcgaatgtcccgagtattatccaaattgtgaggtggtttttatggggatggctaatattcacagcatacgtcgcagcttccaatcattgcggctgctctgcacccagatgcctgaccctggaaattggttaagcgccttagagtccacaaagtggctgcatcatttatccgtcctactgaaatcagcccttctcgttgtgcacgccgtggatcaggatcagagacctgtgcttgtccactgctcagacggttgggaccgcacgcctcagatcgtggctctagccaaactgctccttgatccgtattataggaccattgaagggtttcaggtgctggtcgagatggaatggctggattttggtcacaagttcgccgatcggtgtggccacggcgagaattctgacgacttgaatgaacgctgccccgtgtttctgcagtggcttgattgcgttcatcagctccagcgccagttcccttgtagctttgagtttaacgaggcattcctggtcaaattggttcagcacacctatagctgcctgttcggaacatttctttgtaataatgccaaggagcgaggtgaaaagcacactcaggagcgcacatgttctgtctggtcactcctacgcgctggcaataaggcgttcaagaatctgctttattcctctcaaagcgaagccgtgctatatcctgtctgccacgtgaggaatctgatgctgtggtcagccgtgtacctgccttgcccttccccaacaacgccggtggatgattcatgtgccccatacccagctcctgggacttctccggacgatccccctctgagccgtctgcccaagacgagatcctacgataatctcactacagcctgcgacaacaccgtgcctttagcctcccgcagatgcagcgatccaagcctgaacgagaagtggcaggaacaccgccggagcttagagctttcttctctggccggtccaggcgaagatccactgagcgcagactcgttaggaaaaccgacgagagtgcccggtggagctgagctctctgtcgccgccggtgtagcggaggggcaaatggagaatattctgcaggaagcaacaaaggaggaatccggcgtggaggaacccgcgcacagggccggaatcgaaattcaggagggaaaggaagacccactactagaaaaggaaagtagacggaagactcctgaggccagcgccatcggtctccaccaagacccagagttgggcgacgcagcgctcaggtcccacctggatatgtcttggcccctattctctcaaggcattagtgagcaacagtctggtctgtcggttctgctctcaagcctgcaagttcctcctcgtggcgaggatagcctggaagtccccgtggagcagtttcggatcgaggagatagctgagggcagagaagaagctgtccttccgattcctgtcgatgctaaggtgggctacggcacttctcagagttgttctcttttaccttctcaagtccccttcgaaaccagaggtcccaatgtcgactcctccaccgatatgctggtcgaagacaaagtgaagagtgtgtcaggcccacagggccatcatcggagttgtctagtgaatagtggcaaagacaggctgccccagacaatggaaccctccccttctgagacaagtctggtggagcggccccaggttggctccgtggtgcatcgaacatcactcggctcaaccctgtctctgactcgctcaccatgcgctctccccctggctgaatgcaaagaaggtttggtctgcaacggagcccccgagactgagaatcgggcttccgagcagccccccggcttgtcaacgttgcagatgtatcccacccctaatggacactgcgccaatggggaagccggaaggtctaaagatagcctctcacgccagctcagcgcgatgtcatgctctagcgcacacctgcacagcaggaacctgcaccataaatggctccactcacactcaggcagaccatcagctaccagcagcccagaccagcctagccgttcccacctggatgacgatggcatgtctgtgtacaccgataccatccagcagcggttacgacagattgaaagtggccatcagcaggaggtcgagacgttaaaaaagcaggtgcaggagctgaaatccaggcttgagtcccaatacctgacaagttccctgcactttaatggtgacttcggtgatgaggtgatgaccagatggctgcccgaccatttagccgctcattgctacgcctgcgactccgccttctggctagcttcacgtaagcaccattgtagaaactgtgggaatgtattttgctccagttgttgtaatcagaaggtgcctgtcccctcgcagcaactgtttgaaccttctcgggtttgcaaatcatgttattccagtctccaccccaccagtagcagcatagatttggagttggacaaacccatcgcagccacctcgaactag

SEQ ID NO: 125580 - DNA, 3597 bp, Artificial Sequence
  Description of Artificial Sequence: Synthetic coding sequence
atggatgaggagacccggcactcactggaatgtatccaggccaatcagatcttccctaggaagcagcttattagagaagacgagaatctgcaggtgccattcctcgaactccatggtgaaagcactgagtttgtgggacgtgcagaggatgccatcatcgccctgtcaaattatcgtttacatatcaagttcaaggaatccctggtaaacgtgcctctccagctgatagaatctgtggagtgccgcgacatttttcagttacacctgacatgcaaggattgtaaagtcatacgttgccagttctccacattcgagcagtgtcaggagtggctgaagagactaaacaatgcaatccgacctccagcaaaaatcgaggacctgttttcattcgcttaccacgcttggtgcatggaggtatacgcctctgagaaggagcagcacggagacctctgtcggcccggggagcatgtaacttcccgattcaagaatgaggtggagcgaatggggtttgacatgaacaatgcctggcgaatttctaacattaacgagaaatataagttatgtggcagttatccccaggaactcatcgtgccagcttggatcacggacaaggagctggaaagcgtgagtagttttcggtcatggaaaaggattccagccgtcatttatagacatcagagcaacggcgcagtgatcgcccggtgcggccagcctgaggtgtcctggtggggctggcggaatgccgacgacgagcatctggtgcagtctgtggccaaggcctgcgcctctgactctcgctcgagcggttcgaagctgtcgactcggaacacatctcgggattttcctaatggcggagacttatccgacgtggagttcgacagctccttaagcaatgcatccggtgctgaatctcttgcaattcagccacaaaagctcctgatcttagacgctcggtcctacgctgccgccgtcgcgaaccgagctaagggcggcgggtgtgagtgtcccgaatactacccgaattgtgaagtggtgttcatgggcatggccaacatacactctatcagacgctccttccaaagcctgaggctgctttgcactcaaatgcccgaccctggtaactggctgtcagctttggagagcactaagtggctgcatcacttgagcgttcttcttaagtcagccttgctggtggtgcacgcagtagatcaagaccagcgccccgtgcttgtgcactgttccgatgggtgggatagaaccccacagatcgttgcattggcaaagttactgctggacccttattatcgcaccattgaggggttccaggtcttggtcgagatggagtggctggattttggacacaaatttgctgatagatgcggacatggggagaacagcgacgacctaaatgaaaggtgtccggttttcctccagtggctggattgcgtgcatcagttacagcgacagttcccctgttcttttgagttcaacgaggcattcctcgttaagttggtacaacatacatacagctgcctgttcggcacttttttgtgcaacaacgcaaaggagcgcggtgaaaagcatactcaggagcggacttgtagcgtgtggtctctgcttcgagcgggtaataaggctttcaaaaacttactctattcctcccagtcagaagcggtgctttacccagtttgtcacgttagaaatctgatgctttggtccgccgtttacctgccatgcccgagccccaccactcctgttgatgactcctgcgccccctaccccgcccccggcactagtccagatgatcctcccctgtcacggctcccaaaaaccaggtcttacgacaatctcacgactgcatgcgacaatactgtccccctcgcatcacgcagatgtagtgaccccagcctgaatgagaaatggcaggaacaccggagaagtctggaactttctagtttggccgggcccggggaagaccccctgtctgctgactccctaggcaaacccacacgggtacctggcggcgccgagctttccgtggctgcaggagtggctgaaggacagatggaaaatatactgcaggaggcaacaaaggaggaatccggggttgaggagccagcccacagggccggtatcgaaatccaggagggaaaagaggacccactgttggagaaggagagtcgacgtaagactccggaggccagcgccattgggctgcatcaggaccctgagcttggcgatgccgccttgcggtctcatctcgacatgagctggcctctgttttcccaaggaatatctgagcagcagtctggcctgtcagttctcctgtcatcactccaggtcccccctaggggtgaggactccctcgaggtgcccgtggagcagtttcggattgaagaaatagctgaaggcagggaggaggctgtcctgcctatccccgtggatgctaaggtgggatacggcacttcacagtcatgctcccttttgccctcccaggtgcccttcgagacccgcggccccaacgttgatagctccacagacatgctggtcgaagataaagtgaaatctgtgtcaggccctcagggacaccatagatcttgtctcgtgaactctggaaaggacagacttccccagacaatggaacccagtccgtcagagacttcattggtggagcgacctcaggtgggcagcgttgtgcatcggacaagcctgggctcaaccctcagtctgactcggtcaccatgcgccctcccccttgcagagtgtaaagaaggtttggtgtgcaacggggcgcctgagaccgagaatcgagcatcagagcagcctccaggcctcagcaccctgcagatgtaccctacgcccaacgggcactgcgcaaacggcgaagccggccgctctaaggattccctctctaggcagctctcggcgatgtcatgctcgtccgctcatctgcattctcgcaatctgcatcataaatggctgcatagtcactctggaagaccttctgcgaccagcagccccgatcagcccagcagatcccatctggacgacgatggaatgagcgtgtatacggatacaatacagcagcggctgcgccagatcgagtcaggtcaccagcaagaagtcgaaaccttgaaaaaacaggtgcaggagctgaagtccaggctcgagagccagtacctaacatcctccttgcatttcaatggggattttggggacgaagtaaccagcatccctgactctgaatctaacctggatcaaaattgtcttagcagatgtagcactgagatatttagcgaggcttcatgggaacaagtcgacaagcaggatactgagatgactcggtggttgcctgaccatctggctgcacactgctatgcctgcgacagcgccttttggcttgcaagcaggaaacaccactgtaggaactgtggaaacgtgttctgtagttcctgctgcaatcaaaaagtgcctgtgccgtcccagcagcttttcgaaccctccagagtgtgtaaatcttgctacagctccttgcatccaacttcctctagcattgatctggaattggataagccgatagcagccacaagtaactag

SEQ ID NO: 125581 - DNA, 3513 bp, Artificial Sequence
  Description of Artificial Sequence: Synthetic coding sequence
atggacgaggagacccgccactctctggaatgcattcaggctaatcaaattttcccccgaaagcagctcattcgtgaggacgaaaacctccaggtcccattcctcgagctgcatggcgaatccacggagtttgtcggtcgtgctgaggatgcgattattgcattgtctaactacagacttcacatcaaattcaaggaatctctagtaaacgtgccgttacaattgatagaatctgttgagtgtcgtgatatcttccaactgcacctaacctgtaaggactgtaaagtgataaggtgccagttttctacttttgagcagtgtcaggaatggctgaaaagattaaataacgccattagaccgcccgccaaaatcgaggatctattctcttttgcttatcacgcttggtgcatggaagtctatgccagcgaaaaggagcagcacggcgatctctgccgacctggtgaacacgtcaccagccggtttaagaacgaagtcgagcgtatggggtttgatatgaacaatgcttggcggatatcgaatatcaacgaaaaatataagctttgcgggtcttatccccaggaattgattgttccagcgtggataactgataaggaactggagtccgtgagctccttcagaagctggaaaagaattccagccgtgatctaccgccaccagagcaatggagcagtgatcgcccggtgtggacagcctgaggtgagttggtggggatggcggaacgccgatgacgagcacctggtccagtcagtcgccaaggcatgtgcctcggatagtagaagttccggaagcaagttaagcacgcggaacacatcccgcgatttccctaacggaggagatctgagtgatgttgagtttgactcttcgcttagcaacgcctccggggctgagagcttggcaatccagccccagaagctactcattctcgacgctcgctcatatgcggctgccgtcgcaaaccgggcgaaaggaggcggctgtgagtgccccgagtattatcccaactgcgaggtggttttcatgggcatggcaaacatccacagcattcgtaggagtttccagtcgttaagacttctgtgtacccagatgccggatcccgggaattggctgtctgccttggagtcgacgaaatggttgcatcacctctccgttctattgaagagtgctctcctcgtggtgcacgcggttgatcaggatcagcgaccggtgctcgtgcactgctctgatggctgggacagaacgccacaaatagttgctctggccaagctgcttctcgatccctattaccgaactattgaggggttccaggtgctagtcgaaatggaatggctggacttcggacacaaatttgccgatcgctgtggccacggagagaacagtgacgacttgaacgagcgctgcccggtcttccttcagtggctagattgcgtacaccagctgcagcgccagttcccatgttctttcgagttcaatgaagcctttttagtgaagttggtccagcatacctactcatgcctgttcggtacattcctgtgcaataatgcgaaagaacggggagaaaaacacacccaggaacggacatgttccgtttggagcctgctgagagcaggaaacaaagcttttaagaatctgctctattccagccagagtgaagccgttctataccctgtatgccacgtacggaatctaatgctgtggtctgctgtctatttaccttgcccgtccccaacgactcccgtggacgatagttgcgccccataccccgcacctggaacctcacctgatgaccctcctctttccagacttcccaaaacaaggtcctacgataacctgacaaccgcctgtgataacaccgtccctttggcctccagaagatgtagtgatccatccctcaacgaaaagtggcaggagcatagacggagtttggagctctcctctctcgcgggacctggggaagatcccttgtcagccgattccctgggaaaacccactcgtgtgcccggcggcgctgaactgtcagtcgccgccggggtggctgagggccaaatggagaatattttacaggaggccaccaaagaagagtcgggggtcgaggagcctgctcaccgcgccggtattgaaattcaggaagggaaagaggatccactgctggagaaagagagtagacgaaagactccagaggcatctgcgatcgggcttcatcaggacccagaattgggtgatgccgccttgcgctctcacctcgacatgtcatggcccctgtttagtcaggggattagcgaacagcaatccgggttatccgtgctactgtcaagcttgcaggtccccccaagaggtgaagacagtctcgaggtaccggtcgaacagttccgcattgaagagatagccgagggacgcgaggaggccgtgctgcctatcccggtcgatgccaaagtgggatatggaacctcgcagtcatgctctctcctcccctctcaggtgcctttcgaaaccagagggcctaacgtggacagttcgacagacatgctggtggaggacaaggtgaagagcgtcagtggaccccagggccatcacagaagctgccttgtcaactctgggaaggatagactgcctcagactatggaaccatcacccagcgaaacctctctggtcgagcggcctcaggtgggctccgtagtacaccggacttcccttgggagtaccctgtcccttacacggtctccgtgcgccctccccctcgccgagtgtaaggaagggttggtgtgcaacggagccccagaaaccgagaatcgagccagcgagcagccaccgggcttgagcacccttcaaatgtaccccaccccaaatggccactgcgccaatggcgaagccggtcgctctaaggactccctgtccaggcaactcagcgctatgagctgttctagcgcccacctgcactcccgcaacctgcaccacaagtggctgcactcccactccggcaggccatccgccacttccagccctgaccagccaagccgctcccatctcgatgatgacggaatgagtgtgtacactgacactattcagcagcggttgagacaaatagagtcaggccaccagcaagaagtggagacccttaaaaagcaagttcaggagctcaaaagtcggctcgaatcccaatatttgacctcctccctgcactttaacggggacttcggcgatgaggtgatgacccgctggctcccagaccacttggctgctcactgttacgcctgtgactctgcgttctggctcgccagccggaagcatcactgcagagataccgatagagtggatcagacctggaattgcggcaatgttttttgttcttcttgctgtaaccagaaggtacccgtcccaagccaacagctctttgagcctagtcgggtgtgcaagagctgctatagcagcctgcaccctaccagctcctccatcgatttggagctggacaagccgattgcagctacttccaactag

SEQ ID NO: 125582 - DNA, 420 bp, Artificial Sequence
  Description of Artificial Sequence: Synthetic coding sequence
atggacgaagagaccaggcactctctggaatgcatccaggcaaatcagatttttcccagaaagcagttaatacgggaagatgaaaatctgcaagtgcccttcctagaactacacggcgagtcaactgagttcgtcggccgagccgaggatgcaattattgccctgagcaattatcgtttgcacattaagtttaaagagagccttgtcaacgtgcctttgcagcttatagagagcgtagaatgccgagacatttttcagttacacctcacttgcaaggattgtaaggttatccgatgccagttcagcacctttgagcagtgccaggagtggctcaagcgattgaataacgcaatcagaccacccgccaaaatcgaagacttgtttagcttcgcctatcatgcttggtgtatggaggtttag

SEQ ID NO: 125583 - DNA, 3588 bp, Artificial Sequence
  Description of Artificial Sequence: Synthetic coding sequence
atgggcgaagagggccccccttcgctggaatatatccaagctaaagaccttttcccccctaaggagctcgtgaaggaggaagagaatctgcaagtgccctttaccgtcctccagggagagggagtcgaatttctcggtcgcgccgcggacgcgctcatcgcgatttccaattaccgactgcatatcaaattcaaggactcagtcataaacgtgccattgcggatgatcgatagtgtagaatctcgagacatgtttcagctacatatttcctgcaaggatagcaaggtggttaggtgccactttagcacttttaagcagtgccaggagtggctatctcgcctaagccgcgccactgcccgaccagccaagccagaagatttgtttgcttttgcctaccatgcatggtgtctggggctgactgaagaagaccagcatactcatctctgccaacccggcgagcatatcaggtgtagacaagaagcagagttggcacgcatgggattcgacctgcagaatgtctggcgggtttcccacatcaattcaaattataaactttgccctagctatccacagaagctgctcgtccctgtgtggatcaccgataaggagctggaaaacgtggcttcctttagatcctggaaacggatcccagtggttgtctaccgccacttgaggaatggggctgctatcgccagatgtagtcaacctgagatttcatggtggggctggcggaatgctgacgacgagtatcttgtgacgtcaatcgccaaggcctgcgccctggaccctggcactagagcaacaggaggatccttgtctacaggaaataatgatactagcgaggcttgtgacgctgactttgactcctctttgacagcgtgttctggcgtggagtcgacagcagcacctcagaaactcctcatcctcgatgctcgctcttacaccgcagcggtggccaatcgggccaagggcggcggatgcgagtgtgaagagtactatccaaattgtgaagttgtattcatggggatggcgaatatccacgccattcgcaacagttttcagtacctccgggcagtgtgctcacagatgcccgacccatctaactggctttccgcgttggaatcaaccaagtggctgcagcacctctcagtgatgctgaaggccgctgtgcttgttgccaacaccgtcgatcgggagggccgcccggtactggttcactgctccgacgggtgggaccgcaccccgcagattgttgccctggcaaagatcctactggacccatactacagaacactggaaggtttccaggtcctggtggaaagcgactggctggatttcggccacaaattcggtgaccgctgtggtcatcaggagaacgtggaggatcagaacgaacagtgtcccgtctttttgcagtggttggactctgttcaccagctgctgaagcaatttccttgcctctttgagtttaatgaggctttcctagtgaagcttgtccagcatacttactcatgcctgtacgggacctttctcgccaacaacccctgcgagcgcgaaaagagaaacatatataaacgcacttgctccgtgtgggctcttctgagggctgggaacaaaaatttccacaattttctctacaccccttcttctgacatggtcctccatccagtgtgccatgtcagagcactccacctgtggactgccgtgtatttacctgcatcttccccatgcacacttggtgaggagaatatggatttatatctgtctcccgtggcccagtcccaggaattcagcggccggagcctcgatcggctccccaaaacgcgctccatggacgatctattgtctgcctgcgacacaagcagtcctttaactcgaacctcgagcgacccaaatttaaataaccattgccaagaggtccgggtcggcctcgagccctggcacagtaaccctgagggatctgaaaccagtttcgtcgattcgggcgtgggcgggcctcagcaaactgtaggggaagtaggactcccgccccctctgccttcatcacagaaggactacctaagcaataagcccttcaagtcacacaaatcttgctctcccagctacaagctgctgaatacggcagtgccccgcgagatgaagtctaatacttccgatcctgagatcaaggtcctcgaggagacaaaaggccccgctccagacccatctgcacaagatgaactgggacgaaccctcgatggcatcggggagccaccagaacactgcccagagacagaagctgtcagcgcacttagcaaggtgatcagcaataagtgcgacggagtttgcaattttcccgaaagctcgcagaacagtcccacaggaacacctcagcaggcgcagccggactctatgctcggagtgccgtcaaaatgcgttctggatcactctttgtcgactgtttgcaatccccccagcgcagcttgtcagaccccccttgatcctagtactgatttcctcaaccaggacccatcaggctctgtcgcatctatctctcaccaggagcagctgtcctccgtcccagatctgacccacggtgaggaggacattggaaagcgggggaacaataggaatggacagctattggagaatcccaggtttggcaagatgcctttggaattagtgcgaaaacctatttcccagtcccaaataagtgaatttagctttctcggaagcaactgggacagcttccagggtatggtcacttcattccccagcggggaggccactccaagaaggctgctgtcctatggctgttgttctaaacgcccgaatagcaaacagatgagagccaccggcccttgtttcggcgggcagtgggcccagcgagagggagtgaagtcacctgtatgcagttcacacagtaatgggcattgtacaggtcccgggggtaagaaccagatgtggttaagctctcaccctaagcaggtgagtagcacaaagcccgtgcctttgaattgcccctcgcctgtccctccactgtatctggacgatgatggactgccctttccaacagacgtcattcaacataggctgcgtcagatcgaagccggctataagcaggaggttgagcaactgcggcggcaagtgcgcgagctgcagatgagactcgacatccgccattgttgtgcccccccagctgagccccccatggattatgaggatgattttacatgtctgaaggagagtgatggtagcgatactgaggatttcggcagcgatcactcggaagactgtctgtcagaagccagctgggaaccagtcgacaaaaaagagacagaagtgacacgatgggtcccagaccatatggctagccattgctacaactgtgactgcgaattttggctggccaagcggcggcaccattgccggaactgtggtaacgtattttgtgctggctgttgccatttaaaactccctatccccgatcagcagttgtacgatcctgtcttggtttgtaattcctgttacgagcacatccaggtgagcagggctcgcgagttgatgtcccagcagctcaagaaaccaatcgcaacggcaagttcatag

SEQ ID NO: 125584 - DNA, 570 bp, Artificial Sequence
  Description of Artificial Sequence: Synthetic coding sequence
atgcccgtatggaaactgccctggaagttaagcgagggcaaacgtagggcacaggtcgaaggtgaggacctctttcccgtggctatatcttttggaaggcccaaagaagtactccctctttactcgtctgagagccacagatttaccgtcctggaacccaatactgtctccttcaactttaagttctggaggaacatgtaccatcaatttgatagaacactgcacccccgacaaagtgtattcaatattatcatgaatatgaacgaacaaaataagcaacttgagaaagacatcaaggacttagagagtaaaataaaacagcggaaaaataaacaaactgacggaatactcactaaggagttgttgcactcagtgcacccagagtcgcctaatctgaaaactagtctgtgctttaaggaacagaccctcctgccagtgaatgacgctctaaggactatcgaaggatccagcccagccgataacagatatagcgagtacgctgaagaattctccaaatccgagccagcggtggtgtctctcgaatatggagtggcccgtatgacctgttag

SEQ ID NO: 125585 - DNA, 1866 bp, Artificial Sequence
  Description of Artificial Sequence: Synthetic coding sequence
atggagcatattcgcactaccaaagttgagcaggtaaagctgctggatcgcttttctaccagtaacaaaagcctcaccggcacactgtacctcacagcgactcatctcctctttatcgatagtcaccagaaagagacctggatcctccaccatcatattgctagcgtagaaaaactggcactcacgacaagtggctgtccccttgtgatacagtgtaaaaactttcgaaccgtccactttatcgtcccaagagagagagattgccacgatatatataactcattgctacagctgtcgaagcaggcaaaatacgaagacctatacgcgttttcttataaccctaagcagaacgattccgaacgcctccaagggtggcagctgatcgacctcgccgaagagtataagaggatgggtgttccaaactcccactggcagctgtccgacgctaaccgtgattacaaaatttgtgagacctacccccgggaactctacgtgccccggattgcatcaaagccgatcatcgtgggttcctctaaattcagaagtaaaggaaggttccccgtgctgtcatactaccaccaggacaaggaggcagcgatctgtcgctgcagtcagccattgtcgggattcagcgcacgatgtttagaagatgagcatctgctccaggccatctcaaaagctaatccggtcaatagatacatgtatgtgatggatacccgacccaaactgaatgccatggccaatagggccgctgggaaaggctacgagaacgaggataactattctaatattagattccagtttgtcggcatcgaaaatattcacgtcatgaggtcatctctccagaagcttttggaagttaacggtaccaaaggcctatctgtgaatgacttttactcaggcttggaatccagtggttggctgagacacataaaggctgttatggacgctgccattttcctggccaaggccatcactgtggaaaatgccagcgtgctggtacactgctctgacggctgggacaggacatctcaggtgtgtagtcttggcagtcttttgcttgactcctactacagaactattaaagggtttatggtccttatagaaaaggattggatctccttcgggcacaaattcagtgaaaggtgtggtcagctagacggagatccaaaggaagtgtcgcctgtgtttacacagtttctggagtgcgtgtggcacctaacagagcagttcccacaggcattcgagttttcagaagccttcctattgcagattcatgaacacatccacagttgtcagtttggaaatttcctcggaaactgccagaaagagcgggaggaactgaaacttaaggaaaaaacctactctttgtggcccttcttgctcgaggaccagaaaaaatatctgaatccactttactccagcgaatctcatagattcacagtgcttgagcccaatacagtgagcttcaatttcaagttttggcggaacatgtaccatcagtttgataggacattacaccctcggcaaagcgtgttcaacatcataatgaacatgaatgaacaaaataagcagctggaaaaggacattaaggacttggagtctaaaattaagcagcgcaaaaataagcagacagatgggatcttgacaaaggagctgctgcactctgtgcatcccgagagcccaaacctgaagacctccctgtgtttcaaggagcagaccctgctcccggtgaacgacgccctcaggaccatagagggtagcagccctgctgacaatagatactctgaatatgccgaggaatttagcaaatctgagccagcggtcgtctcacttgagtacggcgtagcacgcatgacgtgctag

SEQ ID NO: 125586 - DNA, 1647 bp, Artificial Sequence
  Description of Artificial Sequence: Synthetic coding sequence
atggagcacattcgtaccacaaaggtggagcaagttaaactgctagaccgcttttccacttccaacaagagcctgactgggaccctgtatctgacagcaacccatctcctgtttatcgatagccatcagaaagaaacatggatccttcatcaccatatcgcaagtgtcgaaaaactggccctgaccacaagcgggtgccccctggtgatccagtgtaagaattttcgaacggtgcacttcatcgtgcccagggaacgagattgtcatgatatctataatagcttgctccagctgtccaagcaagcgaaatacgaagatttgtacgcgttctcatataaccctaaacagaacgactcagagaggttacagggctggcagctgatcgatctggccgaggaatacaagcgtatgggggtccctaattctcactggcaactgtccgatgccaatagggactacaagatttgtgaaacatacccccgcgagctgtatgtcccccgaatcgcatctaagccgatcattgtgggctcgtcaaagtttagaagcaaggggcggttccccgtactgtcttactatcatcaagataaagaggccgccatttgcagatgctcccagccgctatccggcttctcagctaggtgccttgaagacgagcatctgctccaagccatcagcaaagctaaccctgttaacagatacatgtacgttatggacacaagacccaagctgaatgcaatggccaacagagcagccggaaagggatacgagaacgaagataactatagtaacattagatttcaattcgtagggatagagaatatccacgtcatgagatccagtctgcagaaactgctggaagttaatgggaccaagggactgagtgttaatgacttctattcaggcttggagtcctctgggtggctcaggcacatcaaagcagtaatggacgccgcaatctttctagccaaagctattaccgtggagaacgcctcagttcttgtgcactgtagcgacggatgggatcgtaccagccaggtatgttccctgggttctctgcttcttgatagctactaccggacaataaaaggattcatggtgctgatcgagaaggattggatatcgtttggccataaatttagcgagagatgtggtcagctggatggcgaccctaaggaagtgagccctgtgttcacccagttcctcgaatgcgtgtggcacctgaccgaacagtttcctcaagcatttgagttctctgaagctttcctactgcagattcacgagcacattcacagctgccagtttggtaattttcttggaaactgccagaaggaacgagaggagttaaaactcaaagagaagacatacagcctatggcccttcctgttggaggaccagaaaaaatatttgaaccctctctacagttccgaaagccaccgatttacggtcctcgagcccaataccgtttcctttaactttaaattctggcgaaatatgtatcatcaattcgacagaactcttcatccacgccagtctgttttcaatattatcatgaatatgaatgagcagaataagcagctggaaaaagacataaaggacttggaatctttgacctcctattccagtttcaaaatcatagtcggacagtag

SEQ ID NO: 125587 - DNA, 1647 bp, Artificial Sequence
  Description of Artificial Sequence: Synthetic coding sequence
atggaacacattcgcaccaccaaggtggaacaggtgaagctgctggatcgattctctacgtccaataaaagcttgacggggaccttataccttacagccacgcatctgttatttatagactcccaccagaaagaaacctggatcctacatcatcacatcgcgtctgtggagaagttagcgctgaccaccagcggttgtccactggttatacaatgcaaaaactttcgaaccgttcacttcatcgtaccacgggaacgcgactgtcacgacatctataattccttgctgcaactgtctaaacaggcaaaatatgaggatctgtacgcctttagctacaaccccaagcagaatgatagcgagagacttcagggttggcaactgatagaccttgcagaggagtataaacggatgggcgtcccaaactcccattggcaactatcggacgctaaccgggattacaagatctgcgagacatatcccagagagctgtacgtgccgagaattgcctcaaagccaatcatcgtcggatcctcaaagtttagatcaaagggccgatttccagtattatcctattaccaccaggataaggaagctgccatctgtaggtgcagtcagccattgagcgggttctctgctaggtgcctcgaggacgagcaccttcttcaggcaatcagcaaagctaaccccgtgaatcgatatatgtacgtgatggatacgaggcccaaattaaatgcaatggcaaatcgggccgccggtaaggggtacgagaacgaagacaattattctaatataagattccaatttgtcggaatcgaaaatatccacgtgatgcgttcctctcttcaaaaactgctcgaagtcaatgggacgaaaggcctgagcgtgaatgatttctactcaggcctggaatccagtggctggctgcgacatatcaaagcggtcatggacgctgctatattcctcgccaaggcaatcaccgtggaaaatgcctcagtcctcgtgcactgcagtgacggctgggatagaaccagccaggtgtgctctctcgggtctctgctgttggattcatactaccgcacaattaaagggtttatggttctcattgagaaggactggattagcttcggccacaagttttcggagcgttgtggacaactggacggtgatccaaaggaagtttcaccagttttcacacagttcctggagtgtgtctggcaccttacggagcaattcccccaagcttttgaatttagtgaagccttcctattacagatacacgagcatattcatagctgtcagttcggcaattttttgggcaattgtcagaaggagagagaggagctcaagttaaaggaaaagacgtactccctgtggccttttttattggaagaccagaagaagtatctgaaccccctttactccagcgagtcgcaccgatttaccgtgttagaacccaataccgttagcttcaattttaagttttggcggaatatgtaccatcaattcgacaggaccttgcatcctagacaatctgtattcaacatcatcatgaatatgaacgaacagaacaaacagctggaaaaggacattaaggacttggagtcctttacaagtttcgccgcagcgagagtgatccagggacagtag

SEQ ID NO: 125588 - DNA, 1983 bp, Artificial Sequence
  Description of Artificial Sequence: Synthetic coding sequence
atggagcatattagaacaccaaaagtagaaaatgtccgactcgtggatagagtatctcctaaaaaggccgcattagggacattgtatctcacagctacacacgtgatctttgtcgagaattcccctgaccccaggaaagagacttggattctgcactcccaaatctccacgatagagaagcaggctactaccgctacaggatgccccctgcttattcgatgtaagaacttccagattattcagttgatcataccccaggaacgagactgtcatgatgtctacatttcactgatccgcctcgcccgaccagtgaagtacgaggagttgtactgcttcagcttcaaccctatgcttgacaaagaggaaagagagcagggatgggtcctgatagatctctcagaagagtacacccgtatgggactccctaatcactactggcaactcagcgatgtgaacagagattatcgggtgtgtgacagctatcccacagagctttacgtgcctaaatccgccactgctcatattatcgtgggatcctcaaaatttaggtctcggagacgtttccctgtgttgtcctactattataaggacaatcatgcatccatttgtagatccagccagccgctctcaggtttcagcgctaggtgcctggaagacgaacagatgctccaggctataaggaaggccaaccccggtagcgattttgtgtacgtggtggatacacgacctaaactgaatgcaatggctaatcgcgctgctggtaaggggtacgagaatgaggacaactatagcaatattaagtttcaattcatcgggatcgaaaacatccacgtcatgcgtaatagcttgcagaagatgctggaggtgtgcgagctgaaaagcccctctatgtcggattttctgtggggcctggaaaactcaggctggctgcgccatattaaggcgatcatggacgccgggatattcatcgccaaagcagttagcgaggagggagctagtgtcctggtccactgctcagacggatgggatcgcaccgctcaggtttgttccgttgcctctcttttgctggacccacattatcgtactctgaaagggttcatggtcctgatagagaaagactggatcagttttggccacaagttcaatcataggtatggcaacctcgatggcgaccctaaggagataagtcccgttattgaccagtttattgaatgcgtctggcaactcatggaacagtttccatgcgcctttgaattcaatgaaagatttctcattcatattcaacaccatatctattcatgtcaatttggtaacttcttgtgtaattcacaaaaggagagacgggaacttaaaatacaagagcggacgtactctctgtgggcacacctgtggaagaatcgtgctgactacctgaaccccctgtttagagcagaccattcacaaacacaaggtactctccacctgccaacaaccccatgtaattttatgtataaattttggagcggaatgtacaatcgctttgagaagggtatgcagcctcggcagtccgttacggactatctgatggctgtgaaagaggagactcagcagctggaggaagaacttgaagccctagaagagagactggaaaaaatccaaaaagttcagttgaattgtaccaaggttaagtctaagcagtccgaacccagcaagcactctggctttagtacctccgacaacagcatcgcaaacacacctcaggactattccggcaatatgaaatcctttccaagcaggagcccatcacagggagacgaagactcagcgctgattttgacccaagataaccttaaatccagtgacccagacctgagcgccaatagcgatcaggaaagcggcgtcgaagacctgtcgtgtaggtcaccctctggcggcgagcatgccccaagcgaggatagtgggaaggatcgggactctgatgaggcggtctttcttaccgcttag

SEQ ID NO: 125589 - DNA, 756 bp, Artificial Sequence
  Description of Artificial Sequence: Synthetic coding sequence
atggagcagtttccatgtgcattcgagttcaacgagaggttcttgatccacatccagcatcacatctacagctgtcaattcggaaacttcttgtgcaattcccagaaggagaggcgtgagcttaagatccaggagcgaacttacagtttgtgggcccatctgtggaagaatcgtgcagactatctgaatcctctgttcagggctgaccatagccaaacacagggaactctgcacttacccactaccccctgcaactttatgtacaaattctggtctggcatgtataaccggttcgagaaaggcatgcagccccgtcagtcagttacagactacttaatggcagtcaaggaagaaacccagcagctcgaggaggagctcgaagccctggaagaacgactcgagaagattcaaaaggtccaactgaactgcaccaaggtcaagagcaaacaatcggagccctccaagcactctggtttctccacatctgacaatagtattgctaacactcctcaagattacagcggcaacatgaaatctttccctagtaggtctccttcccagggcgacgaggactccgccttgattctgacccaagataatcttaaatccagcgaccctgacttaagcgcaaattccgaccaagaatccggcgtcgaggacctaagttgcagatctccctctggtggagaacacgcaccgtcagaagacagcggtaaggatcgggactctgatgaggcagtttttctgacagcttag

SEQ ID NO: 125590 - DNA, 1668 bp, Artificial Sequence
  Description of Artificial Sequence: Synthetic coding sequence
atggagcatataaggacaccaaaagtcgagaacgtacgattggtggatcgagtgtccccaaagaaggccgctttaggaaccttgtaccttaccgctacacatgttatatttgtggagaattcccctgaccctaggaaagagacatggatcctccattcacagatcagtaccatcgaaaaacaggccacaactgcgaccggctgtccactgctgatccggtgtaaaaatttccagatcatccaactgataattccccaagaacgagattgccatgatgtttacatatctctcataagactggcgaggcccgtgaagtacgaggagttatattgtttctccttcaacccaatgctggataaggaggagcgtgaacagggctgggtgctgatagatctctctgaggaatacaccaggatgggtctgcctaatcactattggcagctctccgatgtgaaccgcgactaccgcgtgtgtgacagctatcccacggagctttacgtccccaagtctgctacggcccacataattgtgggcagtagcaaatttcgtagcaggcggcgcttccccgtgctgagctactattataaggataatcacgcttcaatatgtagatcctcccagcctttgtccggattcagcgctagatgtctggaggatgagcaaatgctccaggctatcaggaaggctaacccaggcagtgattttgtttatgtggtggacactcgcccgaaactgaatgctatggcaaacagagccgctgggaaaggttacgagaatgaggataactacagcaacataaagttccagttcatcggaatcgaaaacatccacgttatgagaaattctttacagaaaatgttggaggtctgtgaattgaagtcacctagtatgtctgatttcctgtgggggctggagaattctggatggctgcgccacatcaaggccatcatggatgccggcatttttattgcgaaagccgtgagcgaggagggggcaagcgtgttagtccattgttccgatggttgggataggaccgcccaggtctgttccgttgcctcgctcttgctggatcctcattatagaaccctgaagggattcatggtcctcatagaaaaggattggatttccttcgggcataaattcaaccaccggtacggaaatctcgatggggaccccaaggaaatttcacccgttatcgaccagtttattgaatgcgtctggcagttgatggaacaatttccatgcgcctttgaatttaatgagcgcttcttaatccacatccagcatcatatttactcttgtcagtttggcaactttctgtgcaacagtcagaaagaacggcgagagctgaagattcaggaacggacttattcattatgggcacacctttggaagaatagagctgattacctcaaccccctttttcgcgcggatcatagccaaacgcaaggtactctgcatctgcctacgacgccctgcaacttcatgtacaaattctggtcaggcatgtacaaccgttttgagaaggggatgcaaccgagacaatcagtgaccgattacctgatggccgtgaaagaagaaactcagcagttagaagaggaattggaggccctagaggaagttaggcacacatgctttgttaatttgttttctgtcctgattagctag

SEQ ID NO: 125591 - DNA, 1773 bp, Artificial Sequence
  Description of Artificial Sequence: Synthetic coding sequence
ctcgatttactcgtgcctaaggtggagaatgtgaagctggtggatcggtatgtgtcgaagaaaccagccaacggcattttgtatcttactgccacccatttgatttacgtggaggctagcggagcagcccgcaaagagacatggatagctctccaccacatcgctaccgtggagaaattgccaatcacttcgctcggatgccctctcacactccggtgcaagaattttcgggtggcacactttgttctagacagcgatctggtgtgtcatgaagtttacatatcgctattaaagctctcccagccagccctgcccgaggatctgtatgccttcagctataatcctaagtcctcaaaggagatgagagaaagcggatggaaattgattgatcctattagtgactttggccgcatgggtattcctaacagaaattggaccattaccgacgctaacataaggtttcgatttatggggattgaaaatattcacgtaatgcggtcctctctccagaaactgttggaggtttgcgagctgaaaaccccgacgatgagcgaatttctgtccgggctggagagctctggctggctccgccacataaaggcaatcatggacgcaggtattttcatcaccaaggctgtgaaggtggagaaagccagcgtactggtccactgctcggatggctgggacaggactgcccaggtctgttcagtggcctcaatactgctggaccctttctatcggacattcaagggattgatgatactgattgaaaaggagtggatctccatgggacataaattcagccagagatgtggacatcttgatggagattccaaagaggtctctcccatatttactcagttccttgactgcatctggcagctgatggagcaattcccttgtgcattcgagtttaacgaaaacttcttgctggagatccacgatcacgttttcagttgccagttcggcaactttttgggcaattgtcaaaaggatcgggaggaccttcgagtgtatgaaaaaacccactctgtatggcccttcttggtccagcgcaagcctgactttagaaatcctttgtataaggggttcaccatgtacggggtattgaacccctcgaccgtaccctacaatatccagttttggtgcggtatgtataacaggttcgacaagggcctgcagcctaagcagtcaatgttagagagcctgctggagatcaaaaaacagcgtgctatgttggagaccgacgtacacgaactcgaaaagaaattgaaagtgcgggacgagcctcccgaggagatttgcacttgctcccaactgggtaacattttgtcccagcacctcggaagccctctaaccaaccctctgggcttcatggggatcaatggcgatctgaacacactaatggagaatggcacactctcaagagaaggagggctgcgtgcacaaatggaccaggtgaagtctcagggtgccgacctacatcataactgttgtgaaatagtagggagtcttcgggcaatcaacatctctggagacgtgggcatttcggaggccatgggcatcagcggagacatgtgcacatttgaggcaaccggctttagcaaggacctgggtatctgtggagcgatggatatcagtgaggccaccggtatatcgggtaacctggggatctccgaagcccgaggattttccggcgatatgggtatcctgggtgatactggaattagtaaggcctccactaaagaagccgactactctaagcatcaatag

SEQ ID NO: 125592 - DNA, 2115 bp, Artificial Sequence
  Description of Artificial Sequence: Synthetic coding sequence
atggaccacattaccgtaccgaaggtggagaacgtcaagctagtcgataggtacgtctctaaaaagccagccaatggaatcctgtatctcacagccacccacctgatctatgttgaggcttcaggggcagccaggaaagagacctggattgcactccatcacattgcaaccgtggagaagttgccaattaccagtcttggttgtcccctgacgctgcggtgtaagaacttcagggtagcccactttgttctggattcagatttggtatgccatgaggtctatatatctctgttgaagctgtctcagccagccctgcccgaggatctatacgctttcagctataatcccaagtcttccaaggagatgagagagtcgggctggaaactgatcgacccaatctcggattttgggcgcatgggcatacctaataggaactggaccatcacagatgccaaccgcaactacgaaatatgttccacctatccacccgagattgtcgttccaaagtcagtcaccctcggcactgtggtgggttccagcaagttccggagcaaagagcgggtcccagtgctgtcatatttatacaaagagaataacgccgctatttgtcgttgcagtcagcctcttagcggattctatacccggtgcgttgacgacgagttgttgctcgaagctatctcccagacaaaccccgggagccagttcatgtatgtagtggataccagacccaagctgaatgctatggctaatcgcgccgcgggcaaaggctacgaaaacgaggacaattacgccaacatcagattcagattcatggggatcgaaaatatccacgttatgcgctccagcctgcaaaagttattggaagtctgtgagctcaaaactcccaccatgtccgaatttctttctggactcgagagctctggctggctccgccatatcaaagccataatggacgctggcatcttcattacgaaagccgttaaggtggaaaaagcatccgtcttggtacactgtagcgacggatgggatcggaccgctcaggtatgttccgtggccagtatactgctcgaccccttctatcgtacttttaaaggactgatgatacttatcgaaaaggagtggatttccatgggccataaattctctcagaggtgcggacatctggatggggatagtaaggaagtgtccccaattttcacacagtttctcgactgtatttggcaactcatggaacaatttccatgcgcctttgagtttaatgagaacttcctactcgaaattcatgatcacgtgttcagttgtcagttcgggaactttctgggcaactgccagaaagatcgcgaagatctgagggtgtacgaaaagactcattcggtgtggccgtttttggtacagcgaaagccagactttcgcaaccctctgtataagggcttcaccatgtatggcgtgctgaacccctcaaccgtcccctataatatccagttttggtgcggcatgtacaataggtttgacaaggggctccagcccaaacagagcatgttggaatcgctgctagagatcaagaaacagagggccatgttggagaccgatgtccacgagcttgagaagaaactgaaagtccgggacgaacccccggaggagatttgcacctgctctcagctgggcaatattttgagtcagcaccttggatctcccctgacaaaccctctgggattcatgggcatcaatggcgacctcaacaccctgatggaaaatggtaccctttcaagagagggcgggttgcgcgcacagatggaccaggtcaagtctcagggagcggatctgcatcacaactgctgcgaaattgtggggagtctgcgggccatcaacattagcggtgacgttggcatctccgaagctatgggtataagcggcgatatgtgtacgttcgaagctacaggattcagcaaagatcttggcatatgcggggccatggatatctccgaagccaccgggatttctgggaacttaggcatttccgaagctcgcggttttagtggagacatggggatcctgggcgacactggtattagcaaggcaagcacaaaagaggccgactacagcaagcaccagtag

SEQ ID NO: 125593 - DNA, 1527 bp, Artificial Sequence
  Description of Artificial Sequence: Synthetic coding sequence
tgagattcagatttggtgtgccatgaggtgtacatttctctccttaaactgtcacaacctgctctaccagaggacctttacgccttctcatacaatcccaagtccagtaaggaaatgagggaaagcggatggaaattaatcgatccaatttccgacttcggtcgtatgggcatcccaaaccggaactggaccatcaccgatgccaatattcgctttcggttcatgggaatcgagaacatccatgtgatgcgcagctccctccaaaagctactggaggtctgcgagctcaaaacccctactatgagcgagtttctatcagggctggagtcttcaggatggctcaggcacattaaagcaatcatggatgcaggaatttttattaccaaggcagtgaaggtggaaaaggcctccgtgctggttcactgcagcgatggatgggaccggaccgcccaggtgtgtagcgttgcttcaattctcctcgacccattttatcgtaccttcaagggcctgatgatcctgatcgagaaggaatggatttccatgggacacaagttttctcagcgctgcggccacctggacggggatagcaaagaggtgagcccaatttttacacagttcttggactgtatctggcaactgatggagcagttcccttgtgcattcgagtttaatgagaactttctgctggagattcatgatcacgttttctcctgccaatttggtaactttttgggaaactgccagaaggatcgcgaggacttacgcgtctacgagaagactcactctgtgtggccattcctggttcagcgaaagccggatttccgcaatcccctatacaagggattcactatgtacggagtgcttaatccctcaacagtgccttacaatattcagttctggtgcggaatgtataatcggtttgataagggactgcagcccaaacaaagcatgctggaaagcttgctggaaattaaaaaacagcgggctatgcttgagacagacgtgcatgaactggagaaaaaattaaaggtcagagatgagccaccagaggaaatatgtacttgtagccaactaggcaacatattgagtcagcacttaggtagccccttaaccaacccgctgggtttcatgggaattaatggggatttaaacacgctgatggagaacggaaccctgtcacgagaaggtggtctcagggcccagatggaccaggtgaaatcgcagggcgccgatctgcaccataattgttgcgagattgtggggagtcttcgtgctattaacatctcaggagatgttgggatcagcgaagctatgggcatcagcggcgatatgtgtactttcgaggccaccggattttctaaggacttaggaatctgtggcgccatggacataagcgaggcgactggcatttctgggaatcttggtatatccgaagctagaggcttctccggagatatgggcatcctcggagataccggcatctctaaggcctccacaaaggaagcagactactcaaagcatcagtag

SEQ ID NO: 125594 - DNA, 2082 bp, Artificial Sequence
  Description of Artificial Sequence: Synthetic coding sequence
atggatcacataaccgtcccaaaagtggagaatgtgaagcttgtggatcggtacgtgtccaagaagccagcgaacgggattctctacttgaccgctactcatctcatttatgtcgaggcctctggcgccgctaggaaagagacatggatagccctccaccatattgcaacggttgagaaattgcccattacatcactggggtgcccactgaccttgaggtgcaaaaacttcagggtggctcacttcgtgctggattcagaccttgtctgccacgaagtttacattagcttgctgaagctctctcagccagcccttcccgaagatctgtacgcctttagttataaccctaaaagcagcaaggaaatgagagaaagcgggtggaaactgattgatcctattagcgacttcggaagaatgggtattccaaatcgtaattggaccattaccgacgccaatcgaaattacgagatctgttccacctatccacctgagattgttgttccgaagagtgtgaccttgggcacagtggtgggaagctcaaagtttagatcaaaggagagagtcccagttctgtcatatttatataaggagaataacgcagccatatgtcggtgcagtcagcccttgtcaggcttctatacacggtgcgtcgatgatgagctgttgctggaagccatatcccaaaccaatcctggcagccagttcatgtatgtggttgacactagacccaagctcaacgccatggcaaaccgggctgccgggaaggggtacgaaaatgaggacaattacgcaaacatccggttcaggtttatgggcatagaaaatatccacgtgatgagatcctcgctacagaagctgttagaagtgtgcgagctgaaaacaccaacaatgagtgagttcctttcaggccttgagtccagtggctggctgcggcacatcaaagctatcatggacgctggaattttcattacaaaggccgtaaaggtggagaaggcctccgtgctggttcactgttccgacggatgggaccgaacggcacaggtttgttccgtggcatctatacttttggacccattttacagaacctttaaagggctaatgatttggcactttttagtgctgatcatgcgcatagtgctgcagctggccaaaatgaatctgatggacattacaaagatattttccctattgcagccagacaaagaggaagaggacactgacacggaagagaaacaggctcttaatcaggcagtctatgataacgactcctacacactcgaccagctgctgcggcaggagcgctacaagcggtttatcaattctagatccgggtggggagtgcccgggacccctctgagactcgctgcttcttatggacacctttcgtgtcttcaagtgctccttgcccatggggccgatgttgatagtctggatgtgaaggcacaaaccccactgtttaccgccgtttcgcacggtcacctggactgcgtgcgcgtcttgctggaggctggggcatcccctggaggcagcatctataacaattgttcgccggtgttaaccgcagcacgcgatggcgctgtagcaatccttcaggagctgctagatcacggagcagaagccaacgtcaaggcaaagttaccagtctgggcctcaaatatagcctcctgcagtggacccctgtatctggctgccgtttatggtcacctcgattgctttcggctgttactgctccatggagcagaccccgattacaattgcactgaccagggtcttctggccagggtcccgagaccaaggaccctgctcgagatctgccttcaccacaactgtgaaccggagtatattcaattgttaattgatttcggtgcgaatatctacctcccgtccttgagtctggatttaaccagtcaagatgataaggggattgcactgttactccaggcccgggctacgccaagatcattgctgtcccaggtccgactggtcgtgcggcgcgccctctgccaagcgggccaacctcaggcaattaaccaactagacatacccccgatgctcataagttaccttaaacaccagctgtag

SEQ ID NO: 125595 - DNA, 861 bp, Artificial Sequence
  Description of Artificial Sequence: Synthetic coding sequence
atgggcggtgagcgctcaggggtgcgaggcaacaagatggcggccgcagagccttcgcctcgaagagttggctttgttggagcaggtcggatggccggagcaattgcacaaggattgattcgtgccggaaaggttgaggcacagcacattctggcaagcgcccctacagaccgaaatctttgtcacttccaggcccttggctgccgaaccactcactccaaccaggaagttctgcagtcctgcttgctggtcatctttgcaaccaaaccgcacgtgcttcctgcggtactggccgaggtagcgcctgttgtcactacagagcatatcctggtgtctgtcgctgccggcgtgtcattgagtacacttgaagagctcctgccacctaacaccagagtactacgggtgcttcccaacctcccatgcgtggtgcaggagggggccattgtaatggcccgcggtcgtcacgtaggctccagcgaaaccaaactgcttcagcacttactcgaggcctgcggacgttgcgaggaagttcccgaggcctacgtcgatatccacactggcctgtccgggagtggggtcgcgtttgtgtgtgccttcagtgaagctctcgccgagggcgccgtcaagatgggtatgcctagcagcctggcacacagaattgcagctcagacactgttggggaccgcaaagatgttgctgcacgagggccagcacccagcccaacttcggagtgatgtgtgcacacccgggggtaccactatttacggactgcacgctctggagcagggcggcctgcgcgccgcgaccatgagcgcagttgaggccgcaacatgtagagcaaaggagctgagcaggaagtag

SEQ ID NO: 125596 - DNA, 900 bp, Artificial Sequence
  Description of Artificial Sequence: Synthetic coding sequence
atgcccctgtcaggcacaccggccccaaacaagaagcgcaaatcgtctaagctcattatggagctgacaggggggggtcaagagtcctccgggctcaaccttggcaaaaagatatctgtgccacgggacgtgatgctcgaggagctgtcgctcctcaccaaccgcggatcaaaaatgttcaaacttcggcaaatgcgggttgagaaattcatttatgagaaccaccccgacgtattctccgatagttccatggatcacttccagaagttcctgcccacagtggggggccagctcggcacggcaggtcaaggtttctcctattctaagagcaacggcagggggggctctcaggccggagggagcggcagtgccgggcaatacggatctgatcaacagcaccatttgggctccggttcaggcgcgggcggcaccggcggacctgcggggcaggccgggcggggaggcgccgctggcacggctggggtgggggaaacaggaagcggggatcaggcggggggcgaaggcaaacacatcaccgttttcaaaacttacatttccccttgggaacgggccatgggcgtcgatccccagcagaagatggagctaggtatcgaccttttagcctacggcgcaaaagcagaattgcccaaatacaaatcattcaataggacagccatgccctatggtggatacgagaaagcctcgaagagaatgacgttccaaatgccaaagttcgatctaggcccacttctctccgagccattggttctgtacaaccaaaatctctctaatcgaccctcatttaatcggacacccatcccatggctgtcatccggcgaaccagtggattataatgtcgacattggaataccgctcgacggtgaaaccgaagaactctag

SEQ ID NO: 125597 - DNA, 795 bp, Artificial Sequence
  Description of Artificial Sequence: Synthetic coding sequence
atgctttctcacaatacgatgatgaagcagcgcaagcagcaggcgacagccataatgaaggaagtgcacggcaatgacgtggacggcatggatctggggaagaaggtgtcaataccccgcgacataatgctggaagaactaagccacctgtctaatcgcggggctaggctgttcaagatgcgccagagacgtagtgataaatataccttcgaaaattttcagtatcaatcccgcgcacagatcaatcactctattgctatgcaaaacggaaaggtagatggaagcaatcttgaggggggttcccagcaagccccactgacccccccaaatacaccagatccacgatcccctcccaaccccgacaacatcgcaccagggtatagcggccccctaaaggaaattccacctgagaagttcaacacgacagcagttcctaaatactatcagtccccatgggagcaggccataagcaacgaccccgaactgctggaagccctgtacccaaagctgtttaagccagagggcaaggccgaattgcccgattacaggagctttaatagagtagccactcctttcgggggctttgagaaagcaagcaggatggtgaagttcaaagttcccgacttcgagcttttactgctgaccgaccctcggtttatgagctttgttaacccactcagcggccgaaggtcttttaaccggaccccaaagggctggatctcagagaatatccccattgtcatcaccactgagccaacagacgataccaccgttcccgaaagcgaggacctttag

SEQ ID NO: 125598 - DNA, 756 bp, Artificial Sequence
  Description of Artificial Sequence: Synthetic coding sequence
atgattcctaaggaacaaaaaggacctgtcatggcagccatgggggacctgacagaacccgtgcctacattggacttgggcaagaaactgtcagtgcctcaggatctgatgatggaggagctttccctccggaacaataggggttctttactatttcaaaaacgtcaacggcgagttcagaagttcacattcgaactggcagccagtcaaagggctatgctggccgggtcagctagaaggaaggtaactggtacggctgagtcaggaaccgtggccaacgcaaacggtcctgaggggcctaactaccggagtgagctgcacatcttccccgctagtccaggagccagccttggcggacctgaaggggctcaccccgccgctgctcccgcgggctgcgtgcccagcccgagtgccctggctccgggatacgctgaacccttgaagggagtgcccccggagaaattcaatcacactgccattagtaaggggtaccgctgcccctggcaggaatttgtgtcatacagagactaccagtcagacggacgctcccatacaccatctcccaacgactacaggaacttcaacaagaccccagttcccttcggtggcccccttgtcgggggcactttcccccgtcccggaactccttttatccctgagccgctgagtggcctcgagctactgcgcctgagaccctccttcaatagggtggcccaaggttgggtgcgcaaccttccggaatcagaggaactgtag

SEQ ID NO: 125599 - DNA, 756 bp, Artificial Sequence
  Description of Artificial Sequence: Synthetic coding sequence
atgatccccaaggagcagaaaggcccggttatggccgccatgggcgatcttactgaacctgtgccaactctcgacctggggaagaaactctcggtcccgcaggacctgatgatggaggagctttcactgaggaacaatcgcgggtctctgctgtttcagaagaggcagaggagggtgcagaaattcacttttgaattggccgcatctcaacgtgctatgttagcgggatcagctagacgcaaggttacaggcacagctgagagtggtactgttgccaacgcaaatggtcctgaaggtcccaactataggtccgagctccacatcttcccagcttcgcccggggccagtctcggcggtcccgagggcgcgcacccggccgccgcacccgccggctgcgtcccttccccaagcgctctcgccccaggctacgcagagccccttaaaggagtcccccctgagaaatttaaccacactgccatcagcaaaggctatcgctgtccttggcaggagttcgtcagctatagagattaccagtctgacggacgttcccacactccaagcccaaatgactaccgcaattttaacaagacacctgttcccttcggtggtccgctggttggcggcacctttccacggccgggcaccccctttatcccggagccactctccgggctggagttgttacgattgagaccttccttcaaccgagtggcccagggatgggtgcgcaacctgcctgaaagtgaagaattgtag

SEQ ID NO: 125600 - DNA, 1989 bp, Artificial Sequence
  Description of Artificial Sequence: Synthetic coding sequence
atggtggtgtcagaggtggacatcgctaaggccgacccggcggccgccagccatcctctgctgctgaacggtgacgctactgttgcacagaaaaatcctggatctgtggctgagaataatctgtgcagccaatacgaagagaaagtacgcccttgtattgatcttatcgattccctgcgggccctgggcgttgagcaggacttagcactcccggctatcgctgtcatcggcgaccaatcatctggaaaaagcagtgtgcttgaagctctgagcggtgtcgctctgccacgtggaagcgggattgtcacccggtgccccttggtgttaaaactgaagaaattagtgaatgaggacaagtggagaggtaaggtgagctatcaggattatgaaatcgagatctccgacgcatcggaggtcgagaaggagataaataaagctcaaaatgccatcgcgggcgaaggcatggggatttctcatgaactcataaccctggagatttccagccgcgatgtgccagacctgacgcttattgacctgccgggcatcacccgggtcgccgtgggcaaccagccggccgacattgggtacaagatcaaaacactgatcaagaaatacattcagaggcaggagacaattagcctcgtggtcgtgcccagcaacgtcgatatagccactacagaggcgctgtctatggcccaagaagtggacccggaaggcgatagaactatcggaattttgactaagcccgatctggttgataagggcaccgaagacaaagtcgtggacgtagtcaggaatttagtttttcatctgaagaaagggtatatgattgttaagtgtcgagggcagcaagaaatacaagatcagctctctctgagtgaggctctgcagcgcgagaagattttcttcgagaaccatccgtactttcgagaccttctggaggaaggaaaagcaaccgttccctgcctggctgaaaagcttacctccgagcttatcactcacatctgtaaatccctcccattattggagaaccaaattaaggagacccatcagcgcattaccgaggagctgcagaagtatggagtagacatcccagaggatgagaatgagaagatgttctttttaatagacaaagtgaacgcgtttaatcaggatataacagctctgatgcaaggcgaagagactgttggcgaggaagacatcaggctttttacgagacttcgccatgagttccacaagtggtccactattatcgagaacaacttccaggagggtcacaagatcctcagcagaaaaatacagaaattcgagaaccagtatcggggaagggaactgccagggttcgttaactatcgcacctttgagactattgtgaagcagcaaattaaggccctggaggagccggcagtggacatgctgcatacagtaaccgatatggtgcggcttgcatttactgacgtttccatcaagaattttgaagaattcttcaaccttcaccggactgctaagtccaagatcgaagatatccgcgccgagcaggaacgagaaggggaaaagctgattagattgcactttcagatggagcagatcgtatattgccaggaccaggtgtatcgaggagccctccagaaggtcagggaaaaagagttagaggaggaaaaaaagaagaagagttgggacttcggagcattccagtcctcttctgccacagatagctctatggaggagattttccagcatcttatggcctaccatcaagaggccagcaagagaatttccagccacatcccactgattatccaattctttatgcttcagacatatggtcagcagctccagaaagcgatgctgcagcttctgcaggataaggatacctattcctggttgctgaaagaacggagcgacacgagcgataagcgtaagttcctaaaggagaggctagctcgactgacgcaggcccgtcgacgactggctcaattccctggatag

SEQ ID NO: 125601 - DNA, 1989 bp, Artificial Sequence
  Description of Artificial Sequence: Synthetic coding sequence
atggtggtgagcgaagtagatatcgcaaaagccgacccagcagccgcttctcatccattgctgctcaacggggatgctacagtcgctcagaagaacccagggtccgtcgcagagaataacctgtgttcacaatacgaagagaaggtgcgcccttgcattgacctcattgattcacttagagcactgggagtcgagcaggatctggcactgcctgccatcgccgttattggggaccaaagtagcggcaagtctagtgtgttggaggctcttagcggagtggccctgcctcgcgggtccggcattgtcacgcggtgccccttagtattgaaactcaagaaacttgtaaacgaagataaatggcgcggtaaagtgagttatcaggattatgagatcgagatctccgatgcaagcgaggtcgaaaaggagattaataaagcacagaatgcaattgctggggagggtatgggtatctctcatgagctcatcactcttgagatcagctctagagatgtgcccgatctaaccctgatagacttacccgggattaccagggtcgccgtggggaatcagccagctgacattgggtacaagattaagacactcatcaaaaaatacatacagcggcaggagactatttctctcgtggtcgttcctagcaatgttgatattgctactactgaggccctgtccatggcacaggaggtggacccagaaggggatcggaccatcggcattctgacgaaaccagacctggttgacaaaggtaccgaagataaggtcgtcgacgttgtaagaaaccttgtttttcacctaaaaaaaggctatatgattgtgaagtgtagggggcagcaagagatacaagatcagctgtccctgagtgaagccttacagcgtgagaaaattttttttgagaaccacccttacttcagagatctcctcgaggagggtaaggcgaccgttccatgcttagccgagaaactgacctctgagcttatcacccatatatgtaagagcctgccgttacttgagaaccagatcaaagagacccaccaaaggatcaccgaggagttgcagaaatacggggtggatattccagaagatgaaaacgaaaagatgtttttcctgatcgacaaagtaaacgcatttaaccaagacatcaccgcactgatgcagggagaagaaacagtgggcgaggaagatatccgcctgtttacgaggctgcggcacgagtttcataagtggtctactattatcgaaaataactttcaggagggtcacaagatcttatctagaaagattcagaagtttgaaaaccaataccgaggcagggagctacctgggttcgtgaattaccggacgtttgaaactatcgttaagcaacagattaaggccctcgaagaaccggctgttgacatgctccacaccgtgacagacatggtgcgactcgcctttaccgacgtgtccatcaagaattttgaagaattttttaacctccaccggaccgctaaatcgaagatagaagacattagggccgaacaagaacgagagggggaaaaactcattcgactacactttcaaatggagcagattgtgtactgtcaggaccaagtgtatcgcggggcgttgcagaaggtgcgagagaaagagttggaggaggagaagaagaagaaaagctgggacttcggggcatttcaatcttccagtgcaacggatagctccatggaggagattttccagcacttaatggcataccatcaagaagcctcaaaacgcattagcagccacatccctctgatcatccagtttttcatgttgcagacatatggacagcagcttcagaaagctatgctgcagttgttgcaggacaaagatacttatagttggctgttgaaggagcgctccgacaccagcgataaaagaaagttcttgaaggagagattggcgagacttacacaggcccgtagacgccttgctcagtttcccgggtag

SEQ ID NO: 125602 - DNA, 207 bp, Artificial Sequence
  Description of Artificial Sequence: Synthetic coding sequence
atggttgtgagtgaagtcgacatcgctaaggctgatcccgcggccgcttcccatcccctgttgctgaacggagatgccacagtggcccaaaagaacccagggagtgtcgccgagaacaacctgtgtagtcagtatgaagagaaggtgaggccctgtatcgacctcatagacagcttgcgggcgttaggtgtagaacaggatctctag

SEQ ID NO: 125603 - DNA, 606 bp, Artificial Sequence
  Description of Artificial Sequence: Synthetic coding sequence
atggtggtgagcgaggtcgatatcgcaaaggcagatcccgccgccgccagccaccctctcctgctaaatggcgatgccacggtggcccagaagaacccagggtcagtggctgagaacaacctgtgctcacagtatgaggaaaaggtgagaccgtgcatcgacctcatagacagcttacgcgccctcggagtcgagcaggacctcgccctgcctgcgattgctgttataggcgaccagagttcaggcaagtcctctgtgttggaagctttgagtggcgtggcgctacctagggggtcaggaatcgtaacgagatgtcccctcgtcctcaagttgaaaaagctggtcaatgaggataagtggcgggggaaggtgtcttatcaggactacgaaatcgaaattagcgacgcctctgaggtggagaaagagatcaataaagcccaaaatgccatcgcaggcgaggggatgggcatctctcacgaattaatcaccctggagatctccagcagggacgtgcccgatctaacacttattgatctccctgggatcacccgcgtcgccgtgggtaaccagccggccgatattggctataagattaagaccctctag

SEQ ID NO: 125604 - DNA, 81 bp, Artificial Sequence
  Description of Artificial Sequence: Synthetic coding sequence
atggttgtctctgaggtggatatagcgaaagccgaccctgctgcagccagtcacccactcttgttgaacggcgatgcgtag

SEQ ID NO: 125605 - DNA, 594 bp, Artificial Sequence
  Description of Artificial Sequence: Synthetic coding sequence
atggtggtttccgaggtagacatcgctaaggccgatccagccgcagcaagtcatcccctactgttgaacggagatgccactgtggcgcaaaagaatcctggaagtgtggctgaaaataacctttgctcccagtacgaagagaaggtgcggccatgcattgatcttatcgacagtctgagagccctcggcgtagagcaggacctggctttgcctgccatcgccgtcatcggcgaccaaagcagcggaaagtcctctgttctggaggccctcagtggagtggcgcttcctcgcggctcaggcatcgttacacggtgcccactggtgctcaagctgaaaaagctagtgaatgaggataaatggcgcggcaaagtctcataccaggactatgagatcgagatttcggacgcctctgaggtggagaaggagatcaataaggcgcagaacgctatcgcaggcgaaggaatgggcatctcacatgagctaattacacttgaaatttcatcaagggatgtgccagacctgacactgatcgatctacctggcatcacgcgggtggctgtgggcaatcaacctgccgacataggatataaatag

SEQ ID NO: 125606 - DNA, 108 bp, Artificial Sequence
  Description of Artificial Sequence: Synthetic coding sequence
atggtagtcagcgaagttgatatcgccaaggccgaccccgcagcggcctcccaccctctgttgttgaatggagacgctactgttgctcaaaagaatccaggttcatag

SEQ ID NO: 125607 - DNA, 234 bp, Artificial Sequence
  Description of Artificial Sequence: Synthetic coding sequence
atggtggtgtccgaggtcgacatcgccaaagcagaccccgccgcggcttcacacccattgttactcaacggtgacgccacagtcgctcaaaaaaatcctgggtctgtcgcagagaacaacttgtgtagccagtatgaggaaaaagtccgtccttgtatcgatctgatcgatagcttgcgggctctgggcgtggaacaggacctggctctccctgctatagccgtcatcgggtag

SEQ ID NO: 125608 - DNA, 1989 bp, Artificial Sequence
  Description of Artificial Sequence: Synthetic coding sequence
atggtggtatccgaagtggatatcgcaaaagccgacccggcagcagcatcacatccgctgctcctgaatggtgacgcgacagtggcgcagaagaaccccggaagcgttgctgaaaacaatctgtgcagtcaatacgaagagaaagttcggccatgtattgatttgatcgactccctacgtgccctgggggtcgagcaggatcttgccctgccagctatcgcggtgatcggcgaccagagcagcgggaagagctcagtgctggaagcactgtctggagtcgctcttcctagaggcagtggaattgttacaaggtgcccccttgtgttgaagctgaaaaagcttgtaaacgaagataaatggcgcggcaaggtgtcttatcaggactatgaaattgagatttccgatgctagcgaagttgagaaggagattaacaaggctcaaaatgctatagctggtgaaggcatgggaatttcgcatgagctgattacactggagatcagcagcagggatgttcccgatctgactctgatcgatttgcctggcataactagggtcgccgtcggaaatcagccggctgacatcggatacaagataaagactcttatcaaaaaatacattcaacgacaggaaacaatcagcttagtcgtggtgccatctaacgtcgacatagccactacggaggccctgtctatggcccaggaagttgatcctgagggagaccgcactattggcatccttacaaagcctgatctggttgacaagggtactgaagataaggtggttgatgtcgttaggaatcttgtttttcaccttaagaaaggctacatgattgtgaaatgcaggggacaacaagaaatccaggaccagctttctctgagtgaagctttgcagcgtgagaagatcttctttgagaatcacccttattttagagatctcttggaagaaggaaaggcaacagtgccctgcctggcggagaaacttacctccgaactaatcacacacatatgtaagagccttcctctcttagaaaaccagatcaaagaaacacaccagcgtattacagaagagctccagaaatacggggtggacattcctgaagacgaaaatgagaaaatgttctttctcattgacaaggtgaacgcatttaaccaggacataacagctctaatgcagggcgaggaaacagtgggcgaagaagatatcaggctgttcacaagactacgacatgaattccacaaatggtctacaataatcgaaaataatttccaagaagggcacaaaatcttgagtaggaaaatccagaagttcgaaaaccagtacagaggacgggaactaccagggttcgtcaattaccgaacatttgagacaatcgttaaacagcaaataaaagccctggaagaacccgcagtggatatgctccatacagtcaccgatatggtgagactggcctttacggacgtgagtattaaaaactttgaggagttcttcaaccttcatcgaaccgccaaaagtaagattgaagatattagggccgagcaagaaagggaaggcgagaagcttataaggttgcacttccagatggagcagattgtttactgtcaagaccaggtataccgaggcgccctgcagaaggttagggagaaagagctcgaagaggaaaagaaaaagaagtcttgggacttcggagcgtttcagtcatcttccgccaccgactcaagcatggaagaaatatttcagcatctgatggcttatcaccaggaagctagtaagcgcatctcgtcgcacattcccctcatcatccaattcttcatgctgcaaacctatggccaacaacttcagaaggctatgctgcagttgctacaggacaaagacacgtacagttggcttctgaaggaaagatctgacacgagcgacaaacgcaagttcctgaaggagagattagccagattgactcaggcacggcgacgcctcgcccagttccccggttag

SEQ ID NO: 125609 - DNA, 2148 bp, Artificial Sequence
  Description of Artificial Sequence: Synthetic coding sequence
atgagtaaggcacataagccttggccctaccgcaggaggagccaattctcaagcagaaaatacctgaagaaggaaatgaatagttttcaacagcaaccaccaccctttgggactgtgcctccacagatgatgtttcctccaaattggcaaggcgccgagaaggacgccgcgttcctggctaaggattttaacttccttactctgaataatcagcccccccctggtaatagatcccagcctcgagccatggggcccgagaacaacctgtacagtcagtacgagcagaaggtcaggccttgcatcgatcttatcgattcattgagagccctcggcgttgagcaggaccttgcgcttcctgctattgctgtcatcggggaccagtcctccggcaaatcttcagtcttagaagccctgtccggagtcgcccttcctcgcgggagcgggattgtaacaaggtgtcccctggtcctcaaacttaaaaaacagccttgtgaggcttgggccgggcgcatttcatatcgaaataccgagctggagttacaagacccaggccaagttgagaaggaaatacacaaagcccaaaacgtcatggctgggaacgggaggggcatctcccatgagctgatcagccttgagataacaagcccagaagtaccggacctgaccattatcgaccttcccgggattacccgggttgccgtagacaatcaaccaagagacattggcttacagatcaaagccttaataaagaagtacattcaacggcaacagaccattaatttagtggtggtgccatgcaacgttgacattgctacgaccgaggccctatccatggctcatgaggtcgaccctgaaggagacagaacaatcggaatactaacaaagcctgatctcatggatcggggcaccgagaaaagcgtgatgaacgtggtgcgaaacctcacctacccgcttaagaaaggatacatgattgtgaaatgccgggggcagcaggaaatcacaaatagactgagtctcgcagaagccaccaagaaggaaatcactttctttcagacacacccctattttagagtgcttctggaagaaggatccgctactgtaccacgacttgccgagcggctgaccacagagctaattatgcatatccagaagagcctgccccttctcgagggtcaaatccgggagagtcaccagaaggcaacggaggagctacggcgctgcggggccgatatccctagtcaagaggcagataaaatgtttttcctgatcgaaaagataaagatgttcaaccaggacattgaaaagctcgttgagggagaagaggtggtgcgcgagaatgaaaccaggctgtacaacaagattcgcgaagactttaaaaattgggttggaatcctcgccactaatacccaaaaggtcaagaatatcattcacgaagaggtcgagaagtacgagaagcagtatcggggtaaagagttattgggatttgttaactacaagaccttcgaaattattgtgcatcaatatatccagcaactcgtcgagcccgctctgtctatgctccaaaaagccatggaaatcattcagcaggccttcattaacgtcgctaagaaacatttcggggaatttttcaacctgaaccagactgtgcagagcactattgaagatattaaagttaagcacaccgcgaaggccgagaacatgatccagcttcaatttcggatggaacagatggtattttgccaggatcagatatacagcgtggtgttaaaaaaagtgagggaggaaatctttaaccctctgggcacaccctctcagaatatgaagctcaatagccacttcccgtccaatgagagcagtgttagtagttttacagaaattggcatccatctcaatgcttactttctggaaacctctaaaaggttggctaatcagattccttttataattcagtatttcatgctgagagagaatggcgactccctgcagaaagctatgatgcaaatcttgcaggagaagaacagatattcttggctgctgcaggagcagagcgagaccgccaccaagcgccgtattttgaaagaaagaatataccgtcttactcaggctcgccacgccctctgtcagttttcatccaaagaaatccattag

SEQ ID NO: 125610 - DNA, 45 bp, Artificial Sequence
  Description of Artificial Sequence: Synthetic coding sequence
atgtccaaggcccacaaaccctggccgtacaggcgcaggagttag

SEQ ID NO: 125611 - DNA, 405 bp, Artificial Sequence
  Description of Artificial Sequence: Synthetic coding sequence
atgtctaaggctcataagccctggccatatagaagacggtctcagttctcatcaaggaaatacctgaaaaaggaaatgaatagcttccagcagcaaccgcccccatttgggacggtgccccctcaaatgatgtttccaccaaattggcaaggagccgaaaaggatgctgcattcctggccaaggactttaattttttgacgctcaacaaccagccaccgccagggaatcggagccagccccgggctatgggtcctgaaaataacctgtattcccagtatgagcagaaggttaggccctgcattgaccttatcgattctctgcgcgccctgggggtggaacaggatctcgccctgccagctatagctgtgatcggcgaccagtcttctgggaaaagttcagtgtag

SEQ ID NO: 125612 - DNA, 378 bp, Artificial Sequence
  Description of Artificial Sequence: Synthetic coding sequence
atgagtaaagcccacaagccttggccatacaggagacgtagtcagtttagctcgcgcaaatatctgaaaaaagagatgaactccttccagcagcagcctcctcctttcggaacggttcccccacaaatgatgttccctcccaactggcagggcgcagagaaggatgcagcgttcctggccaaagactttaacttcttgacactcaacaatcagcctccacctgggaatcggtcacaacctagagccatgggcccagagaacaacttatacagccagtacgaacagaaggttcggccttgtatcgacttgattgattccctgcgggccttgggcgtggagcaggacctcgccctcccggccatcgccgttatcggttag

SEQ ID NO: 125613 - DNA, 390 bp, Artificial Sequence
  Description of Artificial Sequence: Synthetic coding sequence
atgtctaaagcgcataagccttggccgtaccggagacggagtcagttcagctcccggaagtacctcaagaaggagatgaatagcttccagcaacagcctccacccttcggcacggtgccaccacagatgatgttcccaccgaattggcagggtgcggagaaggatgccgcctttctggccaaagacttcaattttcttactttgaacaatcagccgcctccagggaaccgaagtcaaccaagggccatggggccagagaataacctgtacagccagtacgagcagaaagttagaccatgtatcgatcttattgacagtctacgagctctcggggtagagcaagatctggctcttcccgctattgccgtgattggagatcagtccagttag

SEQ ID NO: 125614 - DNA, 606 bp, Artificial Sequence
  Description of Artificial Sequence: Synthetic coding sequence
atgagtaaagcccacaagccatggccttaccgccgccggtcacagttctcatctcggaagtacctcaaaaaggagatgaattcctttcaacaacagccccctcccttcggtacggtccccccccaaatgatgttccctcccaattggcagggtgccgaaaaggacgcggccttcttagctaaagactttaatttcttaaccctgaataaccagccaccaccagggaacaggagccagccaagggccatgggacccgaaaataatctctatagtcagtacgagcagaaagtccggccatgtattgatctgatagactcactacgggccttgggggtggaacaggacttagctctgcctgcgatcgcggtaatcggggaccagagtagcggcaagagcagcgtgctcgaagctctttcaggcgtggccttacctcgcggctccgcccagaacgtgatggcaggcaacgggcggggtatcagccacgagcttatcagtttggagattacatcgcccgaagtacctgatctcaccatcattgacctccccggcataacaagagtggccgtcgataatcaacccagggacatcggcttacaggtctcctag

SEQ ID NO: 125615 - DNA, 663 bp, Artificial Sequence
  Description of Artificial Sequence: Synthetic coding sequence
atgaacatccgcaacgccagacctgaggatctgatgaatatgcagcattgcaatctgctgtgcctgccagaaaattaccagatgaaatactacttctatcatgggctgagctggccacagctgtcttacatagccgaagacgaaaacggaaaaatcgttggatatgtattggccaaaatggaggaagatccagacgatgtgccgcacgggcacatcacttcacttgcggtcaagcgttctcatcgacgcttagggctggcccaaaagcttatggatcaggcctccagggccatgatcgaaaactttaatgccaaatacgtttccctacacgtgcgcaaacggattagtgaggtcgagcccaagtactacgccgatggagaggacgcatatgctatgaaacgcgacctgacccaaatggctgacgaattacggcgccatttggagttgaaggaaaaagggaggcacgtagtgctgggcgccatcgagaacaaagtagagtctaagggtaattctccacccagctcaggagaagcctgtagggaagagaaaggccttgctgctgaagattccggtggggactcaaaggacctgagcgaagtatcggaaactaccgagtcaacggacgtgaaggactcctctgaagcaagtgactcagcatcctag

SEQ ID NO: 125616 - DNA, 708 bp, Artificial Sequence
  Description of Artificial Sequence: Synthetic coding sequence
atgaatatacgaaacgctcgccctgaagatttgatgaacatgcagcactgtaatttgctttgcctacccgagaactaccagatgaagtattatttctatcatgggttgtcctggccccaactaagctatatcgctgaagatgagaatggcaagatcgtcgggtacgtactggctaaaatggaagaggaccccgacgacgtgccccatggtcacattacgtcactcgccgttaagcggagtcataggcggttgggactggctcagaagttgatggaccaggcatccagagctatgatcgagaactttaacgctaaatatgtcagcttgcacgttaggaagtccaatcgagccgcgctccatctatattcgaatacactgaactttcagatctccgaggtcgaacccaagtactacgctgacggtgaagatgcttacgcgatgaagagggatctgacccagatggccgatgagctgcggcgacatcttgagctgaaagagaaggggcggcacgtagttctgggggcaattgagaacaaggtcgagagtaagggcaactcacccccgagttccggcgaagcatgccgtgaggagaaaggtttggcagctgaggactcgggtggagactcaaaggacctgtcagaggttagcgagactactgagtccacagacgtgaaggatagttcagaagcctccgactccgccagctag

SEQ ID NO: 125617 - DNA, 396 bp, Artificial Sequence
  Description of Artificial Sequence: Synthetic coding sequence
atgaatatcaggaacgcgaggcctgaagatctgatgaatatgcagcactgtaatttgttgtgcctacccgaaaattaccaaatgaaatactacttttatcatggattgtcttggccacagctttcctatatagctgaggacgagaatggtaagatagttggttatgtcctggctaagatggaagaggatcctgatgacgttcctcatggacatatcaccagtctggcagtcaaacgatcgcatcgcaggctgggccttgcccagaagctgatggaccaggcctctcgggcaatgatcgaaaacttcaacgccaagtacgtgagcctgcacgtgaggaaacggtctgtaaaatggagccctaataccatgcaaatgggccggactccaatgccttag

SEQ ID NO: 125618 - DNA, 534 bp, Artificial Sequence
  Description of Artificial Sequence: Synthetic coding sequence
atgattgtagcagaaattaagaatcgaaccaagatccataaggaagacggcgacattctggcctctaactttagcgttgacacccaggttgcctacattctgtctcttggcgtcgtcaaagagttccggaagcacggcatagggagccttctattagaatccttgaaagaccacatcagcactactgcccaggatcactgcaaggctatttaccttcacgtgctgactaccaacaataccgcaatcaacttctatgagaatcgggattttaaacaacaccattatcttccctactattatagcattcggggagtccttaaagatggcttcacatacgtgctctacatcaacgggggtcaccctccgtggaccatcttggattacatccagcacctcgggtccgccctcgcgtctttaagtccatgctccatcccacatcgcgtgtatcgtcaagctcactcgctcctatgctcatttctcccttggtccggcatctctagcaagtctggaatcgaatattcaaggacaatgtag

SEQ ID NO: 125619 - DNA, 729 bp, Artificial Sequence
  Description of Artificial Sequence: Synthetic coding sequence
atgaccgaagttgtcccatcctctgctctgagcgaggtctctctgaggctgctctgtcacgacgacatcgacacggtgaagcatttgtgtggagactggtttcccatagagtatcccgatagctggtacagagatattacttccaataagaaatttttcagcctagccgcaacgtaccggggcgctatcgtcgggatgatcgtggcggagataaagaatcgcaccaaaatacacaaagaagatggtgatatcctggcttcaaatttctccgtggatactcaggtggcttacattttatctttgggcgtggtgaaggaattcagaaagcacggaatcggctcccttctgctggagagcctcaaggatcatataagcaccactgctcaggaccactgtaaggccatctaccttcacgttttgaccactaataacaccgccatcaacttttatgaaaacagggactttaagcagcaccactatctgccctactattattccattcgaggagtgttgaaagatggattcacctatgtattatacattaacggcggacatcctccttggaccatcctagactacatccagcacctggggagcgccctggctagtctttctccttgtagtataccacatagggtgtaccgccaagctcattcccttctttgttcctttttgccttggagcggcatctcaagtaagtcgggtatcgaatatagccgaaccatgtag

SEQ ID NO: 125620 - DNA, 729 bp, Artificial Sequence
  Description of Artificial Sequence: Synthetic coding sequence
atgaccgaagtggtgccttcctcggccctctcagaggtgtcactgagattgctttgtcatgacgacatcgatacggtcaaacacctatgcggcgactggttcccaattgaatatccagactcttggtacagggatataacatccaataagaaattctttagtctcgcggctacctatcggggcgccattgtcggaatgatcgttgctgaaattaagaacaggacgaaaatccacaaggaggatggcgatattttggcctctaacttttcagtcgacactcaagtggcatatattctttctctgggtgtcgtcaaagaattccgtaaacacggtatcggctcccttttactcgagtccttgaaagaccacatcagcactaccgcccaggaccattgcaaggctatttacctgcatgtgctaacaaccaacaatacagctatcaatttctatgaaaatagagatttcaagcagcatcactatctgccctattactacagcattcgtggggtgcttaaggacggcttcacatacgtcctgtatatcaatgggggccaccccccatggacaattttggattacattcaacacttaggttccgctcttgctagtctgtctccatgctcaatcccccaccgcgtttaccgccaagctcacagcctcctgtgctcctttctgccatggagcggaattagctccaagtcaggaatcgagtacagcagaaccatgtag

SEQ ID NO: 125621 - DNA, 573 bp, Artificial Sequence
  Description of Artificial Sequence: Synthetic coding sequence
atgactgaggttgtcccatcctcagccttgtctgaggtctctctacggctcctgtgccatgacgacattgacacggtgaagcacctctgcggtgactggtttccgatcgaatatcccgactcttggtatcgcgatattacatcaaataagaaattttttagcttggctgcgacctacaggggtgccattgttggcatgatagtcgcggagattaagaataggacaaagatccacaaggaggatggggatattcttgcttctaacttcagtgtggatacacaggtggcatacatattaagtctgggtgtggtcaaggaatttaggaaacacggaatagaacctcatggacttcaccctgccccaggcctctgtacttcccaacccgagcctctgttgcattcagctcagtctctgccccccggaccgcagcccgctcttcagcttcctgcaatggtgggtcacctattccaagagtggcaccgggtgcaacctgaccacgttatgagcgccgggcagcctcctccaggaccgacactccgtccaccagccgagccagctttcctctccatttag

SEQ ID NO: 125622 - DNA, 750 bp, Artificial Sequence
  Description of Artificial Sequence: Synthetic coding sequence
atgttcccccgaaggagaacagaacggcggttgggggatacaggaaccaggaagaaaattgcataccgcaaggcggtaccgggcgggcggaagtgcggagcatcattatcatgggaaaaaagtagtcgcgagtaccctgactcgtggtatcgggacatcacctcaaacaaaaagttcttcagtctggccgcgacctatagaggagctatcgtgggaatgattgttgccgaaatcaagaatcgaaccaaaatccacaaagaagacggggatatccttgctagtaacttctcggtggacacccaggtagcatacattctgtctctcggcgtcgttaaggaatttagaaaacatggcattggcagcttattacttgaatctcttaaggaccacatcagcacgacggcccaggaccattgcaaggctatctatctgcacgttcttacaacaaataacaccgccattaatttttacgagaacagagactttaaacagcaccattacttaccatactactacagcatcaggggcgttcttaaggatggatttacctatgtgttgtatatcaacggagggcacccgccgtggaccatcctggattacatccagcatctgggttccgcactggccagtctctccccctgctcaattccccatcgtgtgtaccggcaggctcacagtctgctatgcagttttctgccgtggtccggaattagttccaagtctggcatcgaatacagcaggacaatgtag

SEQ ID NO: 125623 - DNA, 492 bp, Artificial Sequence
  Description of Artificial Sequence: Synthetic coding sequence
atggctgtcatcctgggcatttttggtactgttcaatacaggtctagatatcttatactgtacgcagcctggctggtgctatgggtcggctggaacgccttcattatctgcttttatcttgaggtcggccagctatcacaggatagggactttatcatgaccttcaacactagcctgcataggagctggtggatggaaaatggacctggatgtctcgtcacacctgttctaaactcaaggctagcattggaggaccatcatgtgatcagtgtaactggatgtttacttgactacccatacatcgaggctcttagttctgcgctacaaatcttcctggctctgtttgggttcgtttttgcatgctacgtgtccaaggtcttcctggaggaggaggattcgttcgatttcatcgggggtttcgatagctacgggtaccaggcgccccagaagacttcccacctgcagttgcaaccactgtataccagcggatag

SEQ ID NO: 125624 - DNA, 624 bp, Artificial Sequence
  Description of Artificial Sequence: Synthetic coding sequence
atgggcaagtgctcaggacggtgcactttggttgctttctgttgtttgcagctggtggctgcccttgagcggcagatattcgattttttgggttaccagtgggcaccgatcctcgccaactttttgcacattatggccgtaattctgggtatttttggaaccgtgcagtacaggagtcgctacttgattttgtatgcagcatggctcgtgctttgggtgggatggaatgcctttattatttgtttttacctggaggtgggacagctgtcccaggacagagacttcattatgacctttaatacgtccctccaccgatcttggtggatggaaaatgggccaggttgcttagtgactcctgttctgaattcaaggctggccctggaggaccaccacgttatcagtgtcaccggctgcttattggattatccatatatcgaagccctatctagcgccctccagatttttctcgccttattcggcttcgtgtttgcctgttacgtttctaaggtctttttggaggaagaggactcttttgactttataggaggatttgacagctacggctatcaagccccccagaagacatcccacctccagctgcaacctctgtacacatcaggatag

SEQ ID NO: 125625 - DNA, 411 bp, Artificial Sequence
  Description of Artificial Sequence: Synthetic coding sequence
atggctgtgatccttggcattttcggaactgtccagtacagaagccgttatctgatactggatagagattttattatgacttttaacacgtcgctgcaccggagttggtggatggaaaatgggcctggttgtctggttacaccagtcttaaacagcaggctcgctctggaggaccatcatgtgatttcagtgaccggctgcctgctcgattatccttacatagaggctttgagttccgcgctgcagatctttctagctctttttggcttcgtgtttgcctgttatgtttccaaagtctttctggaggaagaggattcctttgatttcataggtgggttcgacagctatggctatcaagctccccagaagacgtcacacctgcaattgcagcccctgtatacaagcggttag

SEQ ID NO: 125626 - DNA, 567 bp, Artificial Sequence
  Description of Artificial Sequence: Synthetic coding sequence
atgggctattgctcggggaggtgcaccctgatcttcatctgtggcatgcagttggtgtgtgtactggagcgacagattttcgacttcctcggataccagtgggctcccatcctcgcgaattttgttcatattatcattgtgatcctgggcctttttgggactatccagtataggccaaggtacatcacaggctatgcagtgtggcttgtgctttgggtgacatggaatgtcttcgtaatttgcttctatcttgaggccggtgacctaagcaaagaaacagacttgatccttacgttcaatatttcaatgcaccgatcttggtggatggagaacggcccgggttgcacagtgacgagtgtcactcccgcccctgactgggccccagaggatcatcgctacatcaccgtgtccggctgtctgcttgaatatcagtatattgaagtcgcacactcttcactccagattgttttggccgtgtcagtgggctcgcagcctctgttgctggtgcctctgggccttttttatttctgcgccaacagcgtgcacacaaatggcatatgcggatag

SEQ ID NO: 125627 - DNA, 627 bp, Artificial Sequence
  Description of Artificial Sequence: Synthetic coding sequence
atgggctattgttctggtaggtgcacgctgatcttcatatgtggaatgcagctcgtctgtgtcctcgagcgacagatcttcgacttccttggctatcaatgggcgcctatactggccaacttcgtacacataatcattgtgatcctgggactgttcggcacaatccaatataggccccgttacattactggctacgctgtgtggcttgtgttatgggtgacctggaacgtgttcgtgatctgcttttacctcgaggctggggacctgtcaaaggagacggacctgatccttacgtttaacatttccatgcatcgctcttggtggatggagaacgggccaggctgtactgtaacttctgtgacaccagccccagattgggctcctgaggaccaccggtatattacggtcagtgggtgcctactggagtatcaatacattgaggtggcgcattcctctctgcagatagtgcttgcactggctgggtttatttacgcgtgttacgtagtgaaatgtataaccgaggaagaggattcgtttgactttattggtggttttgacagttacggttatcagggcccacagaaaacgagccacctgcagctgcagccaatgtacatgtctaaatag

SEQ ID NO: 125628 - DNA, 624 bp, Artificial Sequence
  Description of Artificial Sequence: Synthetic coding sequence
atggggatcatccgatttctgcttctttactgccccaccaatatcttgactgtgtgtgttctagaacggcagatctttgacttcctcggctaccagtgggcgccaattctggctaactttgtccacattattattgtgatcctgggcctgtttgggaccatccagtaccggccacgctacatcaccgggtacgccgtttggttagtgctttgggtgacatggaacgtgttcgtgatctgcttttacctagaagccggggacctgtctaaggaaaccgacctcattctgacctttaatatttccatgcatagaagttggtggatggagaacgggcccggctgtactgtgaccagcgtgacccccgctccagactgggcacccgaggaccatagatatattactgtgtctggttgtctactggagtaccagtacattgaggtggcgcacagctctctgcagatcgtccttgcactggcaggcttcatatacgcttgctacgtcgtgaagtgtattaccgaggaggaggacagttttgactttataggggggttcgattcctacggatatcaaggtccacagaagacttcccatctccagcttcagcccatgtatatgagcaagtag

SEQ ID NO: 125629 - DNA, 576 bp, Artificial Sequence
  Description of Artificial Sequence: Synthetic coding sequence
atgaagatcgtttgcgtcttagaaagacagatcttcgatttcctgggttaccagtgggctccaatcttggccaactttgtgcacattattatcgtgatactcggcctgttcggcactatccagtacagaccacgttacataaccggctacgccgtctggctggtactctgggtaacttggaatgtctttgtcatttgtttttatttggaagccggcgacctcagtaaagaaactgacctcatcttaacatttaatattagtatgcaccgaagctggtggatggagaacggtccagggtgcaccgttacctcagtaacccccgctcctgactgggccccggaagaccacagatatattaccgtgagtggttgtctgctcgaatatcagtacatcgaagtggcacattcgtctttgcagatagtgctggctctcgctggttttatttacgcgtgttacgttgttaaatgtatcacagaggaggaggactcctttgatttcatcgggggctttgacagctacggctaccagggcccccagaaaacctcacaccttcaactccagccaatgtatatgtag

SEQ ID NO: 125630 - DNA, 420 bp, Artificial Sequence
  Description of Artificial Sequence: Synthetic coding sequence
atggggtattgttctggccgatgtacactcattttcatttgcggcatgcagctggtctgtgtgctggaacgccaaatcttcgacttcctcggatatcagtgggcccctatcctcgcaaactttgttcatatcattattgtgatccttgggcttttcggaactattcagtatcggcccaggtacatcaccggctacgcagtctggctagtactctgggtgacctggaacgtgttcgtgatatgcttttatttggaggcaggggatctgtccaagctcgccgggtttatttacgcctgctacgtggttaaatgtatcaccgaggaggaagactcatttgactttatcggtggcttcgattcttatggctatcaggggcctcagaaaacctcccacctacaacttcagcccatgtatatgtag

SEQ ID NO: 125631 - DNA, 594 bp, Artificial Sequence
  Description of Artificial Sequence: Synthetic coding sequence
atgggctgctgcaccggacgttgctccctgatttgcctgtgcgctctccagctggtgagtgcactcgaaagacaaatctttgatttcctcggatttcagtgggccccaattctggggaactttctccacattatcgttgtgatcctggggctgttcggcacgatccagtacagaccaaggtacattatggtgtatacagtgtggacagctctgtgggtgacctggaatgtgttcattatctgcttctacctggaggttggcgggctgagcaaagacaccgacctgatgacctttaacatttctgttcaccggtcctggtggagagaacatgggcccggatgcgtgcggcgcgtgctccctccctcagcccacggcatgatggacgactatacttatgtctcagtgaccggatgcattgtggactttcagtacctagaagttatccactccgctgtccaaatcctgttaagtctggttgggttcgtctatgcttgctatgtgatctcaatatctatggaggaagaggatacatactcctgcgacttgcaagtctgcaagcacctgtttattcagatgttgcagatcatcgagtag

SEQ ID NO: 125632 - DNA, 594 bp, Artificial Sequence
  Description of Artificial Sequence: Synthetic coding sequence
atgggctgctgtacggggagatgtagtctgatctgcttgtgtgctcttcagctggtcagtgcgctcgagcgccaaatctttgactttctaggcttccagtgggccccgatcctcggcaactttctacacattatcgtggtgatcttaggacttttcggaaccatccagtatcgccctaggtacatcatggtgtacactgtgtggactgccttgtgggtcacatggaatgtgtttatcatctgcttctatctagaggtgggcggtttgtcaaaggacacagatttgatgacattcaatataagcgtacatcggagttggtggcgggaacatggacccggatgcgttagacgagtgctcccgccatcggcccatggcatgatggatgactacacctatgtctctgttacaggatgcattgtggacttccagtatctcgaggtcatacacagcgcagtccagatcttgctatctctcgtgggatttgtgtacgcttgttatgttattagcataagcatggaagaggaagacacatattcttgtgatctccaggtatgcaagcacctattcatccagatgctgcagatcatcgagtag

SEQ ID NO: 125633 - DNA, 486 bp, Artificial Sequence
  Description of Artificial Sequence: Synthetic coding sequence
atgggatgttgtaccggacgatgctctcttatctgcctgtgtgctttgcagctggtgagttgggtgtttgaccggcagatcttcttgttgagctttcagtgggcgcctatcctcggcaattttttgcacataatcgtggttattctgggtttgttcggcacaatacagtatcgccctaggtacataatggtctacaccgtttggactgcattgtgggtcacctggaatgtattcatcatatgtttttatttggaagtcggcggtttgtccaaagatacggacctgatgaccttcaacatctctgtgcatcgttcctggtggagggagcatggacccggctgtgttcggcgtgtgctacctccaagcgctcacggtatgatggacgattacacttacgtgagcgtcactgggtgcattgtggattttcagtatcttgaagtgattcactctgccgtgcagatcctcctctccatcttctttctctag

SEQ ID NO: 125634 - DNA, 627 bp, Artificial Sequence
  Description of Artificial Sequence: Synthetic coding sequence
atgggatcttgctccggtcggtgcgcattagtcgtgctttgtgccttccaattagtggcagccctcgagaggcaggtttttgacttcctcggataccagtgggcaccaatcctcgctaacttcgtgcacattatcattgttatcctcggcctgttcggtacgattcagtacagactccgctatgttatggtgtacacactgtgggcagccgtttgggtcacatggaatgtgttcattatttgtttttacctcgaagttggaggtttactgaaggacagcgaactcctgactttttctctctcgcgccatcgatcgtggtggcgcgagcgctggcctggttgtctacacgaagaggttcctgctgtggggctaggtgcccctcatgggcaggcattggtctcaggggcaggatgtgccctggaaccttcatacgttgaggccctacattcatgtctgcagatcctgattgctcttctaggctttgtgtgcggttgccaagttgtttcggtcttcaccgaggaagaggatagcttcgacttcataggcgggttcgaccccttcccactttaccacgttaacgagaaaccatccagtctgttatctaaacaggtgtaccttccagcatag

SEQ ID NO: 125635 - DNA, 267 bp, Artificial Sequence
  Description of Artificial Sequence: Synthetic coding sequence
atggctgaatcccggggccgattatacttgtggatgtgtctcgcagccgccctggcaagctttcttatgggatttatggtggggtggttcataaagcctctgaaagagacgactacgagcgtgcggtatcaccagtctatacggtggaaactagtgagcgagatgaaggccgagaacatcaaatcttttctacggtcgttcaccaaactgccacacctggcggggactgagcaaaacttcctgttggccaagaagatacagacctag

SEQ ID NO: 125636 - DNA, 2223 bp, Artificial Sequence
  Description of Artificial Sequence: Synthetic coding sequence
atggcagagtcccgcggcagactatatttatggatgtgtctcgctgccgcgctggcaagtttcctcatgggtttcatggtgggatggttcattaagccattaaaggaaactacaacctccgtcaggtatcaccagtcaatcaggtggaaactggtgtctgaaatgaaggcggagaacatcaagtccttcctgcgctcctttactaaattgccccacctagccggcaccgagcagaatttccttcttgctaaaaagattcagacacaatggaagaaatttggattagattcggccaagctggtgcactacgatgttctgctcagttatcccaacgagactaatgcgaactatatttcaattgtggatgagcatgaaaccgagatcttcaagacaagctacctggagcccccgccggacggctacgagaatgttactaatatcgtgccaccatacaacgccttttctgcccagggaatgcccgaaggcgatttggtctacgtaaattatgcgcgtacggaagattttttcaaacttgagcgggagatggggattaactgcacgggcaaaatcgtgatcgccaggtacggcaaaatcttcaggggcaataaggtcaaaaacgcaatgctcgctggcgctattggaattattctctactctgatcccgcggactactttgctcccgaagtgcagccttaccctaagggctggaacttgcctggtactgctgcacagagaggcaatgtgctgaatctcaacggcgccggggacccgcttactcccggttatccagcaaaggagtacacgttccgtctggatgtggaagaaggcgtcggtattcccagaattccggtacaccccatcgggtataatgacgcagagatcttgcttcgatatctgggtggaatagctcctccagacaagtcgtggaagggcgcactcaatgtgtcttatagcattgggcctggtttcacagggtcagactccttccgcaaagtccgcatgcacgtgtataatataaataaaattacacgcatctataacgtcgtgggcacaatccggggttcagttgagcccgaccgctacgtcatcttgggcggacatcgtgattcttgggttttcggcgcaattgaccccaccagtggtgtcgccgtcttacaggagatagcccgcagttttggaaagctgatgtctaaaggatggagaccgcgacggaccatcatcttcgccagctgggatgcagaggaattcggccttctgggaagcacagagtgggctgaagaaaacgtcaaaatactgcaggagcgaagcatcgcatacatcaacagtgacagtagcattgaaggtaactatactttgagggtcgactgtaccccccttttgtaccagcttgtctacaagctcactaaagaaatacctagtccggacgatggtttcgagtcaaagagcctatacgaatcctggctggagaaagaccctagtcccgagaacaagaacttgccacggattaataagcttgggagcggttccgacttcgaggcatacttccagaggctagggatagcctctgggcgggccaggtataccaaaaacaagaaaaccgacaaatactcgtcataccccgtgtaccacacaatttatgagacatttgagctggtagagaagttttacgacccgacgttcaagaagcagttgtctgtcgcccagctaaggggcgctctagtatacgagcttgtcgattcaaagattatccccttcaacatccaggactacgctgaagcacttaagaattacgcggccagcatatataatttaagtaaaaagcacgaccagcagctcaccgatcatggcgtcagtttcgatagtttgttctccgcagtgaagaacttctctgaggcagcctcagacttccataaaaggctgatccaagtggatctgaacaaccctatagccgtacggatgatgaatgaccagttgatgctgctggaacgagctttcatcgacccccttgggcttccagggaaactgttttaccggcacatcatctttgctcccagctcccacaataagtacgccggggagtcttttccgggcatttatgacgctatctttgatatcgaaaacaaggcgaatagcagattagcttggaaagaggtcaagaagcacatctccatcgccgcatttacaattcaggcggctgctggaaccctgaaggaggtgctctag

SEQ ID NO: 125637 - DNA, 1635 bp, Artificial Sequence
  Description of Artificial Sequence: Synthetic coding sequence
atgcaatggactaaggtgttggggctcggcctcggcgccgcggctcttctggggctaggtattatcctgggccattttgcgattcccaaaaaggccaattctttagcacctcaggatctggacttggagatcctggaaactgtgatgggtcagttagacgcgcatcgcattagggagaacctccgtgagctgagcagagagcctcacctagctagttccccccgcgacgaggaccttgtgcagctactgctgcagcgctggaaggatcctgaatccggtttagattcggccgaagcatctacttacgaagtgttgctctcttttccgagccaagaacagcctaatgtggtcgatattgttggaccaactggcggcataattcactcatgccacagaacggaagaaaatgtcaccggggaacaggggggacctgatgttgttcagccatacgcagcatacgcgccttctgggacccctcagggattgctagtctacgctaaccggggagccgaagaggactttaaggaactccaaacccaggggattaaactggagggaactattgccctcacccggtacggaggtgttggcaggggagctaaagctgttaacgccgccaagcatggtgtggccggggtgctggtttacacagatcctgctgatattaacgatggactaagctccccagatgaaacattcccaaattcctggtacctgcctccctccggagtggaaagaggatcttactacgagtatttcggagaccccctcaccccttatttacccgcggtgccatcttcttttcgggttgatctggctaatgtgtctggattccctcctattccaacgcagccaatcggctttcaggacgcacgcgacctgctgtgcaacttaaatggtaccttggctcctgccacctggcaaggagcgttagggtgtcactaccgccttggcccaggcttccgtcccgatggcgactttccagccgactcccaggttaacgttagtgtgtacaaccggcttgagctccggaatagttccaatgttctgggtatcatccgcggagccgtcgaacctgaccggtacgtgctatatggcaaccatagagattcctgggttcacggagcggtggatccctcatccggtacagcggtcctgctagagttgtcccgggtgctaggaaccctgctcaagaaggggacctggaggccaagaagatcaattgtgtttgcttcctggggcgctgaggaattcggactgattggaagcacagagttcaccgaggagttcttcaacaaactccaggagaggaccgtggcatacatcaatgtcgacatttctgtgtttgccaacgcgacactcagagtccaaggcactccgccagttcagagcgtggtcttcagcgcgacaaaggagatcagatcacccggaccgggggacttgagtatctacgacaactggatccgctattttaataggtcatccccagtgtatggactggtgccaagagcccggctgcagcccggcagtacaccaccaacaacacagccactgacgccgctcacaatgtggacatctttctggacacgggcttctgcagctattcgcctgtggcctggccagcggggagtctag

SEQ ID NO: 125638 - DNA, 1569 bp, Artificial Sequence
  Description of Artificial Sequence: Synthetic coding sequence
atgcagtggacaaaggtcttgggcctcggcctgggagccgcagcccttctcggactagggataatcctcgggcattttgctataccaaaaaaagctaattcattggcgccccaggaccttgatctggagattctggagacagtaatgggtcaattggacgctcatcggatcagggagaacctgcgtgagctgtcccgggagcctcacttggcttcatcgccaagggacgaagaccttgttcaactgctgctgcagcgttggaaagatcctgagtccggtctggactctgccgaggctagcacatatgaggttctgttgtcatttccaagccaagaacagcctaacgtggtcgatatcgtcggacctacgggtggcattatccattcatgccatcgcactgaagagaacgtaaccggcgaacaggggggcccagacgttgtacaaccctatgccgcctacgccccctcagggaccccacaaggattgcttgtctacgccaaccgtggagcagaagaagacttcaaggaattgcagacccagggtatcaagctcgaggggactatcgccctcactcgatacggaggggtcggcagaggcgctaaggccgtgaacgcggccaaacacggagtcgccggagttttagtatataccgaccctgctgacatcaatgacggccttagctcaccggacgagacttttcctaactcctggtacttgccacctagtggagtcgagaggggcagctactatgaatattttggcgaccccttaacaccctacctccctgccgttcccagcagcttccgggtagacctagcgaatgtaagcggattccccccaatccctacccagcccatcgggttccaagacgccagagatctcctatgtaatctgaatggcacgctggcccctgccacttggcagggtgccctcggttgccactaccggctcgggccagggttcagacccgatggcgattttcctgctgactcacaggtaaacgtgagtgtctacaaccgcctggagttgaggaacagtagcaacgtactgggaatcatccgcggagctgtagaaccggaccgatatgttctttacggcaaccacagagactcatgggtgcatggcgccgtggatccgtccagcggcaccgccgtactcctcgaactgtctcgggtgctcggcacattactgaagaagggtacttggcgcccacggcgctctattgtgtttgccagttggggggccgaagaatttgggctgataggctctacagagtttactgaggaattctttaacaaacttcaagaacgcaccgttgcctacatcaatgtcgatatctcagtgttcgccaacgccacactgagagtgcaaggtactcccccagtccagtccgtggtcttcagcgcaactaaagagattcgaagtcctgggcctggagatctctctatatatgacaactggatccggtactttaaccggagctctccggtctacggcttagtgccaagactgcagcagccttcaggttgcgggccagactcaggcgagtgtgattcgccagctcagtag

SEQ ID NO: 125639 - DNA, 2223 bp, Artificial Sequence
  Description of Artificial Sequence: Synthetic coding sequence
atgcaatggactaaggtgctgggtttgggactgggggcagctgccctgctcggcctgggcataatccttggccacttcgccataccgaagaaggccaattctttggctccacaagatctggacctggagatccttgaaacagtgatgggtcagctggatgctcaccgcattcgggagaatctgagggaactgtcaagggagcctcacttagcttctagcccccgcgacgaagacctggtgcagttactgctgcagcggtggaaagacccagagtcgggacttgactccgccgaggcttccacttatgaggttctgttaagtttcccgtcccaggaacagcccaatgtcgttgacattgtagggccgaccgggggtatcatacactcgtgtcatcggaccgaggagaatgtgacaggggagcaaggcggcccggatgtcgtccagccttatgcggcatatgcaccctcaggaaccccccagggtctccttgtgtatgctaatagaggtgccgaggaggactttaaagagctccaaacccagggaattaaactggaaggcaccattgccctgacgcgatatggaggagtgggacggggagctaaagctgtgaacgctgcaaagcatggggtagccggcgtgttagtgtatacagacccagccgatataaatgacgggctctcgagtcccgacgaaaccttccccaactcctggtacctgccgccatccggagtcgagcgagggtcctactacgagtatttcggagatccacttaccccctaccttccagctgtgccttcctctttccgcgtcgacctagccaatgttagtggcttcccgcctatccccacgcagcctattggctttcaggatgcccgtgaccttctgtgtaacctgaatggcactctggcccctgccacatggcagggtgctcttggctgccattaccgcctcggaccgggctttcgtccagacggggacttccccgccgattcccaggttaacgttagtgtgtataatagacttgagctacggaactcaagtaatgtactcgggattatcagaggagcagtggaacctgatcgctacgttctgtatggcaaccatagagatagttgggtccacggcgcagtggacccgagctcgggcacggccgtgctgctcgagctctccagagtgcttggaacgttactgaaaaaagggacgtggagaccacggaggtccattgtcttcgcgtcctggggcgccgaggagtttggccttattgggtcgacagagtttaccgaggagttcttcaataaattgcaggagcggacagttgcttacattaacgtcgacattagcgtgtttgctaacgcaacgctgcgggtgcaaggcacccctcctgtgcagagtgtagtttttagtgctacaaaagaaattagatctcccgggcccggagatctcagtatttacgacaactggattcggtactttaacaggtcaagtccagtctatggtctcgtgccctcccttggttccctcggcgccggatccgactacgctcctttcgttcacttcctggggattagttctatggacatcgcctacacttacgacagatcaaagaccagtgctagaatatatccaacctaccataccgcattcgacacattcgactatgtggacaagttcctagacccaggctttagttctcatcaggctgttgcaaggaccgccggatccgtcatcctgcggctgtctgattccttcttcctgccactaaaagtgtctgattattctgagacattacgatccttcctgcaagcagcacagcaggatctgggcgccttgctggaacaacattccatctctttaggacctcttgtgactgcagtggaaaagttcgaagctgaggccgctgcgttaggacaacgaatctcaactttgcagaagggcagcccagaccccctgcaggtccgaatgctcaacgaccagctgatgctcctcgagaggacctttctcaaccctagagccttcccagaggagcgatactactcacatgtgttgtgggccccccggacgggctcagtcgtgacgttccctggactttcaaatgcctgttccagggctcgtgacactgcgtctggttctgaagcatgggctgaggtccaacggcaactaagtattgtggtgacagctttagaaggcgccgctgcaaccctccggcctgtagccgatttatag

SEQ ID NO: 125640 - DNA, 2220 bp, Artificial Sequence
  Description of Artificial Sequence: Synthetic coding sequence
atgcaatggaccaaagttcttgggctgggactgggggcagccgcgctcttggggctaggcattattttgggccatttcgctatccctaagaaagctaattctttagctcctcaggaccttgaccttgaaatccttgagaccgtgatgggacaattagacgcccaccgcatacgggaaaacctaagagagttatcaagggagccccacctcgcttccagccctagggacgaggacctggtgcagttgttgttgcagaggtggaaggaccctgaaagcgggttggactcagcagaggcttctacctatgaagtcctcctgtcgtttccttcccaggagcaacccaacgtcgtggacatcgtcgggcctaccggagggatcattcacagttgtcaccggacggaagagaatgtgaccggtgagcagggtggacccgacgttgtccaaccgtatgcagcttatgcaccaagcggaacacctcaggggctcctggtttatgccaatcgcggggcggaagaagatttcaaggagctgcagacacaaggtattaagctggaagggaccatagccttgactaggtatgggggagtgggccggggtgccaaggcggtcaacgctgcaaagcatggggtggccggagtgttagtgtatactgaccctgccgatatcaacgacggcctgagctcccccgacgagacttttcccaactcttggtacctgcccccctccggagttgaacggggaagctactatgaatacttcggcgatcctctcacgccttacctccccgccgtgccgagctcctttcgtgtagatctggcaaatgtgagcggctttccacccatcccaacccagcctatcggcttccaggatgcgcgcgatctcctttgcaatttgaatggtacccttgcacccgccacctggcagggagcgctggggtgtcactatcgcctgggccccgggttcaggcccgacggagatttcccagctgattctcaggtaaacgtatccgtgtacaaccgactggagttacgcaactcatccaacgtcctgggcatcatcaggggagcggtcgagcctgacaggtacgtcttgtacggcaatcacagagattcctgggtccatggcgccgtcgacccatcatccggtacggcagtcctcctggagctcagccgtgtgctgggtactctgctgaagaagggaacctggcggcctcgacgctccatcgtgttcgcaagctggggagccgaggaattcggcctgatcggttccaccgaattcacggaagaatttttcaataagctccaggagcgtacggtggcgtacatcaacgttgatatctccgtcttcgccaatgcgacccttagagtacagggaactcccccagtccaaagtgttgtattcagtgccaccaaggaaatccgatctcctggccctggtgacctctcaatctacgataattggatcagatatttcaatagatctagcccagtctacgggctcgttccatccctcggctccctcggggccgggtccgactatgccccattcgtgcatttccttggtattagctctatggatattgcttacacatatgataggtctaagaccagcgcaagaatctaccctacctatcataccgcctttgacacatttgactatgtcgataagttcctggacccaggattctcttcacaccaagccgtagcgaggacagcaggctcagtgatcctgaggctgagcgatagtttcttccttcctctaaaggtgtccgattactccgaaacgctaagatcttttctacaagctgcacagcaggacctgggcgccctgctggagcagcatagtatatctttgggtcccctcgtaactgctgtagaaaagttcgaggccgaggctgctgcactgggacaacgtataagcacactccagaaaggatctcctgacccattgcaggtgcggatgctcaatgaccaattgatgctcctggaaagaacatttttgaatcccagagcattccctgaagagcggtactattcccacgtgctgtgggcacctagggggctccgatcccacattcccgggcttagcaacgcatgtagcagggcaagagacacagcatccggatcagaagcctgggcagaagtgcagcgacagctgtcaatcgtggtgaccgccctagagggagccgctgccacattgagacctgtggccgatctttag

SEQ ID NO: 125641 - DNA, 405 bp, Artificial Sequence
  Description of Artificial Sequence: Synthetic coding sequence
atggagattagtaagaaaattaaaacccagtggacaagcctggggttagaggatgtgcagtttgtgaattattctgttttattagacttgccaggcccttctccaagcaccgttacccttagtagctccgggcagtgcttccatcccaacggtcagccctgttccgaagaagcgcggaaggattcctcccaggacctattgtatagctacgctgcatatagtgcgaaaggcacattgaaggccgaggtcatagacgttagctacggcatggccgatgacttgaagcggattagaaaaataaaaaacgtaacaaaccagatcgctttgcttaaattagggaagctacctctgctctacaagatgaaagtcctcgataaagctgaccaaacgagccccttgtattag

SEQ ID NO: 125642 - DNA, 2388 bp, Artificial Sequence
  Description of Artificial Sequence: Synthetic coding sequence
atgggagaaaatgaagccagcctgcccaatactagtttgcagggaaagaaaatggcttaccagaaggtgcacgcagaccaacgagctcccggccacagtcaataccttgacaatgatgacctccaagcaaccgctttggacctggaatgggacatggagaaggagttagaagagtctgggtttgatcagtttcaactagatggcgctgaaaatcagaacctgggccactccgaaaccatcgatctcaacctcgactccatccagcccgccactagccccaagggccggttccagaggctgcaggaggaatccgactacattactcattatacaagatctgctccgaaatccaatcgttgtaacttctgccatgtgctgaaaatcctgtgtactgccacaatcctgtttatcttcggtatactcatcgggtactacgtccatacgaattgtccaagcgacgcaccatcgagcgggacggtagatcctcaactgtatcaggaaatcttgaagaccatccaggccgaggacatcaagaaaagcttcagaaacctggtgcagttatacaaaaatgaggatgacatggagatcagcaagaaaataaaaactcagtggacctcacttgggttagaagacgtccagtttgtgaattactcagtgctgctagacctgccggggccatcaccatctacagtgaccctcagctcttccggacagtgttttcaccccaacggccagccatgctccgaggaggcccggaaagacagctcacaagacctgctgtacagttacgctgcgtactccgcaaagggcactcttaaggctgaagttatagacgtgagttacgggatggctgatgacttgaagcggattcgaaagattaagaatgtgaccaaccagattgccctcttgaaactgggtaagctacccttgctttacaagcttagcagtctggaaaaggccggtttcggaggtgttttgctgtacattgacccttgtgaccttcccaagaccgtaaatccgagtcatgacacatttatggtatccctaaatcccggtggagatcccagcaccccagggtacccaagcgtggatgaatcgttccgacagtctcggtccaatctcacctcgttgctagttcaaccaatctccgcccctctggtggctaagttaatatctagccccaaggccaggaccaagaatgaagcctgttcttcgctggaactgccaaacaatgagattcgggtcgtgtcaatgcaggtccaaactgtaaccaagctgaagaccgtgactaacgtggtgggttttgtgatgggcctgacttcccccgatcggtatattatcgtaggatctcaccaccacactgcacacagctataatggacaggaatgggcttccagcacggctattattacagccttcatcagagcactgatgtcaaaggtgaaaagaggatggagacccgatcgcaccatcgtcttctgcagttggggtgggaccgccttcggcaacattggatcatatgagtggggggaggacttcaagaaggtgctccaaaaaaacgttgtcgcttatatctccctgcatagccctatacggggcaatagttcattgtatcccgtggcaagtcccagtcttcaacagctggtggtcgaaaaaaacaacttcaattgcacacgcagggcacagtgtcctgagactaatatctcgtctatccaaattcagggggacgcagactatttcataaaccatctgggggttcccattgtccagttcgcctacgaggatatcaagaccctcgaaggtccaagcttcttatctgaagcacgatttagcaccagagcaactaagattgaagaaatggatccaagcttcaatctccacgaaacaattaccaagctctcaggggaggttatcttgcagatcgccaatgagccagtgctgcccttcaatgccctggatattgctttggaagtgcagaataaccttaaaggggatcaacctaacacccatcagctactggccatggccttgcgattgcgcgagtccgctgagctgttccagtccgatgagatgcgacctgcaaacgatcctaaggagagagcccccatcagaatcaggatgctgaacgacatcctacaagatatggagaaaagctttctggtgaagcaagctccaccggggttctaccggaatattctctaccacctcgatgagaagacatcacggtttagcatcctgattgaagcttgggagcactgcaagcccctggcgagtaacgagacacttcaggaagctctgagtgaggttctgaattccatcaatagcgcccaggtgtattttaaagctggcctagacgtattcaaatctgtcttggacgggaaaaactag

SEQ ID NO: 125643 - DNA, 1236 bp, Artificial Sequence
  Description of Artificial Sequence: Synthetic coding sequence
atgctgttaaagacagtcctactgctcgggcacgtggctcaggtgcttatgctggataatggccttctgcagaccccacccatgggctggctagcctgggaaagattccgctgtaacatcaattgcgacgaggatcccaagaattgtatctccgagcaactgttcatggagatggctgataggatggctcaggatggttggagggatatggggtacacctacctgaacatcgacgactgttggatcggaggccgcgacgcatctggccgccttatgccggatcctaagcgttttccacatggaattcctttcctggccgactatgtgcatagtcttgggttgaagctcgggatatatgcagatatgggcaactttacgtgtatgggctaccctgggaccacactagacaaagtcgtgcaagacgcccaaacatttgcagagtggaaagtggatatgctgaaattagacggctgtttctccacccccgaagagagagctcagggttatcccaagatggccgctgccctgaacgccacaggcaggcctatcgccttttcctgtagctggccagcttatgagggagggcttcctccgcgcgtcaattacagtctacttgcagacatttgcaatctctggcggaactacgacgacatacaagactcatggtggagtgttctctctatcttgaattggtttgtggagcatcaagacattctgcaacctgttgcaggccctggtcattggaacgacccagatatgttactcattggcaatttcggcctatccctggagcagtcacgggctcagatggccctctggaccgttctggccgcacctctgcttatgagcacagacctcaggacaatctctgctcagaatatggacatcctgcagaaccctctgatgattaaaatcaatcaggatcccctgggaatccagggaagaaggattcacaaggagaaatcattgatagaggtttatatgagacctttgtccaataaagcctcagctctggtttttttctcgtgtagaaccgatatgccttataggtaccactcgtctcttggtcagctgaatttcaccggctctgtcatctatgaagcccaagatgtttattctggagacattatctctggacttagggacgagacgaactttactgtaattataaatccctccggcgtggtaatgtggtacctttatccaatcaagaatcttgaaatgagtcagcagtag

SEQ ID NO: 125644 - DNA, 1236 bp, Artificial Sequence
  Description of Artificial Sequence: Synthetic coding sequence
atgctcctcaaaacagtcctgctgctcgggcacgtggcccaggtgttgatgctggataatgggctccttcagacaccgcccatgggatggttagcatgggagcgcttccgctgcaatatcaactgcgatgaagatccgaagaattgcattagtgaacagctgttcatggaaatggccgatcggatggcccaggacgggtggcgagacatggggtacacttatctgaacatcgatgactgttggatcgggggccgcgacgcgtccgggagactcatgcctgatccgaagcggtttccacacggaatacccttcctggccgactacgtccactccctcggacttaaacttgggatatatgcagatatggggaattttacctgtatggggtatccaggtactacattggataaggtggtacaggacgcacagaccttcgcggagtggaaagttgacatgcttaagcttgatggctgtttctctaccccagaggagagagctcagggttatccaaagatggcagccgctctaaacgcgaccggcaggcctattgcgttttcgtgtagctggcccgcctacgaaggcggattgccgcccagagtgaactattctctgcttgccgacatatgcaacctctggcggaattatgatgacattcaggacagctggtggagcgttctgtctattcttaattggtttgtggagcaccaggatattctacaacccgtggctgggcccggccactggaatgatcccgacatgctccttatcggtaacttcggtctgtccttagaacaatccagggcacaaatggccttgtggactgtcctggctgctccgctcctaatgagcactgacttgaggacaataagcgcccagaatatggatattctgcagaatcctctcatgattaagataaaccaggaccctcttggcatccagggtcggcgcattcacaaggaaaagagcctaattgaggtctacatgcgtcctctgtcaaataaggcaagcgctctggtattcttcagctgtaggactgatatgccatataggtaccactcctctctcgggcagctgaactttactggcagtgtgatatacgaggcgcaggatgtctacagcggggacattattagtggtctgcgggacgagaccaactttacagtgattatcaacccctcgggagtggtgatgtggtatctgtatcctattaagaatctggaaatgtctcagcagtag

SEQ ID NO: 125645 - DNA, 1236 bp, Artificial Sequence
  Description of Artificial Sequence: Synthetic coding sequence
atgctgctaaaaacggttttgctgctcgggcatgtggcccaggtgctcatgttggacaatggcctactgcagactcccccaatggggtggttagcatgggaacgcttcagatgcaacattaactgcgacgaggatccaaagaattgcatcagcgaacagctgtttatggagatggccgatcgcatggcccaggacgggtggcgcgacatgggatacacgtacttgaacatagatgattgttggatcggaggcagagatgctagtggcagactgatgcctgaccccaaacgctttccacacggcatacccttcttggccgactatgtccactccctgggattgaaattgggaatttatgcagacatggggaacttcacttgcatgggctatcccgggacaaccctggacaaagtcgtccaggacgcacagacatttgcagagtggaaagtcgacatgttgaaacttgacggatgcttttcaacgcccgaagagcgggcccaagggtatcccaagatggcggcagctttgaacgcaaccggccggcccatagccttctcctgctcttggcccgcctatgaggggggtctgccgccaagagtgaactacagtctcctggccgatatatgtaatctctggagaaactatgatgatattcaagactcttggtggagtgtgctctctatccttaattggttcgtggaacaccaggatatactccagcctgtggccgggcctggccattggaacgaccccgatatgcttctgatcgggaattttggcctgagtctggagcagtcacgagcccaaatggccttgtggaccgtgctggccgcacctctgctgatgtccaccgacctcagaactatttctgcgcagaatatggacatcctgcagaatcctctcatgatcaaaattaaccaggaccccctgggtatccagggaagaaggatccataaagaaaagagtctaatagaggtgtatatgagaccgttgtccaataaagcaagcgctctggtcttttttagctgccggacagatatgccatatagatatcattccagtcttggacaactgaatttcaccggatcagtgatctacgaagcccaagacgtgtactccggggatataattagcggactccgtgacgagacgaattttactgtgataatcaacccgagcggcgtggtgatgtggtacctgtatcccatcaaaaatttggagatgagtcagcaatag

SEQ ID NO: 125646 - DNA, 1035 bp, Artificial Sequence
  Description of Artificial Sequence: Synthetic coding sequence
atggcagcgatctatggcggtgttgagggcggaggcacaaggtctgaagtcttgctggtgtccgaggacgggaaaatcctggccgaggccgacggcctctccacaaaccactggttaataggaacggacaagtgtgtggaaaggatcaatgagatggtgaaccgcgctaagcgaaaggctggcgttgatcccctcgtcccgcttagatctttaggcctttctctatccgggggagaccaggaggacgctggaaggattttgatagaggaactgcgtgaccgatttccgtatcttagcgaatcgtacctaattacaacggatgccgctggatcgattgcgactgcaacccctgatggtggcgttgtgttgatctctgggacaggctcgaattgtagactaattaatcctgatggttcggagtctggttgtggagggtggggtcacatgatgggagatgagggctctgcctattggatagcccaccaggccgtcaagatcgtgtttgattccattgacaatctggaagcagcaccccacgatattggttacgtaaaacaggccatgttccattactttcaggtcccggacagacttggcatcctcacgcacctataccgagacttcgacaagtgccgcttcgctgggttttgtaggaaaatcgcagagggggctcagcaaggagaccctctttctcgatacatcttccgaaaagctggcgagatgctggggagacacatcgtggctgtcctgccggagatcgatccagttctcttccagggcaaaatagggttgcccattctgtgcgttggctccgtgtggaagagttgggaactgctgaaagaaggattcttattggcattaacacagggacgtgaaatccaggctcagaattttttctcctccttcacattgatgaaactgcgtcattccagtgcgctaggcggcgccagtcttggcgctcgtcacataggacacctactgcccatggactacagcgccaacgcaattgccttttatagctatacatttagctag

SEQ ID NO: 125647 - DNA, 1173 bp, Artificial Sequence
  Description of Artificial Sequence: Synthetic coding sequence
atgcggacccgaactgggtcacagctggctgcacgggaagtcactggctcaggcgctgtccctagacagttggaaggtcgacgctgccaggccgggagagacgctaatggcgggacctcctccgacggctcctcctctatggcagcgatctatggcggcgtcgaaggcgggggcacacgatctgaagtattgctggtgagtgaggatgggaaaatactggcagaggcagacggattaagtacgaatcactggctgatcggcacagacaaatgcgtcgagcgcataaacgagatggtgaatagagctaaacggaaggccggtgtggaccctcttgtgcctctgcgctctctcggtctctccctatcagggggcgaccaggaggacgccggccgaatcttaattgaggagctgagagatagattcccatacctgagcgaatcttatctcatcacaaccgacgcggcggggtcgatagctaccgcaacacccgatggaggcgttgtcctgatcagcggaacagggtcaaactgccggttaatcaatccagatggatctgaatcaggctgcggcgggtggggtcatatgatgggcgatgaaggctctgcgtactggatagcccatcaggccgtgaaaatcgtattcgactcaatagataacctggaggcggcccctcatgacatcggttacgtgaaacaggccatgtttcactactttcaagtccctgatcggcttgggatcttaacccacctataccgcgattttgataaatgccgctttgccggcttctgtcgtaaaatcgcggagggggcacagcagggtgacccgctgtcccgctatattttccggaaggccggcgagatgcttggccgacatatcgttgcagtgctgcctgagatcgaccccgtgctctttcagggcaagatcggcctgcccatactgtgtgtcggctctgtttggaagtcttgggagctgctcaaagagggatttttgctcgcacttacccaaggccgtgagatacaggcacagaatttcttctcatcgtttacgctgatgaaattacgccattcaagcgcgctcgggggtgccagtctcggggctcgacatatcggccatctgctgcctatggattattccgcgaatgcaattgccttctactcgtacactttcagttag

SEQ ID NO: 125648 - DNA, 1548 bp, Artificial Sequence
  Description of Artificial Sequence: Synthetic coding sequence
atggccaccagcaccgggcggtggctcctgcttaggctggccctgtttgggttcttatgggaagcaagcggcggactggacagtggtgcgtcccgcgatgacgatttactgctgccatatccccgagcacgcgcaagactgccccgggattgtacgagggtgcgagcgggaaaccgagagcatgagagctggcccccgccacccgctacccccggggctggcggcctggccgttcgaacatttgttagccactttagagaccgggcagtggcgggacatctgactagagctgttgagcctctcaggaccttcagcgtgcttgagccaggtgggcctggcgggtgtgccgccaggcgccgggcaacagttgaggaaacagcccgcgccgctgattgcagagtagcccagaacggaggcttctttcggatgaactctggcgagtgcctgggtaatgttgtgtcagacgagagaagggtgtccagttccggaggactgcagaacgctcaatttggcattaggcgagatggaacgctcgtgaccggctatctttcggaggaagaggttctcgacacagaaaatccctttgtacagttattgtcgggcgtggtgtggctgatacgcaacggcagcatttatataaacgagtcgcaggcaactgagtgcgatgagacacaggaaactggatcgttttcaaaattcgtcaatgtgataagcgccaggaccgccattggtcatgacaggaaaggccagttagtgttgtttcatgccgatggacaaacagaacagcgcggcattaacctgtgggagatggccgaattccttctgaagcaagatgtggtgaacgcgataaaccttgacggcggcggctccgctacctttgttctgaacggcactctggcatcttacccttccgaccattgccaggataacatgtggcgctgtcccaggcaagtgtccacggtggtatgcgtgcatgaacctaggtgtcagcccccagattgtcacgggcacgggacctgcgtggacgggcattgtcagtgtaccggacatttttggcgcggccctggatgcgacgaactggactgtgggccaagcaactgttcgcagcatgggttgtgtacagaaacaggctgtagatgcgatgcaggctggaccgggagtaattgttccgaagagtgtcctctgggttggcatggccccgggtgccaacgcccctgcaagtgcgaacaccattgtccctgcgatccgaagacgggcaattgttcagtttcacgggtcaagcagtgtcttcagccccctgaggcgaccctccgcgccggcgagctatcattcttcacacgtactgcctggctggcactcacgctagcgctggccttcctactgctgatcagcaccgccgccaacctatcactgttgctgtccagggccgaacggaatagacgactgcatggcgattacgcgtaccatccacttcaggaaatgaatggggagcccttggccgctgagaaggagcagccgggcggagcgcacaacccattcaaagattag

SEQ ID NO: 125649 - DNA, 1446 bp, Artificial Sequence
  Description of Artificial Sequence: Synthetic coding sequence
atggccacttcaacaggccgctggttactgttgcgacttgcactgttcggtttcctgtgggaggcctccggtggccttgatagcggagcctcccgggacgacgacctactccttccatatccaagagcccgcgcacggctgccaagggactgtacacgggttcgggctggtaaccgcgaacatgagagttggccgcccccaccggctacgcctggggccggcgggctggctgtccggaccttcgtttctcatttccgagatagggcagtggccggacatttaacccgggctgtagaaccgttaagaacttttagcgtactggagcctgggggccctggcgggtgcgccgcgagacgaagggccacagtggaagagactgcgagagcagccgactgccgggtggctcagaatggagggttttttaggatgaactctggggaatgcttgggcaatgtggtcagcgacgagcgccgtgtttcctcttctggggggttgcaaaacgcacagtttggtatccgacgtgacggaacactcgtgacagggtacctgtctgaggaggaggtcctcgataccgaaaaccctttcgttcaacttctctctggcgtggtgtggttgatccggaacggaagtatttatatcaacgaatcgcaggctactgaatgtgacgaaacccaagagaccggcagtttctcaaaatttgtgaacgtgatctccgctagaaccgccataggtcatgaccgcaaggggcaacttgtgctttttcacgccgatggccagactgagcagcgtggaataaatttgtgggagatggctgagtttctgctgaagcaggatgtcgtgaatgcgatcaacttagacgggggaggaagcgccaccttcgtcctcaatggaacactagcctcttaccctagcgatcactgtcaagataacatgtggcggtgcccccggcaggtatccaccgttgtgtgtgtccacgagccccgatgccagcctcccgattgtcacggtcatgggacctgtgtcgatggacactgtcagtgcacaggccatttttggcggggccccggatgtgacgagcttgactgcgggcctagtaattgctctcagcacgggctttgcaccgagaccggttgccgctgcgatgctggctggactggctcaaattgttccgaagtgaaacaatgtctgcaaccacccgaagcaacccttagggcgggtgagcttagtttctttacccggacggcatggctggccttgacccttgctctcgctttcctgcttctgatctccaccgccgcaaatctgtccctgttgctgtccagggccgaacgtaaccgccgtctgcatggtgattacgcctaccatccactacaggaaatgaacggcgagccccttgccgccgaaaaagaacaacctgggggcgctcataacccctttaaagattag

SEQ ID NO: 125650 - DNA, 2514 bp, Artificial Sequence
  Description of Artificial Sequence: Synthetic coding sequence
atggcggagcccagccaagcgcccaccccggctccagctgcacagccccgacccttgcagtctcccgcccccgcgccgacccccacacccgccccttctcctgcatctgccccaattcctacgccgaccccagcaccagcacctgcccctgccgccgcccccgccggcagtacgggaactgggggcccgggcgtcggcagcggcggcgcaggctccggcggggatcctgctcggcctgggctgagtcagcagcaacgcgcctcacagcggaaagcccaggttaggggtctcccaagagcaaagaagctggaaaaactcggggtgttctctgcatgtaaggcaaatgagacatgcaagtgtaacggctggaagaatcccaagccaccaacggcccctcgcatggatctgcaacagcccgccgcaaatctctccgagctgtgcaggtcctgtgagcaccctcttgctgaccacgtcagccacttagagaatgtcagcgaggatgagatcaaccggcttctcgggatggtagtggacgtcgagaacctctttatgagcgtgcataaagaagaggacaccgacactaagcaggtttacttctacttgtttaagctgctgaggaagtgcattcttcaaatgacacgccctgttgtcgaaggttccctcggaagcccaccttttgaaaagcctaatatcgaacagggagtactcaattttgtccaatataagttcagtcacctcgccccgcgagagaggcagaccatgttcgaactgtctaagatgttcctcctgtgccttaattattggaagctcgaaaccccagcacagtttcggcagcgaagccaggccgaggatgttgcgacatacaaggtgaattatacaaggtggctgtgttattgccacgtgccacagtcttgtgactctctcccgaggtacgaaactacgcatgtgtttggacgttcgttattgagaagcatttttacggtaaccagacgacagctgctggagaagtttcgcgtcgagaaagacaagctcgtgccagagaagaggacgctaatcctaactcacttccctaaatttttgagcatgctggaggaggaaatctacggtgccaacagccctatctgggaatcagggttcactatgcctccatccgaaggtacccagctcgtacccagaccagctagtgtgtccgcggcggtggtgccaagcacacccatcttcagtcccagcatggggggcgggtccaactcctccttgagcctcgactccgccggagctgagccaatgccgggcgagaagaggacactcccagaaaacctgaccctcgaagatgcgaagcggctgcgggtgatgggggacatccccatggagctcgtcaatgaagttatgcttactataactgaccctgccgctatgctgggcccagaaacgagtctactatccgccaatgccgcacgcgatgagacagctcgcctggaagagaggaggggtattattgaattccacgtaatcgggaactccctgacgccgaaggctaacagacgagtactcctgtggctggtggggctccaaaacgtgttctctcaccagttaccccggatgcccaaagagtatattgcccggctggtgttcgacccgaagcataagacactcgctctgataaaggatggcagggttatcggcgggatctgtttccgaatgttccccacccagggatttaccgaaatcgtgttctgcgccgtgaccagtaacgagcaggtaaaaggatacggcacccacctcatgaatcacttaaaggagtaccatatcaagcacaacatcctgtactttctgacctatgctgacgagtacgccattggttactttaaaaagcagggctttagtaaagacattaaggtgcctaagtcacgatatctcgggtacatcaaggactatgagggtgccactctaatggaatgcgagctgaacccccgaatcccctatactgagctgagccacattattaagaaacagaaagagatcatcaaaaagcttattgagagaaaacaggcacagatccgaaaggtgtaccctgggttgtcgtgctttaaagaaggtgttagacagattccggtcgaatcagtgccaggaattagagagaccgggtggaaaccattgggcaaggagaaaggtaaggagttgaaggatcctgaccagctctacacaaccctcaagaacctcctggcccagattaaatcacacccttccgcctggccattcatggagcccgtcaaaaagagcgaagcacccgattactacgaggtgattagattccccatcgacctcaagaccatgaccgagagactgcggtctcggtactacgtgacacgaaagctattcgtggcagacctgcagagagtgatagctaactgtagggaatataatcccccagattccgaatattgtagatgtgcatccgcgctggagaaatttttctacttcaaactcaaagaggggggcctcatagacaagtag

SEQ ID NO: 125651 - DNA, 1260 bp, Artificial Sequence
  Description of Artificial Sequence: Synthetic coding sequence
cctcaatgttgtctgcactcccgagggatgttcccacggctgagtccagttgatacagaggcagtatggctcctccaggggtggctttttcagcaccagccacaattttgggggccagcccagattagagccgtgctgggtgctgtcccaagaggccgactcctcgtgctagatctgtttgctgagtctcagcctgtctatactagaactgcttccttccaaggacagcccttcatctggtgtatgctgcacaactttggtggaaaccatggcctgttcggagcgctcgaggcagtaaacgggggaccagaggctgccaggctgtttcccaactccaccatggtagggacaggaatggcgcccgagggtatcagccagaatgaggtcgtctattccctcatggcagaactcgggtggagaaaagaccccgtgcctgatctggccgcctgggtcacctccttcgctgctcgaaggtacggcgtcagtcatcccgatgctggagccgcctggagactgctgctgcgctccgtgtataattgtagtggcgaagcttgccgcggtcacaacaggagtcctcttgtaagaaggccaagcctgcaaatgaacacaagcatttggtataacagaagtgatgtcttcgaagcctggcgcctcctactgactagtgccccctcgctggcgacatcaccggcctttagatacgacctccttgatctcactagacaagcagttcaggaactcgtgtctctgtactatgaggaggcccgaagcgcttacctgagcaaggagctagcatcgctgctacgcgcaggcggagtccttgcctacgagctgcttcccgcccttgacgaggtgttagcgtccgattcaagattcctgttgggctcctggctggagcaagcgcgcgcagctgccgtgagtgaagcggaggccgacttctatgaacagaattcgcgttaccaactaacattgtggggccccgaagggaacatcctcgactacgctaataaacagctggctgggctcgtggcaaattactataccccacgctggagactgtttctcgaggcattggtggactccgtggcacagggaatcccatttcagcaacatcagtttgacaagaatgtattccagctcgagcaagcatttgtgctatctaagcaaagatacccttcccagccccgaggcgacaccgtggatttggcaaagaagatcttcctgaagtactacccccgctgggtcgcgggaagctggtag

SEQ ID NO: 125652 - DNA, 963 bp, Artificial Sequence
  Description of Artificial Sequence: Synthetic coding sequence
atggctttccctaagaaaaaactgcagggcttagtggcggccacgatcaccccaatgacagagaacggtgagatcaacttttcagtaatcgggcaatatgtggactacttggtcaaggagcagggcgtcaagaatattttcgtaaacggtactactggagaggggctcagcctgtccgtttctgagcgcaggcaggtcgccgaggagtgggtgacaaagggcaaggataagctcgaccaggtaatcatccatgtcggggcgctgagtctgaaagaatcacaggagctggctcagcatgccgccgaaatcggggccgatggtatcgctgtgattgctcccttttttcttaagccatggaccaaagacatcctgataaatttcctgaaagaagtggccgctgccgcacccgctctgcctttctattactaccacataccggcactcactggtgtcaaaatcagagctgaggagctattagacggcatccttgacaagatccctacatttcaggggttgaaattctcggatactgatcttctcgactttggtcagtgtgtcgatcagaataggcagcagcaattcgcattcctctttggggtggacgaacagctactgagcgccctggtaatgggagctacaggcgccgtggggtccacatataactacctgggcaaaaaaaccaatcaaatgcttgaggcatttgaacagaaagacttttcccttgctctgaattatcagttttgtatccagcggttcatcaatttcgttgtcaaactgggttttggtgtgtcacagaccaaagcaatcatgacactcgtgtctggtatccccatgggccccccccggctcccgctacagaaggccagccgcgaatttactgactctgcagaggcgaaattgaagagtctggatttccttagctttacggacctgaaagatggcaacctggaggcggggtcctag

SEQ ID NO: 125653 - DNA, 330 bp, Artificial Sequence
  Description of Artificial Sequence: Synthetic coding sequence
atggcatttccaaaaaagaaactgcagggcttggtggccgcaaccattacgccaatgaccgaaaatggcgagatcaacttctctgttataggacagtacgtggactatttggtaaaggaacagggtgtcaagaatatcttcgttaatgggacaacaggcgagggattgtccctgtcggtttccgaacgccggcaggtggccgaagagtgggtgactaagggaaaagacaagtcaaatcatcacaagctcgggactataagaaccactcagagcagaagatcttcatttaggagacagcttaaagcgtggcacagcggcagccacctctag

SEQ ID NO: 125654 - DNA, 558 bp, Artificial Sequence
  Description of Artificial Sequence: Synthetic coding sequence
atgtcccgggctcccgggattttagcctcatggcgccgtgcaccctctctctccgtgcagaagggttcccagacagcacggcatacttgtcatcccgaggtgcctctggggaactgctttctccccgtctataaagcttccccgctcacggtgacgcgactctgggccgagagactggatcaagttatcattcacgtcggcgcgctatccctcaaggaaagccaggagctggcacaacatgctgcagaaatcggagctgacgggatcgcggttattgctcctttcttcctgaaaccatggaccaaggacatcctcatcaatttcttgaaggaggtggccgcagcggcaccagctttgcccttttattattatcatatcccagctttaacgggtgtaaagataagagcagaagaactgttggacgggattttggacaaaatccctaccttccagggactgaagttttctgacaccgacctgctggatttcggccaatgcgtcgaccagaaccgccagcaacaatttgctttcctgttcggcgtggacgaacacctgtag

SEQ ID NO: 125655 - DNA, 723 bp, Artificial Sequence
  Description of Artificial Sequence: Synthetic coding sequence
atggcgtttccaaaaaagaagttacagggtcttgtggcggcgactatcacaccaatgaccgagaacggcgagatcaatttctccgtgatagggcagtacgtcgactacctggtgaaggagcaaggcgtaaaaaatatctttgtgaatgggacaacaggtgaggggctctctctgtcagtgagtgaacggcggcaagtcgcagaggagtgggtaactaagggcaaagataagcttgatcaagtaatcatacacgtgggtgctctgagtctcaaagagtctcaagagctcgcacaacatgcggcggaaatcggcgccgacggtatcgccgtcatcgcgccctttttcctgaagccctggactaaagatatactgataaatttcctcaaagaggtcgcagctgccgctcccgctctgcctttctactactaccacattcccgccctgactggcgttaaaatcagagcagaggagcttctcgatggaatcctggataaaatcccaacctttcaggggcttaagttcagcgacacggacctcctcgatttcgggcagtgcgtcgatcagaatcgccagcagcagttcgctttcttatttggggtcgatgagttttgtattcagaggttcatcaattttgtagtcaaactcgagaatagtaaactcaaggtttcaaagaaccagcgcactctgcctctgggtaccacgaatttcccttttctccactag

SEQ ID NO: 125656 - DNA, 963 bp, Artificial Sequence
  Description of Artificial Sequence: Synthetic coding sequence
atggcctttcctaaaaaaaagctgcagggactggtggctgctactattacgcccatgaccgaaaatggggagattaatttcagtgtgatcgggcagtacgtggattacttggttaaagagcagggagtcaagaacatctttgtgaacggcaccacaggagaaggcctgagtctgtcagtgagcgagagacgtcaggtggccgaagaatgggtgaccaagggaaaggataagctggaccaggtgatcattcatgtaggcgccctctctcttaaggaatcccaagaactcgcccagcatgcggccgaaattggcgccgacgggatcgctgttatcgccccattcttcctaaagccatggacaaaagatatactcattaactttctgaaggaggtggccgctgctgcaccagccctccccttttattattaccatataccggcactaaccggcgttaaaatcagagccgaagagctgctggacgggattctagataagatccctactttccagggactgaagttttcagataccgaccttttggattttggacagtgcgtcgatcagaatcggcaacagcagttcgcctttcttttcggagtggacgagcagcttctgtccgcactcgtcatgggcgcaactggcgccgtgggatccacttacaattatctgggaaagaagacaaaccagatgctcgaggcttttgaacaaaaggatttctccctggccttgaattatcagttctgcatccagagatttattaatttcgtggttaaactcgggttcggtgtgagccagactaaagccattatgacactggtatccggaatcccaatggggcccccgagactccctctgcagaaagcgtctcgggaatttacagacagcgctgaggctaagttaaagtctctggactttctcagcttcacagacctgaaagacggcaacctagaagcgggaagttag

SEQ ID NO: 125657 - DNA, 906 bp, Artificial Sequence
  Description of Artificial Sequence: Synthetic coding sequence
atgtctcgggcccctgggatcctggcctcatggcggcgcgctccctcactgagcgttcagaaaggcagtcagacagcacgacacacatgtcacccagaggttcccctggggaattgcttcctgcctgtatataaggcctcgcccttgacagtgactagactgtgggcagagcgcctggaccaggtcatcattcacgtgggggccttgtcgttgaaagagagccaggagctggcacagcacgctgccgaaatcggggccgatggaatcgcagtcatcgcaccttttttcctcaagccttggacaaaggatattctcattaactttctcaaagaggttgctgctgccgcgccagccctgcctttttactactatcacattccagcgctgacaggcgtaaaaatcagggctgaagagctgctggacggcattttagacaagatcccaacctttcagggtttaaagttttcagataccgatctgttggactttggtcagtgcgtggaccaaaataggcaacagcagttcgctttcctctttggagttgatgagcagctactgtctgcacttgtgatgggtgctaccggggcggtcggaagcacttacaattatttaggtaaaaaaactaaccagatgctcgaggctttcgagcaaaaggacttttctctcgccctaaactaccagttctgcatccagcgatttatcaacttcgtggtgaagttggggtttggggtgtcccagaccaaagctatcatgaccctcgtgtcgggaatccccatgggtcccccccgcctacctctacaaaaagcctcaagagaatttacagacagtgcggaggcgaaactcaagtctctggactttcttagctttaccgatctgaaggacggtaacctggaggctggaagttag

SEQ ID NO: 125658 - DNA, 723 bp, Artificial Sequence
  Description of Artificial Sequence: Synthetic coding sequence
atggcctttccaaagaagaaacttcaaggcctcgttgcagccactatcaccccaatgacggagaatggcgagattaactttagcgtcattgggcagtatgtggattatctggttaaagagcagggcgttaaaaatatctttgtcaatggcaccacgggggagggcctatccctgtctgtgagtgagcgacgacaggtcgctgaggagtgggtgaccaaaggcaaggacaagcttgaccaggtgatcattcacgtcggagccctgagtctcaaggaatcacaagaactcgcacagcacgccgctgaaatcggcgccgacgggatagccgttatcgctccatttttccttaagccctggaccaaggacattctgattaatttcctcaaggaagtggccgctgccgctccagccctgcccttttactactatcacattcccgctctgaccggagttaagattcgggcggaggagctactggacggaatcctggataagattcctacattccagggactaaagtttagcgacacagatctgctggacttcggacagtgtgtggaccagaatcgacagcagcaatttgcattcctgttcggcgtggatgagttttgcatccagagatttattaacttcgtcgtcaagttagagaacagcaagctgaaagtttcaaaaaaccagcgcactctcccccttggtacaacaaacttcccatttctgcattag

SEQ ID NO: 125659 - DNA, 624 bp, Artificial Sequence
  Description of Artificial Sequence: Synthetic coding sequence
cgagaaggacagaaagggtcacaaacagcccggcacacctgtcaccccgaggtgccactgggtaattgtttccttcccgtctataaggctagcccattgaccgttacgcggctttgggccgaacgcctggaccaggtaatcattcacgtaggcgctctctccctgaaggagtcccaagagctggcccagcacgccgctgagatcggggcagatggcatcgcggtcattgcccctttctttctcaaaccttggacgaaagacatactcattaactttctgaaggaagttgccgccgctgcaccggctctacctttttactattaccacatcccggcactgacaggagtgaaaactactgtggagtgctcgggcgacggtagcaactggtcgtcaggacagttctgcatacagcgctttatcaactttgtggtcaaattgggtttcggtgtcagccagaccaaagctattatgaccctcgtttcaggtatccccatggggcccccgcggctgccactgcagaaagccagccgggaattcaccgattctgcggaggccaagctgaaaagtcttgatttcctgtcctttaccgaccttaaggacggcaacctggaggccggtagctag

SEQ ID NO: 125660 - DNA, 747 bp, Artificial Sequence
  Description of Artificial Sequence: Synthetic coding sequence
atgggattaagccgggtgagggctgttttcttcgacctggacaataccttgattgataccgccggcgccagccgccggggaatgctggaagtgattaagctcctccagagtaagtatcattacaaggaggaggctgaaattatatgtgataaggtgcaagttaagctctctaaagagtgctttcacccctataacacctgtattaccgacttgcgcacatcccactgggaggaggcaattcaagagaccaaaggtggggccgctaatcgaaaattagccgaggagtgttattttctgtggaaatctacccgtctccagcacatgaccctggcagaagatgtcaaggctatgctgaccgagctgaggaaggaagtacgtctcctcctgctgaccaacggggacagacaaactcagagagaaaaaattgaggcttgcgcgtgtcaaagctattttgatgccgtagtggtgggaggggaacagagagaagaaaaaccggccccctccatattttactattgttgcaacctgctgggggtgcaaccaggagactgcgttatggtgggtgacacactcgaaactgatattcagggcgggctgaatgccggcctgaaggctacggtgtggataaacaagaacggcatcgtgcctctgaagtccagtcccgtgccccattacatggtctccagcgtattagagctgcccgctctgctgcaatcaatagactgcaaggtgagcatgtccacgtag

SEQ ID NO: 125661 - DNA, 1515 bp, Artificial Sequence
  Description of Artificial Sequence: Synthetic coding sequence
atggcagcgcaggccctagctctgctgcgcgaggtcgctcgccttgaagctcccctggaggagctgcgtgctctccattctgtcctgcaggcagtgccgctaaacgagttgcgacagcaggccgccgagctgcggctcggtcctctgttctcactcctgaatgagaaccatagagaaaagaccaccctgtgtgtcagtatccttgagagattgctgcaggccatggagcccgtccatgtggccaggaacctccgagtggatctgcagcggggtctcatccatcccgacgacagcgtgaagattctcaccttgtcccaaatagggagaatcgtggagaactccgatgccgtaacggaaattctgaacaatgcggaactgttaaagcagatagtctattgcatcgggggtgagaatctgtctgtggctaaggctgctatcaagagcctgtcaagaatctctctgacccaggcgggactggaggcactgtttgagtccaacctcctggatgatctgaagagcgttatgaaaactaacgatatcgtccgctatcgagtgtatgagctgatcattgagatttctagtgtctctcctgagagcctcaattactgtacaacttcaggcctggttacccagctgttgagggagcttaccggggaagacgtgctggtgcgagctacctgtatcgagatggtgacttccctggcctacactcaccatggcagacagtacctggcgcaggagggagtgatcgaccagatcagcaatattattgtgggagcagacagcgaccctttttctagtttttatctacccgggtttgtgaagttctttggcaacctggctgtgatggacagcccccagcaaatttgtgaaaggtaccctattttcgtggaaaaggtttttgaaatgattgaatcccaggaccctacaatgattggggtagctgtggacacagtaggcatcttaggctcgaatgtggaaggaaaacaggttcttcagaaaaccgggacacggttcgagcgccttcttatgcgcatagggcatcagtccaaaaacgccccggttgaactgaagattagatgtcttgacgctatctcttccttactgtatctgccgccagaacagcagaccgatgatctcttgcggatgacagagagttggttcagtagtctgagtcgagaccctctggagctgtttaggggaatttcatcgcagccattccccgagttacactgcgcggccctcaaggtcttcaccgctatcgccaatcagccgtgggctcagaagttgatgttcaactcaccgggcttcgtggaatacgtggtagatcgatctgtggaacatgacaaggcttccaaggacgctaaatatgagctcgttaaggctctggccaatagcaagactatcgctgagatctttggcaatccaaattacctgcgattacggacctatctcagcgagggaccttactatgtgaagccagtgagtaccacagctgtcgagggcgctgagtag

SEQ ID NO: 125662 - DNA, 423 bp, Artificial Sequence
  Description of Artificial Sequence: Synthetic coding sequence
atggttcttgtgctcgactattcaggacgcccaatggtcatcagctcagggatgcagagtatggatacaatgaaacaagtgtaccaaattgtcaagcctctgaatccgaacttctgtttcctgcagtgtacgtcagcataccccttacaacctgaggatgtgaacctgagagttatcagtgagtatcagaaactgttccccgatattcctatcggttacagtgggcacgagaccgggattgccattagtgtggctgctgtcgcactaggcgctaaggtcctggaaagacacatcacactggataaaacatggaaagggtcagatcactccgcatcactggagccaggggagctcgcagaactggtgcggagcgttcgtcttgtagagcgcgcgctgggatcccccactaagcagttgttatag

SEQ ID NO: 125663 - DNA, 348 bp, Artificial Sequence
  Description of Artificial Sequence: Synthetic coding sequence
gaggatgtgaacctgcgtgtgatatccgaataccagaaactgtttcccgacattcctattggttattccggccacgagaccggaattgccatctccgttgcagcggtggccttaggcgccaaggtgctggaacgtcatatcaccctcgacaagacttggaagggatctgaccattccgcgagtctagaacccggcgagctggcagagctggtgcgaagcgtgaggctggtcgagagggcgctgggctcccccactaagcagctgttgccgtgtgagatggcttgcaatgagaaagtgtgccctgccggactgtacagcgtactcttaccttgcgtcgagaagggatag

SEQ ID NO: 125664 - DNA, 873 bp, Artificial Sequence
  Description of Artificial Sequence: Synthetic coding sequence
atggatattgaggcctaccttgagcggataggctacaagaagtccagaaacaagctggatctcgagacacttactgacattctccagcaccagatacgagcagtgcctttcgagaacctaaacatccactgtggcgacgccatggacctgggcctggaagctatctttgatcaagtggtgagacgcaataggggcggttggtgtctgcaagtaaatcacctgctgtattgggccctcaccaccattggattcgagaccactatgctagggggatatgtgtacagcacccctgctaagaagtactcaaccggcatgattcatcttctgcttcaggttacaattgacggccgaaattatattgtcgatgctggcttcggcaggtcataccagatgtggcagcccttggagctcatatccgggaaggatcagccccaggtgccctgcgtgttcagattgacggaagagaacggcttttggtatctggaccagattaggagagaacagtatattccaaacgaagagtttctccactccgacctgctggaggattcaaagtatagaaaaatctatagctttacacttaagccacgtacaatcgaggattttgagtccatgaatacctacctgcagacctctccatccagcgtcttcacatctaagagcttctgttctctccagacgccagacggcgtccactgtttagttggattcacgctcacacacaggcggttcaattacaaagataacaccgatcttatcgaattcaaaactctgagcgaggaagaaattgaaaaggtgcttaagaatatcttcaatatatcactacagaggaaactggttcctaaacatggtgatcgcttcttcacaatatag

SEQ ID NO: 125665 - DNA, 873 bp, Artificial Sequence
  Description of Artificial Sequence: Synthetic coding sequence
atggatatcgaggcctacctggagcgcataggttacaaaaaaagtcggaacaagttggatctcgagacactgacggacatccttcaacaccagatcagagccgtgccatttgaaaatctcaacattcactgtggtgatgccatggacctaggtctcgaagccatttttgaccaggtggtgaggcgcaaccggggcggctggtgtcttcaggtcaaccacctgttatattgggctctgaccacaattggcttcgaaactactatgttaggcggatacgtttattcgactccagcaaagaaatactccaccgggatgattcatctcctgctccaggtcacaattgacggacgcaactatatcgtggacgctggatttgggcggtcttatcagatgtggcaaccgctggaactgatctccggaaaggaccagccacaggttccatgcgtgtttcgacttaccgaagaaaatggcttttggtacctagaccagatacggcgagaacagtatatccccaacgaagaatttttgcactcggacctgctagaggacagcaagtatagaaagatttatagcttcacattaaaacccagaacgatcgaggatttcgaaagtatgaatacgtacctgcagacttctccctcatcagtctttacaagtaagtccttctgctccctgcagaccccagacggcgtccattgcctggtgggcttcaccttgactcaccgtagatttaattataaggacaacaccgacttgatagaattcaagacactatctgaggaggagatagaaaaggtcctaaaaaatatttttaacatcagtctgcagagaaagctggtccccaaacacggtgaccgtttcttcacaatttag

SEQ ID NO: 125666 - DNA, 873 bp, Artificial Sequence
  Description of Artificial Sequence: Synthetic coding sequence
atggatatcgaggcttacctcgagcgcattggctacaagaagtccaggaataaattagacctggaaactctgactgacattttgcagcaccagatcagggccgttccctttgagaacctgaacatccactgtggagatgcaatggacttgggtcttgaggccatcttcgaccaggtggttaggagaaaccgagggggctggtgccttcaggtcaatcacctcctttactgggccctgaccactatcggcttcgaaaccactatgctcggcggctatgtgtatagcaccccagcgaaaaaatactctacagggatgattcatctcctgcttcaggtgacgatagacggccgcaactacattgtggatgcgggtttcggccgtagttatcagatgtggcagcctctggagcttataagcggaaaagaccagccgcaggtaccctgcgtcttcagactgacagaagagaacggtttttggtatcttgatcagattagaagagaacagtatattcctaatgaagagttcctgcacagcgacttgctcgaggactctaaataccggaagatttattcctttacacttaagcccagaacaatcgaagactttgagtccatgaacacatatctgcaaacctcacccagctcagtttttacaagcaaatcattttgtagtcttcagacccccgacggggtgcactgtctggtaggatttacccttactcaccgacgatttaattacaaagacaacaccgacctcattgagtttaaaacactgtcagaggaagagattgagaaagtgcttaaaaatatttttaacatcagcctgcagagaaagctcgtcccaaaacacggtgataggtttttcaccatttag

SEQ ID NO: 125667 - DNA, 873 bp, Artificial Sequence
  Description of Artificial Sequence: Synthetic coding sequence
atggatattgaggcctaccttgaacggataggttataagaagtctcggaataagcttgacctcgagacactgaccgatatcctgcagcaccagatccgcgcggtgcctttcgagaatctcaatattcactgtggcgacgccatggatctgggcctggaggcaattttcgatcaagttgtgaggcggaaccgaggaggctggtgtctgcaggtcaatcacctattgtactgggcactcaccactattggttttgagactacaatgcttggcggctacgtctacagcacacccgcaaaaaagtacagcacagggatgattcacttactgttgcaagtgaccattgatgggcgcaattatatcgtggacgccggctttggccggagttaccagatgtggcagcctctggagctcatcagcgggaaggaccagccgcaagtaccgtgtgtgttcaggctgactgaggagaatgggttttggtatcttgatcagattagacgagaacagtatatcccaaatgaggaattcctgcactcagacctgcttgaggatagtaaatacagaaaaatttattcgtttacactgaaaccaagaaccatcgaagacttcgaaagcatgaacacatatctccagacatctccctccagtgtctttactagtaagtcgttttgcagcctgcaaactccagatggggtacactgcctggtcggattcactttaacacacaggaggtttaactataaggataacaccgaccttattgagtttaagactctgagcgaggaggagattgaaaaagtgctaaagaatatttttaacatatccctgcagagaaaactggtgccgaagcacggcgataggtttttcaccatttag

SEQ ID NO: 125668 - DNA, 873 bp, Artificial Sequence
  Description of Artificial Sequence: Synthetic coding sequence
atggatattgaagcatacttggaacgtattggctataaaaagtccagaaataaactggacctagagacactgacagacatccttcagcaccagatacgcgcagtgcccttcgagaatctcaacatccattgtggcgatgctatggatctgggcctcgaggccatctttgatcaggtagtaagaagaaaccgaggagggtggtgtttacaggtgaaccatctgttgtattgggccctgaccacaattggcttcgaaaccaccatgttaggcgggtacgtttactccacccctgccaagaaatacagcacaggaatgattcacctgttgctccaggtcactatcgatgggcgcaactatatcgtggatgcgggtttcggccggtcctaccaaatgtggcaacctctggaattgatctctggtaaggaccagccccaggttccctgtgtgttccggctcacagaggagaacggattctggtaccttgaccaaatccgccgggaacagtacatacccaatgaagagtttttacacagcgatctcctggaagatagcaagtatcgaaaaatctattcttttacactgaagcctaggacaattgaagactttgagagtatgaacacctacctgcagacctcaccatcttctgtgttcactagcaaaagcttttgtagtctgcagacacctgatggggtccattgtctggtggggtttactttgactcatcggaggttcaattacaaggacaacacagatctgatcgaatttaaaacactttccgaggaggaaattgaaaaggtgctgaaaaacattttcaacataagtttacagaggaagctggtgccgaaacatggcgaccgattctttaccatctag

SEQ ID NO: 125669 - DNA, 873 bp, Artificial Sequence
  Description of Artificial Sequence: Synthetic coding sequence
atggacatcgaggcctaccttgagcggatcggttataagaagtctaggaataaactggatttggaaacactgactgacattctgcagcaccaaatccgggcagtccccttcgagaatctgaatatacactgtggagatgccatggatttgggactggaagctatcttcgatcaggtggtgcgtcggaaccgggggggctggtgtctgcaggtgaatcaccttctttattgggctcttaccacaatcgggtttgagactacaatgctgggaggctatgtgtactctacccccgctaagaaatatagtacgggaatgatccatttactgctgcaggtgaccatcgatggccgcaattacattgttgatgctggttttggacgttcttatcagatgtggcagccccttgaacttataagcggtaaggaccaaccccaggtgccttgcgtcttccgactgactgaagagaatggcttttggtatctagaccagatccgacgcgagcaatatatcccaaatgaggagttcctccattccgatctgctggaggactcaaagtataggaagatttattcatttactctaaaacccagaacaatcgaggattttgagtccatgaatacttatctgcagacttcaccctcatccgtgttcacatcgaaatcattttgctctctccagacgcccgacggagttcactgcctggtaggattcaccctgactcaccgaagattcaattacaaggacaacaccgatcttattgaattcaaaactctgtcagaggaagaaatagagaaggttctcaagaatatctttaatatatcactgcagcgtaaactcgtacccaaacacggagaccgatttttcactatctag

SEQ ID NO: 125670 - DNA, 873 bp, Artificial Sequence
  Description of Artificial Sequence: Synthetic coding sequence
atggacatagaggcctatctggagagaatcgggtataagaaatccagaaacaaactggatttggagacactgacggatatcctgcagcaccagatcagggcagtgccattcgaaaacctcaatatccactgtggcgatgccatggatctcggtctagaggctatattcgatcaagtagttcggaggaatcgcggcggatggtgtctccaggtgaaccacttgctctactgggccttaaccaccatcgggttcgagaccaccatgttgggcgggtatgtgtatagcacccccgcaaaaaaatattcaactggcatgatccatctccttctgcaggtcactatcgacggaagaaactatatcgtggatgctggcttcgggaggtcctaccagatgtggcagcccctcgagctcatttctggcaaagaccaaccgcaggtaccatgtgtctttaggctgactgaggagaacgggttttggtacctggatcagatccggagagaacagtatattccaaacgaagaattcctgcactctgacctgttagaggactccaaatacagaaagatttatagctttaccttgaaacccagaacaatcgaggattttgagtctatgaatacctacctgcaaacatctccgtccagcgtgttcacaagcaaatctttttgtagcctgcagacacctgacggcgtgcattgccttgttggctttacccttacacatcgtcgcttcaactataaggacaatacagacctgatcgagttcaagaccttgtccgaggaggagatcgagaaagtcctcaagaacatatttaatattagtctccagcgcaaactggttcccaagcatggggatcgctttttcacaatatag

SEQ ID NO: 125671 - DNA, 1059 bp, Artificial Sequence
  Description of Artificial Sequence: Synthetic coding sequence
atgctcctgctcctcctgcacaaggaggccgcccttgagccccagggtccagcggtcgggtacaacagcctcccggtaagcgacgatcaccatgtgagcggaatccaggcccgaaaaaaacaacaaagcgttttctggattaagacagaggaccaacccacgttcaatcttctgcgtaagggaattatggatattgaagcttacctcgagaggatcgggtataagaaatccaggaacaaactagacctggagacccttactgacattctccagcatcagatcagagccgttccctttgaaaacttgaatatccactgtggcgatgcaatggacctcggcctcgaggccatctttgatcaggtcgtaaggcgaaacagaggtgggtggtgcctgcaggtcaaccacttactgtattgggccttaacaaccatcggtttcgagacaaccatgttaggcggctacgtgtacagtacccctgccaagaagtattcaaccggtatgatccatctgcttttgcaggtcacaatcgacgggaggaattacattgttgacgctgggttcggacgatcttaccagatgtggcagccactggaactcatcagcggaaaagatcaaccacaggtgccgtgcgtgtttagattgacagaagagaacggattttggtatctggaccagatccggcgagaacaatacatcccaaacgaggagttcctgcatagcgacttgctggaagattctaagtatcgtaaaatctacagctttactctgaaaccacggaccatcgaagactttgagtccatgaacacatacttgcagacaagcccgtccagtgtctttacttctaagagcttctgctcactgcaaacacccgacggcgttcactgcttggtggggtttacactcacccaccggagatttaactacaaggataacacagacttaattgaattcaagacactgagtgaggaggagatcgagaaggttctgaaaaatatcttcaacataagtctgcagcgaaagcttgtgccaaaacatggggatcgatttttcactatttag

SEQ ID NO: 125672 - DNA, 873 bp, Artificial Sequence
  Description of Artificial Sequence: Synthetic coding sequence
atggacatagaagcatactttgagaggataggctacaagaatagccgtaataaattagatctggaaaccctaacggacattctggagcaccagattcgcgctgtgcctttcgagaatttaaacatgcactgtggccaggccatggaactggggttagaggccatcttcgaccatatcgtgcgacggaaccgcggaggctggtgcctgcaggttaaccaacttctatactgggcactgacgaccatcgggttccaaacgacaatgcttggaggatatttctatatcccaccagtgaataagtactcaacaggcatggtgcatctactgttgcaggttaccatcgacggtagaaattacatcgttgatgcagggtccggaagttcctctcagatgtggcagccacttgagctaattagcgggaaggatcagccgcaggttccttgtatcttctgtttaactgaagaaaggggcatatggtaccttgaccagatacgccgagagcagtacattaccaataaggaatttctgaacagtcacctactcccaaaaaaaaagcatcagaagatctacctatttactctcgagcccaggacgattgaagatttcgagtcgatgaatacttacttacagacgtctccaacaagctcgttcattactaccagcttctgcagcttacagacaccagaaggagtatattgcttagtgggattcatcctgacatacagaaagttcaattataaagacaatacagatctggttgaattcaaaacactgactgaggaggaagtggaagaggtcttaaggaacatatttaaaatctccctgggcagaaacctggtccccaaaccgggcgacggaagtctgactatctag

SEQ ID NO: 125673 - DNA, 684 bp, Artificial Sequence
  Description of Artificial Sequence: Synthetic coding sequence
atggccccgtgtcacatacggaaatatcaagaatccgatagacagtgggtggtggggctgctgagccgcggaatggccgaacacgcgcccgccacttttcggcaactcctgaagttaccaaggacactcattctgctgctaggggggccactcgcgctgctgctagtgtccggctcctggcttctcgcacttgtcttcagtatatcgctgttcccagccctatggtttctggctaagaaaccttggaccgaatacgtggacatgaccctgtgtacagacatgagcgacattaccaagtcttaccttagcgagagggggtcatgcttctgggtggccgagtctgaggagaaagtggtggggatggttggggccctgccagtcgatgatccaacacttcgcgaaaaacgtctgcagctctttcacctgtttgtcgactctgaacataggagacagggaatcgcgaaggcactcgtccgaactgtcctgcagtttgctcgagaccagggctacagcgaggtaattctggatactggaaccattcagctgtccgcaatggcactttaccaaagcatgggatttaaaaagactgggcagagtttcttttgtgtgtgggcacggttagtcgcactgcacaccgtccacttcatttaccaccttcccagttccaaagttggatctctgtag

SEQ ID NO: 125674 - DNA, 405 bp, Artificial Sequence
  Description of Artificial Sequence: Synthetic coding sequence
atggcggatattgagcagtattatatgaaacctccggggtcgtgcttttgggtcgccgtgctggacggaaacgtggtaggaatagttgcagccagggcccacgaagaagacaataccgtcgaactgctgagaatgagcgtggatagccggttccggggaaagggcatcgcaaaggctttaggaaggaaggtgctcgagtttgcggtcgtccacaactatagcgctgtggttttggggactaccgcggttaaagttgccgcacataaactgtacgagtcccttggcttccgccacatgggggcctctgaccattacgtcttgcccgggatgactctgtcactcgcagaacgtctgttctttcaggttaggtaccacagatataggctgcagctcagagaggagtag

SEQ ID NO: 125675 - DNA, 909 bp, Artificial Sequence
  Description of Artificial Sequence: Synthetic coding sequence
atgcattgtggtcccccagatatggtctgcgaaaccaaaatcgtggcagccgaagaccacgaagcgttacccggcgccaaaaaagacgccctgctagcagccgccggagccatgtggccacccctgcccgccgcaccagggcctgcagccgccccgcccgcacctccacccgcacccgtggcacagcctcacggcggagccggtggcgcggggcctccaggcgggaggggtgtgtgcatacgcgaatttcgcgcagccgaacaggaggcagcccgccggatattttatgacggaattatggaaagaatcccaaatacagcctttcgggggctgcgccagcacccccgagctcagctgctgtatgcattgctggccgcgttgtgttttgctgttagtagatcacttctgctgacgtgtctggttccagccgctcttctgggtctgcgatattactactctaggaaggttattcgggcgtatctggagtgcgcactacacacggacatggccgatatagagcagtattacatgaaacccccggggtcctgcttctgggtggctgtcctcgatggtaacgtcgtgggcatagtggccgcgagagctcatgaggaggacaatacggtcgagcttctgaggatgagcgtcgatagcagatttcgcggtaaggggattgccaaagctcttggccgcaaagtgctggaatttgccgtggtacataactattctgccgtcgtgctggggacaactgccgtgaaagtcgcagcccataaactctatgagtccctcggcttccggcacatgggcgctagcgatcactacgttctccccggaatgactctgtccctcgctgaacgtcttttctttcaggttcgctatcaccgttaccggttgcaacttagggaagaatag

SEQ ID NO: 125676 - DNA, 1182 bp, Artificial Sequence
  Description of Artificial Sequence: Synthetic coding sequence
atggacgaaaatgagtccaatcagagcctgatgacctcttcccaataccccaaggaagctgtgcggaaacgccagaactcagcacggaatagcggcgcgtccgactcatcgcgcttttctaggaaatcttttaagctcgactaccgactggaagaggacgttacaaagtcaaaaaaaggcaaagatggacgctttgtaaatccctggcctacctggaaaaatccctctatccccaatgtcttgaggtggctcattatggaaaaggaccactctagcgtaccttcgtccaaggaagagctggataaggaacttcctgtgctcaagccttacttcattaccaatcccgaggaggccggagtacgcgaggctggcttaagagtgacctggctcggtcatgccaccgtgatggtggagatggacgagttgatcttcctaaccgaccctatcttttccagcagagcttccccatcccagtacatgggtcccaagcggttccgtcgcagcccttgcacaatctcagaactccctcctattgatgccgtgctgatctctcacaatcattacgatcacctggattataattcagtgatagcactgaacgaacgcttcggcaacgaactaagatggttcgtaccactggggctgctggattggatgcagaaatgcggctgcgaaaatgttattgaactggattggtgggaggaaaactgcgtccccggacatgacaaggtgacctttgtttttacaccatcccagcattggtgcaagaggaccctcatggacgacaataaagtcctgtggggatcctggagcgttctcggtccttggaatcggttcttttttgctggagacactggttactgtccagcctttgaggagattgggaaacggttcggcccatttgatctggcagccatccccattggggcatacgagccaaggtggttcatgaagtaccagcacgtagatcccgaagaggccgtacggattcatacagacgtgcagactaagaaaagtatggcgatccattggggtacattcgccctggcaaacgagcattacctcgagccaccagttaaattgaatgaagcgctggaacgatacggtctgaacgcagaggatttctttgtgctgaagcacggggaaagccgctatctgaacaacgacgacgagaatttctag

SEQ ID NO: 125677 - DNA, 375 bp, Artificial Sequence
  Description of Artificial Sequence: Synthetic coding sequence
atggatgagaacgagtctaaccaaagcctcatgaccagtagccagtaccctaaggaggccgttcggaaaaggcagaattccgctcgaaattccggcgccagcgattcctccaggttttcccgtaagagtttcaagctggactatagactggaagaggatgttactaaaagtaaaaagggaaaagatggccggtttgtgaatccgtggcctacatggaagaacccatcaattcccaatgtcttacggtggctcattatggagaaggatcactcaagcgtcccatcctcaaaagaggagttagataaggagttgcccgtgctcaagccctattttataacgaaccccgaagaagccggcgtgcgcgaggccggctag

SEQ ID NO: 125678 - DNA, 1182 bp, Artificial Sequence
  Description of Artificial Sequence: Synthetic coding sequence
atggacgagaacgaatccaaccaatctctgatgacaagctctcagtatcccaaagaagccgttagaaagcggcagaactcagcccggaactccggcgccagtgactcttccagattcagtcggaagagcttcaagctcgactatcgactggaagaggatgtaactaaaagcaagaagggcaaggacggccgcttcgtaaacccttggcctacttggaaaaacccttcgattcccaatgttctgcggtggctgatcatggagaaagatcattctagtgtgccttcctcgaaggaggagctggataaggaattgccagtgttaaagccgtacttcatcaccaatcctgaggaagctggtgtccgggaggctgggttgcgcgtcacatggttgggacacgctaccgtcatggttgaaatggatgagctcatcttcctgactgaccctatctttagctcccgcgcctctccatctcagtatatgggccctaaaaggtttagaagaagcccctgcactatttctgagttgcctccgatcgacgcagtccttatcagccacaatcactacgaccacctggattacaattcggtgatcgctctgaacgaaaggtttgggaatgaactaaggtggtttgttccactggggcttttggactggatgcaaaagtgtgggtgtgagaacgtcattgaactagactggtgggaagagaactgtgtgcctggacatgacaaggtgacatttgtgtttactccttctcaacactggtgcaaacggacactgatggacgataacaaggtgctgtggggctcctggagtgtactgggcccctggaaccgcttcttcttcgccggcgacactgggtactgtcctgcatttgaggaaatcggcaagaggttcgggccattcgacctggctgctattccaattggcgcctatgagcctcgttggtttatgaagtatcagcacgtagatcccgaagaagctgtgcgtattcatactgatgttcagaccaaaaagagcatggccatacattggggtacatttgctctggcaaatgagcattatctagagccccctgtgaaactgaacgaagccctcgagcggtatgggctgaatgctgaagacttctttgtgctgaaacatggcgaatccagatacctgaacaatgacgacgaaaatttctag

SEQ ID NO: 125679 - DNA, 18 bp, Artificial Sequence
  Description of Artificial Sequence: Synthetic coding sequence
atggatgagaatgaatag

SEQ ID NO: 125680 - DNA, 1182 bp, Artificial Sequence
  Description of Artificial Sequence: Synthetic coding sequence
atggatgaaaacgagtccaaccaatccctcatgacatccagccaatacccaaaggaagctgtccgaaagcggcaaaactcagctaggaactccggagccagcgacagcagtcggttctccaggaagtcgtttaagctagactacaggctagaagaggacgtgaccaagtcaaaaaaagggaaggacggacgattcgttaacccttggcccacatggaaaaacccatctattcccaatgtcctccgttggctgatcatggaaaaggatcactcttcggttccgtcgagtaaggaggaactggacaaggagcttcctgtgcttaagccctattttatcacgaaccctgaagaagccggagtgagggaggccgggctgagagttacgtggttgggacatgcaacagtgatggtcgaaatggacgagctgatcttcttgaccgatcctatcttttcatctcgggcctcaccatctcagtacatgggtccaaagagatttagaagaagtccctgtaccataagcgagctcccgccaattgacgccgtgttgatcagtcacaatcactacgaccacttagactataacagtgttattgctctgaatgaacggttcgggaatgagcttcggtggtttgtaccactgggcctactagattggatgcagaagtgcgggtgcgaaaatgtgatagagctagactggtgggaagagaattgcgttcccgggcacgacaaggtcacatttgtattcactccttctcagcactggtgcaagcggaccctgatggacgataataaggtgctgtgggggagttggtctgtgctgggcccatggaacagatttttttttgccggagatacaggatattgcccagcctttgaagagattggcaaacgcttcggcccctttgacttggccgcaatccccataggcgcctacgagccccgctggttcatgaagtatcagcacgtggatccagaggaggccgtgcgaatacacaccgacgttcagactaaaaagagcatggccatacactgggggacttttgcactggcaaacgagcattatctggagcctcctgtgaaacttaacgaagcactggaaagatacggcctcaacgcagaggacttttttgtattgaaacacggcgaaagcaggtatctgaacaacgacgacgaaaacttttag

SEQ ID NO: 125681 - DNA, 1401 bp, Artificial Sequence
  Description of Artificial Sequence: Synthetic coding sequence
atggccagacgccgcgagctgaagagatgtctgcaacttctggcgagcagcgccgagcccgctagacgggcacgcgtccgcaagaacccatccgcatgcaggggacgcccctcgcgatacgctgccgcattatgcgcgggaactctgtggcctgaggccgcagagctgcgccgtcgtgccttaccagcaactccaagcgcgtcttcaagcccaaaagatatggacgagaatgagtcaaaccagagcctgatgacctcatcccaataccctaaagaggcagtgagaaagcgccagaatagcgcaagaaactcaggtgcctcagattcttctcgattttctagaaaatccttcaaactcgactatcgactggaggaggacgtgaccaaatccaaaaagggcaaagatgggcggttcgtcaatccttggcctacatggaagaatccaagcattccgaatgtgttgaggtggctgatcatggagaaagatcattctagtgtgccaagctctaaggaagagctggacaaggagctccccgtgctgaagccctatttcatcaccaatccagaggaggctggcgtcagagaggccggcctgagagtgacctggcttggacatgccaccgtgatggtcgagatggatgagcttattttcctcaccgacccaatctttagctctagagcctctcccagtcaatatatgggcccgaagcggtttagaagatctccctgcacaataagcgagctcccgcctatcgacgctgtcctgatctctcataatcactatgaccacctggactacaacagtgtcatcgccctgaacgagcggttcggtaatgaactgaggtggttcgtgcccttaggcctgctggattggatgcagaaatgtggttgcgaaaatgtgatcgagttggattggtgggaggagaattgtgtccccggccatgacaaggtaactttcgtgttcacacctagtcaacactggtgtaaaaggaccctgatggatgataataaagtgctgtgggggtcatggtctgtgctgggtccctggaatcgtttctttttcgctggcgataccggctattgccccgcatttgaggagataggtaagcgattcggaccatttgatctggcagctattccaatcggggcatatgagccaaggtggttcatgaagtaccagcacgtggaccccgaagaggcagtccgcatccatacagatgttcagaccaagaagtccatggcaatccactggggcaccttcgccctcgcgaacgaacattacctcgaaccccctgttaaattgaatgaggctctagagcgatatggtcttaacgcagaagacttcttcgtgcttaaacatggcgagtctcgctatctcaataatgatgacgagaacttctag

SEQ ID NO: 125682 - DNA, 1182 bp, Artificial Sequence
  Description of Artificial Sequence: Synthetic coding sequence
atggacgaaaacgagtccaaccagagcctcatgacaagtagccagtacccaaaggaagcggtccgcaagagacagaactcagcgcggaacagtggtgccagtgattctagtaggtttagccgtaagtcatttaaactggattataggctggaagaggatgtcaccaagagtaaaaaagggaaagatggcagattcgtcaacccttggcccacttggaagaacccatctattcccaatgtcctgcgttggctaattatggagaaagaccatagcagcgtaccctctagcaaggaagagctcgacaaagagctgcccgtcctaaaaccctacttcattacaaaccccgaggaagccggcgtaagagaagcgggcttaagagtgacttggctcggtcacgccaccgtgatggttgagatggatgagttgatctttctgacagatcctatcttttcctccagagcaagtcccagccagtacatgggcccaaagaggtttcgacggagcccctgtaccatatctgagctaccccccatcgacgctgttttgataagccataatcattacgaccacctcgactacaacagtgtgatagccctgaatgagagatttgggaatgagctgcgatggttcgtgcctctgggcttgttagactggatgcaaaagtgtggatgtgaaaacgttatcgagctcgattggtgggaggaaaattgtgtccccgggcatgataaagtgacctttgtcttcaccccaagtcagcactggtgtaaacgcactctcatggacgataataaagtgctgtggggatcctggagcgtgctgggcccatggaataggttcttcttcgctggcgacacaggttattgccctgcattcgaggaaattggcaaacgcttcggtcccttcgacttggcggctattcctatcggcgcctacgagccacgttggttcatgaagtatcagcacgtagacccagaagaagcggtgagaatccacaccgatgtccagacaaagaagtcaatggctatccactggggaacattcgcactggcgaacgaacactacctcgaaccaccagtgaagctcaatgaagccctggagagatacgggctgaacgccgaggacttttttgtgctgaagcacggagaaagccgctacctgaataatgacgatgagaacttctag

SEQ ID NO: 125683 - DNA, 2199 bp, Artificial Sequence
  Description of Artificial Sequence: Synthetic coding sequence
atggagaggcaagtactgctcagcgaaccggaggaggcagccgccctgtataggggcttgtcacgacagccagcactttccgccgcatgtttaggtcctgaagtcaccacgcagtacgggggccagtatcggacggtccacaccgagtggacacaacgagatctggaaaggatggaaaatatcagattctgccgacagtatttagtgttccacgatggggactcagtagtgtttgccggacctgccgggaactcggtggaaacccgtggcgagttgctgagcagagagagcccttcaggcacaatgaaagctgtcctgaggaaggctggtggtaccggacctggggaggagaagcagtttctcgaagtgtgggagaagaatagaaagttgaagagcttcaatttatctgctctcgagaaacacggcccagtttatgaggacgattgttttggatgcctgagctggagtcactccgagacgcacctgctctacgtggccgagaaaaagcgcccgaaggcggaatcgttcttccagactaaagcgctcgacgtgagtgctagtgacgacgagatcgcccggctgaaaaaaccagaccaagctatcaaaggagaccagtttgttttttatgaggattggggcgagaacatggtctctaaatcaatacctgtgttatgcgtcctggatgtggagtccggcaacatatcagtactcgagggcgttcctgagaacgtctcccctgggcaggccttttgggcaccgggtgacgcgggagtagtgtttgtgggatggtggcatgaaccatttcgtcttgggatccggttctgcacaaacagaaggtcagccctctactatgttgacctcattgggggcaagtgcgaacttctgagtgatgacagcctggctgtgtcctctccacggctctcccccgatcagtgtcggatcgtctacctgcaatatccaagcctcataccacaccaccagtgctcacagctgtgtctatacgactggtacactaaggtgacctccgtcgttgttgacgtggtgccacggcaactcggcgagaatttcagcgggatttattgcagcctgctgccgctggggtgttggtctgcagatagccagcgggttgtttttgattcagcccaacgaagccgccaggacctattcgctgttgatacacaggttggtacagttacttccttaactgcaggagggagcgggggtagttggaagctgctgaccatcgatcaggacctcatggtcgcgcaatttagcaccccctctctgcctcctacgttaaaggtgggcttcctcccttctgcaggcaaggaacagtccgttttatgggtgtctctcgaagaggccgagcccatccctgacattcactggggcatcagggtgctccagccaccacctgagcaggaaaacgtgcaatatgccggcttggattttgaagctatcctcttacagcccggatctcctcctgataaaacccaggtgcccatggtggttatgccacacggaggcccccactcttcttttgtaaccgcgtggatgctgtttcctgcgatgttgtgcaagatgggattcgccgtattgctggtgaactacagaggtagcactggttttggtcaggactcgatcctgtctctcccaggtaatgtgggccatcaggatgttaaagatgtccagtttgctgtagagcaggtgctgcaggaagagcactttgatgcctctcacgtggctctgatgggcggaagccacggaggcttcataagttgtcacctcattggtcagtatccagagacctaccgtgcatgcgttgcgaggaaccctgtgatcaacatcgcatccatgctcggctctaccgacatcccagactggtgcgtcgttgaggctgggttcccgttttcgtccgattgcttgcctgacttgtctgtatgggccgaaatgctggacaagtcacctatcaggtatatcccccaggttaaaactcccctgctgttgatgctgggtcaggaggatcgcagggtgccttttaagcaaggcatggagtattatcgggcacttaaaacgcgtaacgttcctgtgaggcttctgctgtatccaaagtcaacccacgctctttcagaagttgaagtcgaatcggattcctttatgaatgccgtgttatggctgcgaactcacttggggtcgtag

SEQ ID NO: 125684 - DNA, 1833 bp, Artificial Sequence
  Description of Artificial Sequence: Synthetic coding sequence
gtactgaatcgcctacagtcgaaatacggatctctgtatcggcgcgataatgtgatattgtccggtacacatacacactcaggacctgccggatatttccagtacacagtcttcgtcatcgcttccgaaggcttttcaaatcaaaccttccagcacatggtgacagggattctcaagtccatagacatcgcccacaccaacatgaagcccggcaaaatcttcattaataaaggcaatgtggacggcgtgcaaattaaccgtagcccttatagttatttgcagaatccacaaagtgaaagggcgagatactctagcaacactgacaaggagatgatcgtcctgaagatggttgacttgaacggggacgatttgggccttatcagttggtttgcaatccacccggttagtatgaataattctaatcacctcgtaaactctgacaacgtggggtacgcgtcctatctcctggagcaggaaaaaaataaggggtacttgcctggtcagggccctttcgtggccgcctttagctctagtaatctcggtgacgtcagtccaaacatcctcggccccagatgcattaatacgggagaatcgtgtgataacgccaacagcacctgccctataggtgggcctagcatgtgcattgccaaggggcccgggcaggacatgtttgatagtacacagatcattggccgggctatgtaccagagagccaaagaattgtacgctagcgctagtcaagaggtgacagggcctctcgcgtccgcacaccagtgggtggacatgaccgatgtgacagtgtggctcaacagtacccacgcatcaaagacatgcaaaccggccttggggtactccttcgccgccggcaccattgacggcgtcggcggtttgaattttactcagggcaaaactgaaggcgaccccttctgggatacgattcgggatcagatcctgggtaaaccttccgaggagattaaggaatgtcataagccgaagcccatcctcctgcacaccggcgaattgtccaaacctcacccctggcaccctgatatcgttgacgtacagatcatcacgctggggagtttggctatcaccgcgattccaggcgaattcactactatgtcaggaagacgactgagagaggccgtgcaagccgagtttgccagccatggcatgcagaatatgacagtcgtaatcagcggactatgtaacgtgtatacccattacatcaccacatacgaagagtatcaggcccagcgctatgaggccgccagtacgatttacgggccgcacaccctgagcgcctatatccagttgtttcggaacttagccaaagcgatcgcaactgatacagtggcgaatctgagtagaggccccgagccccccttcttcaaacagttaattgtccccttgataccttccatcgttgatcgcgcccctaagggacgaacatttggcgacgtgctccaacccgcaaagcctgagtaccgagtaggagaagttgccgaagtaatcttcgtcggtgccaatcccaagaattcagtgcagaaccagaatcaccagacctttctgaccgtggagaagtacgaggctacctccacctcgtggcagatcgtgtgcaatgatgcgtcttgggagaccaggttttactggcacaagggactgcttggcctgtccaacgccactgtagaatggcacatccctgacacagcacagcctggcatctacaggatccggtacttcgggcacaaccgcaagcaagacatactaaagcccgccgttattctgtccttcgaaggaacaagccctgccttcgaagtggttaccatatag

SEQ ID NO: 125685 - DNA, 1869 bp, Artificial Sequence
  Description of Artificial Sequence: Synthetic coding sequence
atggactcagagaagtcctccgagtggcgctccgacgttctaaatcgattgcagtccaaatacggaagcctctaccgtcgagacaacgttattctgagcggcacgcatacccactctggcccggccggttactttcagtacacggtatttgtcattgcctctgagggcttttccaaccaaacatttcagcacatggttacagggattctcaagagcatcgacattgcgcatacgaacatgaagcctggaaaaatttttataaataagggcaatgttgacggggtacagatcaaccgcagcccatactcgtacttgcagaaccctcagtctgaaagggctagatactcctcaaataccgacaaggaaatgatcgtgttgaagatggtagatttaaatggggatgatcttggcctgatttcatggttcgcaattcaccctgtgtctatgaataacagcaaccacctggtgaattctgacaatgtagggtatgcatcatatctgctggaacaggaaaagaataaaggttaccttcctggccaaggaccatttgttgccgcattctcaagcagtaacttgggggacgtgtcacctaacatcctgggccccagatgtatcaacacaggtgagtcttgtgacaacgcaaacagcacttgtcccatcggaggtccttctatgtgcatcgccaagggcccaggccaggatatgttcgacagtacacagatcatcggccgggcaatgtatcagagggctaaggaactctatgcttccgccagccaagaggtgaccggacctcttgcgagcgcacaccaatgggtggacatgacagatgttactgtttggctgaactccacccatgctagcaaaacatgcaagccagcactcggctactcattcgcggccggtaccattgacggcgtcggcggattaaattttacccaggggaagacggagggggacccattttgggataccatcagggaccagatactaggaaagcccagtgaagagatcaaggagtgtcataagccaaagcctatcttgttacataccggcgaactgtctaagccacacccctggcatcctgacatagttgatgttcaaattatcactttaggatcattggcaataactgccatcccaggtgagttcaccacaatgagcggaaggcgcctcagagaagccgtgcaggctgaattcgcctcacacggaatgcagaacatgactgtggtgatttcgggtttgtgcaatgtctatacgcactatatcaccacctacgaggagtaccaggcccagagatacgaggccgctagtactatatacggtccacacaccttatccgcttacatccaactcttccgaaacttggccaaagctattgccacagatactgtggctaatctgtcgcgtggaccagagccacctttctttaaacagctgattgtgccgcttatccctagcatcgtggaccgagcccctaaaggtaggacgttcggagatgttctccagcctgctaagcccgaataccgggtgggagaggtggcagaagtcatcttcgtcggtgctaatcccaagaactcagtgcagaaccagaaccaccagacctttcttactgtcgaaaaatatgaagccacctctacctcctggcagatcgtatgcaatgatgcctcatgggagacccggttctactggcataaaggattattgggactgtctaatgccaccgtggaatggcacatacctgacaccgcccaacccggaatctaccgcatccggtattttggccataatcgtaagcaggacattctaaagcctgccgtcatcttaagttttgaggggacatctccagctttcgaggtggtgacaatatag

SEQ ID NO: 125686 - DNA, 1341 bp, Artificial Sequence
  Description of Artificial Sequence: Synthetic coding sequence
atggagatggaacaagaaaaaatgactatgaacaaggagttgtctcctgacgcagcagcctactgctgttctgcttgccacggggacgaaacatggtcttataatcatcccataagggggagagcaaagtcccggtcactgagtgcttcccctgcgttgggcagcacaaaagaatttagacggactagaagccttcacggcccgtgtccagtgaccactttcgggcctaaggcctgtgtcctccagaacccacagactatcatgcacatccaggaccctgcctcacagcggttgacctggaacaagtcgccaaaaagcgttcttgttataaaaaagatgcgggacgcttccttattacagccatttaaagagctttgcacacacctgatggaggaaaatatgatcgtatacgtagagaaaaaagtactcgaagaccccgccatcgcaagcgatgaatctttcggcgccgtcaagaagaaattttgtaccttccgagaagattacgatgacatctccaatcagattgattttataatctgcctgggtggtgacggcacccttctgtatgcttcctctctgttccagggcagtgtgccaccggttatggcttttcacctggggtcactgggctttttaaccccttttagtttcgagaactttcagtcacaagttacacaggtgattgagggtaatgcggccgtcgtcctcagatcgcgccttaaggtgcgcgtggtcaaggaacttagaggcaaaaagacagctgttcataatggccttggggaaaatggcagccaggctgcgggtctcgatatggatgtcggcaaacaggccatgcagtaccaggtcctgaacgaagtggtaatcgatcgtgggccctcttcttacctcagcaatgttgacgtatatctagatggccatctgatcaccactgtgcagggggacggagtgatcgtctcaaccccaactgggagcaccgcctatgctgccgctgcaggcgcatccatgatccaccctaacgtgccagccatcatgatcacacccatttgtcctcatagcttatcttttcggcctattgtcgttcccgcaggggtagaactgaaaattatgttgtcccctgaggctcgaaatactgcctgggtgagcttcgatggtcgaaagcgtcaggagattcggcacggtgactcaatcagtatcacaacctcctgctaccctcttccctcgatatgcgtgcgcgaccccgtttcagactggttcgagagcctggcccaatgtctgcattggaatgtgcgcaagaaacaggctcacttcgaggaggaggaggaggaagaagaagaagggtag

SEQ ID NO: 125687 - DNA, 1341 bp, Artificial Sequence
  Description of Artificial Sequence: Synthetic coding sequence
atggaaatggagcaagagaagatgaccatgaataaagagctgtccccagacgcagctgcgtattgctgcagtgcttgccacggcgacgaaacatggtcatacaaccacccaattcgcggcagagccaaaagtagaagcctgtcagcctccccagctctcggctcaactaaggaatttcggcgtaccagatcccttcacggaccctgtcctgtcacaacttttgggccaaaagcatgtgtgctccagaatccacagactattatgcacatccaggaccctgcgagccagaggctaacctggaacaaatccccaaaatcagttctggtcatcaagaagatgagggatgcatccctgttgcaaccctttaaggagttatgtacccaccttatggaggagaatatgatcgtgtatgtcgaaaagaaagtgctggaagaccctgccatcgcaagtgatgagtccttcggggctgtgaagaaaaagttttgcacatttagagaggattatgacgatatcagtaatcagatcgactttataatctgtctaggcggtgatggcaccctgctatacgcctcctctctctttcaagggtccgtacctcctgtgatggctttccacctcggatcactgggatttttgactcctttcagctttgaaaactttcaatcacaagtcacacaagttatcgaagggaatgccgccgtggtacttagatcacgactcaaggtgagagttgtgaaggagctcaggggcaagaaaactgctgtgcataacgggcttggggagaatggatcacaggccgcaggtctcgacatggatgtcggcaagcaggccatgcagtatcaggtcctaaacgaagtcgtcattgatcggggacctagctcctatctgagcaacgtggacgtttatctggacgggcatttgatcactaccgtgcaaggggacggagtaatcgtgtcaacacccacaggatccactgcctacgccgcagctgccggcgccagtatgattcacccgaatgtaccagctattatgattacacccatatgtcctcactccctgtcattcagaccaatcgtcgtgccggcaggggtggagctgaagattatgttgtctcccgaagctcggaatactgcctgggtatcatttgatggtcggaagcgccaggaaattcgccacggggacagcatctcaatcacgacctcttgttatccgctgccatccatttgtgttagggatcccgtgagtgattggtttgagtctctggcgcaatgtctgcattggaacgttcgcaagaaacaggcccacttcgaggaggaggaggaagaagaggaggaaggttag

SEQ ID NO: 125688 - DNA, 1245 bp, Artificial Sequence
  Description of Artificial Sequence: Synthetic coding sequence
atgggtcgcccacgagtgaggcaggcttggcccggctgctgcggacacactggtcgcttgcccgctggtagaggttatttagcaagccacatgtgcgaccctgccggcgccgaactcattggagacgggatgtccgaccctactcccccttctaacgcttgcaccgggcacattcaagaccctgcctcacagaggctcacctggaacaagagtcctaaaagcgttctagtgatcaaaaaaatgcgggacgcgagtcttctgcagcctttcaaagagctgtgcacacatttgatggaggagaatatgatagtatatgtggaaaagaaagtgcttgaggatccagcaatcgctagtgacgagtcatttggcgcggtgaagaaaaagttctgtacctttcgggaggactacgatgacatttctaaccaaatcgactttataatatgtttaggaggcgatggaaccttgctctacgctagttccctgtttcagggaagcgtgccccccgtgatggcttttcacctcggaagtctcggttttcttacaccgttctcattcgagaattttcagtcacaggttacccaggtgatcgaaggcaatgcagcagtggtcttgcgtagccgtttgaaggtcagggtggtgaaggagctgcgggggaagaagacagcagtgcataatggcctgggagaaaatggatcacaagccgctggtctggatatggacgtcggcaaacaggccatgcagtaccaagtgctgaacgaggtcgtgattgacagaggcccgtctagttaccttagcaacgtggatgtgtacctcgacggccatctgatcactactgtacaaggagacggcgtgatcgttagtaccccaaccgggagtactgcctacgccgctgcggcaggggcatctatgattcatccgaacgttcctgcaattatgattactccaatatgcccgcactctttaagttttaggccgattgtcgtccccgcaggcgtggagctgaaaattatgctgagtcccgaggctagaaataccgcctgggtgagctttgacggacggaaaagacaggaaattagacacggagactctatctcaattactacatcatgttaccccttgccctccatctgcgttagggacccagtgagcgattggttcgaatcattagcccagtgtctgcactggaacgtgcggaaaaaacaggcccattttgaagaggaggaagaggaggaagaggaaggctag

SEQ ID NO: 125689 - DNA, 1776 bp, Artificial Sequence
  Description of Artificial Sequence: Synthetic coding sequence
atggaaatggagcaagagaagatgacaatgaacaaagaactgagtccggacgccgcggcgtattgctgctctgcttgccatggagacgagacatggagttacaatcaccctattcgggggcgtgccaagtcacgttccctgtcagcaagcccggcgctgggttcaaccaaggaattccggcggacacgctcccttcatggcccatgtcccgtcaccacgttcggtccgaaggcatgtgtgctgcagaatccccagacgatcattgccacacccttatccctggcttctcagctcctccctagtcccgccgttagccactcgggacaaggcggagtgacaggccaggtacatgttttaccacagccttcagaccagggagtgctgagtggaccacgggccgcccgcggccagaccgccccccaagaggaagccgttacgcaggaggaagtggaagctcttgtgtgtgggcacactcagagatgggtgccgggacctgtgtatgatgccgccgctggaggttctggctgggcccaactttcactgcgggccggaatgggagttggtcaggccaccgggcacatccaagaccccgcctcccagcggctgacatggaacaaaagccccaaaagcgtactcgtgattaagaaaatgcgggacgcctcccttctccagccctttaaggaactctgtacacatcttatggaagcaagaggggccggtgggaagggggcatggggtgcccatggcgtcggcggagcatccattcacatcaccgcccctcgtgttggatcggcgggcggcatgtcaaggctggcgctatgttttcaggaaaatatgatagtttatgtggagaagaaagtgctggaagaccccgccattgctagtgatgagagttttggcgctgtgaagaagaagttttgtaccttccgagaagactacgatgatatcagcaatcagattgatttcatcatctgcctcggaggcgacgggaccttgctctacgcctcctcactattccaaggatccgtgccaccagtgatggccttccacttggggtccttgggcttccttacgcctttcagcttcgaaaatttccaaagccaggtgacacaggtaatcgaagggaacgccgccgtagtgctgcgatcccgtctgaaagtgagagtggttaaagaactcagggggaagaagacagccgtgcacaacggcctgggagagaatgggagtcaggccgctggacttgacatggatgtgggaaagcaggccatgcaatatcaggtcttaaacgaggtagtgatcgacagaggaccctcgtcatacctgagcaacgtcgacgtgtacctcgacggtcatctcattactaccgtccagggagatggagttatcgttagcacccctaccggctccaccgcttacgctgccgctgccggcgcttccatgattcatccaaatgtccctgctattatgattacacccatttgcccccattctctgagtttccgccctatcgtcgtgcccgcgggtgtcgagctcaaaattatgctttctccagaggctagaaatactgcatgggtttctttcgacggccggaaaagacaagaaatccgccatggtgactcgatctcgataacaacttcatgttatcccctcccctcaatttgcgttcgggacccagtgagcgactggttcgaaagcctggcgcagtgcctgcactggaacgtacgcaaaaagcaggcccactttgaggaagaggaggaggaggaggaagaagggtag

SEQ ID NO: 125690 - DNA, 1776 bp, Artificial Sequence
  Description of Artificial Sequence: Synthetic coding sequence
atggagatggagcaggagaaaatgacaatgaataaggagctgtcacctgacgcagccgcttactgctgtagcgcctgtcatggggacgaaacatggtcctacaatcaccccattcgaggaagagccaaaagcaggtccctctccgcatctcctgccttgggatcaaccaaagagttcagaaggacccgaagccttcatggcccctgtcccgtcaccaccttcggccctaaagcgtgcgtgctgcagaaccctcaaactatcatcgccactccattaagccttgcatctcagttactcccttctccagctgtgagtcactctggacagggcggtgttaccggacaggtgcatgtcctaccacaaccgtctgaccagggtgtgctaagtggcccccgcgccgctcggggtcaaactgcaccacaggaggaggccgttacccaggaagaggtggaagcgctggtttgcgggcatacccagagatgggtcccagggcctgtgtacgacgctgccgccggcggttctggttgggcccagcttagcctgcgtgccgggatgggtgtgggccaggccactggccatattcaggatcccgccagccagcggctgacctggaacaaatcccccaagagcgtgctcgtgatcaaaaagatgagggacgcctcgctcctgcagccatttaaagaactgtgcactcatctcatggaagcaaggggggccggcggcaagggggcatggggggcccatggagttgggggcgcctctattcatatcaccgctcctagagtaggaagtgcaggaggcatgtcgagattagccctttgttttcaagaaaacatgatcgtctatgtggagaagaaggtgctcgaggatcctgctatcgcctcagacgaaagctttggggcggttaagaaaaagttttgtaccttccgggaagactatgatgatatctccaatcagattgactttattatctgccttgggggcgatggaactctattgtatgcgtcttccctttttcagggcagtgtaccgcccgtcatggcctttcacctgggctccctgggatttcttactccttttagttttgagaacttccagtcccaggtcacccaagtgattgaagggaacgccgccgtcgtgttgcgtagtcggctcaaagtccgcgtcgtgaaagaactccgcggcaaaaagacagccgttcacaatgggctgggagagaatggatcccaggcggcaggccttgacatggacgtggggaagcaggccatgcagtatcaagtactgaatgaagtcgtgattgaccgcgggccctcctcttatctaagtaacgtcgatgtgtatcttgatggccatttaattactactgtgcaaggagacggggttatcgtaagcactcctacaggttctaccgcttacgccgctgctgcgggcgcgtccatgatacaccctaatgttcctgccataatgattactccaatttgcccacactctctgtcctttaggccaatagttgtgcccgccggtgttgagttaaagatcatgctgtctcccgaggcacggaatacagcatgggtgagctttgatggccgcaagagacaggagattcgtcatggagactcaatttccatcaccacaagttgctatcctctgccaagtatctgtgtgagggaccctgtctccgattggtttgaatccctggcccaatgtctccattggaacgttagaaaaaaacaggctcacttcgaagaagaggaagaggaggaagaggagggctag

SEQ ID NO: 125691 - DNA, 621 bp, Artificial Sequence
  Description of Artificial Sequence: Synthetic coding sequence
atgggacggccccgcgtgaggcaggcttggccaggttgttgcggtcatacgggtcgactccctgctggccgaggctacctggcaagccacatgtgtgaccccgctggagccgaacttatcggagacggcatgtccgaccccaccccccccagcaacgcatgcacgggtcacatacaggaccccgcttctcaacgcctgacctggaacaaatcaccgaagtccgttcttgtgataaaaaaaatgcgcgacgcctccctcctgcaacccttcaaagaactgtgtacgcatcttatggaggagaatatgatcgtgtacgtggaaaagaaagttctggaggaccccgctatagcctccgatgagtcattcggagcagttaagaagaagttttgtacctttagggaggactacgacgatatttctaaccagatagacttcatcatctgcttgggtggcgacggcacactgttgtacgcgtcttcgctcttccaaggatcggtccccccagtgatggcttttcacctaggctctctcgggttcctcacccccttcagctttgaaaattttcagtcacaagtaactcaggtgattgaaggcaatgccgcagtggtgcttagaagctag

SEQ ID NO: 125692 - DNA, 2121 bp, Artificial Sequence
  Description of Artificial Sequence: Synthetic coding sequence
atgggccgcaaggtgactgtggcaacctgtgccttgaaccagtgggctcttgattttgagggcaatctgcagcggatactaaagtcaatcgaaatcgccaagaacaggggggcccgatataggctgggccctgaattggaaatctgtgggtatggctgctgggaccactactacgaatcagacactttactccacagtttccaggtcctggccgctcttgttgaaagtccagtcactcaagacatcatctgcgacgtgggaatgcccgtcatgcaccgcaatgtgaggtacaactgcagggttatctttcttaacagaaaaatcttactgattcgccccaagatggccttagccaacgagggcaactacagggaactccgctggtttaccccgtggtcccgctcccgccatactgaggaatatttcttgccacggatgattcaggacctcacgaaacaggagacagttcctttcggggatgccgtcctggttacctgggacacatgcattggctcagaaatttgtgaggagctgtggacccctcactctccccacatagatatgggtcttgatggagttgagattataaccaacgcttctgggagccaccaggtgctgcggaaggctaatacaagggtggatctggtgacaatggtgacgagtaagaatggcggcatttatctcctcgcgaaccagaaaggatgcgacggggatcgcctctactacgacgggtgcgccatgattgctatgaacgggtctgtgtttgcccaagggtcccagttttctcttgatgacgtggaggtcctgacagcaactttggatctggaggacgtgaggtcctaccgggccgagatttccagtcgaaatttagcagccagtcgggcgagtccttatcctcgggtgaaggttgacttcgctctctcttgccatgaggatctgcttgcacctatctccgagcctatcgaatggaagtatcactcacctgaagaggagatatccctcggacccgcatgctggctgtgggacttcctgcgtagatcccagcaggctggattcttgcttccactgtccggcggagttgattccgccgcaaccgcttgcctcatctattcaatgtgttgtcaggtttgcgaagccgtcaggagcgggaatgaagaagtgctggcggatgttcggaccattgtgaaccagatatcatataccccacaggatccgcgggatctgtgcggcaggattctgaccacctgctatatggcctccaaaaatagctctcaagaaacatgtactcgagctcgagaactggctcagcagataggctcacatcatatttcactcaatatcgatcccgcggtaaaggcagtgatggggatctttagcttagtgacaggcaagtctccgctgtttgccgcccacggagggagctcccgagagaacctggctctgcaaaacgtccaagcaaggataagaatggttctggcctatctgtttgcccagctgtccctgtggagcaggggcgtgcatggagggctcctggttctcggctcggctaacgtggatgaatcgctgcttgggtacctcacgaaatacgactgtagctctgctgatattaatcccatcggaggaatttcaaaaaccgacctgcgagcattcgtccagttttgtattcagaggtttcaactgccggccctgcaaagtattctcctagcccctgcaactgccgaactggagcctctggcagacggacaggtctcccagaccgacgaggaggatatgggcatgacctatgctgagttgagtgtctacggaaagctgcgaaaagtcgccaaaatgggaccctattctatgttttgcaaattgctgggcatgtggagacatatttgtacaccacgacaggtggctgataaggtcaaaaggtttttttccaaatactccatgaatagacataaaatgaccaccttgacccccgcttatcatgcagagaattactcccccgaagacaataggttcgacctgagaccttttctgtacaacacctcctggccatggcagttccggtgtattgaaaaccaagtgttgcagctggaaagggccgagccgcaatcactggacggggtcgattag

SEQ ID NO: 125693 - DNA, 1341 bp, Artificial Sequence
  Description of Artificial Sequence: Synthetic coding sequence
atgggaattagtggtcaagaggtgctcacagccacattagatttagaagatgtgaggagctacagagcagaaatttcctcaaggaatctcgccgcttccagggcatcaccatatccccgagtgaaggttgacttcgccctctcctgccacgaggacctgcttgccccgatctccgaacctattgagtggaaatatcacagtccagaggaggaaatcagccttggtcccgcgtgttggctgtgggactttttaagacgttcccaacaggctggatttctgctacctctctccgggggagtcgactccgccgccaccgcttgccttatatactcaatgtgttgtcaggtgtgtgaggctgttcgatccggcaatgaagaagttttagcggatgtccggacgatagtcaaccagattagctacacgccccaggacccaagagacttgtgtggccgaatcttgaccacttgttacatggcttccaaaaattcgagtcaggagacatgtactcgggctcgcgaactggcccaacagataggttcccaccacatatctttgaacatcgatcctgctgtgaaagctgtgatgggtatattcagcctggtgaccggtaagtcccccctcttcgctgcccacggcggcagcagtcgcgagaatctagcactgcagaacgtccaggctcgcattaggatggtgctggcctatttatttgcccagctgtctctttggagccgcggcgttcacggtggattactggtgctggggagtgcaaacgtggacgagtccctacttgggtaccttactaagtacgactgctccagcgcagacattaaccctatcggcggcatttctaaaacggacttgagagccttcgtacagttttgtatacagcgctttcaactgcccgccttgcaaagcatactcctggcaccagccacagccgagctcgagcccctggcagatggccaagtttctcagacagatgaggaagacatggggatgacatatgccgagctttccgtatacggtaaactcaggaaggtggctaagatggggccttactccatgttctgcaagctgctcggaatgtggcgccatatctgtactccccggcaggtcgctgataaggtcaaaaggttcttcagcaaatattccatgaacaggcataagatgacaacactaacccccgcttaccacgcagagaattactctcccgaggataatcgttttgacctgcgtccatttttgtacaatactagttggccctggcaatttagatgtattgaaaatcaagttcttcagttggaaagagctgaaccacagtctctggacggggtagattag

SEQ ID NO: 125694 - DNA, 1122 bp, Artificial Sequence
  Description of Artificial Sequence: Synthetic coding sequence
atggaacctgcagtctctgagcctatgagggatcaggtggcccgtactcaccttacagaagacaccccaaaggtcaacgcagatatcgagaaggtcaaccagaatcaggccaagagatgcacagtcatcggaggatccggttttctgggccagcatatggtggaacagctcttagcccgtggctatgccgtaaacgtctttgacattcagcaggggttcgataaccctcaggtccgatttttcttaggcgatctctgtagtcggcaagacttgtatccggcgctgaagggggtcaatacagtcttccattgcgcctctccacctccctcttcgaacaacaaggagttattttatagagtgaattacataggaacaaagaacgttatcgagacttgcaaggaggcgggtgtgcagaaactaatccttacaagctccgcttctgtgatctttgagggggttgatatcaagaatggaacagaggacctgccttatgccatgaaacccattgattattacacagaaaccaagattcttcaagagcgcgcagtgctcggcgccaacgatccagagaaaaattttctgaccaccgccattagacctcacggtatctttggccctagggatccccagctggtacctattttaatcgaggcagcacggaacggcaagatgaagttcgtaatcggtaatggcaagaatctggtggattttactttcgtggagaacgtagttcacggccatatcctcgctgcggaacagctgtcccgcgatagcacattgggcggcaaagccttccacatcactaatgacgagcctattcctttttggacatttttatcacggatcttaacaggcctcaattacgaagcacctaagtaccatattccttattgggttgcctactacttagccctccttttgtctttgctcgtgatggtgatttctccagttatacagctgcagccaaccttcacacccatgagagtggccctggctggcaccttccactactactcctgcgaacgcgcaaagaaggctatgggttaccaacctcttgtaacaatggacgacgctatggagagaactgtccagtcctttagacatttaaggagagtcaagtag

SEQ ID NO: 125695 - DNA, 765 bp, Artificial Sequence
  Description of Artificial Sequence: Synthetic coding sequence
atggagcccgccgtcagcgaaccgatgcgggatcaggtcgcccgcacacacctgacagaagacacaccaaaggtcaacgcagacatcgaaaaggtcaaccagaaccaggccaagcggtgtactgtgataggtgggagcgggttcctgggacagcacatggtcgaacaattattggcgaggggctatgcagtgaacgtttttgacattcagcaggggttcgataatccccaagtgcgcttctttctgggcgatctctgctccagacaggatctctaccctgcactgaagggggttaatacagtgttccactgtgccagcccacccccctccagtaacaataaggagctcttctatcgggtgaactacattgggactaagaatgtcattgaaacctgcaaggaggcgggagtccagaagttgatcttgacgtcttccgctagcgtgatctttgaaggcgtggatatcaaaaatggtactgaggatttgccgtatgcgatgaagccaatcgattattatacagaaaccaaaattttgcaggagcgtgctgtgttaggtgctaatgatccggaaaagaatttcctcaccaccgccattagaccacatggcatatttggcccccgcgatccacaattggtacctattttgatagaggccgcccgtaatgggaaaatgaagtttgtcattggcaatggtaaaaatctagtagatttcacttttgtcgaaaacgttgtccacgggcatatactagccgctgagcaattgtag

SEQ ID NO: 125696 - DNA, 1122 bp, Artificial Sequence
  Description of Artificial Sequence: Synthetic coding sequence
atggagccagcagtgtcggagccaatgcgcgatcaggtagctcgaacacacctgacggaggacactccaaaggttaacgctgacatcgagaaggtaaatcagaatcaggcgaagagatgcacggtgatcggcgggtcaggattcttaggtcagcacatggtggagcagctgctggccaggggatatgctgtcaatgtgttcgacatacagcaaggtttcgacaatccacaggttcgcttcttcctcggagatctctgcagtagacaagatctctatccagcgctcaaaggggtaaatactgtttttcactgcgcaagtccccccccatcctctaacaataaggaactgttttaccgagtgaattatatagggaccaaaaatgtcattgagacatgcaaagaggccggtgttcagaagctgatccttacctcaagcgctagcgtgatttttgagggcgtcgatatcaaaaacggtacagaggatttgccatacgctatgaagcctattgattactacactgagacgaagatacttcaagagcgggcagtcctgggagccaacgaccccgagaaaaactttttaaccaccgctattagaccacacgggattttcggccctcgggatccacagctggtgccgatcttaatagaggctgcccgaaatggtaagatgaaattcgtgatcggtaatggcaaaaacttggtcgattttacatttgtcgaaaatgtggtccatggccatatcttggccgccgaacaactgtctcgagactctacactcgggggaaaggcttttcacatcaccaatgacgagcccattcctttttggacattcctgtcacggatccttactgggttgaattacgaggcccctaagtatcacatcccgtactgggtggcctactacctcgccttattgctttctctgctcgttatggttatcagcccagtgatacagctgcagcctacgtttacccctatgcgggtcgccctggccggcactttccactactatagctgcgaacgcgcaaaaaaggcgatggggtatcagccactcgtgacaatggatgacgccatggaaagaacagttcagtcttttcgacacctgcggcgcgttaaatag

SEQ ID NO: 125697 - DNA, 825 bp, Artificial Sequence
  Description of Artificial Sequence: Synthetic coding sequence
atggtcggcagaagagccttgatcgtgctcgcccacagcgagagaacgagttttaactacgcaatgaaggaagctgcggctgctgctctgaaaaagaagggctgggaggtcgtagaatcagatctctatgccatgaatttcaaccccattatatccagaaaagacatcaccggaaagctgaaggatcccgccaacttccaatatccagctgaaagcgtgctagcttataaggagggccacctctcacctgatatagtggctgagcagaaaaagctggaggccgctgacctggtgattttccagttcccccttcagtggttcggcgtccctgctatcctgaagggctggtttgaaagggtgttcatcggagagtttgcttatacctatgcggcaatgtacgataagggccccttcagaagtaagaaagccgttctgtctatcaccactggcggaagcggctctatgtacagcctacaggggatccatggcgacatgaacgtcattctttggcccatccagagtggtatcctgcacttctgtggatttcaggtgttggagccacagttgacctatagtattggccacacccccgctgacgcacggattcagattttagaggggtggaaaaaaaggctcgaaaatatctgggatgagacccctctttattttgcacccagcagcctgttcgatctgaatttccaggccggcttcttaatgaaaaaagaagtccaggacgaagagaagaataagaaattcggtctgagtgtcggtcaccacctgggaaagagcattcccacagacaaccaaatcaaggctcggaaatag

SEQ ID NO: 125698 - DNA, 711 bp, Artificial Sequence
  Description of Artificial Sequence: Synthetic coding sequence
atggtgggtcgtcgcgctctgattgttctggcccatagcgagcgcacctcattcaattatgctatgaaagaggcagccgcagccgccttgaagaaaaaggggtgggaagttgtggagtccgacttgtacgccatgaactttaaccccatcatcagtcggaaggatataaccggaaagctgaaagatcccgcaaactttcaataccctgctgagtctgtgctggcatataaggaaggccacttgtctccggacatcgttgcagagcagaagaagctggaggccgccgacctcgtcatctttcagtcaaagaaggccgtactatctataacaacaggcggctccggcagcatgtactcattacagggcattcatggggacatgaacgtaatactgtggcccattcagtctggcatccttcatttttgtggattccaagtgcttgagcctcagctcacttatagcatcggtcacacccccgccgacgcccgtattcagatcctcgagggatggaagaaacgactggagaatatatgggatgaaacaccactatactttgccccgtcgtctctgtttgatctgaattttcaagctggttttctaatgaaaaaggaggtccaggatgaggagaagaacaaaaagtttggattgagcgttgggcaccatctcggcaagtcgatcccaacagacaaccagattaaggcccgcaaatag

SEQ ID NO: 125699 - DNA, 723 bp, Artificial Sequence
  Description of Artificial Sequence: Synthetic coding sequence
atggtgggaaggcgtgcactcattgttttagcccattctgaacgaactagcttcaattacgcaatgaaggaggctgcagctgcggccctaaagaaaaagggatgggaggtcgtagaatctgacctctatgctatgaactttaaccctatcatttcccgaaaggacatcacaggtaaattgaaagatcctgcaaacttccagtatcctgccgaatccgtcctggcgtacaaggaggggcatctgtcaccagacatcgtggctgaacagaagaagctcgaagctgccgatctggtcatattccaatttccgctccagtggttcggagtacccgccattctaaaagggtggttcgagcgggtttttatcggggagttcgcttacacctacgccgccatgtatgataaaggccctttccgaagcgggatcctgcatttctgtgggttccaggtcctagagccacagctcacctatagtattggtcacactccagctgacgctcggatacagattctcgaaggttggaagaaaagactggagaatatatgggatgagacccctctttacttcgccccttcatccctgtttgacctgaactttcaggctggattcttgatgaagaaagaggttcaggacgaagagaaaaataaaaaattcggactgtctgtggggcaccatctcgggaagagtatccctaccgacaaccaaataaaagcccggaagtag

SEQ ID NO: 125700 - DNA, 609 bp, Artificial Sequence
  Description of Artificial Sequence: Synthetic coding sequence
atggtcggaagacgggccctgattgtgctggcgcacagcgaaagaacgtctttcaactatgccatgaaagaagctgccgccgctgcccttaagaagaagggctgggaagttgtggagtctgatctgtacgcaatgaactttaaccccataataagccgtaaagacataaccggcaaactgaaagatccagccaacttccagtaccccgccgagagtgtgctggcctataaggagggccatctctctccggatatagtggccgagcagaagaaacttgaggcagccgatttggtgatttttcagagcggcatcctccacttttgcggctttcaagtgctggaacctcaactcacttacagcattggccacaccccagccgacgcccggatacagattctcgagggatggaagaagaggctcgagaatatctgggacgaaacacccctctacttcgcacctagctcattatttgacttaaacttccaggccggatttctaatgaaaaaagaggtgcaggacgaggagaagaacaaaaagtttggcctatctgtgggccatcacttgggcaaaagcattccgacggacaatcaaatcaaggctcggaagtag

SEQ ID NO: 125701 - DNA, 696 bp, Artificial Sequence
  Description of Artificial Sequence: Synthetic coding sequence
atggctgggaaaaaagtgctgatcgtatacgcccaccaggaacccaagagctttaacggcagcctaaaaaacgtcgcggtggacgagctcagcaggcagggatgcactgtgacagtgtcagacttatacgcgatgaacctagagcccagggccactgataaggacatcacgggtaccttaagcaaccctgaagtgtttaattacggtgtagagacccacgaggcctacaagcagaggtccctggcgtcagacatcacagacgaacaaaagaaagtcagggaagccgacctagtgatatttcagttccccctgtactggttttctgtgccagccatattgaagggctggatggatcgggtgttgtgtcagggctttgcctttgacataccaggcttctacgactcgggcctccttcagggcaagctcgcactccttagtgttacaactggcggaacagcggagatgtacacgaaaacaggagtcaatggcgatagcagatactttttgtggccgctgcagcacggaacactgcatttctgtgggttcaaggtccttgcccctcagatctcgttcgccccagaaatcgccagtgaggaggagagaaagggcatggttgccgcatggtctcagcgtctgcagaccatatggaaagaggagcccattccttgtacagcgcactggcactttggtcagtag

SEQ ID NO: 125702 - DNA, 696 bp, Artificial Sequence
  Description of Artificial Sequence: Synthetic coding sequence
atggccgggaaaaaagtacttatcgtatacgctcaccaggagcctaaatccttcaatgggagcctgaagaacgtagctgtcgacgagctctccagacagggctgtacagtgacagtgtcggacctatacgctatgaacttggaacccagggctacagacaaggatatcacaggaaccctatcgaatcctgaggtgttcaattacggagtggaaacgcacgaggcctacaagcagaggtctctggcctctgatattacagatgaacagaaaaaggtcagagaggccgatttggttatctttcagtttcccctgtattggtttagcgtgcccgccatacttaaggggtggatggaccgtgtgctttgtcaaggattcgcctttgacatccctggcttctacgattccggtctcttacaggggaagctcgctcttctgagtgtcaccaccggaggaacagctgagatgtacaccaagactggagtcaatggcgattctcgatatttcctttggcctctgcagcacggcactcttcacttctgcggcttcaaggtgctcgcgccacagatcagctttgcccccgaaatcgccagtgaggaagagcgcaaaggtatggtggccgcttggtcacagcgtttacaaacaatatggaaagaagaacccatcccgtgtactgcccattggcactttggtcagtag

SEQ ID NO: 125703 - DNA, 582 bp, Artificial Sequence
  Description of Artificial Sequence: Synthetic coding sequence
atggcaggcaagaaggtgttgatcgtgtacgcacaccaggagcccaagtccttcaacgggagcttaaagaatgtggcagtcgatgagctgtctcggcagggatgtaccgttactgtatccgacctgtacgctatgaatctggagccacgggccaccgacaaagatattactggcaccttgagtaaccccgaggtgttcaactatggcgtggagactcatgaggcgtataagcagcgttccctggcctccgacataactgacgagcagaagaaggtgagggaggcagacctcgtgatttttcaaggcaaactcgcgctcctgtcggtcacgaccggggggactgccgagatgtacaccaaaacaggagtcaatggagactcccgatacttcctgtggcctttacagcacggcaccctgcacttttgcgggttcaaagtcctggccccgcagatctcttttgcccctgagatcgccagtgaagaagagaggaaggggatggttgccgcttggagtcagagactgcagaccatctggaaagaagagccaattccatgtaccgcccattggcactttgggcagtag

SEQ ID NO: 125704 - DNA, 582 bp, Artificial Sequence
  Description of Artificial Sequence: Synthetic coding sequence
atggccgggaaaaaagtgctcatcgtctacgcccatcaggaaccaaagagtttcaacggatcactgaagaacgtcgctgtggatgagctgagcagacagggctgcaccgttacggtctctgacctctatgctatgaatctggagcccagggccactgacaaagacataactggtacgctgtcaaatcctgaagtgttcaattacggcgtggaaacgcacgaagcctacaaacaaaggtctctggcaagtgacattaccgatgaacaaaagaaagtccgagaggcagaccttgtgatttttcagggcaaactggctttactgtctgtgacaaccggcggcaccgcagagatgtataccaaaactggcgttaacggagactctcgatactttttatggccacttcagcacggcaccctccacttttgtggcttcaaggttttagcccctcagatttccttcgctcctgagatcgctagcgaagaggaaaggaagggtatggtggccgcttggagccaacgcctccaaacgatttggaaagaggagccaatcccctgtacggcacactggcacttcgggcagtag

SEQ ID NO: 125705 - DNA, 696 bp, Artificial Sequence
  Description of Artificial Sequence: Synthetic coding sequence
atggctgggaagaaggttctcatcgtgtacgcgcaccaggagccaaagtcttttaacgggagtttaaagaacgttgcggtggatgagctatctcgccaaggctgtacagtgactgtctctgacttatatgcgatgaaccttgaaccacgggccactgacaaagatatcaccgggacattgtcaaaccccgaggttttcaactatggcgtggagacccatgaagcatataagcagaggagtctggcttctgacatcaccgacgaacagaagaaggtgagagaggccgatctggtcatcttccagttccctttgtattggtttagcgtccctgctatcttgaaggggtggatggatcgggtcctgtgtcaaggatttgcatttgatattcctggtttctacgacagcggcctattacaggggaaattggctttgctgtcggtcactaccgggggaacagcagaaatgtacactaaaaccggcgtcaacggagacagccgatacttcctttggccactgcagcacgggaccctgcatttttgtggatttaaagtgctcgcgccacagataagctttgcgccagagatcgcctctgaggaggaaaggaaaggaatggtggcagcttggagtcaaagactgcagactatttggaaggaggagcctataccatgcacagcccattggcattttggtcagtag

SEQ ID NO: 125706 - DNA, 420 bp, Artificial Sequence
  Description of Artificial Sequence: Synthetic coding sequence
atggccggaaagaaggtgctcattgtatacgcacaccaagagccgaagtccttcaatggtagcctaaaaaacgtagctgtggatgaactctcacggcagggctgcaccgtgactgtctctgacttatacgctatgaacttggaaccccgagcgactgacaaagatattactgggactttgtcaaacccggaagtcttcaactacggagtggagacgcacgaggcctataagcagcggtccctggcttccgatatcacggacgagcagaagaaggttagggaggcagaccttgtgatctttcaatttcctctgtattggttcagcgttccagcaattttgaaaggatggatggaccgggtgctgtgtcaagggttcgcctttgacatcccaggcttttacgacagtgggctcctccagtag

SEQ ID NO: 125707 - DNA, 420 bp, Artificial Sequence
  Description of Artificial Sequence: Synthetic coding sequence
atggctgggaagaaggtattaatcgtctatgcacatcaagaacccaaaagtttcaacggatctttgaagaacgttgcagtcgatgaactgagcagacagggttgtactgtaacagttagcgacctgtacgcaatgaacctcgagccgagagcaacagacaaagatatcaccggcacactgtccaaccccgaggtctttaattatggcgtggagacacatgaggcctataaacagcgctccctggcctccgatattactgacgaacagaagaaggtaagagaggctgatctagtgatcttccagttcccgctgtactggtttagcgtacccgcaatccttaaaggctggatggatcgggttctgtgtcagggcttcgcatttgacatcccagggttctacgactccggtctgctgcagtag

SEQ ID NO: 125708 - DNA, 192 bp, Artificial Sequence
  Description of Artificial Sequence: Synthetic coding sequence
atggccggaaaaaaggtgctgatcgtttacgcccatcaggagcctaagtcctttaatgggtctctcaaaaatgtcgcggtggatgaattatccaggcagggatgcaccgtcactgtgagcgacctgtacgccatgaatctcgagcctcgcgctacagataaagacatcacagggaccctctcgaatccatag

SEQ ID NO: 125709 - DNA, 483 bp, Artificial Sequence
  Description of Artificial Sequence: Synthetic coding sequence
acccctggtttaaagcaaagctcacatctctctctgtggtcgagctgggactacaggttgctcgatagcctgaaacgagactatgcagggaaacctcagcctccgattaaatccgagaggcgcaacccgccaagctacgctatggcaggtaagaaagtcctcattgtatatgcgcaccaagagccaaagtcctttaatggtagcctaaagaatgtcgctgttgatgaacttagtagacagggctgcacagtcacagtgagcgacctgtacgcaatgaatttggagccccgggccacagataaagacattaccggaacacttagcaaccccgaggtgtttaattatggggtggaaactcacgaagcctacaaacagagaagcctcgcctcagacattaccgatgagcaaaagaaggtgagggaggctgacttggtaatattccaaatgctcagtaccgagctttcgctaactagtcggtgctag

SEQ ID NO: 125710 - DNA, 231 bp, Artificial Sequence
  Description of Artificial Sequence: Synthetic coding sequence
atggcggcagctgctgcttcacgaggtgtgggggccaaactgggcctgcgggaaattagaatacatttgtgccaaaggtctccagggtctcagggggtgcgggatttcattgaaaagagatatgtcgaactgaagaaggcaaacccagatctgccaatcctgatcagagagtgcagcgatgtacaaccaaaattgtgggctaggtacgccagtagagtacaaaattcatag

SEQ ID NO: 125711 - DNA, 213 bp, Artificial Sequence
  Description of Artificial Sequence: Synthetic coding sequence
atgtggttcgagattctgcccggcctttccgtgatgggagtgtgccttcttatcccaggactggcgaccgcttatatccaccgtttcacaaacggtgggaaagaaaaacgcgtcgcacactttggctatcactggtctctgatggagagagatcgccgaatcagcggcgttgataggtactatgtgagcaaaggactcgaaaacatagactag

SEQ ID NO: 125712 - DNA, 1068 bp, Artificial Sequence
  Description of Artificial Sequence: Synthetic coding sequence
atggctttgaggctcctgaaattggcggctacctccgctagcgctcgcgtggtggccgcaggtgcccaacgggtgagaggcattcacagttcagtccaatgtaaactgcgctatggtatgtggcacttcttgttgggagataaggctagtaaaagactgactgagagaagtcgcgtcattactgtagatggcaatatctgcacaggcaaaggaaaactggccaaggaaatcgcagagaagttgggattcaaacactttcctgaggctggaattcattaccccgacagtaccacgggagatggcaagccactggctactgattacaatggcaactgctcattggagaaattttatgacgaccctagatccaacgatggtaattcctacaggttgcagtcctggctatatagctcacggctgctccagtattcagatgcgttggaacacctgctgaccaccggccaaggtgtagtgctagagcggtctatatttagtgactttgtcttcttggaggctatgtataatcaaggctttatccggaaacaatgtgttgatcattacaacgaggtcaaatcggtaacgatttgtgactacttgcctccgcacctggtcatatatattgatgtgcccgtgccggaggtgcagcggcggattcagaagaagggagaccctcacgaaatgaaaattacctcagcctacttgcaggacattgaaaatgcatacaaaaaaaccttcctgccagaaatgtctgagaagtgcgaggtactgcagtattcagcgagggaggctcaggatagtaagaaggtggtggaggacattgaatacctcaaatttgacaaaggtccctggttgaagcaggacaacagaaccctttaccacctgcgattgcttgtccaggataagttcgaggtgctgaattacactagcattcctattttcctgcccgaggtcacaatcggggctcatcagactgatcgggtgctgcatcagttcagggaactgcccggtcgaaagtactcacccggctataataccgaagtgggagacaagtggatctggctgaaatag

SEQ ID NO: 125713 - DNA, 1068 bp, Artificial Sequence
  Description of Artificial Sequence: Synthetic coding sequence
atggcacttcgcctgcttaaactcgctgccacctcagcatcagcccgtgtggttgcgcgggctccaagcgcttggcgcggaatccactcgagtgtgcagtgcaaactgcgctacgggatgtggcacttcttgttaggggacaaagccagcaaacgactcactgagcgatcacgggtgattacagtggacggtaacatctgtacaggaaagggcaagctcgccaaggagatcgccgaaaagctgggatttaagcacttccctgaagccggtatacactatccagactctacaacaggcgatggaaaacctcttgccactgattacaacggaaactgcagcttagaaaaattttatgatgaccctcggagcaacgacgggaacagctaccgcttgcagtcttggctttacagttctcgtctgcttcagtattccgacgccctggaacaccttctgactactggccagggagtggtgctggagaggtctattttctccgatttcgtgttcctcgaagcaatgtacaaccagggatttattcgtaaacagtgtgtggaccactacaacgaggtgaagagcgtcactatctgtgactacttacctcctcatctcgtcatctacattgatgtgccagtgccagaagtgcaacgccgtattcagaagaagggtgatcctcatgagatgaagataacctctgcttacttgcaggacatcgagaacgcttataaaaagaccttccttcctgagatgtcggaaaagtgcgaagtgctccagtactctgcaagagaggcccaggactctaagaaggtagtggaagacattgagtacctgaagttcgataagggaccctggctgaaacaagacaataggaccctctatcatctaaggctcttggtgcaggacaaattcgaggtccttaattacacatctattcctatttttcttccagaggtgactatcggagcccatcagactgatagggtgctccaccagttcagggaattgcccggccgtaaatacagtcccggatataacaccgaagtcggcgataagtggatctggctaaaatag

SEQ ID NO: 125714 - DNA, 426 bp, Artificial Sequence
  Description of Artificial Sequence: Synthetic coding sequence
atggctcctaaggtgttccgacagtattgggacattcctgacgggaccgattgccatcgtaaggcttacagtaccacctcaattgcctcagtcgctggcctgacagccgctgcttacagagtcactcttaaccccccgggaacttttctggagggtgttgccaaagtggggcagtacactttcaccgcagcggccgtcggtgctgtgttcggactaaccacatgtatttccgcgcacgtccgggagaagcccgatgaccccttgaactacttcttgggagggtgtgccggcggcctgacgctgggggcaaggacccacaattacggtataggcgctgctgcctgtgtgtacttcggcattgctgcttctctggtgaagatgggccggttggaaggctgggaagtctttgcaaagccaaaggtttag

SEQ ID NO: 125715 - DNA, 687 bp, Artificial Sequence
  Description of Artificial Sequence: Synthetic coding sequence
atggcaccaaaggtatttagacagtactgggacatcccggatggaaccgactgccataggaaggcttatagcactaccagcatcgcttctgtcgcaggcctgactgctgcagcttatcgggtcaccctgaacccccccgggactttcctggagggagttgcaaaagtcggtcagtacaccttcaccgcagccgcagtgggcgccgtgttcggactgacaacatgcattagcgctcacgtccgcgaaaaacctgacgatccgcttaattatttcctgggaggctgcgctggtggcctgacactgggcgcaagaaagactggcagccattgtgttgtacaagccgggctgaagttacttgcttcttcatccccacatacctcggcaagtcagagcgcaggcatcatcggtatgtctcattgcgttcagaggttctgggtgccatcttcctctgcctgcctcgaagtgctgtccggcgaatccaccgatgttcatgcttgctcaagtaccaggggggcctgtaattcttctggctctaggccactgccggagctgggagctcgggctagtggttcattaagaaaagggggccatactcatcctgctcctcggggagcaggtgctttgactcccgtacaggccttgatagagtccttgctgaataccctgggcagcaacccacgaacttag

SEQ ID NO: 125716 - DNA, 684 bp, Artificial Sequence
  Description of Artificial Sequence: Synthetic coding sequence
atgcaggaaccgcgccgcgtgacaccatgcctgggaaaacggggcgtcaaaacccctcaacttcagccggggtcagctttcctgccccgggtccgccgacaatctttccctgctcgctcagattcgtacacgacggtgcgagatttcctggcggttccgagaaccatctctagcgcctcagctaccctgatcatggctgtggccgtgtcgcactttcgccctgggcctgaggtttgggataccgcctccatggcagcttcgaaggtcaagcaggacatgccacctccaggcgggtacggtcccattgattacaagcggaacctgcctaggaggggcttgagtggatactcgatgctggctataggcatagggaccctgatctatggtcactggagtatcatgaaatggaaccgggagaggagacgattgcaaatcgaggacttcgaggctcggatagccctgttgcctcttttgcaggccgagacggacagacggacgctgcagatgctgagagagaacctagaggaagaggcaatcatcatgaaagacgtgccagattggaaagtgggcgaatcagtgttccataccacccggtgggtccctccactcatcggagagctctacggattgaggactacagaagaggccctccatgcttcccatggcttcatgtggtacacttag

SEQ ID NO: 125717 - DNA, 435 bp, Artificial Sequence
  Description of Artificial Sequence: Synthetic coding sequence
atggcagcttccaaagtgaagcaggatatgccaccgcccgggggctatgggcctatcgattacaagaggaatctgcctaggagaggtcttagcggctatagcatgctggctatcgggatcggcactttgatctacggccattggtcgataatgaagtggaatcgcgaacgacgcagactgcagatcgaagacttcgaagcccgcattgccttattgcctctgcttcaagccgagacagacaggcggactcttcagatgcttagagagaacctggaggaggaggctattatcatgaaggacgtgcccgattggaaggtcggcgagtccgtctttcatacaactaggtgggtccccccacttatcggcgagctctacggactgcgaactacggaggaggccctgcacgccagtcatgggttcatgtggtatacttag

SEQ ID NO: 125718 - DNA, 300 bp, Artificial Sequence
  Description of Artificial Sequence: Synthetic coding sequence
atggccgcagcagctgcttcacggggtgtgggggctaagctcggtcttagggagatccgtatacacttgtgccaacggagtccggggtcccagggggtgcgggatttcattgaaaaacggtatgtggagcttaagaaggctaacccagacttgccaattctaattcgtgagtgtagcgacgtgcagcctaagctatgggccagatatgcctttggtcaggagacgaacgttcccctcaataatttctccgccgaccaggtcactagagcactagagaacgtgcttagcggcaaggcttag

SEQ ID NO: 125719 - DNA, 720 bp, Artificial Sequence
  Description of Artificial Sequence: Synthetic coding sequence
atggccggcgttctgaagaaaactaccgggcttgtagggctggccgtgtgtaacaccccgcatgaagtgtgcacctttgttttgtccagctttcttaattcacagggtaggctgaatagctgtcattttgcatattgccgcgtcaacggaatacagatgttccaggcactcaactacaaaccccgtgagcttctcaggcatggacgttgtcctcccacctccctgattcgatgtcacatatttatctacttctgtcacgatctctttatcaagcccgttttcctactcaccttctctctcactttttcttggctgcatttgtgtctgctcctatccgccccttcccaaatttacatcagcgtgttccatctcttttccttgccctataggttctgtcttggcgcattggattatatatatcttggccttctcaaggtactgccaccctttccctccgttagatcttttccctccgtatttacaaacgtatttattaaaaaaacacataagttctttatattactggtcccaagtatcatcacaccctttctgtgttttactctgcagatcacgcagaaatcttacctctactttcttcagtttttgtcctactcgcctcttaacgccctaagtcacccgtggcgtttcagctcttctccgatcattagcatgctcccaaacccgatggtcagctcttacttctccccaagtcttacgtag

SEQ ID NO: 125720 - DNA, 351 bp, Artificial Sequence
  Description of Artificial Sequence: Synthetic coding sequence
atggcaggcgtcttgaaaaaaacaactggcttagtgggtctggctgtgtgtaacacaccacacgagcgcctgaggattctctacaccaaaatcctcgacgtactcgaggagattcctaaaaacgctgcctatcggaaatacacagagcaaatcacaaatgagaagctggcaatggttaaagcggagcctgatgtgaaaaagttggaagaccagctccagggaggacagttagaagaggttatactgcaggcagagcacgagcttaatctcgctcgcaagatgcgggagtggaagctttgggaacctctcgtcgaggagccaccagcagatcagtggaagtggcctatatag

SEQ ID NO: 125721 - DNA, 351 bp, Artificial Sequence
  Description of Artificial Sequence: Synthetic coding sequence
atgccctatagggtggggcaaacgacagggttagtgggtctggctgtctgcaacaccccacatgagcggctcagaatcctgtacacaaagatattagacgttcttgaagagatccctaagaatgcagcctatcggaagtatactgagcagattactaatgagaaactggccatggtgaaggcagaacccgacgttaaaaagttggaagaccagctgcagggcggtcagctcgaggaagtgatcctgcaggccgaacacgagctcaacttggcacggaaaatgagagaatggaagttatgggagcccctcgtggaggagccgccagccgatcaatggaagtggcctatttag

SEQ ID NO: 125722 - DNA, 465 bp, Artificial Sequence
  Description of Artificial Sequence: Synthetic coding sequence
atgggtaaagacattagacctcgctctgcccgtgccgcgtgtaagggcgttggcctatggagcggctgcttcggcaagatggccggttcaggtgtgcgacaagccaccagtactgcctctacattcgtgaaacctatctttagcagagacatgaacgaggccaagcgccgagtgagggaattgtatcgggcatggtaccgcgaggtgccgaatactgtgcaccagtttcagctggacatcactgtcaagatgggtagggacaaggttcgtgagatgttcatgaagaatgcgcacgtgaccgacccccgggtggtggacctgctggtcatcaagggaaaaatcgagcttgaagagactattaaggtctggaagcagagaacccacgtgatgcgctttttccacgagacagaggcccccaggccgaaggatttcctcagtaagttctatgtgggccacgatccttag

SEQ ID NO: 125723 - DNA, 342 bp, Artificial Sequence
  Description of Artificial Sequence: Synthetic coding sequence
atggcctccgcaacccggctgattcagcggttacggaattgggctagtggccacgatctccagggcaagctccagctgaggtatcaagagatttctaaacgcacccagcctccgcctaaattacccgtagggccaagccacaagctgagcaacaattattattgcaccagagacggccggcgagagtctgtgccccctagcataatcatgtcttcacagaaagcattggtgtccggcaagcctgcagagtcctccgccgttgcagcgaccgaaaaaaaagccgtcacgcctgccccaccgattaagagatgggaactgtcatctgaccagccttacctttag

SEQ ID NO: 125724 - DNA, 519 bp, Artificial Sequence
  Description of Artificial Sequence: Synthetic coding sequence
atgcccggaattgttgagctgccaacactggaagaactaaaggtggacgaggttaagatttccagcgccgtactcaaggctgcggctcaccattacggcgcacaatgcgacaaacccaataaagagttcatgctgtgtagatgggaggagaaggaccctcgacgttgccttgaggaaggtaaactggtaaacaaatgtgcgttggactttttccgccaaatcaagcgtcactgcgccgagccgttcacagagtattggacttgcatagactatactgggcagcagctgttccgccattgtaggaagcagcaagccaagttcgacgagtgtgtgctggacaaactggggtgggttcgaccggatctgggtgaactgtctaaggtcacaaaagtcaagaccgacagacccctgcctgagaacccttatcactcgcggcccaggccggacccctctcccgagatcgaaggcgacctccagcccgcgactcatggctctaggttctatttctggaccaaatag

SEQ ID NO: 125725 - DNA, 387 bp, Artificial Sequence
  Description of Artificial Sequence: Synthetic coding sequence
atgcccggtattgtggagctgccgacgcttgaggaacttaaagttgatgaggtcaagatatcaagcgcagtgctgaaagccgccgcccaccattacggggcccagtgtgacaagccgaataaggagtttatgctgtgtaggtgggaggagaaagaccctagacgatgtctcgaagaggggaagttggtcaacaaatgtgcgcttgactttttccgacaaattaagcggcattgcgcagagccattcacagaatactggacatgtatcgactacaccggacagcagttatttcgtcattgtagaaaacagcaggccaagtttgatgagtgtgtccttgataagctgggttgggtgagacctgatttgggcgagctgagcaaaggctag

SEQ ID NO: 125726 - DNA, 1134 bp, Artificial Sequence
  Description of Artificial Sequence: Synthetic coding sequence
atggcagccgccgcgcagtcccgggtagtgcgcgtgctgtccatgagccgctccgcaatcaccgccattgcgaccagtgtctgccatggccctccatgcagacaactccaccacgctcttatgccccacgggaaaggaggaagaagttctgtgtcgggcatcgtagccacagtgttcggggctacagggttcttgggccggtacgtcgtgaaccaccttggtcgcatgggctctcaggtgataattccatacaggtgtgataaatacgatattatgcacctccggccaatgggggacctggggcagctgttatttctggaatgggatgcgcgggacaaggactccattaggcgcgtggtccagcacagtaatgtagtcattaatctcataggtcgggattgggagacaaaaaattttgatttcgaagacgtgttcgtgaagattccgcaggccattgcccaattgagtaaagaggcaggcgtggaaaagttcatccacgtgtcacacctgaacgccaatattaagagtagcagccgttacttaagaaacaaagcggtaggggaaaaggttgttagggacgcctttccggaagccattatcgtgaagcccagtgatattttcggcagggaagaccgtttcctcaattcatttgcaagtatgcataggtttgggcctattccacttgggagcctaggatggaagacagtgaagcagccggtctatgtggtcgatgtgtctaaaggcatagtgaatgctgtgaaagatccggacgctaatggcaagtcctttgcctttgtgggcccctccaggtacctactgttccacttagtcaagtatatttttgccgtagcccaccgcttatttctgccttttcctcttcccttgttcgcatatcgatgggtggccagggtgtttgagatctccccatttgagccctggataacccgagacaaagtggagaggatgcacattacagatatgaaactccctcatctgcccgggttggaggatctggggatccaggcgaccccactggaattaaaagcgatcgaggtactgcgccggcacagaacttataggtggctaagcgccgagattgaggatgtgaagcccgccaaaactgtaaatatttag

SEQ ID NO: 125727 - DNA, 984 bp, Artificial Sequence
  Description of Artificial Sequence: Synthetic coding sequence
atggccctagtgcacaagcttctgcgcggcacctatttcctgcgtaagtttagtaagcccaccagcgctctgtaccctttcctagggattagatttgcagaatactcatctagtctccagaagcccgtagcttcacctggcaaagcctcttctcagaggaagacagagggagacctgcagggggatcaccagaaggaggttgccctggacatcacttcatcagaggagaaacccgacgtgagcttcgacaaggccatccgtgacgaagcaatttaccatttccgtctgcttaaggacgagatcgtggaccattggcgtggccccgagggccatcccctgcatgaggttttgctggagcaagctaaggtagtctggcagtttaggggaaaagaggatctggataaatggacagttacttctgacaaaaccatcggcggccgctctgaggtttttttaaagatgggcaagaacaaccagtccgcgctcctgtacggtactctgtcatctgaagccccacaggatggagagtcaaccagaagcggctactgcgctatgataagccggattcctaggggagcctttgaacgaaaaatgtcctatgattggagccagtttaacacactctatctgagggtacggggagacggacgtccatggatggtaaatattaaggaagataccgacttcttccaacggaccaaccagatgtattcttattttatgtttacccggggcgggccctactggcaggaagtgaagatccccttctctaaatttttctttagcaacagaggaagaatcagagacgtccagcacgaactcccgctggataaaatttcttcaatcggttttacactcgccgacaaagtggatggaccgttctttctggagatcgactttatcggggtgtttaccgaccctgcacatacggaagagttcgcctatgaaaattctccagagctgaacccacgcttatttaagtag

SEQ ID NO: 125728 - DNA, 576 bp, Artificial Sequence
  Description of Artificial Sequence: Synthetic coding sequence
atggctcttgtgcacaagctcttgcgcggtacctatttcctgaggaaattctctaagccaacctccgctctgtatccctttctcgggatcaggtttgcggagtacagttcctcacttcaaaagcctgtggcctcccccgggaaggcctcatcccagcgcaagactgaaggtgaccttcagggagatcaccaaaaagaggtcgctctggatataacttcatccgaggagaagccagacgtaagctttgacaaggctatcagagacgaggcaatataccattttcgactcctcaaagacgagatcgtcgaccattggaggggccctgagggccaccctctgcacgaagtgcttctggagcaggccaaagtcgtctggcaattccgaggaaaagaagatctggacaaatggaccgtcacctcggataagaccattggaggaaggtcagaggtttttttgaagatgggcaagaataatcagtccgcacttttgtatggcaccctgtcttccgaagctccgcaggacggggaatcgaccaggagtggttactgtgctatgattagtaggattccccggtag

SEQ ID NO: 125729 - DNA, 630 bp, Artificial Sequence
  Description of Artificial Sequence: Synthetic coding sequence
atggccctggtgcacaaattgttacggggtacttatttccttcgaaagttctcaaagccgacttctgcgctgtacccgttcctgggcataaggttcgctgagtatagttcctctttgcagaagcccgtggctagccctggcaaggctagtagccagcgaaaaacggaaggcgacctccaaggcgaccaccagaaggaggtggccctggacattacttcttccgaggagaaacccgatgttagcttcgataaggcaattagggacgaggcaatctatcacttccgcctgttaaaagatgagattgtcgaccactggaggggcccggaggggcatcctctgcatgaggtcctcttggagcaggccaaggtcgtgtggcagtttcgaggtaaggaggacctggataaatggaccgttacatcggataaaacgataggtgggaggtctgaggtcttcctgaaaatggggaaaaacaaccaaagtgccctgctctacggcaccctgtcctccgaggccccacaggatggggaatccacaagatctggctattgcgctatgatcagccgcatcccgaggggagcttttgaaagaaaaatgagttacgactggtctcagtttaataccctgtattag

SEQ ID NO: 125730 - DNA, 510 bp, Artificial Sequence
  Description of Artificial Sequence: Synthetic coding sequence
atgggatggagccaggacctcttccgcgctttatggcgtagtttatctagggaggtcaaggaacatgtgggaacagatcaatttgggaacaagtactactatatcccccaatacaaaaactggagaggtcagactatccgcgagaaacggatcgtggaggctgcaaacaaaaaggaagtggattatgaagccggggacatccctaccgagtgggaagcatggataaggcggacgaggaaaacaccgcccacaatggaagagatcctcaagaacgagaaacatagagaggaaatcaagatcaagtcgcaggatttttacgagaaggagaagttactctcgaaggagaccagcgaggagctactgcccccccccgtgcaaacccagataaagggccatgcctcagccccttatttcggtaaggaggagcccagtgtcgcgccatctagtacaggaaagaccttccaacctggatcttggatgccccgggacggcaagtcacacaaccagtag

SEQ ID NO: 125731 - DNA, 384 bp, Artificial Sequence
  Description of Artificial Sequence: Synthetic coding sequence
atgtacatcgactcctacaattctcggggtttcatgatcaatggcaacagagtgcttggtccttgcgcgctgctgccacatagcgttgtgcaatggaacgtggggtcccatcaggatatcacagaagactctttctccctcttttggcttctggagccccgcatcgaaatcgtcgttgtgggtaccggagatagaacagaaaggctgcagtctcaggtcctccaggccatgcgtcaacgggggatagccgtggaagttcaggacacgcccaacgcatgtgcaacttttaacttcctgtgccacgaggggagggtcactggagcagccctcatcccaccccccgggggcacttcattaacttccctgggtcaggcggcgcagtag

SEQ ID NO: 125732 - DNA, 555 bp, Artificial Sequence
  Description of Artificial Sequence: Synthetic coding sequence
atggccactgccctggcacttcgaagcctctatagggcccggcctagcttgaggtgtccgcctgtggaactgccctgggcacctaggagaggacaccggctcagccctgccgatgacgaactctatcaacgcacccggatctctctcctccaaagggaggccgcgcaagctatgtatatcgattcttacaattctaggggctttatgattaacggtaatagagttctgggtccatgcgccctcttgccacacagcgtcgtccagtggaacgttggttcccatcaggacattacggaggactcttttagtttgttctggctgttagagcctcgcatcgaaatagttgtggtgggcaccggcgaccgaacagaaagactgcaatcccaggtgctgcaagctatgcgacaacggggaatcgcagtcgaggtgcaggatacccctaacgcctgcgctaccttcaacttcctttgtcacgagggtagagttacaggtgccgccctgatcccccccccgggaggaacgtctctgacatcattgggccaggcggcacagtag

SEQ ID NO: 125733 - DNA, 384 bp, Artificial Sequence
  Description of Artificial Sequence: Synthetic coding sequence
atgtatattgactcatataattctagaggttttatgatcaacgggaatagggtgcttggtccttgtgctttgctgccccattctgtcgtccaatggaacgtgggaagccaccaggatattacggaggatagtttttcactcttttggctactggagccacgcattgaaatcgtggttgtgggcactggtgataggacagaacggctccagtcacaggtactgcaagcaatgcggcagcgaggcattgctgtggaggttcaagatacccccaacgcatgcgccacgttcaacttcctgtgtcacgagggacgggtgaccggggccgcacttattccacctccaggagggaccagtcttaccagtcttggccaagcagcccagtag

SEQ ID NO: 125734 - DNA, 384 bp, Artificial Sequence
  Description of Artificial Sequence: Synthetic coding sequence
atgtacattgactcctataacagccgggggttcatgatcaatggaaatagagtgttgggcccgtgtgccttactccctcatagcgtagtacaatggaatgtggggtcccatcaagatataaccgaggatagcttcagtctcttctggctgttggagccccggattgaaatagtagtggtaggcactggagataggacagagcggctccagtcccaagtactgcaagcaatgcgacagaggggcatcgcggttgaagttcaagacaccccaaatgcatgcgctacctttaacttcctgtgccatgaaggccgagtgactggagcagctttgattcctccccctgggggcaccagcttgacttccttgggccaagccgctcagtag

SEQ ID NO: 125735 - DNA, 528 bp, Artificial Sequence
  Description of Artificial Sequence: Synthetic coding sequence
atgggagcattagtcatccgtggcataaggaactttaaccttgagaaccgtgcggaaagggagatatccaaaatgaaaccttctgtggctccgagacatccgagcaccaactcactgctgcgggagcagatttcactttatcccgaggtgaaaggtgaaatagcccggaaagacgagaaactgttgagctttctgaaggatgtctacgtcgactcaaaagatccagtgagttccctgcaggtgaaggctgctgagacttgtcaggaaccaaaggaatttagactgcccaaggaccatcattttgacatgattaacataaagagtattcccaagggtaaaatcagcatagttgaagccctgacccttcttaacaatcacaaactgtttcccgaaacatggaccgctgaaaaaatcatgcaagagtaccaactggagcagaaagacgtcaactccctccttaagtatttcgtcaccttcgaggttgagatctttccaccagaggacaaaaaggcgattcgctccaagtag

SEQ ID NO: 125736 - DNA, 519 bp, Artificial Sequence
  Description of Artificial Sequence: Synthetic coding sequence
atgcccgactcctgggacaaggatgtgtatcccgaacctcccagacggactcctgtgcaacccaacccaattgtttatatgatgaaagcttttgaccttatcgttgaccgcccggtaactctggtaagagaatttatcgaacgccagcacgccaagaatcggtattactactatcatcggcaataccgacgggttcccgacatcacggagtgcaaagaagaagatatcatgtgtatgtatgaggccgagatgcagtggaagcgagactacaaagtggaccaagagattattaatataatgcaggataggcttaaagcctgccagcaaagggagggccagaattatcagcagaactgtattaaggaggttgaacaatttacgcaggttgcgaaagcctatcaggatcggtaccaggacctgggggcctacagttccgccagaaagtgcttagctaagcagcggcagcgcatgttacaggagcgcaaggctgccaaggaggccgccgccgccaccagctag

SEQ ID NO: 125737 - DNA, 507 bp, Artificial Sequence
  Description of Artificial Sequence: Synthetic coding sequence
atgccagattcatgggacaaggacgtgtaccctgagcctcccaggagaacacctgtgcaacctaatcctatagtttatatgatgaaagcattcgatctcatcgtggaccggcccgttacattggtcagggagtttattgagcgccaacatgccaagaaccggtattattactatcaccgtcagtatcgccgcgtgccagatatcaccgaatgtaaggaggaagacatcatgtgcatgtacgaggcagagatgcagtggaagcgcgactacaaggtggaccaagaaatcatcaacattatgcaggatcgtctgaaggcctgtcaacagagagaagggcagaactaccagcaaaactgtattaaggaggttgagcagtttactcaggtggccaaagcctatcaggataggtgtgcttgcccgactcacccccagcctccgactatcttgctcagaccgggtgggcagaaccattgtaagtccagcctgccttcgttggttctgacctag

SEQ ID NO: 125738 - DNA, 492 bp, Artificial Sequence
  Description of Artificial Sequence: Synthetic coding sequence
atggccgcaggtctttttggactgagcgcgagacgccttctggccgcggccgcgacacgcggcctccccgccgctcgggttcgatgggaatcatccttttccagaactgtcgttgcaccttctgccgttgcaggcaagagaccacctgagccaaccacaccatggcaggaggatccagagcctgaggacgaaaacctatacgagaagaatccagacagtcatgggtatgataaggaccctgtgctcgacgtctggaacatgcggctcgtgttcttttttggcgtgtccattattctggttcttgggtccacgtttgtcgcgtatttaccagactatagatgcaccggttgtccaagggcttgggacggcatgaaggagtggagtagaagggaggccgaacggttggtgaagtaccgggaagctaacggcttacccatcatggaatcaaactgttttgacccctcgaagattcagctgccagaagacgagtag

SEQ ID NO: 125739 - DNA, 462 bp, Artificial Sequence
  Description of Artificial Sequence: Synthetic coding sequence
atggctgcaggtctttttggcctgtcagctaggcgcttgctggcagcggccgccaccagaggtctgccggccgctcgagtgagatgggagagttctttcagtcgcactgtggtagccccttccgcagttgcggggaagaggccgccggaacccaccactccttggcaggaggatccggaaccggaagatgagaatctgtacgagaagaatccggattcccatggctacgacaaggatcctgtgcttgacgtttggaacatgcggctcgtcttcttttttggtgtgtctataatcttggtcctaggctccacatttgtagcttacttacccgactaccgcatgaaggagtggtcccgccgggaggccgaacgccttgtgaagtatcgagaagcaaatgggctgcctattatggaatcaaactgctttgacccaagcaaaattcagctccccgaggatgaatag

SEQ ID NO: 125740 - DNA, 474 bp, Artificial Sequence
  Description of Artificial Sequence: Synthetic coding sequence
gcagcccccagcgtcatggctgcaggcctgtttggcttatccgccagaaggttgctggccgcacggaggcgcggactgcccgccgcccgcgtgcggtgggaatcctcctttagcaggacagtagttgctccctcagctgttgccggaaaaagaccacccgagcccaccaccccctggcaggaggaccctgaacccgaagatgagaacctttacgagaagaacccggactcccacggatatgacaaggatcctgtgctcgacgtctggaacatgcgcctagtgttctttttcggcgtttccatcattcttgtcttggggagcacatttgtcgcgtacctacccgattataggatgaaggaatggagccgtagagaggcggaacggctagtaaagtatagagaggctaatggcctaccaatcatggaatccaattgttttgatcccagcaagatccaactaccagaggacgaatag

SEQ ID NO: 125741 - DNA, 297 bp, Artificial Sequence
  Description of Artificial Sequence: Synthetic coding sequence
atggcccatgagcacggacacgagcacggacaccacaaaatggagttgcccgactaccggcagtggaaaatcgaaggtacccctctggaaaccatccaaaagaagctcgctgccaaggggctcagagacccctggggccgaaacgaggcttggagatacatgggagggttcgctaaatcagtctccttttcagacgtttttttcaaggggtttaagtggggatttgcagctttcgtggtcgcagtgggggcagagtactaccttgaatccctcaataaggacaagaagcaccattag

SEQ ID NO: 125742 - DNA, 297 bp, Artificial Sequence
  Description of Artificial Sequence: Synthetic coding sequence
atggcgcacgagcatgggcacgaacatgggcatcacaagatggagctgcccgattataggcagtggaagatcgagggtactcccctggaaactatccagaaaaagctggctgctaaaggcctgagggacccttggggacgaaatgaggcctggaggtatatgggcggcttcgctaagagtgtatctttcagtgacgtgttcttcaagggtttcaagtgggggttcgctgccttcgtcgtagcggtgggtgctgagtattatctcgagtctcttaataaggacaagaagcaccattag

SEQ ID NO: 125743 - DNA, 198 bp, Artificial Sequence
  Description of Artificial Sequence: Synthetic coding sequence
atggctcacgagcatgggcacgagcacgggcaccacaagatggagctgcctgactatcggcagtggaaaattgagggaacccccctggagaccatacagaagaagctagccgccaaaggcctcagggatccatgggggcgcaacgaagcatggcgctacatggggggctttgcaaaatccgtgtcattttctgattag

SEQ ID NO: 125744 - DNA, 297 bp, Artificial Sequence
  Description of Artificial Sequence: Synthetic coding sequence
atggcacacgagcatggccatgagcacggccaccataagatggagctccccgactatcgtcagtggaagatcgagggcactccattggagaccattcagaaaaagctggcagctaaggggctccgggacccttggggccggaacgaagcctggcgctacatgggtggcttcgctaaaagtgtgagcttcagcgatgtcttttttaagggtttcaaatggggatttgctgccttcgtggtagccgtaggggcagagtactatctagaatctttaaacaaagacaaaaagcaccactag

SEQ ID NO: 125745 - DNA, 741 bp, Artificial Sequence
  Description of Artificial Sequence: Synthetic coding sequence
atgactactggggattgttgccatcttcctggatcactttgtgactgcagcgggtcacccgcctttagtaaagtggttgaggccacgggactgggcccaccccaatatgttgcacaagtcacttcgagggacggccgcctcctttccacggttattcgcgctctggacacaccatccgacgggcccttttgccgcatctgccacgagggcgctaatggggagtgcctcctgagcccatgcggatgcacaggtactctcggcgcagtgcacaagtcttgtctggagaaatggctgtccagcagcaacacaagctattgtgagctgtgccacactgagttcgccgtggaaaaaagacctaggcccctgacggagtggctcaaggatcccgggcctcgaacagagaagcgtaccctttgctgcgatatggtctgcttcctttttataacccctttagccgcaatctcaggctggctttgcctacgtggcgcgcaggaccacctgcggttgcactcccaactcgaggctgtcggcctgattgcactgactatcgccctatttactatttacgtgctgtggacactcgtgtcatttaggtaccattgccaactgtattcagagtggcgcaaaacaaatcagaaggtgcgcctgaagatcagagaggccgactcccctgaggggccgcaacactctccgctggctgctgggctgcttaagaaggtggccgaagaaactccagtgtag

SEQ ID NO: 125746 - DNA, 561 bp, Artificial Sequence
  Description of Artificial Sequence: Synthetic coding sequence
atggccgtagctcgtgcgggggtcttgggggtgcaatggctccagcgagccagcaggaacgtcatgcctttaggcgctaggaccgccagccacatgacaaaagacatgtttccgggcccatatcccagaacacctgaggagcgggcggccgccgccaaaaaatacaacatgcgcgtcgaagactacgagccctaccctgatgatggcatgggctacggcgactatccgaaactcccagacagaagtcaacacgagcgggacccctggtacagttgggatcagcccggcctgagactgaactggggggagccaatgcactggcatctcgatatgtacaatagaaaccgggtggacacaagtcccactcctgtcagttggcacgtgatgtgcatgcagctcttcggatttctcgccttcatgatcttcatgtgctgggtcggcgatgtgtaccccgtttaccaacccgtggggcccaaacaatacccctataacaacctgtatcttgagcgtggaggcgatccctcaaaggaaccggagcgggttgtacactatgagatttag

SEQ ID NO: 125747 - DNA, 519 bp, Artificial Sequence
  Description of Artificial Sequence: Synthetic coding sequence
atggctgtggctcgtgctggggtgctgggagtgcagtggttgcagcgagccagccgtaatgttatgccactaggggcacgaactgcaagtcatatgaccaaggacatgtttccaggtccataccccagaactcctgaggagcgcgccgctgcagctaagaaatataatatgcgggttgaagattacgagccctaccctgatgatggcatggggtatggagactaccccaagctgcctgacagatcccagcatgagcgagacccctggtacagttgggatcagcctggactgcgccttaattggggcgaaccaatgcattggcatctagacatgtacaatcggaatcgtgtagatacttccccaacccccgtttcctggcacgttatgtgtatgcaactcttcggattcctggcctttatgattttcatgtgttgggtaggagacgtgtatcccgtgtatcagcccgtttgccgccatcatttctcatacaaccttggcttcttaagtgcactgggttag

SEQ ID NO: 125748 - DNA, 468 bp, Artificial Sequence
  Description of Artificial Sequence: Synthetic coding sequence
atgacgaaagacatgttccccggcccctatcctcgtacccctgaagaacgcgcggctgccgccaagaagtacaatatgcgggtcgaggattacgagccataccccgacgatggaatgggttatggtgattaccccaagcttcccgaccgtagccaacatgagcgcgatccctggtactcgtgggaccaacctggtctacgcctgaattggggcgagcccatgcattggcatctggacatgtacaaccgaaaccgcgtggacacaagtcccacacctgtttcgtggcacgtcatgtgcatgcagctgttcgggtttcttgcctttatgattttcatgtgctgggtaggcgatgtatacccggtgtaccagcctgtcggtccaaaacaatatccttacaataatctctatcttgagagggggggagaccccagcaaagagcccgaacgtgtcgtccactacgagatctag

SEQ ID NO: 125749 - DNA, 519 bp, Artificial Sequence
  Description of Artificial Sequence: Synthetic coding sequence
atggccgttgcaagggcgggggtccttggggtccagtggctgcagagggcgtcgcgaaacgtcatgcctctgggagccaggactgcaagtcacatgactaaggatatgtttcctggaccatatcctcggactcccgaagagagggccgcagctgcaaaaaagtataacatgcgggtggaggactacgagccatacccagatgatggcatgggatatggcgactatccgaaacttcccgaccggtcccaacacgaacgggatccctggtatagctgggaccagcctgggctgcgattaaactggggcgagcctatgcattggcacctagatatgtataacaggaacagggtggacaccagcccgacccctgtctcctggcatgtcatgtgcatgcagctcttcgggttcctcgccttcatgatctttatgtgctgggtcggcgatgtctaccccgtgtaccagcccgtgtgcagacatcacttttcttacaatctggggttcctgagcgccctcggctag

SEQ ID NO: 125750 - DNA, 540 bp, Artificial Sequence
  Description of Artificial Sequence: Synthetic coding sequence
atggcattcttggccagtggcccatatctgactcaccagcagaaggtgctacgactgtacaaacgagcacttcgccatcttgagtcctggtgcgtgcagcgggataaatacagatattttgcttgcttgatgagggcccggtttgaagagcacaaaaacgaaaaggatatggctaaggctacccagctgctgaaggaagccgaggaagaattttggtataggcagcatcctcaaccctacatcttccctgactctccaggaggcacttcctatgaaagatacgactgttacaaggtgcccgaatggtgtctcgatgactggcaccccagtgagaaggcaatgtaccccgactactttgcaaagcgggagcagtggaagaaacttcgcagagagtcatgggagcgagaagtaaagcaacttcaggaggagactccacccgggggtcctctgactgaggcattacctcctgccaggaaagaaggcgatctcccccctctatggtggtatattgtcacccgcccaagggagagacccatgtag

SEQ ID NO: 125751 - DNA, 471 bp, Artificial Sequence
  Description of Artificial Sequence: Synthetic coding sequence
atggcttctcgggtgctcagcgcctacgtgagccgattgcccgcggcctttgctccactgccgcgcgttagaatgttagctgtcgcccggcccctaagtacagctttgtgcagcgcaggaacgcagacgagactaggaacgcttcagcctgcacttgtcctggcacaggtccccggcagagtgacacagctgtgccggcagtattctgacatgcctcctctgacactggaagggatccaagaccgggtgctttacgtgctgaagctgtacgacaagattgatcctgaaaagcttagcgtgaattctcacttcatgaaggacttaggattagattcccttgatcaggtcgagatcataatggcaatggaagacgagttcgggttcgaaattcccgacattgatgccgaaaagctaatgtgccctcaggaaatagtcgattacattgccgacaagaaagacgtctacgagtag

SEQ ID NO: 125752 - DNA, 231 bp, Artificial Sequence
  Description of Artificial Sequence: Synthetic coding sequence
atggccccctcagccctgctgagacctctaagtcggcttctggcccccgcaaggctcccttccgggccttcagttagatctaagttttatgtcagagaaccacccaatgccaaacctgattggctgaaagttggtttcaccctcgggacaaccgtgtttttgtggatttaccttataaaacagcataatgaggatatcctggaatataagcgcagaaatggcctggagtag

SEQ ID NO: 125753 - DNA, 231 bp, Artificial Sequence
  Description of Artificial Sequence: Synthetic coding sequence
atggccccctctgcattgctccgaccgctatctaggctgctggcccctgcgaggctcccttcagggccgagcgttaggtccaagttctacgttagggagccaccaaacgccaagcccgactggttgaaggtgggttttacgctcggaaccacggtgttcttgtggatctacttaatcaaacagcataacgaagatatcctggaatataaacgtcgcaatggcctggaatag

SEQ ID NO: 125754 - DNA, 231 bp, Artificial Sequence
  Description of Artificial Sequence: Synthetic coding sequence
atggcaccctctgccctcttgagaccactgtccagactattggcaccggcccgactgcctagtggaccctctgtcagatctaagttctatgtgagggaaccgcccaatgccaaaccagattggctcaaggtgggcttcacactgggcactacagtgttcttgtggatatacctcatcaagcagcacaatgaggatatccttgagtacaaacgaagaaacggacttgaatag

SEQ ID NO: 125755 - DNA, 231 bp, Artificial Sequence
  Description of Artificial Sequence: Synthetic coding sequence
atggccccatcggccttgttacgccccctgtcacgactgttagcaccagcccggttgcctagcggccccagtgtccggtccaagttttacgtacgcgaaccccccaacgcaaaaccggattggctgaaggtgggatttaccctagggactacagtctttttatggatctatctgatcaaacaacataatgaagacatcttggaatataaacgcaggaatggtctggaatag

SEQ ID NO: 125756 - DNA, 231 bp, Artificial Sequence
  Description of Artificial Sequence: Synthetic coding sequence
atggctcccagtgccctccttagaccactgtctcggcttctggccccggcaagattaccgagcgggcctagcgtgcgatcgaaattttacgtgagagaaccccctaacgctaagccagactggttaaaggtaggatttaccctaggtaccacagtgtttctctggatctacctgatcaagcagcataacgaggacatcttagagtacaagagacggaatgggctggaatag

SEQ ID NO: 125757 - DNA, 231 bp, Artificial Sequence
  Description of Artificial Sequence: Synthetic coding sequence
atggcaccctcagcccttctaaggccgctctcgcgactcctggcccctgcacggctcccctctggcccttccgtgagatccaaattttacgtaagagagccgcctaatgcaaaacccgattggctgaaggtggggtttacactggggacaactgtgttcttgtggatctacctgattaagcagcacaacgaagatattctcgaatataaacgcaggaacggacttgaatag

SEQ ID NO: 125758 - DNA, 231 bp, Artificial Sequence
  Description of Artificial Sequence: Synthetic coding sequence
atggcacccagcgcccttttacgacccctgtcacggctgctagcccccgctcgcctaccaagtggaccttctgtgcggagcaaattttacgtgagagagcctcccaacgccaaacccgattggctgaaagtagggtttacattaggcaccactgtcttcctttggatttatcttattaagcaacataacgaagacattctggaatataagaggcggaatgggctcgaatag

SEQ ID NO: 125759 - DNA, 231 bp, Artificial Sequence
  Description of Artificial Sequence: Synthetic coding sequence
atggccccaagcgcgctgctccgcccactgagcagattactagcaccggcaaggctaccctcagggccgtcagttaggagcaaattttatgtacgcgagccccctaatgctaagccggactggctaaaggtgggcttcacactgggaactaccgtctttctgtggatttaccttatcaaacagcacaacgaagatatcttagagtacaagcggcgaaatgggttggagtag

SEQ ID NO: 125760 - DNA, 915 bp, Artificial Sequence
  Description of Artificial Sequence: Synthetic coding sequence
atgatctacacaatgaaaaaggtccatgccctctgggcaagcgtttgtctacttctcaacctcgcccctgcccctttgaacgccgacagcgaagaggacgaagagcataccataatcaccgacaccgagcttcctcctctcaaactgatgcatagcttttgtgcattcaaagctgatgatgggccatgcaaggctataatgaagcgctttttttttaatatctttactcggcaatgcgaggagtttatttatggaggatgcgaaggcaatcaaaatcgctttgagtcactcgaggagtgcaagaagatgtgtaccagggataatgctaaccgaatcatcaaaaccacgctgcagcaagagaagcctgatttttgtttcctggaggaagaccctggcatttgccgcgggtacattacgcgatatttctacaacaatcaaaccaaacagtgcgagaggttcaagtacggtggatgtctgggcaacatgaacaatttcgagaccctcgaggagtgcaaaaatatctgtgaagacgggccaaacgggttccaggttgacaattatggcactcagctcaacgctgtgaataactctttgaccccacaaagtactaaagtcccatccttattcgaatttcacgggccgtcctggtgcttaactcccgcagatcggggcctctgtagggccaatgagaaccgcttctactacaacagtgttataggtaagtgtcggccattcaagtactccggatgcggaggcaacgagaacaacttcacgtccaagcaagaatgtttgcgcgcctgcaagaaggggttcatacagaggatctctaagggaggactgatcaagactaaacgtaagagaaagaaacagcgcgttaagattgcgtacgaagaaatcttcgtcaaaaacatgtag

SEQ ID NO: 125761 - DNA, 2013 bp, Artificial Sequence
  Description of Artificial Sequence: Synthetic coding sequence
atgcaaattcctagattttgctaccatgagagactgtccgtggccggcaattgtaggatgtgtctggtggaaatcgagaaagccccaaaagtggtggcagcctgtgcaatgcccgtgatgaaaggatggaacattctgacaaactctgagaaaagcaaaaaggcgagggaaggcgtgatggaatttttactcgctaatcaccccctggattgtcctatctgtgaccaaggcggcgagtgtgaccttcaagaccagtcgatgatgttcgggaatgatcggtctcggtttctggaaggtaaacgggccgtcgaggataaaaatatcggcccactggtgaagacgataatgacacgatgtattcagtgtacccgatgcatccgattcgcaagcgagattgctggggtggacgatctgggaaccaccgggcgaggcaatgacatgcaggtgggcacgtacatagagaaaatgttcatgagtgagctgtccgggaacattatcgatatctgccccgtgggggctttgacatcaaagccatatgcctttaccgcacgcccttgggagacaaggaagactgagtctatagatgtcatggatgccgtagggtctaatatcgtcgttagtacaaggaccggcgaagttatgcgaatcctcccacggatgcatgaggatatcaatgaggaatggatcagcgacaagacccgctttgcctatgatggattgaaaaggcagcgactaacagaacctatggtgcggaatgaaaagggcctgcttacatacacatcttgggaggacgccctgagcagggtcgccggcatgctccagagtttccaaggaaaagacgtcgccgctatcgccgggggcttagtggacgcagaagccttggtcgcactaaaagatctcctgaaccgtgtcgacagtgatactctgtgcacggaggaggtctttcctaccgctggtgccgggactgacttgcggtcgaactatcttttgaataccacaatcgccggagtggaagaggccgatgtggtgcttcttgtggggacaaaccctaggtttgaggcaccgctctttaacgccaggattcgaaagagttggttgcacaacgacctcaaagtcgcactgatcggatcgcccgttgatctaacatacacctacgaccacctgggggatagtcctaagatcctgcaggacatagcttctggctctcatcctttttcacaggtactgaaggaagcaaaaaaaccaatggtcgtcctcgggtcgtcagctcttcagagaaatgacggggctgcaatcctcgctgctgtgtcttccattgcccagaagataaggatgacgtccggggtgactggagactggaaggtaatgaacattttacatcgcattgcctcccaagtggccgcccttgatctggggtataagcccggagtggaggcaattcggaagaatccgcctaaggtgttgttcctcttgggcgcagacggagggtgcattacgcgacaagatcttcccaaagactgtttcataatttatcaaggccatcacggcgacgtgggcgctccaattgcagacgtgatccttccaggagctgcgtataccgagaagagcgctacttatgtgaatacagaaggccgagcacaacaaaccaaagtggcagtcaccccacctggactcgcccgggaagactggaagatcattagagcgctgtctgagattgccgggatgaccctcccttatgacacccttgatcaagtgcgcaacaggctggaggaagtaagccctaatctcgtgaggtacgacgacatagaaggggctaactatttccagcaggctaacgaactgagcaagctggtaaatcagcagctgctggcagacccacttgtgccaccacagctaaccattaaggacttttatatgacggatagtatcagcagggcgagtcagaccatggcaaagtgtgtgaaggctgtgactgaaggggcccaggcagtggaagagcctagtatctgctag

SEQ ID NO: 125762 - DNA, 1851 bp, Artificial Sequence
  Description of Artificial Sequence: Synthetic coding sequence
atgtgggaaggcgtgatggaatttctgctggcaaaccaccccttagattgtcctatctgcgatcagggcggcgaatgtgacctccaggaccagagcatgatgtttggaaatgacagatcgcgctttttggaaggtaagagagcagtagaagacaaaaatataggcccgttagtgaagaccattatgaccaggtgtatccagtgtacccgctgcattcgtttcgctagcgagatagccggcgtagatgatcttggtactaccgggagaggcaacgatatgcaagttggtacgtacatcgaaaagatgtttatgtcagagctctctggcaatatcatcgatatttgtccagtcggggcgctgacctctaagccctacgcctttactgcccgcccctgggagaccagaaaaaccgaatcaatcgatgtaatggacgctgttggaagtaacatcgtggttagtaccaggaccggcgaagtgatgcgtatcctcccacggatgcacgaggatatcaatgaagagtggatttccgataagacccgattcgcttacgacggactgaaaaggcagagactgacggagccaatggttaggaacgagaaaggcctgctgacctatacctcctgggaggacgccctgtctagagtggctggaatgctgcagagttttcagggcaaggatgtggccgcgattgccggtgggctggtggacgcagaagctttagttgcacttaaagacctgctaaatagagtagatagcgataccttgtgtacagaagaagtctttcccacagcaggcgccggcaccgacctgcggagtaattacctcctgaatactacgatagccggcgtcgaagaagcggatgtcgttctactcgttggtactaaccctcggtttgaggcccccctgttcaacgctcgcatccggaaatcttggttacataatgatctgaaggtggccctgattggctctccagtggatctgacatacacttatgatcacctaggggactcccctaaaatcttacaggacatagcctccggtagccacccgttctctcaggtgctgaaagaggccaagaagcctatggtggtcctgggatcctccgcgcttcagcggaacgacggggccgcgattctggcggccgtatccagcatcgcccagaagatccggatgacatccggggttaccggcgactggaaagtcatgaacatactgcatagaattgcaagtcaggtcgccgcattggatctcggctacaaacccggagtagaagctatccgcaagaaccctcccaaagttctcttcctcctgggtgcggacggcggatgcatcacccgccaggatttgcccaaagactgctttatcatttaccagggtcaccacggtgacgtgggcgcccccatcgccgacgttatcctaccgggcgctgcctatacagagaaaagtgctacatatgtcaatactgagggccgagcacagcaaactaaagtggcagttactccacccggactggctcgcgaggattggaagatcatccgggcattatcggagatcgcagggatgacgctgccttatgacacactcgaccaggtaaggaaccgtctagaagaggtctctcctaacctggttcgctacgacgatatagagggagccaactacttccaacaggctaatgagttgtccaaactggtgaatcagcaactactcgctgacccactggtaccacctcaactaaccatcaaagacttttatatgacagactcgatatcgcgcgcaagtcagactatggctaaatgtgtgaaagccgtcacggagggcgcccaggccgtggaggagccaagcatctgctag

SEQ ID NO: 125763 - DNA, 2076 bp, Artificial Sequence
  Description of Artificial Sequence: Synthetic coding sequence
atgctccggatccctgttcgtaaggctctggtggggctgagcaagtcgccaaaaggttgtgttcggacaaccgccactgcagcgagcaacttaattgaagtttttgtggatgggcaatctgtgatggtggagcccggcacgaccgtactgcaggttgtggcagcttgcgcaatgccagtgatgaagggatggaacatattaaccaacagcgagaagtctaaaaaggccagagagggtgttatggagttccttttggccaaccatcctctcgattgccccatatgcgatcagggcggagaatgtgatcttcaggatcagagtatgatgtttggtaacgaccgctcgcgctttttggagggaaaacgggctgttgaggacaaaaacataggccccctggtaaaaacgataatgacaaggtgtatccagtgtactcgatgcatacgctttgcatctgaaatagcaggcgtcgatgatctggggacgacgggtaggggcaatgatatgcaagtgggtacttacattgagaagatgtttatgagcgaattgtctggtaacatcatagacatttgccccgtcggcgccctaacttcaaagccctacgcctttacagccagaccatgggaaactaggaagactgaatcaatcgatgtgatggacgctgtcggctctaacatcgttgtctcaactaggaccggcgaagtgatgcggatactcccacgcatgcacgaggacatcaacgaggagtggattagcgataaaactagattcgcatatgacgggctcaagcgtcaacgactaaccgaaccgatggtccgcaacgaaaaagggctcctaacttacactagctgggaggatgctcttagcagggtggccggtatgctgcaatctttccaaggcaaagacgttgcggcaattgctggcgggttggtcgatgcagaagccctcgtggctctgaaggacttactcaaccgtgtcgatagcgacacgctatgcactgaggaagtatttcctaccgcaggtgccggaactgacctgcgatccaactacctcctgaataccaccattgctggagtggaggaggctgatgtcgtgctgttggtggggacaaacccccgctttgaggccccgctgtttaacgccaggatcaggaaatcttggttacacaacgatctaaaggttgccctgatcgggagcccggtggatctcacctatacctacgatcatcttggtgactcccctaagatccttcaagatattgcaagcgggagtcaccctttctctcaggttctgaaagaggctaagaaacctatggtggtgcttggtagcagtgccctgcaaagaaatgacggtgcggccatcctggccgctgttagctccattgcccagaaaattcggatgacatcgggagtgaccggcgactggaaagtcatgaacatcctgcaccgaattgcgagccaggtggctgccttagacctgggttacaaacctggagtagaggcgataagaaagaacccccccaaggtgttattcctcctgggagccgacggtggctgcattacccgccaggacctgccgaaagattgtttcatcatctaccagggccaccatggagatgtcggggcccccatcgcagatgtaatcctccccggggcggcctacaccgagaaaagcgctacgtacgtgaacaccgagggacgcgctcagcaaacaaaggtcgccgttacccccccgggtctggctagagaggactggaaaatcatccgtgcactttccgagattgccggaatgactctgccatacgacacactcgatcaggtcagaaacagactggaggaggtgtcacctaatctggtccggtacgacgatatcgagggggctaattattttcagcaggccaatgagctgtccaagctagtgaaccagcagctgctcgcagatcctctagttccaccccagttgaccattaaggacttctacatgactgattccatctccagagcatcgcagaccatggcgaaatgtgtcaaagccgttaccgagggagcacaggccgtcgaagagccttctatctgctag

SEQ ID NO: 125764 - DNA, 2184 bp, Artificial Sequence
  Description of Artificial Sequence: Synthetic coding sequence
atgttaagaatccctgtccgcaaggccctcgtgggcctgtccaagtcccctaaggggtgtgtaagaacaaccgctacagctgcgagcaatctaattgaagtcttcgtggatgggcagtctgtaatggtggaaccaggaacaaccgtgctgcaagcatgtgagaaagtcggcatgcagataccaaggttttgttaccatgaaagactgtccgtggccgggaattgtcggatgtgcctggttgagatcgagaaagctcccaaggtggtcgctgcatgcgcaatgcctgtgatgaaaggctggaacatcctgaccaacagcgaaaagtccaaaaaggcccgtgaaggggtgatggagttcttactagccaaccaccccctcgactgtccaatatgcgatcagggcggcgagtgcgacctgcaagaccagtcaatgatgtttggtaacgaccggtccaggtttttagaaggtaaaagagcagtcgaagataagaatattggtcctctggtaaaaactatcatgactagatgcattcagtgcacccgttgcatcaggtttgcttcggagatagccggcgtagacgacctgggcacaactgggcggggtaatgacatgcaagtgggtacctacatcgagaaaatgttcatgtccgaattgagcgggaacatcattgacatctgccctgttggggccctaacgtccaaaccttacgctttcaccgcccgtccttgggagactcgaaagacagaatccatcgacgtaatggacgcagttggatccaacattgtcgtgtcaacccggacaggtgaggtgatgcgaattctacctcggatgcacgaagacattaatgaagagtggatatccgataaaacgcgatttgcgtacgacgggctgaagagacaacggcttaccgagcccatggtccgaaatgagaagggcctgctgacctatacctcatgggaggatgccctgagtcgggtagccgggatgctacagtcttttcaaggaaaagacgtggcagccatcgctggtgggctggtcgatgccgaggctctggtcgcattaaaggacttactcaatcgggtggacagcgatacactgtgcaccgaggaagtattcccaactgcaggggccggcacagacctgagatccaactacctgctcaatactaccatcgcaggagtggaagaggcggacgtcgttctcttggtagggactaaccctcggtttgaggctcctctgtttaacgctcgtattaggaaaagctggctccacaatgacctgaaggtcgcacttattggttcaccagtcgatctcacctatacttatgaccatcttggggactcacctaagatactccaggacatcgcatctggaagccatccattctctcaagttctgaaggaggctaagaagcctatggtagtcctgggatcaagcgcattgcagagaaacgatggtgcagctatcctcgccgccgtgagctcaattgcacagaagatccgcatgacaagcggggtcacaggagattggaaggtaatgaatatcctgcaccgcatcgcctcacaggtggcggctttagatttgggatataaaccaggggtagaggctattcgcaagaacccaccaaaagtcctctttctgcttggggccgacgggggatgcattacaagacaggacctgcccaaagactgcttcatcatataccagggccatcacggtgatgtcggggcacctattgcagacgtgatcctgccaggggccgcttacaccgagaaatcagctacttacgtaaacactgaaggcagagcacaacaaacaaaggtggcagtgactccgcctggcctggctagagaagactggaaaattattcgcgccctgagcgaaatagccggcatgactcttccctacgataccctggaccaggtgcgcaaccgacttgaagaggtaagcccaaatctggtgcgttacgacgatatagagggagccaactatttccagcaggcaaatgaactgtctaaactcgtaaatcagcagttactcgcagaccccctggtgccgccccagcttacaatcaaagacttttatatgacagacagtattagcagggccagccagaccatggccaagtgcgtgaaagccgtcactgaaggcgcccaggctgtggaagaaccgtctatatgctag

SEQ ID NO: 125765 - DNA, 393 bp, Artificial Sequence
  Description of Artificial Sequence: Synthetic coding sequence
atgctcaggattcccgtgaggaaggctctcgttggcctgtccaaatcgccaaaaggatgtgtccggaccactgcaaccgccgccagtaacctaattgaagttttcgtcgatggacagtctgtcatggtggaaccgggcactacagtgctgcaggcgtgtgaaaaggtcggcatgcagattccacgattttgctaccatgaacggctctccgtggcgggcaactgccgcatgtgtctggtggaaatagagaaagcacctaaggtggtggctgcctgcgcgatgcccgtcatgaagggatggaacatcctgactaacagtgaaaagtcaaagaaagcgcgcgagggcgtcatggaattcttactggccaatcatcctcttgactgcccaatttag

SEQ ID NO: 125766 - DNA, 2226 bp, Artificial Sequence
  Description of Artificial Sequence: Synthetic coding sequence
atgagaatcagggggagcagtggaaccctgagccggattaacatgctgcgaattcccgtgagaaaggcactagtgggactctccaagtccccgaaggggtgtgttcggaccacagccacagctgccagtaacttgatagaggttttcgtggatggccagtcagtcatggttgaaccagggaccacagtgctccaagcatgcgagaaggtgggaatgcagatccctcggttctgttatcacgagaggctgtcagtggccggcaattgccggatgtgtctggtcgagattgaaaaggccccaaaagtggtcgctgcatgcgctatgccagttatgaaaggctggaatattctcacgaattctgaaaaatctaagaaggctcgggagggcgtcatggagttcctgctcgctaaccatccactcgattgcccaatttgcgaccagggtggcgagtgcgacttacaggatcagtcaatgatgtttgggaacgacagaagtcgattcttggaaggtaaacgagccgtcgaggataagaacatcggacctttggtgaagacaatcatgactcgctgcatacagtgcacccgctgcatccgatttgcttccgaaatcgccggagtggatgatttagggaccacaggcagaggcaacgacatgcaggtggggacgtacatcgaaaaaatgttcatgtctgagttaagcgggaacatcattgacatttgtcctgtgggggctctgacctctaagccatacgctttcacagcccgcccatgggagaccaggaagactgagtcaatcgatgttatggacgcagtgggaagtaacattgttgtgtccacccggactggtgaggtcatgcggatcttgccaagaatgcatgaagacattaacgaagagtggatctctgacaagacacggttcgcgtacgatggactgaagagacagaggcttaccgagccaatggtccggaatgagaaggggctgctcacatacacatcctgggaggatgccctaagccgagtcgccggcatgctgcagagcttccagggtaaagatgttgctgcaatagcgggaggcttggtcgacgcagaagctctggtggctttgaaggacctgctgaaccgagttgactcagatacactctgcacggaggaggtctttcccaccgccggggccggaactgatctgcgctctaactatctgttgaataccaccatcgctggggtcgaggaagccgatgtggttctgctagttggaacaaatccacgttttgaagcgcctctcttcaatgctaggatccggaaatcttggttgcacaatgatctgaaagtggctctgatcgggagtccagttgacctaacatatacttacgaccacctgggagactcaccgaaaatccttcaggatatagccagtgggtcccatcctttttcccaggtccttaaggaagcaaagaaaccaatggtagtcctggggagttccgccctccagcgaaatgacggagctgcaatactcgcggcagtcagctctatcgcacagaaaattaggatgacatccggcgttactggcgattggaaggtcatgaacatcctacaccggattgcaagccaagtggcggccctggaccttggctataagcccggagttgaagctatcaggaaaaatccgccaaaggtccttttcctgctgggggcagatggggggtgcattacccggcaggatttgcccaaggattgtttcatcatctaccagggccaccacggggacgtgggcgctcccattgctgatgtcatcctgcctggggccgcttataccgagaagagtgctacctatgtcaatactgaaggtagggctcaacaaaccaaagttgctgtgaccccccctggcctcgcccgtgaagactggaaaatcattcgagccctgagtgagatagccggcatgacacttccctacgataccctggatcaagtccgcaatcgactggaagaggtgagcccgaacctggtacggtatgacgacatcgagggggcgaactactttcagcaagccaatgagctctcaaagcttgtgaaccagcaattgctggctgaccccttggtacccccacaactaactataaaggatttctacatgactgactccattagtcgagctagtcaaactatggcaaaatgtgttaaagctgtcaccgaaggtgcccaagccgtggaagagcccagtatctgttag

SEQ ID NO: 125767 - DNA, 1836 bp, Artificial Sequence
  Description of Artificial Sequence: Synthetic coding sequence
atggaatttttgctagcgaaccatcccctagattgtcccatctgcgatcagggcggtgaatgcgatttgcaggatcagtccatgatgtttggtaatgacaggtcgcgcttcctcgaaggcaaacgggcagtggaagataagaatattgggcccctcgtgaaaaccatcatgacccgctgcattcagtgcacacgatgcattcggtttgcaagtgagatcgcaggcgtcgatgaccttggaactaccgggaggggcaacgatatgcaggtgggtacctacatagagaagatgtttatgagcgaattgagtggcaacattattgatatctgccccgtcggcgcgcttacttccaaaccttacgctttcacagccaggccgtgggagaccaggaagacggaatctatcgatgtcatggatgccgtcggctctaacatcgtggtttctacaagaaccggagaagttatgcgcattctcccacggatgcacgaagacattaacgaggagtggatcagcgataagacacggtttgcctatgatggtctcaagcgccagagactcacggaaccgatggtgagaaatgaaaagggtttactgacatatacgagctgggaagatgctctgagccgggtggccggcatgcttcagtctttccagggcaaagacgtggccgccatcgccggggggttggtagacgcagaggccctggttgctctgaaggatctcttgaaccgcgtggacagcgacacactgtgcaccgaagaagtgttccctaccgctggggctgggaccgacctccgaagtaactacctgctcaatacaactattgctggcgtcgaggaggccgacgtagtgttgctcgtcggaactaatccgcgcttcgaagcccctctctttaatgcccgtatccggaagtcgtggctgcacaacgatctaaaggtagctctgatcggttcccccgttgacctcacttatacctatgaccacctcggagattcccctaaaattttgcaggatatcgccagcggaagccatcctttcagccaggttctaaaggaagcgaagaagccaatggtggtccttgggagttccgctttgcagagaaacgatggagctgcaattctggcggccgtgtcatcaatagctcagaaaattagaatgacgtccggtgtcactggggattggaaggtgatgaacatcctccatcgcatcgcaagccaagtagctgcacttgaccttggttataaacctggagtcgaggcaattcggaaaaatcctccaaaggtgctcttccttctgggggctgacggcggatgtataacacgtcaagacctgcccaaagactgtttcatcatctatcagggccaccacggcgacgtgggtgcgccaattgcagatgttattttgcctggggccgcctatacagagaaatctgccacttacgtaaatacagaagggcgggcacagcagacaaaagtggcagtgacaccccccggcctggctcgcgaggattggaagataatcagggctctgagcgaaattgccggtatgaccctgccctatgacaccttggaccaggtccggaatcgcttagaggaggtatctccaaacctggtgagatatgacgatattgaaggagcgaactatttccaacaagctaacgagctatccaagttggtgaatcagcagcttcttgcagatcctcttgtgcctccacagctcacgatcaaagatttttacatgactgactcaatctctcgggcatctcagacaatggccaaatgtgttaaggccgtaacggaaggagcacaggccgtggaggaaccaagcatctgctag

SEQ ID NO: 125768 - DNA, 1392 bp, Artificial Sequence
  Description of Artificial Sequence: Synthetic coding sequence
atggcagctctaagagccctgtgtggcttcagaggagtggccgcccaggtcctccgccctggggccggcgttaggctgccaattcagccaagccgaggtgtgagacagtggcagcccgatgtagaatgggctcagcagttcggtggagccgtgatgtacccttctaaagagaccgcccattggaaaccaccgccttggaatgatgtggatccccccaaagacactattgtcaaaaatatcaccctcaactttggtccgcaacaccccgctgcccatggggtcctgaggctggtgatggagctatccggagagatggtccgaaaatgtgatccacacatcggcctgctacatcgtgggactgaaaagttaatagagtacaaaacttacctccaggctctcccatacttcgacaggctagactatgtctcgatgatgtgtaatgaacaggcttactcccttgcagtggaaaaactgctcaacatcagacccccccctagggcacagtggattcgggtgctattcggggaaattacgcgtctgctcaatcatataatggctgttacgactcatgccctggatctcggagccatgacccccttcttttggctgttcgaggagcgcgaaaaaatgttcgagttctatgaaagagtgtctggcgcccgtatgcacgccgcatatatacgccctgggggggtacatcaggacctacctctgggccttatggacgatatctatcagttttcaaaaaatttttccctgcgactggatgagctggaggaacttcttaccaataatagaatctggcgaaacagaaccattgacattggagttgtcaccgctgaggaggcgctgaattatggcttcagtggcgtcatgctgcgcggcagcggaatccagtgggacctgagaaagacccaaccctacgacgtgtacgatcaggtggaatttgatgtccccgttggcagccggggagactgctatgatcgctacctatgcagggttgaagaaatgcgacagagtctcagaatcattgcccaatgcctgaacaagatgccacctggcgaaattaaagtggacgatgcgaaagtgtcaccacctaaaagagccgagatgaagaccagcatggagtccctcattcaccacttcaaattatatacagagggctatcaagtccctcctggggctacttacaccgctattgaggcccctaagggcgagttcggggtgtatttggtttcagatggaagttcgcgcccctataggtgcaagatcaaggcacccggctttgcccatctggccgggctggataaaatgagcaaaggacatatgctggcggatgtcgtggccattatcggaacccaggacatcgtgttcggagaagttgataggtag

SEQ ID NO: 125769 - DNA, 1374 bp, Artificial Sequence
  Description of Artificial Sequence: Synthetic coding sequence
atggctgcactgcgcgccctgtgtgggtttaggggtgtcgctgcacaagtgctcagacctggggccggcgtgcgactgcctatacagccttctcgcggtgtccgccagtggcagccggatgtagaatgggctcagcaattcggtggggcggtgatgtatccatccaaagaaacagcacactggaaaccaccaccctggaacgacgtagaccctccaaaagatacaattgttaagaacatcactctaaattttggtccacaacacccggccgcccatggcgtgctccgtctggtcatggagctctctggcgaaatggtgcgcaagtgcgatccacatatcggcttgctgcatagggggacggagaagctgattgagtataaaacatacctgcaggctctcccttatttcgaccgattggattacgtgtctatgatgtgcaacgagcaagcctactcattggccgtcgaaaaactcctgaatatacggcctcccccacgcgctcagtggatcagagtgctatttggggagatcacccgccttttaaatcacatcatggcggttaccacccacgcgctcgatttaggagcaatgacgccgttcttctggctgttcgaggagagggagaaaatgtttgagttttatgaaagggtcagcggagcccggatgcacgctgcctacatccggccaggcggcgtgcatcaggatctccccctcgggctcatggacgacatataccagttttcaaaaaacttttctctgcggctggacgaactcgaggagcttctgacaaataaccggatttggcggaaccgtactattgacattggagtggttacggctgaagaggctctaaattacggtttttcgggcgttatgttgagagggtctggcatccagtgggatctcagaaaaacccaaccatatgacgtgtatgatcaggtggagtttgacgtccctgtcggcagccggggagattgctatgacaggtatctttgtcgcgtcgaagagatgagacagagcctgcgcatcatcgcacaatgcctgaataaaatgcctccaggcgaaattaaggtcgacgacgccaaggttagtcccccgaaaagggccgagatgaagacaagtatggaatcgctcatccaccacttcaaactgtacaccgagggctatcaggtgccccccggtgccacttacacagcgatcgaagcgccaaagggcgagtttggagtttatctcgtctcagacggatcgtccagaccctatcgttgtaagatcaaagcacccgggttcgcccatctggccggcctggacaagatgtccaaagggcatatgctcgcagatgtggtcgctatcatcgggactagacccattgtttag

SEQ ID NO: 125770 - DNA, 696 bp, Artificial Sequence
  Description of Artificial Sequence: Synthetic coding sequence
atggaactctctggcgaaatggtgcgtaaatgtgaccctcacattggtctgcttcacaggggtaccgagaaacttattgagtacaagacctacctgcaggcccttccatactttgacagactagattacgtctctatgatgtgtaacgaacaagcttactctttagccgtggagaaactgctcaacataagacctccacccagagctcagtggataagggttttgttcggcgagattactcgtctgctcaatcacattatggccgtcacaacccatgctctggatttgggtgctatgactcctttcttctggctgttcgaagagcgagaaaaaatgtttgaattctacgagagagttagcggcgcccgcatgcatgctgcatacatcagacccggaggggtccaccaggatctccccctggggctgatggatgatatttatcagttcagcaagaatttctccctacgcctcgacgaactcgaagagttactgactaacaaccggatctggagaaaccgtactattgacatcggggtcgtgaccgctgaagaggcactgaattacgggttctccggcgtgatgttaaggggaagcggtattcaatgggacctgcgcaaaacccaaccatatgatgtgtacgatcaggttgagtttgatgtccccgtcggttccagaggggactgctacgatcggtag

SEQ ID NO: 125771 - DNA, 162 bp, Artificial Sequence
  Description of Artificial Sequence: Synthetic coding sequence
atgttcgagttctacgagcgggtgagtggggctcggatgcatgccgcttacatacgccccggaggggtgcaccaagacctgcctctgggcctcatggacgatatctaccagttcagcaagaatttcagtctgaggttagacgagctggaggaggtttcttag

SEQ ID NO: 125772 - DNA, 795 bp, Artificial Sequence
  Description of Artificial Sequence: Synthetic coding sequence
atggctgccgcagcggtggcacggctgtggtggcgcggcatactgggagcctctgccctcacaagagggaccggccgcccttctgtgcttcttctcccagtaaggagagagagcgcaggggccgatacacgccccactgtacgaccgcggaatgacgtggctcacaaacaactgagcgcatttggcgagtatgtcgcagagatactgcccaagtacgtccaacaggtccaagtgagctgtttcaatgagctcgaggtttgtatccatcccgacggagtaatcccggtactgacctttctgcgagatcacactaacgctcagttcaagagtctagtcgacctgaccgctgtggatgtgccaactagacaaaaccggtttgagatcgtgtacaacctactgtctctgcgtttcaattcgagaatacgcgtcaagacatataccgatgaactgacccctatagagagcgccgtgtctgtgtttaaggccgcaaactggtatgagagggagatttgggacatgtttggcgtgttcttcgcaaaccacccagatctgcgcagaattctcacagactacggctttgagggacatccatttcgaaaggacttccctttgagtggttatgttgagctccgctacgatgacgaggttaagagagtggttgctgagcccgtggagctggcgcaggaatttcgtaagtttgatctcaactcaccttgggaggcgtttcctgtgtataggcagccacccgaatcgctaaagcttgaggccggagacaaaaaaccagacgctaagtag

SEQ ID NO: 125773 - DNA, 528 bp, Artificial Sequence
  Description of Artificial Sequence: Synthetic coding sequence
atggccgcagtctccatgtccgtggtccttcggcagacactatggcggagacgggcagtggctgtcgccgccctgagcgtctcgcgtgtccccactagatcccttcgaacatcaacgtggaggcttgcacaggaccagacacaggacacgcagctgattaccgtggacgaaaaactggatatcacaaccctgacaggagtccctgaggagcacattaagacgagaaaagttcgcatttttgtcccagctagaaacaacatgcagtctggcgtcaataacacgaagaaatggaaaatggagtttgatactcgggaaaggtgggagaaccccctgatgggatgggcttctacagcagacccactgagcaatatggtgctgaccttttcaaccaaggaagacgcagtttcgttcgctgaaaagaacggctggtcttatgatatcgaggaaaggaaggtccctaaacctaagagcaagtcttacggggctaatttctcatggaataagcgcacccgagtcagtactaaatag

SEQ ID NO: 125774 - DNA, 321 bp, Artificial Sequence
  Description of Artificial Sequence: Synthetic coding sequence
atgccattcctcgatattcaaaaacgttttggtctgaatatcgacagatggctgacaatccagagcggcgaacagccatacaaaatggcggggcgctgccatgcttttgagaaggagtggattgagtgcgctcatggcatcggctacaccagagcggagaaagaatgtaaaattgagtatgacgacttcgttgaatgcctcctgcgccagaagaccatgcggcgggccggcacaatccggaagcagcgggataagctgatcaaagagggcaagtatacaccacctccccatcacatcggtaaaggcgaacctcgtccttag

SEQ ID NO: 125775 - DNA, 321 bp, Artificial Sequence
  Description of Artificial Sequence: Synthetic coding sequence
atgccgttcctggacatacagaagcggttcggcttgaatattgatcgctggctgaccatccagtctggggagcaaccttataagatggccggcaggtgccatgccttcgagaaagaatggattgagtgcgctcatggaattggatacactagggcagagaaggaatgtaaaatagaatacgacgattttgtggagtgtctgctcaggcagaagaccatgaggagagcaggcactattcggaaacaacgcgataaactcatcaaggaaggaaaatacactccccctccacaccacatcggaaagggagagccgcggccatag

SEQ ID NO: 125776 - DNA, 375 bp, Artificial Sequence
  Description of Artificial Sequence: Synthetic coding sequence
atggctgccgctatgacattttgtagactcttgaatagatgcggagaagcagcacgctctctgccccttggcgcacgatgcttcggagtcagagtgtcacctactggagagaaagtcactcatacagggcaggtgtatgacgacaaggattaccggagaattcgcttcgtgggcaggcaaaaggaggtcaacgagaactttgccatcgacctgattgcagagcagcctgttagcgaggtcgaaacacgggtgatagcttgcgatgggggcggaggtgcccttggtcacccgaaagtgtacatcaacttggacaaggaaaccaagaccgggacatgtggctactgcggactgcagttccgacagcatcatcactag

SEQ ID NO: 125777 - DNA, 1560 bp, Artificial Sequence
  Description of Artificial Sequence: Synthetic coding sequence
atggctccgatccctaaaaccgtagggaggattaagctggattgctccctgcggccttcatgcccgctcgaagttgctgcagcacccaagctgtgcaaggaatttggccccgaggattacggcgaagaggacatcgtggatttccttcgcaggttggtcgaatcagacccgcagggactgcaccgaatacatgtggacgggagttccggaaggcttcagttatggcatcatgattatctcctgggccacctggacgacgaagggaaaagcacaggacagtccgacagaggcaagggggccgaagggcttggtacatattgtggccttcgcaagtcatttttgtatcccccccaggagtcagagccatgtccccagagtccttctgcatctgctacgtttccttccgtgagtgacagcctactacaggtggccatgcctcaaaaactcctggtgaccgaagaagaggcaaatcggttagcggaggagttggtcgccgaggaagaaaggatgaaacaaaaggctgaaaaaaaacggttgaaaaaaaagagacagaaggaacgtaagcggcaggagaggctagaacagtactgcggggagcccaaagcatcgactactagcgacggggatgaatcaccgccctcaagtcccggtaatccagttcagggccaatgcggggaagaggaagattcgcttgatcttagttcgacgttcgtcagtctggcactccgcaaagtcggggattggccactttctgccaggagagagaaaggcttgaaccaggaacctcaagggaggggccttgccctgcaaaaaatggggcaggaagaggaatcaccaccccgtgaggagaggcctcaacagtctcctaaggttcaggcctccccgggcctgcttgctgctgccctccagcagtctcaagagctggcgaagctcggcacttcctttgcccagaatggcttctatcacgaggctgttgtgctcttcacccaggcactcaaactgaacccccaggatcatcgcctctttgggaatcgatctttttgtcacgagcgattaggccagccggcatgggctttggcagacgcacaagtggccttgacattgcgtcctggttggccacgcggcctgttcagactagggaaggcactcatgggactgcagcgctttagagaggccgccgcggtgttccaggagacactgcgcggcggcagccagcccgatgccgcacgagaactgagatcttgcctgctgcaccttaccctgcaaggccagagagggggtatatgcgcgcctccactatcacctggagctcttcagccacttcctcacgccgagttagctccaagtgggcttccatcactccggtgtcctaggtccacggcgctgagatcacccggcctcagccctctcctccactacccaagttgtcaccgctcacaccccaaccagccgctctcacaaacgcagtcaaggcgtccacatcctctgaaaccacaagatccgtctaagggctgggacattttggggctcggactgcagcacctgagccaggctagatag

SEQ ID NO: 125778 - DNA, 621 bp, Artificial Sequence
  Description of Artificial Sequence: Synthetic coding sequence
atggcagtgctgagtgcacctggcctaaggggctttcgaattctggggctgcggtccagtgtgggccctgcagtccaggcaagaggagtgcaccagtcagtagccactgacggcccatcctctacacagcccgctctgcccaaagcccgagccgtagcacccaagccctcatctagaggggagtacgtcgtggctaagctcgatgacctggtcaactgggcgaggcggtcttccctgtggccaatgaccttcgggcttgcttgttgcgctgtagagatgatgcacatggcggcacctaggtacgatatggatcggtttggggtggttttccgcgcttccccgcgtcagtcggacgtgatgatcgtggcaggtacactaacaaataagatggcccccgctttacggaaagtgtatgaccaaatgccagaaccacgttacgtggtttcaatgggtagttgcgccaacggtggcgggtactaccattattcttactcggtggtcaggggctgcgaccggatagtgccggttgacatttacatccctggaagagctgggaccgccccccccacacgtgagcttgagaccgggccagcacctcacggagctcggcgcccactgtag

SEQ ID NO: 125779 - DNA, 885 bp, Artificial Sequence
  Description of Artificial Sequence: Synthetic coding sequence
atggctgtgttaagcgcccctggcctgcgtggtttcagaatacttgggctgagatccagtgtgggcccggccgtgcaggcacggggggtgcatcagagtgttgcaacagatggtccctcaagcacgcagcccgccctccccaaagcacgtgccgtggcaccaaaacctagttctcggggtgagtatgtcgtggctaagctcgatgaccttgttaactgggccaggagggtgagtaccatgtcatgccggccgagtagctcagcccgggcctcccttcatacacacagacatactcacactcacaccaacgttcagacacgaacgcacaccacgcacgcttgtactctgacttgtgctcatgtgcatgcaagttcccacgtttggactgacgtgtacacagatcatacccatacacacgctcataatgctcacatgcacactcggacccacgctcacctgcatacacacgctcataccagcacgtgtgctcacactctggctcacatccatacatgcacgctggctcttatgcacactcacgcacacatctacacttgtaccagaacattagcccatacctgcacttacatgcactcacacgcccacacttgcactctcactcatatgcatacaaggccctgcgttgacacctgtatgtgtgcatgctggcacgcttgtacccaggcccattccctgatgcacactcacccatgtgggagaggggctggccgtactctgcctgaggctcccgttttagcctggtggcccgtggtgcctagtgaggactcagaccccgccggggacgatccgtccgtgagcgtgattctgttcttggcgtctgtgtgtagcagttgttttagctttaaggttaaagccgtcttctag

SEQ ID NO: 125780 - DNA, 645 bp, Artificial Sequence
  Description of Artificial Sequence: Synthetic coding sequence
atggccgtattgagtgcccccggactgcgagggttcagaatccttggcctcagatccagcgttgggcccgctgtgcaggctagaggcgtgcatcaatccgtcgccactgacggccccagcagcacgcagcctgcgttacccaaggcccgtgccgtggcccctaaacctagtagccgaggcgaatacgtggtcgcgaagttggacgacttggtcaactgggcccggagatcttctttgtggcctatgactttcggcctggcttgctgcgctgtcgaaatgatgcatatggccgctcctcgctacgacatggatagattcggggtagtcttccgagctagcccccgccagagcgacgtgatgatcgttgctggcacactgaccaataaaatggctcctgcacttcgcaaaagcagcctgcgccctgacgccggggcggcactgcggggactgcacggagagcttaggcagcgaaggagattgctccctttgttcctattagggggagagggattgcggcctcaccgggcccgggggcatctacacccgcggttaccaactaccgccgaagcactactctacggaattctgcaacttcagcgtaaaatcaaaagggaacgacggctgcaaatctggtatagacgctag

SEQ ID NO: 125781 - DNA, 621 bp, Artificial Sequence
  Description of Artificial Sequence: Synthetic coding sequence
atggcggtcctgtccgcccccggattaagagggtttcggatactgggactgaggtcctctgtgggccctgccgtgcaagcgcggggcgtacaccaatcagttgccaccgatggcccgtcatccactcagccagccttaccaaaagcgcgggccgtggctcccaaaccctctagcagaggtgaatatgtcgttgcaaaactggatgatctggtgaactgggctcgccgatcgtcactgtggccgatgaccttcggactagcatgttgcgccgtggaaatgatgcacatggccgccccccgctacgatatggatcggtttggtgttgtgtttcgcgcctccccgagacagtccgatgttatgatcgtcgccgggacccttaccaacaagatggcgccagctctgaggaaagtgtacgaccagatgccagagccccgttatgtggtgtccatgggaagttgtgcaaatggaggcggatactatcattattcctattccgttgtgagaggctgtgataggattgtgcctgtcgacatctacatacccggtagggccgggacggcaccaccgacaagagaactggagactgggcccgctcctcacggcgccaggaggccactctag

SEQ ID NO: 125782 - DNA, 633 bp, Artificial Sequence
  Description of Artificial Sequence: Synthetic coding sequence
atgagatgcttgacgacccctatgctgcttcgtgccttagctcaggccgccagagcaggcccccctggaggccggagtctgcattccagcgcggtggctgccacctacaaatacgtcaacatgcaggatcctgagatggatatgaagagtgttactgaccgcgctgcacggaccttactgtggacagaactgtttcgaggcctgggaatgactctcagctacctgttccgggaaccagctactataaactatcctttcgaaaagggacccctgagtcctcgctttaggggtgagcacgccctccggcggtatccttccggggaagagcgatgcattgcttgcaaactctgcgaggcaatttgtccagctcaggccattactatcgaggcagaaccgagggctgatggctcacggcgcaccacgaggtacgatattgatatgactaaatgcatctattgcggcttttgtcaagaagcatgcccagttgatgccattgtggaggggccaaacttcgaattctctacagagacccatgaggagctactgtacaataaagagaagctgcttaataacggggataaatgggaggctgaaatcgcagctaatattcaggccgattacctgtacagatag

SEQ ID NO: 125783 - DNA, 375 bp, Artificial Sequence
  Description of Artificial Sequence: Synthetic coding sequence
atgcgatgtctgacgacccccatgctgctgagagcccttgcccaggcggccagggccggcccccccggtggaaggtccctacactcttctgccgtcgccgccacatacaaatacgtgaatatgcaggacccggaaatggacatgaagtctgtaaccgatcgtgcggctcgtacactgttgtggactgaactgtttagagggcttggcatgacgttaagttatctctttagagaacctgccactatcaactatccgtttgaaaagggtccactttccccacgcttccggggagagcacgccctgcggcggtatcccagcggggaggagcgctgtatcgcatgtaagttatgcgaagccatatgtccagcccagtag

SEQ ID NO: 125784 - DNA, 333 bp, Artificial Sequence
  Description of Artificial Sequence: Synthetic coding sequence
atgcggtgcctgacgacccctatgctgcttcgggcactggcccaggccgctcgggctggcccaccagggggacggtcattgcactcatcagcagtagcagctacctacaaatatgtcaatatgcaggaccctgagatggacatgaaatctgttaccgaccgagcagctcgaactttgctgtggacggagttgtttagaggtttaggcatgaccctctcttatctattccgcgagccagctacaattaactatccttttgagaaaggacccttgtcacctcgatttcgcggagaacacgccctccgcagatacccctccggtgaggagcgctag

SEQ ID NO: 125785 - DNA, 555 bp, Artificial Sequence
  Description of Artificial Sequence: Synthetic coding sequence
atgagatgcttgaccactcctatgctgttaagagccctggctcaggccgcgcgagcaggccccccaggtggacggtcgttgcactcaagtgccgtagccgcaacatataagtatgttaatatgcaggatccagagatggacatgaaatctgttactgaccgggctgcacgcacccttttgtggactgagctgtttaggggcctcggcatgacactttcctacctttttcgagaacccgccacaatcaactacccgttcgagaaaggtcccctgtcgccaagattcagaggcgagcacgccttaagacgttacccctcaggggaagaacggtgtatagcttgcaaattgtgtgaggcaatatgtccggcacaggccatcactatcgaagctgagcctagggctgacggctctagacggaccactaggtacgatatcgacatgaccaaatgtatctattgtggattttgtcaggaggcttgcccggtggacgcaatagtcgaaggccccaatttcgaattctctacggagacacacgaggagctcctttacaattag

SEQ ID NO: 125786 - DNA, 195 bp, Artificial Sequence
  Description of Artificial Sequence: Synthetic coding sequence
atgacaaaatgcatctactgtggattctgtcaggaagcctgccctgtggatgccatagttgaggggcccaacttcgaattttcaacagagacccatgaggagctgctgtacaacaaggagaagctactgaataacggagataagtgggaggcggagattgctgccaatatccaggcggactacctatacagatag

SEQ ID NO: 125787 - DNA, 1395 bp, Artificial Sequence
  Description of Artificial Sequence: Synthetic coding sequence
atgctggcaacacgccgcctcctgggctggagcctccctgcacgggtgtccgtaagattctcaggcgataccactgcaccaaagaaaactagtttcggaagcctcaaagacgaggaccggatttttacaaatctgtacggccgccacgactggaggctcaaaggatctttatcccggggggactggtataagacaaaagagatcctcctcaagggtccagactggatcctaggagagattaaaaccagtggcctgagaggtcggggcggagccggcttcccaacaggactgaagtggagcttcatgaacaaacccagcgatggccgccctaagtatttggtcgtcaacgcggatgaaggagagccggggacttgtaaagaccgtgagatcctgaggcacgatcctcacaaattgttagagggttgcctagtgggaggtcgtgcaatgggtgctcgcgccgcttatatctacatcaggggcgagttttataatgaggcatccaacctgcaggtggcaatcagggaggcctacgaagcaggcctgatcggcaaaaacgcatgtggatccgggtacgatttcgacgtatttgtcgtcagaggagcgggtgcatacatctgcggcgaggaaaccgccctgatcgagtccatcgagggcaaacagggaaagccccgcctgaagccgcccttccctgccgacgtgggtgtcttcggctgccccacaacggtcgccaacgtagagaccgttgcggtgagtcccaccatctgcaggcgtggaggcacctggttcgccggattcggccgtgaaagaaactccgggacaaagctgttcaacatatccggacacgtgaatcatccgtgcacggtcgaggaggaaatgagcgtgcccctgaaggaattgattgagaagcacgccggcggggtcacaggggggtgggacaacttgctcgctgtgattccagggggatcttctacaccactgatccctaaatccgtgtgtgagacagtacttatggactttgacgccctggtccaagcccaaactggacttggaacagccgccgtcatcgttatggaccggtctacagacattgtaaaagctatcgcccgactaatagaattttacaaacatgagtcatgcggtcagtgcacaccatgccgggagggggtggattggatgaataaggtgatggccaggtttgttagaggagatgctcggcccgctgagatcgactccctttgggagatctccaagcagattgagggccacactatctgcgcactgggcgacggggctgcgtggcctgttcagggcctcatcaggcacttcaggccagagctggaagagagaatgcaacgcttcgcacaacagcaccaggcccggcaggccgctagttag

SEQ ID NO: 125788 - DNA, 1374 bp, Artificial Sequence
  Description of Artificial Sequence: Synthetic coding sequence
atgctagctacacgtagacttctcggttggtctctgcctgcaagagtttccacagccccaaaaaagacctcgtttggctcactgaaagatgaggaccgaatcttcacgaacctgtacgggaggcacgactggaggctgaaaggctccctctctagaggagattggtacaaaaccaaggaaatcctcctgaagggcccagactggattctcggagagattaaaacctcaggcctgaggggcaggggaggcgccgggtttccgaccggtcttaaatggagcttcatgaataaaccatccgacgggagacctaagtacttggtggtgaatgccgatgagggagaaccggggacgtgcaaagaccgtgaaatcctgaggcatgaccctcacaagcttctagaggggtgtctggttggggggcgggctatgggagccagagccgcttatatatacatacggggcgaattctataacgaggctagcaatttgcaggtggctatccgtgaggcatacgaagccggcctgattggaaagaatgcttgcggaagcggctacgatttcgacgtgttcgtggtccgtggcgctggggcctacatttgcggggaggaaaccgctttgatagaaagcatcgaagggaagcaaggaaagcccagactgaaacctcctttcccagcagacgttggagttttcgggtgtcccacaactgtagctaacgtggaaacagtggcagtttcacccacaatttgcaggagggggggtacgtggtttgctgggttcggtcgcgaacggaattccggaaccaaactgttcaatatcagcggccacgtaaaccacccgtgcacggtggaggaagaaatgagcgtgcccctaaaggagctcatcgagaagcatgccgggggcgtaaccggtggatgggataacctcctggcagttatacccgggggctccagcactcccctcatcccgaaaagtgtctgtgaaacagtgctcatggacttcgatgccctcgtgcaggcccagacaggactggggacagccgcggtaatcgtgatggaccgatcaacagatatcgttaaggccattgctcgactcatcgaattctacaaacacgaaagttgcggacagtgcactccttgcagagagggagtcgactggatgaacaaggtgatggctaggtttgtgaggggcgatgcgagaccagcagagatagactccctgtgggaaatttcaaaacagatcgaagggcacaccatttgcgccttaggcgatggcgcggcgtggcccgtgcaggggctcatccgtcactttcgccccgagttagaggaacgtatgcaaaggttcgcccagcagcaccaggcacgtcaggctgctagctag

SEQ ID NO: 125789 - DNA, 1008 bp, Artificial Sequence
  Description of Artificial Sequence: Synthetic coding sequence
atgctagccacaaggcgactcctcgggtggagcctacctgccagggtgtctgtgagattttcaggggacaccaccgcaccaaagaagacatcttttgggagcctgaaggatgaagaccggatctttacaaacctatatggcaggcatgactggcggctgaaagggagcctatcaagaggggactggtataagacaaaagaaatcttgctcaaggggccagactggattcttggagagatcaagaccagcggcctgcgcgggagaggaggagctgggttcccaaccgggctcaaatggagtttcatgaacaaacctagcgatgggtcaccaaccacggtggctaatgtggagacagtcgcggtttccccaacaatctgtaggagaggcgggacttggttcgcaggcttcgggagagagcgaaattcaggcaccaagctattcaatattagcggacacgtcaaccatccctgcaccgtagaagaagagatgagcgttcccttgaaggaactcatagagaaacacgcgggaggagtcacgggtgggtgggacaacctcctggctgttattccggggggcagctcaacaccgcttatccccaaaagcgtctgtgagactgtgctgatggatttcgatgccctggtgcaggcccagaccggcttaggcacagctgccgtgattgtgatggatcgctcaaccgacatcgtaaaagctattgcgcgactcatagagttttacaagcacgagtcatgcggacagtgcaccccttgtagagaaggggtcgattggatgaataaggtgatggctagattcgtgaggggtgacgcaagacccgcagaaatagactcattgtgggagatttcaaagcagatcgaagggcacacaatctgcgccctcggggacggggccgcctggccagtgcagggcctcatcagacactttaggcctgagttagaggagcgaatgcaaagatttgcgcaacaacaccaggctcgacaagcagcctcttag

SEQ ID NO: 125790 - DNA, 1368 bp, Artificial Sequence
  Description of Artificial Sequence: Synthetic coding sequence
atgctggccacacggcgattgcttgggtggtcactccctgcccggaccgcccctaagaaaaccagcttcggatccctgaaagacgaagatagaatctttacgaatctgtatgggaggcacgattggcgcctgaaggggtcgctgagtcgcggcgattggtataaaaccaaggagattctgctcaaaggaccggactggatactaggggagataaagacgtctggtttgcgggggaggggtggcgctggcttcccgaccgggctgaagtggtcatttatgaataagcccagtgatggtcgtcccaaatatttagtcgttaatgccgatgagggagagccagggacatgcaaagaccgcgagatcctgcggcacgacccacataaattgttggagggttgcctggtgggcggacgagctatgggggcccgggctgcctatatctacattaggggggaattctacaacgaggccagcaatttgcaggtggcgattcgggaggcctatgaggcagggctgattggaaagaacgcctgtggtagcgggtacgacttcgatgtctttgtggtgcggggggccggcgcctacatttgtggcgaggaaacagccctcattgaatccatcgaggggaagcagggtaagcccaggctcaaacctccttttccagccgatgtgggcgtgtttggttgccccacaaccgttgctaacgtcgaaactgtggcagtgtcccccacaatctgtaggcggggaggcacgtggtttgccggttttggaagggagcggaattccggtactaaactcttcaacatttctggacacgtgaaccacccgtgcaccgtcgaggaagaaatgtcagtgcccctgaaggaacttatcgagaagcacgctggaggcgtcactgggggttgggacaacctgctcgcagtgatccccggcggttccagtactcccctgattcctaagtccgtgtgtgaaactgtgctcatggactttgatgccctagtgcaggctcagaccgggcttggcaccgctgccgtcattgtcatggaccggtccacagacatcgtcaaagcaattgcgcggctcatcgaattctataaacacgagagctgcggtcagtgcacaccttgtcgcgagggtgtagattggatgaacaaagtgatggcccggttcgtcaggggagatgctcgacctgccgaaatcgattccctgtgggaaatctccaagcagattgaaggccataccatttgtgctctcggtgacggagccgcctggcccgtccagggcttgattcggcactttagacctgagctggaagagagaatgcaacgctttgcacagcagcatcaggctaggcaagccgccagttag

SEQ ID NO: 125791 - DNA, 1092 bp, Artificial Sequence
  Description of Artificial Sequence: Synthetic coding sequence
atgaacaagccaagcgacgggagacccaagtatttagtggtcaacgcagatgaaggggaacccgggacctgtaaggatcgggaaatactgaggcatgatcctcacaagctcctggagggttgcctggtcggggggagggcaatgggagccagagcagcttacatttacatccggggggagttttataacgaggccagtaatcttcaagttgctatacgcgaagcctatgaagcaggactcatcggtaaaaatgcttgtgggtccgggtacgattttgatgtgttcgtcgtgcggggagccggcgcttacatctgcggcgaggaaacagcccttatcgaaagtatcgagggcaagcagggcaaacctcgactgaaaccgccgttccctgccgatgtcggtgttttcggctgtccgacaactgttgccaatgtcgagactgtcgcagtctcacctaccatctgtaggagaggcggtacttggtttgcaggattcggccgggaaaggaatagcggtactaagctgtttaatattagcggtcacgtgaaccacccttgcacagttgaggaagagatgtctgtgcctctaaaagagctgatagaaaagcacgccggaggagtgactggcggttgggacaatctgctggccgttattccaggcggatcgagcacaccactaataccaaaatccgtctgtgaaactgtgctgatggactttgacgctttagtgcaggctcaaaccggcctcggcaccgctgctgttatcgtgatggatcgatccaccgatattgtaaaagcgattgcaaggttaattgaattttataagcatgaatcttgtggacagtgcacaccatgcagggagggagtggattggatgaacaaggtgatggctagatttgtgaggggggatgctaggccggccgagatcgactccttgtgggaaatctctaaacagatagaaggtcacactatatgtgcgttaggagacggggccgcatggcccgtgcagggtctgatcaggcattttcgaccagagctagaagaacggatgcaacggtttgcccagcaacaccaggcaaggcaggcagcgagctag

SEQ ID NO: 125792 - DNA, 750 bp, Artificial Sequence
  Description of Artificial Sequence: Synthetic coding sequence
atgtttttttcagcggcattgcgagcccgagcagccggattaacagcacactggggccgccacgttaggaatctgcataagactgtgatgcagaacggtgccggcggcgccctgttcgtgcaccgggatacgcccgagaacaatcctgatacccctttcgattttacacctgaaaactacaaacggatagaagctatcgtgaaaaattacccagaagggcataaagccgctgcagttctgcctgttctcgacttggctcaacgacagaacggctggttgccaatctctgctatgaataaggtcgccgaagtcctgcaggtcccaccgatgagggtttacgaagtggctaccttttacaccatgtataatcgaaagcccgttggcaaataccatatacaggtgtgcaccactactccttgtatgctccgcaactccgacagcattctcgaagcaatccagaagaagctcggtattaaggtcggagaaaccactccggataaactgttcacactcattgaagtagaatgcctgggagcctgcgtcaatgcaccaatggtccagataaacgacaactactacgaggatcttactgcaaaggatattgaagagatcattgacgagttgaaggcaggaaagatccctaagccgggcccacgatccggacgatttagctgcgaaccagccggaggattaacatctcttactgaaccacccaagggacccgggtttggtgtccaagcgggattgtag

SEQ ID NO: 125793 - DNA, 327 bp, Artificial Sequence
  Description of Artificial Sequence: Synthetic coding sequence
atggcggccccatgtcttctccgccaagggcgagcaggcgctctgaagactatgctgcaggaagcccaggtcttccgcgggctcgcttcaacagtgtcactgtccgctgaaagcgggaaatcggagaaaggtcaaccacaaaacagtaaaaagcagtctccacccaagaaacccgcacccgtccctgcggagcccttcgacaataccacctacaaaaacctacagcaccatgactatagcacatatacttttctggaccttaatctggagctttccaaatttcggatgccccagccttcatctggcagagagagccccagacattag

SEQ ID NO: 125794 - DNA, 1422 bp, Artificial Sequence
  Description of Artificial Sequence: Synthetic coding sequence
atggccgccccatgcctcctgcgtcagggtagagctggagcactgaaaactatgctgcaggaagcccaggtgttcaggggcctagcctccaccgttagcctaagcgctgaatccggtaagtccgaaaaagggcagccacagaattccaaaaagcagagtccacctaaaaacgtcgtggagcctaaggaacgtggaaagttactggccactcagacagccgcagagctcagcaagaacctgtcgtcccctagctcctacccgcccgctgtaaacaaagggaggaaggtggcgtcaccctctccttcaggcagtgtgctgtttaccgacgaaggagtgcccaaatttttgtcccgaaagaccctggtggaattcccccagaaggtgctatctccttttagaaaacagggctcagactcagaagcccgacaggtggggcggaaggtcaccagtcccagtagttcttcatcatccagctcatccgattcggagtcagacgatgaagccgatgtgtcggaagtaaccccacgagtggtctcaaaaggaagggggggactgaggaagcctgaagcgagccatagttttgagaatcgcgcacccagggtaactgtgagtgcaaaggaaaaaaccttgttgcaaaaaccccatgtggacataacagaccctgaaaagcctcatcagccaaaaaaaaaggggagcccagctaaaccttcagagggacgtgagaacgcacgtccgaagaccaccatgccgcgctctcaggttgacgaggaattcctgaagcagtctctgaaagagaaacagctacagaagactttcagactgaacgagatcgacaaagagtcccagaagccctttgaggtaaaaggcccacttcccgtccacacaaagtccggacttagcgccccccccaaggggtctcccgctcctgccgtgctggctgaggaagcccgggcagaagggcagctccaggcgtcccccccaggcgcagccgagggacaccttgagaaacccgtgccagaacctcagcgaaaagcggccccgccattacctcgtaaagaaacttctgggactcagggcattgaggggcaccttaaaggcggccaggctatagttgaggaccagattccaccttcaaacctggagacagtcccggtcgagaataaccacggattccatgagaaaacggctgctctgaaactcgaggctgaaggtgaggcgatggaggacgccgcagccccgggcgatgaccgcgggggaacacaggaaccagcccctgtcccggccgagccctttgacaacacaacttacaagaatctgcagcaccacgactactctacctatacgttcctggacctgaatctggaattaagtaaatttagaatgcctcagccatcctccggcagggaatctccccgccactag

SEQ ID NO: 125795 - DNA, 339 bp, Artificial Sequence
  Description of Artificial Sequence: Synthetic coding sequence
atgctccaagaggctcaggtgttccgtgggcttgcgagcacggtgtcactgagtgcagaaagtggaaagagcgaaaaaggtcaacctcagaactcaaagaaacagagccctcctaaatccgtgcccaccccgcatagacggtactcaccctgtggagattggaaagatgctagttctttgaagccagctccagtcccagccgagcctttcgataatactacctataagaaccttcagcatcatgattattctacttacactttcctggacctcaacttggagttatctaaattccggatgcctcagccatccagtggacgcgagagcccgcgtcattag

SEQ ID NO: 125796 - DNA, 2223 bp, Artificial Sequence
  Description of Artificial Sequence: Synthetic coding sequence
atggagaaacttggggtggagcctgaagaagagggcggtggggatgacgatgaggaagatgctgaggcctgggctatggagttggccgacgtcggagctgcagcctcctcacaaggtgtgcacgaccaggtactgcccaccccaaatgcttcctctagagtaatagttcatgttgacctggactgcttctatgcacaggtggaaatgatctcaaaccccgagctcaaagataaaccattaggcgtgcagcaaaagtatctcgtggtgacctgtaattacgaggcccgcaagctgggcgtgaaaaaactcatgaatgtgcgggacgccaaagaaaaatgcccacagttggttctcgttaacggcgaagacctgacccggtacagagagatgtcatataaagtcacagagctgttggaagagttttctcctgttgtggagaggctcggttttgacgagaattttgtggacctgacagagatggtagagaagcgtttacagcaattacagtctgacgagctctccgcggtgacagtcagcggccatgtgtataacaaccaatcaattaatttactggatgttctgcatataagactgctagtcggcagccaaatcgcagctgagatgagagaagccatgtacaaccagctgggtctgacaggttgtgccggggtggccagcaataagctattagctaaattggttagcggtgtcttcaaacccaatcagcaaacggtgctcttgcccgaatcatgtcagcacctcatacactccctgaatcatataaaagagatcccaggtatcgggtataaaactgctaaatgcctggaggctctgggcatcaactccgtcagagacttgcagacatttagcccaaaaatactcgagaaggaactcggtatatccgtagctcagcgcattcagaaacttagctttggcgaggataattcccccgtgatattatcaggccctcctcaaagcttctcagaggaggactcttttaaaaaatgttccagcgaggtggaggctaaaaataagatcgaagagctgctggccagccttttaaaccgcgtttgccaggatggaagaaaaccccatactgtccggttgataatccggcgatactcctctgagaaacactacgggcgagagtctagacaatgtcccatcccatcccatgtcatccaaaagctgggaacgggaaactacgacgtgatgaccccaatggtcgatatcctgatgaagctcttcaggaacatggttaacgtgaagatgcccttccatcttaccttgctgtccgtttgcttctgcaatctcaaagccctgaacacagccaaaaagggcctgatagactattacctgatgccttcgttgtctactacatcaaggtctggaaaacacagttttaagatgaaagatacgcacatggaagatttcccgaaagacaaagagactaatcgggacttcctcccctccggccgcatcgagtctactcgcacgagagaatcacccttggacaccaccaacttcagcaaggagaaggatattaatgagtttccgctctgctcactacctgagggcgtggaccaagaggttttcaaacagcttccggttgacatacaagaggagattctgtcggggaagagcagggagaaattccagggtaaaggaagtgtttcatgtcccctgcatgctagtaggggcgtgctcagctttttcagcaaaaaacagatgcaggacatcccaattaacccaagggatcatctttctagctcaaagcaggtttccagcgtgtctccctgcgaacccggaacctctggctttaacagcagttcctccagctacatgtctagccagaaggattattcctactatctcgacaaccgactgaaggatgaacgcatttctcaaggacccaaggagccgcagggtttccactttaccaatagtaaccccgccgtgtccgctttccacagctttccaaatcttcagagtgaacaattattcagcaggaaccataccacagattcacacaagcagacagtagcgaccgattcccacgaaggactgaccgagaacagggagccagattccgtggacgaaaaaataacgttcccgtctgacattgacccacaggttttctacgaacttcctgaagccgtccagaaggagttgctcgccgaatggaagcgtgctggcagcgattttcacatcggacacaaatag

SEQ ID NO: 125797 - DNA, 540 bp, Artificial Sequence
  Description of Artificial Sequence: Synthetic coding sequence
atgaacaagagaggtttctctatggaagtcggccagtatatcttcgtcaattgcccatccatcagccttctcgagtggcatccattcacccttacatccgcacctgaggaggactttttttctatacatattagggcagcgggggattggaccgagaacttgattcgagcttttgagcagcagtattctccaattcctcgtattgaagtggacgggccctttgggaccgcatcagaggatgtgttccagtatgaggttgccgtattagtaggcgctggcatcggtgtgacccccttcgcctcaatcctgaagtcaatctggtataagttccagtgtgctgaccacaatctgaagaccaagaagatctatttctattggatctgccgagagactggagcatttagctggttcaacaaccttttgacttctctggaacaggagatggaagaactgggaaaatccctgcggaaatgttgccaccgctactcctccctagaccctaggaaggtgcagttttattttaataaggagaacttctag

SEQ ID NO: 125798 - DNA, 1584 bp, Artificial Sequence
  Description of Artificial Sequence: Synthetic coding sequence
atggggaactgggtggtgaaccactggttctcagtgctgtttttggtggtgtggcttggcctgaatgtatttctgttcgtggatgctttcctgaaatacgagaaagcagataaatactattacacaagaaaaatactaggcttctgtagcaggactctgcgcaaacagcttgatcataatcttacattccataagctggtagcatacatgatctgccttcatactgccattcacattattgcccacctgttcaacttcgactgctatagtcggtctaggcaggccactgatggttccctggcctccattttaagctcactaagccacgatgagaagaagggtggctcttggctgaatcctattcagtcccgaaacactaccgttgagtatgttactttcacaagcattgcgggactcactggggtgattatgacgatcgcactgatactcatggtgacctcagctaccgagtttattcggaggagctactttgaagttttttggtatacacatcacctgtttatcttttacatcctgggactgggcatacatggcatcggaggcatagtaagaggtcagacagaagagagcatgaatgagtcccaccccaggaagtgcgctgagagcttcgaaatgtgggacgatagagattcccattgtcggaggcctaaattcgaagggcaccccccagagtcatggaagtggatcctagcgcccgtaatcttatatatatgcgaaaggattctcaggttctacaggagccaacagaaggttgtgatcaccaaggtggtgatgcacccatcaaaagtactcgagctccaaatgaataaacgtggattctcaatggaggtggggcaatacatttttgtaaactgtcctagcatcagtctgctagagtggcatccctttaccttaacatcagctcccgaggaggatttcttcagcatccacatccgggcggccggggactggacagagaatttaattcgggcattcgaacagcagtactcccctatcccacggatagaggttgatgggccgttcgggactgccagcgaggacgtgttccaatatgaagtcgcagtgctcgtcggggccggaattggtgtgaccccgtttgccagtattctgaaaagtatctggtataaatttcaatgcgccgaccacaacctcaagactaagaagatctacttttactggatctgccgagagactggggcctttagctggttcaataacctcttaacttcactagagcaggagatggaggaactgggaaaggtgggattcttgaactatcggctgttcctgaccggatgggatagtaacattgtaggccacgcagccctaaacttcgacaaggcaacagatatagtcactgggctgaaacaaaaaacgtctttcgggagacctatgtgggacaatgagttttcaacaatcgccaccagccacccaaagtcagtcgtgggggtctttctttgtggacctagaaccctcgcaaagtctctgcgaaagtgctgtcacagatattcctctttagaccccagaaaagtgcagttttacttcaataaagaaaatttctag

SEQ ID NO: 125799 - DNA, 579 bp, Artificial Sequence
  Description of Artificial Sequence: Synthetic coding sequence
atgggcaactgggtggtgaatcactggttcagcgtcctctttcttgttgtgtggctgggcctcaatgtgtttttgttcgtggacgcttttctgaaatatgagaaggcagacaagtactattatacccgcaaaattctgggaagcaccttagcttgcgctagagcctcggccttgtgcttaaatttcaacagtaccctgatcctgttgccagtatgtagaaacctgctgagctttttgcgcgggacttgtagtttctgctccagaacgcttcgaaagcagctggaccataacctgacttttcacaaactcgtggcatacatgatttgccttcacactgccattcacatcatagcccacctttttaattttgattgttactcaaggagccgacaggctactgacggttcactggcctccattctcagtagcttgagccacgatgaaaaaaaaggcgggtcgtggctgaacccaatacatccacacattacccccacagtgtacatgtttacagtaacatttgatatggtactgtccagtgttaattccaatctgttcctgttcctccttattaaaaagtag

SEQ ID NO: 125800 - DNA, 579 bp, Artificial Sequence
  Description of Artificial Sequence: Synthetic coding sequence
atgggcaattgggtggttaaccactggttctcagtcctcttcctggttgtgtggctgggactgaatgttttcttatttgtggacgccttcctcaagtatgagaaggctgataagtattactatactagaaagatcctgggttctaccctggcctgcgcccgggctagcgccttgtgcttaaatttcaatagcacactgattctactccctgtctgtcggaacttgctgagctttctcagaggcacctgttctttttgctcccgcaccttgcgcaaacagctggaccacaatctcacctttcacaagctggtggcttacatgatttgcttacatacagcaatccacatcatcgcacatttatttaacttcgattgttactctcggagcagacaggcaactgatggatctcttgcgagtattttgtctagtctgagccacgacgagaagaagggaggctcttggctcaatccaattcatccccacattacccccactgtttatatgtttaccgtgaccttcgatatggtcctctctagcgtcaattcaaacttgttcctgttcctgcttatcaagaaatag

SEQ ID NO: 125801 - DNA, 1695 bp, Artificial Sequence
  Description of Artificial Sequence: Synthetic coding sequence
atgggcaattgggtagtgaatcactggttcagcgtacttttcctcgtcgtctggcttggcctcaacgtcttcctgtttgtggacgcctttttgaagtacgagaaagctgacaagtactactatactcgtaaaatcctaggaagcacacttgcctgtgccagagccagcgcactctgcctgaacttcaactcaacactgatcctgctgcccgtgtgccgcaatctgttaagtttcctgcggggaacctgcagcttttgctctagaacgcttcggaaacagctggaccataacctaacgttccacaagctggtggcatacatgatttgtctgcacacagcaattcatattatcgcgcatttattcaatttcgactgttattctagatctagacaagccactgatggcagcttggcttccattcttagttccctctcgcatgacgagaagaaaggggggagttggctgaacccaatacaatcccgcaataccactgtggaatacgtcactttcacttccattgcgggcctcaccggagtcattatgactatcgccctaatcctgatggtgacttcggccaccgagttcatccgaaggagctatttcgaggtgttctggtatacacatcacctgttcattttttatatactggggctcggcatccacggcatcggcggcattgtgcgcgggcagactgaggagtcaatgaatgagtcacacccaaggaagtgcgctgagtcatttgagatgtgggacgacagggatagccactgccgccgtcctaagtttgagggccacccgcctgaatcatggaaatggatccttgcacctgtgatactgtatatctgtgaacgaatcctccgattctaccggagccaacaaaaggttgtgataacgaaagtggtgatgcatccctctaaggtgctggaactccaaatgaacaagagaggattcagcatggaagtgggtcagtacatcttcgttaactgcccaagtattagccttctcgagtggcacccttttacactgactagcgcaccagaagaagactttttttcaattcatatccgagccgctggcgactggaccgagaatctcatacgtgccttcgagcagcagtattcacccattcctagaatcgaggtggatggccccttcgggactgcatccgaagatgtgttccaatacgaggtggcagttcttgttggagccggcatcggagtgacccccttcgctagcattcttaagtcaatctggtacaagtttcagtgcgccgaccacaacctgaagaccaaaaagatatacttctattggatttgccgcgaaactggcgcattctcttggttcaataatctgctgacatccctggaacaggagatggaggaactgggtaaggtgggcttcctgaattaccgtttgtttcttaccgggtgggatagcaatatcgtggggcacgcagctctgaacttcgacaaggctaccgatatcgttactggactaaagcaaaagacatcatttggccgccctatgtgggacaatgagttcagtacaatcgctacaagccaccctaagagcgtggtgggcgtgtttctgtgcggccctaggactctagctaaaagtttgagaaaatgctgtcaccggtactcttctctcgatccccgcaaggttcaattctactttaataaggagaacttttag

SEQ ID NO: 125802 - DNA, 528 bp, Artificial Sequence
  Description of Artificial Sequence: Synthetic coding sequence
tagttttcgatggaggtggggcagtatatctttgtgaattgcccaagcataagcctcctcgagtggcaccccttcactctgacatccgctcccgaagaagattttttttcaattcatataagggccgcaggggattggacagaaaatcttatccgggcgtttgaacagcagtactcgcctattccacgtatagaggtggatggcccattcgggactgcttccgaagatgtattccagtacgaggtagccgttctcgtaggagctgggatcggggtgaccccctttgccagcatcctgaaatcgatctggtataaatttcagtgtgccgaccacaacctaaagaccaaaaaaatctatttctattggatctgtcgcgaaactggggcattctcttggttcaataacctgttaacctcactcgaacaagagatggaggagcttgggaagagtcttagaaagtgctgccaccgatacagttccctcgatccacgtaaagtgcaattctatttcaataaggaaaatttctag

SEQ ID NO: 125803 - DNA, 1707 bp, Artificial Sequence
  Description of Artificial Sequence: Synthetic coding sequence
atgatgggctgctggatcctcaatgaagggctgagcactattctcgtcctgagctggctggggatcaacttctacttatttatcgacactttctattggtacgaggaggaggaatcattccattatacccgtgttatcctggggagtacactggcgtgggccagagcttctgcgctgtgccttaatttcaactgcatgttaatcctgatccctgtgagtcggaatcttatttcatttatccggggaactagcatctgctgtcggggcccctggcgaagacaactcgacaagaacctcaggtttcacaagctggtggcctatgggatcgcagtcaacgccaccatccacatcgtggcacactttttcaacctggagaggtatcactggtctcagtccgaagaagcccagggcctgctcgctgctctaagcaagttaggcaacaccccgaacgagtcttacttgaacccggttcggacatttccaacgaatactaccaccgaattgctcaggacaattgccggtgtcaccggtcttgtgatctctttggcgctcgtgctgatcatgacaagctccacagagttcatccggcaagcaagctacgaactcttctggtacactcatcatgtgttcattgtattctttctctcgctcgcaattcacgggacaggacgcatcgtgcgaggtcaaacacaggacagtctgtcactccataatattaccttctgcagggacagatatgccgagtggcagacagtggcccagtgccccgtcccccagttttcaggaaaggagcccagcgcttggaagtggatcctcgggcctgttgtactgtacgcctgcgagaggatcatacgcttctggcgcttccaacaggaggtggtgatcactaaggtggtatcacatcccagtggtgtgttagagttacacatgaagaaacgaggatttaaaatggccccggggcaatatattcttgtgcagtgtcccgccatatcttcacttgaatggcacccctttaccttgacctccgcaccccaggaggacttcttctcagtgcacatccgtgccgcaggggactggaccgccgctctgttggaggcttttggggccgaaggacaagcattacaagaaccttggtcactgccccggctggccgtggatggaccctttgggaccgcacttaccgatgtcttccactaccccgtgtgcgtatgtgtcgccgctggcattggggtgacacctttcgctgccttgctgaagagtatatggtataagtgttccgaagcccagacaccgcttaaactcagcaaggtctatttttactggatctgccgtgacgccagagcattcgagtggttcgctgaccttctcctgtctctggaaacccgcatgtcagagcagggcaagacccacttcctctcataccatatctttctcactgggtgggatgaaaatcaggccctgcacatcgcactccactgggatgagaacacagacgtgattacggggctaaagcagaagaccttctacggacgaccaaattggaataatgagttcaaacagattgcatataaccaccctagcagcagcattggcgttttcttctgcggtccaaaggccctgtctaggaccctacaaaaaatgtgtcatttgtacagcagcgctgacccccggggggtgcatttctactataataaggaatcattttag

SEQ ID NO: 125804 - DNA, 1737 bp, Artificial Sequence
  Description of Artificial Sequence: Synthetic coding sequence
atggccgtgtcctggcgctcgtggctcgctaatgaaggcgtcaaacacttatgcctcttcatctggctgtctatgaacgtcctactgttctggaagacattcttgctctataaccaggggccagagtaccactacctccaccagatgctgggcttggggctctgcctctcacgagcctcagccagtgtattaaacctcaactgttcgctgatacttctgccaatgtgtcgtaccttattagcatacctccggggctcccaaaaggtcccctctcgacggactagaaggcttttagataaaagcaggacatttcatatcacatgtggcgtgacgatctgcatatttagcggagtccatgttgctgcccatctggttaatgccctgaacttcagcgtaaactattcagaggacttcgtggagctgaacgccgcacggtacagggacgaagatcctagaaaactcttattcacaaccgtccccggattgaccggggtgtgcatggtcgtggtgctgttcctgatgataacagcgtccacgtacgccattcgagtgagcaactatgacatcttttggtatactcacaacctcttttttgtgttctacatgctgctgaccctccacgtttccggcggactgctcaaataccaaacaaatctcgatactcaccccccaggctgtatctcgctcaaccgaacaagctctcagaatatcagtctccccgagtacttcagtgagcatttccacgagccattccctgaagggtttagcaaacccgcggaattcacccagcacaaatttgtgaaaatttgtatggaagagcccagattccaagccaatttccctcagacctggctctggataagtggccccctgtgtctctactgcgctgagcgcctgtacaggtacattagatccaacaaaccggttaccatcatctccgtcatgtcacatcccagtgacgtcatggaaatccgtatggtgaaggaaaacttcaaagcgcggccagggcaatacattaccctgcattgtcctagtgttagcgccctggaaaatcacccttttaccctgaccatgtgtccaacagagactaaagccacattcggtgtccacctaaaaatagtcggagactggacagaacggtttcgcgatctgctgctgccacctagttcccaggatagcgagatcctgccctttattcaaagtaggaactaccccaaactgtacatcgacggccccttcgggagtcctttcgaggagagcctgaactatgaggtgtccctgtgtgtcgcgggaggtattggcgttaccccatttgctagcatccttaacacccttctcgacgactggaaaccctataagcttcgaagactttacttcatctgggtatgccgcgacattcagtcattccggtggtttgccgatcttctgtgtatgctgcacaacaagttctggcaagagaatcgtccggactatgtgaacattcagttgtacctgagtcagaccgacgggatccagaagatcatcggagagaagtatcatgccctcaactctcgcctgttcataggtcgcccccggtggaaattactgtttgatgagattgctaagtataaccgtgggaaaactgtcggtgtattctgctgcggtcccaactccctgagcaaaactctgcataaacttagcaaccagaacaacagctacggcactcgctttgagtataataaagagagcttcagctag

SEQ ID NO: 125805 - DNA, 1665 bp, Artificial Sequence
  Description of Artificial Sequence: Synthetic coding sequence
atgaatgtgctcctgttttggaaaacctttttgctttacaatcagggacctgagtaccattacttgcaccagatgctgggcttgggcctttgcctctctagggctagcgcgagcgtcctaaatctcaactgctcactcatactgctaccaatgtgcagaactttgcttgcctacctcaggggaagtcagaaagtaccaagcaggcgcacaaggcgtctcttggacaaatctcgcacgttccacatcacctgcggcgtaactatttgtatcttttcaggcgtgcatgttgcagcccacctggtgaacgccctgaacttcagcgtgaattatagtgaagatttcgttgagcttaacgcagccagatatcgagatgaggaccctcgcaaacttttgttcaccacagttcccggcctgactggggtatgtatggtggttgtattatttctcatgatcaccgcctccacttatgccattcgtgtgtcgaattacgacatcttctggtacacacacaatctcttctttgtcttttacatgctacttacactgcatgtgtctggtggcctgctaaaataccagaccaatttggacactcacccccccggatgcatcagtctgaatcgaacatcctcccagaatatctcccttccggagtattttagtgagcatttccacgagccgtttcccgagggctttagcaagcccgcagaatttacccagcacaaatttgttaagatatgtatggaggaaccaaggtttcaggccaactttccacagacttggttatggatcagtggccccctgtgcctctattgcgccgagagattgtaccgctatatccgctcaaataagcctgttactattatctccgtaatgtcacatccatcagatgtgatggagattcgaatggtgaaggaaaatttcaaagcgcggcccgggcagtacatcacgcttcactgccccagcgtatctgcactggaaaaccacccctttacattgacaatgtgcccaactgagactaaggcaaccttcggcgtccatctcaaaattgtcggtgattggacagaacggtttcgggaccttctcctgccaccctcgtctcaggacagcgagatattgccttttattcagtctcgtaattacccgaaactttacatcgacgggccgttcgggagcccattcgaggagtcactgaattatgaggtgtcactgtgcgtcgccggaggtattggagttacgccctttgccagcattctgaacacactcctcgacgattggaaaccttacaagctgaggaggctgtacttcatctgggtgtgcagagacattcagagtttcaggtggttcgctgacctcttgtgcatgctccacaacaagttttggcaggaaaataggccggactatgtgaatatccagctatatctgtcccagaccgatggcatccagaagattattggcgaaaagtatcatgcccttaactctcgcctattcatcggacggcctcgctggaagcttctcttcgatgagatcgcaaaatataacaggggcaaaactgttggggtcttttgctgcgggccaaactctctaagcaaaaccttgcataagctctccaatcagaacaatagttacgggacccgttttgagtataataaagagagtttcagctag

SEQ ID NO: 125806 - DNA, 816 bp, Artificial Sequence
  Description of Artificial Sequence: Synthetic coding sequence
atggcagttagttggcgctcatggctggccaacgaaggggtcaagcacctgtgcctgttcatttggctatctatgaacgtattgctcttttggaaaactttcttgttgtacaatcagggacctgaataccactacttgcatcagatgcttggctgcccgaccgagaccaaagccacttttggcgtgcatctgaaaattgtaggcgactggacggagagattcagggatttactgctccccccctcttcacaggattctgagatcctccccttcatacaatcaaggaattatccgaaactgtacatagacggaccctttggctccccctttgaggaaagtttgaactacgaggtgagcttatgtgttgcaggcggtattggcgttacaccgtttgcctccattttaaatacactcttggatgactggaaaccttacaagttgcgccggctgtattttatttgggtgtgtcgcgacatccaatccttcaggtggtttgcggacttgctttgcatgttgcacaacaaattttggcaggaaaacaggcctgactatgtgaatatccagctgtatctgtcacagacagacggaattcagaagattattggcgaaaaatatcatgccttgaatagtagactgtttatcggtcgcccccggtggaaactgttatttgacgaaattgctaaatacaaccgtggaaagacagtcggcgtgttttgctgtggaccaaattctctgagtaagactctgcataagttgtctaaccaaaataattcatacggaactagatttgagtataataaggagagcttttcgtag

SEQ ID NO: 125807 - DNA, 165 bp, Artificial Sequence
  Description of Artificial Sequence: Synthetic coding sequence
atggccgtatcctggcgctcctggctcgcaaatgaaggcgtgaagcatttatgtctttttatttggctaagtatgaatgtgttgttgttttggaagacctttttgctctataaccaggggccagagtaccattacttgcatcaaatgctgggggaactcagctag

SEQ ID NO: 125808 - DNA, 1800 bp, Artificial Sequence
  Description of Artificial Sequence: Synthetic coding sequence
atgggagagatgtggaggaagagagaagaggtcatctttcgtgaatatagtttctctttctacccactcaatatctttgcgccctttgtgctattcccagactacttctgcctgctcggcttcatatggctgtctatgaatgtgcttttattttggaaaactttcttactatataaccagggcccagaatatcactatcttcaccagatgctgggtctgggcctttgcctaagcagggccagtgcctctgtactgaatctgaattgcagcctgattctactgccaatgtgtagaacactgttagcatatcttagaggctcacagaaggtaccctctcgccggacacggagattgctggacaagagtcgaacatttcatatcacttgtggcgtgactatttgcatattttcaggcgtgcatgtcgccgcacatttggtaaacgccttaaatttctccgtgaactattccgaagactttgtcgagcttaatgcagcccgataccgagatgaggatccccgtaaattgctttttacaacagtgccaggtttgacaggtgtttgtatggtggtcgtgctcttcctcatgatcaccgcctctacatatgccattagggtctccaactacgatattttctggtatactcacaacctcttttttgtgttctatatgctgctcactttgcatgtgtcggggggactgctgaagtaccaaacaaatttagacacacacccgccagggtgtatatctctgaacaggacttctagtcagaatatctcgctgccggaatatttttcagaacatttccacgaacctttcccagaggggttcagtaaacccgccgagttcacccagcataaatttgttaagatttgtatggaagagcctcgattccaagcaaactttccgcaaacctggctgtggatttccggtcccttgtgcctatattgcgcagaacggctttaccgctacatccgatctaacaagcctgttactatcatctccgtgatgagtcatccctctgacgtcatggagattaggatggtcaaagagaatttcaaagcacgcccgggccagtacatcaccctgcattgcccgtctgtgagcgcactggagaatcatccattcaccctaaccatgtgtcccaccgaaacaaaagctaccttcggcgtacacctcaagatcgttggtgactggacagagcggttccgcgacctgctgctgcctcccagctcacaggattccgaaattttgccctttatacagtcgagaaattaccccaaactgtatatcgatggcccgtttggtagcccattcgaagagagtctaaattacgaggtgagtttgtgcgtggccgggggtataggagtgactcccttcgcctcgattttaaacactttacttgacgattggaaaccgtacaaattgagacgcctgtactttatatgggtctgtagagacatccagtctttcaggtggtttgcagatctactgtgcatgttgcataacaagttttggcaggaaaataggccggactatgttaatatacagctgtacctttcccaaaccgacggaatccaaaagatcattggggaaaagtaccacgcactgaatagccggctgttcatagggcggccacggtggaagctactcttcgacgagattgctaaatacaaccgcggaaagaccgtcggggtgttctgttgtggcccgaattccctgagcaagaccctgcataaactgagtaaccagaacaactcctatgggacccgattcgaatataacaaggaatctttcagttag

SEQ ID NO: 125809 - DNA, 1665 bp, Artificial Sequence
  Description of Artificial Sequence: Synthetic coding sequence
atgaatgtcctcctcttttggaaaacattcttactctataatcagggccccgagtatcactacctacaccagatgctcggtctgggtctatgcctttcccgggcatctgcatcagtcctgaatttgaactgcagcctcatccttttacccatgtgtaggacactgctggcttatttgcgaggcagccagaaggtccctagccgacgcacccggcgtctgctggataaaagtcggaccttccacatcacttgcggagttacaatctgcatcttcagcggagtgcacgtcgcagcgcacttggtaaacgcattgaacttcagtgtcaattacagtgaagacttcgtagaactgaacgctgcccgataccgcgacgaggatcctcggaagttgttgttcacaactgttccaggccttaccggtgtgtgtatggttgtggttctgtttctaatgatcaccgccagcacctacgcaataagggtgtcgaactatgatatcttttggtacactcataacctctttttcgtgttctatatgctgttgacgctgcacgtgtctggcggattgttgaaatatcaaacaaacctggacactcacccccccggatgcataagcctgaaccgaacttcttctcagaatatatcactgcctgaatacttctctgaacattttcacgagcccttccctgaaggattttccaagccagcagagtttacccaacacaaattcgttaagatctgtatggaggaaccgagatttcaggctaatttcccccaaacttggctgtggataagcggccctttgtgtctctattgtgccgagaggctctatcgttatatccgcagcaacaagccagtgacaattatttccgttatgtcccacccttctgatgttatggaaatccgaatggtgaaagagaatttcaaggcccggccaggccagtatatcacgctgcattgcccttcagtcagcgcgctggaaaatcatcctttcaccttgaccatgtgcccaacggaaacaaaagcgacattcggcgtgcatctgaagattgtcggcgattggaccgagcggtttcgggacttactgctgcccccaagctcccaggattctgagatactacctttcatccagagccgaaattatcccaagttgtatatcgatggacccttcggcagtccattcgaggagagccttaattacgaagtgagcttgtgcgtagcaggagggattggtgtgactccatttgcaagtatcctgaataccctgcttgatgactggaaaccctacaaacttcgccggttatactttatatgggtgtgtcgtgatattcaaagcttcagatggtttgccgacctgctctgtatgctccataacaagttttggcaggagaatagacccgattacgttaacatccaactctacctcagccagacggacgggatacagaagatcataggggaaaagtatcacgccttgaatagccgcttgttcatcggaagacctaggtggaaactgctgtttgacgagatcgctaagtataaccggggaaagaccgtgggcgtgttctgctgtggcccaaatagcctatctaaaacgctgcataaactgagtaaccagaataacagctacggaactcgattcgagtacaataaagaaagcttctcctag

SEQ ID NO: 125810 - DNA, 1665 bp, Artificial Sequence
  Description of Artificial Sequence: Synthetic coding sequence
atgaatgtcctgctgttctggaagacctttttgctgtataatcaaggacccgaataccattatcttcaccagatgttgggactagggttgtgcttgtcgagggcctcggcctccgtcctgaacctgaattgtagtctgatcctactgcccatgtgtaggacgctcttggcctacctgagagggagtcagaaggtgccctctcgaagaactaggcgattgcttgataaatctagaacgttccacattacatgcggtgttactatctgcattttctctggcgtccacgtagcagcgcatcttgttaatgctcttaacttcagcgtgaactacagtgaggactttgtggagctcaatgccgcgaggtatagggatgaggatccccgcaagctacttttcaccactgttcccgggctaaccggagtgtgcatggtggtcgtactcttcctgatgataacagcaagcacctatgcaattagagtcagcaactacgatatcttctggtatacccacaacctctttttcgtgttttatatgttgctcaccctgcatgtcagcgggggactgctgaagtaccagaccaatctggatacccaccctccagggtgtatcagccttaataggacttcatcccaaaacatctcactcccagaatacttttccgagcatttccacgagccttttcctgagggtttttctaagcctgctgagttcacccaacataaatttgtgaagatctgcatggaagagccacggttccaggccaacttcccccagacctggctgtggatctccggccccctttgtctgtactgcgctgaacggctatacagatacatccgcagcaacaaacccgttacaattattagcgtgatgtctcacccttcagacgttatggaaatccggatggtcaaggaaaactttaaagcaaggcccggccaatatatcaccctgcactgtccctcagtgtccgcgctcgagaaccaccccttcacactgaccatgtgtccaactgaaactaaggccacctttggagtgcacctgaaaatcgttggggattggaccgagcgatttcgggacctgctgctgccgccctcaagtcaggactcggagatactgccctttattcagagcagaaactaccctaagctttacattgacggccccttcggcagcccgtttgaggagtcactgaactatgaggttagtctttgcgtggctggcggtatcggtgttacaccattcgcttcaattctcaacaccttgctggacgactggaagccctacaagctgcggcgcttatacttcatctgggtctgccgggacatccagagctttcgatggttcgctgacctcctgtgtatgctacataataagttctggcaggaaaaccgacctgactacgtaaacattcagctgtacctctcacagacagacgggatacagaagatcattggcgagaaatatcatgcccttaacagcaggctgttcatcgggcgtcctaggtggaaacttctgttcgatgaaatcgctaaatataatcgcggcaagacagtcggcgtgttctgttgcggcccgaatagtcttagtaaaaccctccacaagttaagtaaccagaataattcttacggaaccagattcgaatataataaagagagcttttcctag

SEQ ID NO: 125811 - DNA, 696 bp, Artificial Sequence
  Description of Artificial Sequence: Synthetic coding sequence
atggctgtgtcttggagatcttggttggcaaacgaaggcgtcaaacatctgtgtctcttcatttggctgtcaatgaatgtgttactgttctggaagacattcctgctctacaatcagggccctgagtatcattatcttcatcagatgctcggttgccccacggagacaaaggccacgtttggggtccacctcaagatcgtcggtgactggaccgagcgattccgcgacttactgctgcccccttcaagtcaggactccgaaatattacctttcattcagtccagaaattaccctaaagatgattggaaaccctacaaactccgaagactgtatttcatttgggtttgtcgggacattcagagctttcggtggtttgctgacctgctgtgtatgttacataataagttttggcaagagaatagaccagactatgttaatattcagttatatctgtcacagacggacggcatacagaaaatcatcggcgaaaagtaccacgcacttaatagtcgcctgttcatcggtcggccacgttggaagcttctcttcgacgagatcgccaagtacaatcgcggcaaaactgtaggggtattctgctgtggccctaattctctctctaaaacactgcacaagctgtctaaccaaaacaattcctacggcacccgcttcgagtacaataaagaaagtttttcctag

SEQ ID NO: 125812 - DNA, 1617 bp, Artificial Sequence
  Description of Artificial Sequence: Synthetic coding sequence
atggccgtgagctggagaagttggctcgcgaacgagggcgtgaagcacctgtgcctctttatttggctgtccatgaatgtacttctcttctggaagacctttctgctttacaatcagggcccggagtatcactatctacatcagatgctgggcctgggtctgtgtttatctagggcaagcgcgagtgtcctgaaccttaactgttccttgattttgctaccaatgtgccgtacactgctggcctacctgagaggtagtcagaaggtgcctagtcggcggacccggaggctcctggataagtccagaacctttcatattacgtgtggcgtaaccatttgcatcttctctggcgtgcatgtcgccgcacatctcgtcaacgctctgaatttttccgtcaactactccgaggactttgttgaactaaatgccgcccgataccgggatgaggacccacgtaaactgttattcactaccgtgccaggcttaacgggagtatgcatggtcgttgtgctattcctgatgattactgcgtccacatacgccataagggtgagcaactacgacatcttttggtatacacataacctgttctttgttttctatatgctccttactctacacgtgtctgggggcctgttgaaatatcaaaccaatcttgacacacatcctcccggatgcatctcattaaatcggaccagctctcaaaatatttcactgcctgaatatttttcagagcattttcatgagccattcccggaaggtttcagcaagcccgccgagtttacacagcacaagttcgtgaaaatctgcatggaagagcctcgattccaggctaactttccgcagacgtggctctggatctctggaccactttgcctctattgtgctgagagactgtacagatacattagatctaataagcctgtcacaattatctccgtcatgtcacatccttcagatgtgatggagattaggatggtgaaagaaaactttaaagcccgccctggtcaatacatcacgttacactgtccatcggtatcagccctagaaaaccaccccttcaccctcacaatgtgccccaccgaaacgaaagctacatttggagtccacctcaaaatcgtcggcgactggactgagaggtttcgcgaccttctgctgccccccagctctcaggactctgagattttacctttcatacagagccgcaattatccaaaagacgattggaagccctacaagctgagacggctctacttcatttgggtgtgtagggacatccagagcttcagatggtttgcggacctgctgtgtatgctgcacaacaaattttggcaagagaatcgcccggactatgtgaacatccagctttatctatctcagaccgatggaattcagaaaatcattggcgagaaataccatgcgctgaacagtaggctttttatcggccgtcctaggtggaagctactgtttgatgagatcgccaagtataatagaggaaaaacagtcggagtgttctgttgcggtcccaacagcttgtctaagactctgcacaagctcagcaaccaaaacaactcctatgggacaaggtttgagtataacaaggaaagctttagttag

SEQ ID NO: 125813 - DNA, 1665 bp, Artificial Sequence
  Description of Artificial Sequence: Synthetic coding sequence
atgaacgtacttcttttttggaagacatttttgctgtataatcaggggcccgagtaccattacctgcaccagatgctggggcttggcctgtgtctctcgagggctagcgcctccgtgctaaatttgaattgttccctgatattactgcccatgtgccgaaccctcctggcctatctgcggggtagccaaaaagtgccctcccgcaggacacgaaggctcttggataagtctcgcacttttcacattacttgcggagtaacaatttgtatcttcagcggcgtgcatgttgcagctcacttggtgaacgccctgaacttcagcgtaaactattctgaggattttgtggagctaaatgccgcccgctatagagacgaggacccccgcaaactgttattcacaacagtcccgggacttaccggtgtgtgtatggtggtggtgctcttcctaatgataacagcttccacatacgccatacgcgtgtcaaactatgacatcttttggtacacacacaacttgttcttcgtgttttacatgctgttaacattgcatgtgtcaggcggtctgctgaagtaccagactaacctagacacccatcctcccgggtgtatctctcttaatcgcactagcagtcagaacattagtcttccggagtacttcagcgaacacttccacgaaccatttccagaaggattctcaaagcccgctgagttcacacagcataagtttgtgaaaatttgtatggaggagcctcggttccaggcaaatttcccgcagacctggctttggatctctgggcccctctgtctctactgcgcagagcgcttgtatcgctacatccggagtaataaaccagttactatcatcagcgttatgtcacatccctctgatgtcatggaaattcgaatggtcaaggaaaatttcaaggcacggccaggtcagtatattaccctacactgcccgtccgtatccgctcttgaaaatcatccttttaccttaactatgtgtcccacagagacaaaggccacctttggtgttcacttgaagatcgtgggcgattggaccgaaaggttccgtgacctcctgctcccaccgtcatctcaggacagcgagatcttgccgttcattcagagccgaaactatcctaagctgtacattgacgggcccttcggttcccctttcgaggagagcctgaactacgaagtgagcctttgtgtcgccgggggaattggggtgaccccttttgcaagcattcttaacactcttctggacgactggaaaccctataaactgcggaggctctatttcatttgggtctgtagagacatccagtcctttcggtggttcgccgacctgttatgcatgctgcacaataaattctggcaggaaaaccggccagactatgtgaacattcagttgtacttgagtcagactgacggaatccagaaaattattggcgaaaagtatcatgcgttgaacagccgattatttattggccggcccaggtggaagctgctcttcgatgaaatcgctaagtataataggggtaagactgtgggcgtgttctgttgcggtccaaattctctgtccaagacactgcacaaactgtccaatcagaataattcctacggcacccgctttgaatataacaaggaatccttttcatag

SEQ ID NO: 125814 - DNA, 1665 bp, Artificial Sequence
  Description of Artificial Sequence: Synthetic coding sequence
atgaacgtcctgctgttttggaagacattccttttgtacaaccaaggtccagagtaccattacctgcaccagatgctgggcctgggtctgtgtttgtcaagggcatccgcctccgttctcaacctcaattgtagcttaattctgttgccaatgtgccgaactctgcttgcgtacctgcgcggtagtcagaaggtaccgagccgtcgtaccaggaggctcttggacaaatcccggactttccacatcacatgcggcgtgaccatctgtatattcagtggagtgcatgttgccgcccatctggtgaatgcactcaacttctcggtgaactactcagaggactttgttgagctgaacgccgccagatatagggatgaagatcccaggaagcttctgtttacaaccgtgccaggcctcaccggcgtgtgcatggtcgtcgtgctcttcctgatgatcacggctagcacatatgccatccgcgtgagcaattacgatatattctggtatacccacaacctgtttttcgtattctacatgttactgaccctgcatgtgagcgggggtttactgaagtaccagaccaatctggacacccatccaccgggttgcatctctctcaatagaacatccagccaaaacattagcctccctgaatatttctcagaacactttcacgagccatttcctgagggatttagcaagccggcagagttcacacaacacaaatttgtaaaaatttgcatggaggaacccagatttcaggctaatttccctcagacatggctctggatcagcggaccgctgtgcctctattgtgccgagcgattgtacaggtatatacgctcaaacaagccagtcaccatcatttctgtaatgtcccacccttctgacgttatggaaattcgcatggtgaaggagaacttcaaagctcgacccggccaatacattacattgcactgtcccagcgtgagcgctctggaaaatcatcctttcacattgacaatgtgcccaaccgaaaccaaagcaacttttggtgtgcacctgaaaattgtgggagattggaccgaacgcttccgtgatcttcttctgccaccatcatcccaagactctgagatcttgccgttcattcagagccgcaattatccaaagttgtacatcgacgggccctttggcagcccattcgaggaaagcctgaattacgaggtgtctctgtgcgtggcaggcggcatcggagtaactccgtttgcatctattctcaatacgctgctggacgactggaaaccgtataaactgaggcgactgtatttcatatgggtgtgtagagatatccaatctttccgttggttcgcagaccttctgtgtatgttgcataataagttttggcaggaaaaccgtcccgactacgtgaatatccagctctacctgtcacagacagatggtattcagaagattatcggggagaaatatcacgcccttaattcccgactgtttatcggcaggccccgctggaagcttctatttgacgaaattgccaaatacaaccgcgggaaaaccgttggcgtgttttgctgcggtcctaattcgctctcaaaaacgctccacaaacttagtaatcagaataattcctacgggacaaggtttgaatataataaggagagcttttcctag

SEQ ID NO: 125815 - DNA, 2193 bp, Artificial Sequence
  Description of Artificial Sequence: Synthetic coding sequence
atggccttcgtctgtgcaggacttagtgatactatgtccgctgaggaagatgcccgatggctgcgctgggttacccagcagtttaaaaccatagccggagaagatggtgagattagccttcaggaatttaaggcagccctccatgtcaaggagtccttttttgccgagagattttttgcactttttgactccgacagatctggcactattaccttacaggaactgcaggaggctttgactctcctcatccacggctctcccatggataagctgaaatttctgttccaagtttacgacatcgacggttcaggaagcatcgatcctgacgagctgaggaccgtgttgcagtcctgcctgagagaatccgccatttctctccctgacgagaagttggaccagctcactctggcactgtttgagtctgcagacgctgacggaaacggcgccattacattcgaagaactccgggacgaactccagaggtttccgggcgtcatggaaaacctcacgatcagcgccgcacattggctcaccgccccagcacccaggcccagaccacgccgtccgaggcagctcactcgggcgtattggcacaaccacaggtcccagctgttctgtctggccacctatgcgggcctgcacgttctcttattcggactggctgcttccgctcaccgcgacctgggagcctctgtaatggtggctaaagggtgcggccagtgtctgaactttgactgtagttttatcgccgtactcatgttacggcgatgtctaacctggctccgcgctacctggctggcccaggtactgcctctggaccagaacatccagttccaccaactgatggggtacgtcgttgtgggcctatcccttgtgcataccgtggctcatacagtgaactttgtgttacaggctcaggccgaggcttctcccttccagttctgggagctcctgctcaccacaaggcccggcattggctgggtccacgggtcagcctcccctacaggcgtagccctcctgttgcttctgctcctcatgttcatttgtagctccagctgtatccggaggtcagggcattttgaggtcttttattggacccacctgagctaccttctggtttggcttctgctgatatttcatggacctaatttttggaaatggctcctggtgccggggatcctgttttttcttgagaaggccatcggactggccgtgtcacggatggctgccgtctgcattatggaagtaaacttgctcccttccaaggtgactcacctgctgatcaagcgtcctcccttttttcattaccgacctggggactatctgtacctgaacattccgacgattgctaggtatgaatggcatccttttaccatcagctcagcacctgagcaaaaggacacaatttggcttcacatccgcagccaaggtcagtggactaaccgtctctatgaaagttttaaagccagcgatcccctgggacggggtagtaaacgattgtcccggtccgtgacaatgcgaaaatctcagagatcctctaagggctcagagatcctgctcgaaaagcataagttttgcaacatcaaatgttatatcgacggcccctacgggaccccaactcggcggatcttcgcctctgaacacgcggtgttgattggcgcaggaataggtatcaccccatttgccagtattttacagagcattatgtaccggcatcagaaacgaaaacatacatgcccaagctgccagcactcttggattgagggggtgcaggacaatatgaagttacacaaggttgacttcatctggataaatagagaccagcgatcctttgaatggttcgtttcactcctgacaaagttggaaatggaccaagctgaggaagcccagtacggaagatttctagaactccacatgtacatgacctcagccctgggcaagaacgatatgaaagctattggactgcagatggcactggacttattagccaacaaagagaagaaggattccataactggactccaaacaaggacccagccaggccgacccgattggagcaaggtgtttcagaaggtggccgcggagaaaaagggcaaagtgcaagtgttcttttgcggcagtcccgccttggccaaagtgcttaaggggcattgtgagaagtttggattccggttcttccaggagaatttctag

SEQ ID NO: 125816 - DNA, 2298 bp, Artificial Sequence
  Description of Artificial Sequence: Synthetic coding sequence
atgaatacatccggtgaccctgcccagaccggtccggagggttgcaggggaactatgtccgctgaggaggatgcccggtggttgagatgggttactcagcaatttaaaacaattgctggagaagatggagagatcagcctgcaggagttcaaggccgcactccacgttaaggagtcttttttcgctgagcgattcttcgcactgtttgacagcgatcgctccggaacaataacgctccaagaactccaggaggctcttacgctgttgatacacgggagtcctatggacaagctgaaattcctgttccaggtgtacgatatagacgtttgcgcccgccagggtgctagtgcaggaaccgagtggggagcaggggctggaccccactgggcaagctcacctttaggtaccgggtccgggagtattgacccagacgaattacgaacggtactacagagctgcctgcgggagtcagctatctcgctgccagacgagaaactcgaccagctgactcttgccctttttgaaagtgcggacgctgacgggaacggagctattacttttgaggagttgagggatgaactgcaaaggtttcccggagtcatggagaatctcactatctccgccgcacactggctgacagcgcctgctccacgcccacgcccgaggagacctagacagcttactcgggcgtactggcacaaccacaggtcccagctgttctgcctggcgacatacgctgggcttcatgtcttactttttggtcttgccgcctctgcacaccgggacctgggagcatcggtcatggtggctaagggttgcggccagtgtctgaacttcgattgttccttcatcgctgtgctcatgctcaggcggtgtctgacctggctgcgggctacatggctcgctcaggtgctacccctagaccagaatatacagtttcaccagctgatgggctacgtcgtggtggggttgtctcttgtgcatacagtggcccacaccgtgaactttgtcctgcaggcccaggccgaagcttccccctttcagttttgggagctactgctgacgacccgcccggggataggatgggtccatggctcagcatcgcctactggagtggctttactgttgctactgctcctgatgttcatttgctcttccagttgcatacggcggtcaggacattttgaagtgttttattggactcatctgtcatacctgctggtgtggctgcttttgattttccacggccctaacttctggaagtggctgctggtcccggggattctattcttcctcgaaaaggctatcggcctggctgttagtaggatggccgccgtgtgtataatggaggtaaatcttttaccctcaaaggttacgcacttattaattaaaagaccgccgttctttcactatcggcccggagactatctttatctgaatataccaactattgccagatatgagtggcatccattcaccatctcttccgctcctgagcagaaagataccatatggctacacatcagatcccaaggacagtggacaaacagattatacgagagctttaaggcttccgatccattagggcgcggcagtaaacggctgtcaagaagcgtcaccatgaggaaatctcagaggtcatcaaagggttccgaaattctccttgagaaacataagttttgcaatataaagtgttacatagacggcccttatggtaccccaacccggcgcatcttcgcctcagaacacgctgttttaatcggcgctgggattgggatcacaccatttgcgtccattctgcagagcatcatgtaccggcaccagaagaggaaacatacatgtcctagttgccagcactcatggatcgaaggcgttcaggataacatgaaactccataaggtggactttatttggattaaccgggatcagaggtctttcgaatggttcgtcagtttactcaccaaactggagatggatcaggcagaggaagcccagtacggccgcttcctggagctccacatgtacatgacttctgcgctaggaaaaaatgatatgaaggcaataggtctgcaaatggcactggatctgctggccaacaaggagaaaaaggactcaatcaccggacttcagacaaggactcaaccaggcaggcccgattggagtaaagtttttcaaaaagtggctgctgaaaagaagggcaaggtgcaggtcttcttttgcggatctcctgcgctcgctaaagtgctcaaggggcattgcgaaaagtttggcttcaggttctttcaggaaaacttctag

SEQ ID NO: 125817 - DNA, 2214 bp, Artificial Sequence
  Description of Artificial Sequence: Synthetic coding sequence
atgaacacgagcggagatcccgcccaaactggacctgaaggctgtcggggtaccatgagcgccgaggaagacgccagatggctccgctgggtaacacagcagttcaagactattgcaggtgaggacggggagatctctttgcaggagttcaaagcggctctgcacgttaaggaaagttttttcgcggaaagatttttcgcactgtttgatagcgataggagtggtacaatcactctccaggaattgcaagaagccctgacgttacttatccacgggagtccaatggataaacttaagttcttgttccaggtttacgatattgacggtagcggaagcatcgatcctgatgagctgcgcaccgtcctgcagtcgtgcctgcgcgaaagcgcaatttccctacccgatgagaagctcgaccagctcactctcgccttatttgaatctgctgacgcagatggcaacggagcaatcacctttgaggagctgcgagacgaactgcaacggttccccggtgtcatggagaacctgacaattagtgcagcacactggctgaccgcccctgcgccccgtccacggccccggcggcccagacaactgacccgggcatattggcataatcaccgtagccagttgttctgcctcgcaacctatgcaggcctccacgtgctgttattcggtctggctgcatcagcccatcgtgatctgggcgcttctgtcatggtggccaaggggtgcgggcagtgcttgaacttcgactgctcgttcatcgccgtcttgatgctgaggcgatgtctaacctggctcagggctacttggctggcccaggtcttacctctagatcaaaatatccagtttcatcaattgatgggttatgtggtcgttgggctgagtctggtacacaccgtcgcccacacagtcaacttcgttcttcaggctcaggcagaagcttcaccctttcagttttgggaacttttgctcactactcgccctggaatcggctgggtacatggatctgccagccctacaggcgtggccctcctcttgctccttttactaatgttcatttgctcatcgtcttgcatcaggcgatctgggcattttgaggtattctattggacccatctcagctacttattggtctggctcctccttatctttcacggaccgaacttttggaaatggctgctcgtccccggcatcttattctttctcgaaaaggcaattggattggcggtaagcagaatggccgccgtctgtatcatggaagtcaacttattgccatcaaaggtcacccatcttctgataaaaaggccccctttctttcattatagaccaggcgactacctgtatctcaatatccccacaatagcccgttacgagtggcacccctttaccatcagcagcgcaccagagcagaaagacacaatctggttgcatattcggagccagggacaatggactaaccgcctgtacgagtcattcaaagccagcgatccactcgggcggggttcgaagcgcctgtctagaagtgtaacaatgcggaagtctcagcgtagttctaagggtagtgagattctgcttgaaaagcataaattctgcaacattaagtgctacatcgacggtccctatggaacacctacacggcgcatctttgcttccgagcatgccgtgctcataggggccggaatcggaattactccgtttgcatcaatcttacagtccataatgtatagacaccagaagaggaagcacacctgtccttcctgccagcactcctggatcgagggcgtgcaggacaacatgaaactgcataaagtcgatttcatctggatcaaccgcgaccagcgaagctttgagtggtttgttagcctcttaaccaagctggagatggaccaggccgaagaggcacagtacgggcgatttctcgagctgcatatgtacatgacctcagccctcggaaagaatgatatgaaagcgatcggactgcagatggctctggatctgctggctaacaaagaaaagaaggacagcatcaccggcttgcagacccgaactcagccgggacggccggactggtcgaaggttttccagaaagttgcagccgaaaaaaagggcaaggtccaagtgtttttttgcggaagccctgccctagctaaggtgttaaaaggccactgcgagaagttcgggttccggttttttcaggagaacttctag

SEQ ID NO: 125818 - DNA, 4419 bp, Artificial Sequence
  Description of Artificial Sequence: Synthetic coding sequence
atggataatgccctcttctgtcttgccgctgtgtctaatctcgacattgagtccaagctctccgtgtattatcgcgcgccctggcaccagcaacgtaacatttttttacctgctacaagaccaccctgtgtggaggagctgcacagacatgccaggcagagcctgcaagccctccgacgcgagcacaggtcaaggagcgaccggcgtgagcagagagccgccgcgccgctgtccatagccgctccacccctccccgcctatcctcctgcacatagtcaacgccgacgcgagttcaaggacaggcatttcctgactttcaattcaacaagatccccgtccccaacagagtgctgtcatatgacgccatggagtaggaagtctcacccaccggaggacgaggacacagatgttatgctgggccagcgccctaagaatcccattcacaacatcccatctactctcgacaaacagaccaattggtcaaaagccctcccccttccaaccccagaggaaaaaatgaaacaagacgcacaggtgatatccagttgtataattcctattaacgtcaccggggtgggcttcgaccgggaagcatctattcgatgctctctggtgcactcgcagtccgtcctccagcgccgcagaaaattgaggcgaagaaagaccatatccggcattccacgcagagtgcaacaggagatcgactcagatgagagtcccgtggcacgcgagagaaacgtgatagtccacaccaacccggacccgagcaacacagttaatcgaatctcaggcaccagggatagcgagtgccagactgaggatatcctcatcgccgctccttctagacgtcggattagagctcagagggggcagagtatcgctgcatctctgagtcatagcgcagggaatatcagcgcccttgctgacaaaggtgataccatgtttacccctgccgtatcgtcaaggaccaggagtcgctcccttcccagggaaggaaacaggggaggcgacgcagagccgaaggtgggtgctaaacctagtgcatatgaggagggcgagtcattcgttggcgatcatgaacgaaccccaaatgacttctctgaagctcccagtagtccatctgcgcaggaccatcagccaaccctcggcttggcttgttcgcagcacctgcactcacctcaacacaagctttcagagcgtggcagatcccgactgagcagaatggctgcggattccggctcctgcgacatatccagcaacagcgatacctttgggtctcccatccactgcatttccacggccggggtcttactttccagccatatggaccaaaaagacgatcatcagtcttcatcaggtaattggtcaggcagctcttcgacatgccctagtcagactagcgagaccatccctcctgctgccagtccacccctcactggaagttcgcactgcgactctgaattatctctcaacaccgctccacacgccaacgaggatgcctctgtgttcgtcacagaacaatataacgaccacctggataaggtccgcggccatagagcaaactcattcacatccaccgttgccgacttgcttgacgaccctaataattccaatacttcggatagtgagtggaactatctgcaccaccatcacgatgctagctgccgccaggatttcagccctgagcgaccgaaggccgattcattagggtgtcctagtttcaccagtatggcaacctacgatagcttcttagagaagtccccttcagacaaagcggacacttcttcacatttttcagtagacaccgaaggatattatacctccatgcatttcgattgtggactgaagggtaacaaaagctacgtctgtcattatgcggcactaggaccagaaaatgggcaaggagtgggggcctctccaggcttgcctgactgtgcatggcaggactatctggaccacaagaggcagggtagaccctccatcagctttcgcaagcccaaagcgaagccgacccctccgaaacgtagctcctcccttagaaaatctgatggcaatgccgacatcagtgagaaaaaggaacctaagatctctagcggtcagcatctgccccattcatcacgcgaaatgaaactcccactggacttcgcaaacacgcctagccgcatggaaaacgcaaatttgcccacaaaacaggaaccatcctggattaatcagagtgagcagggcattaaggagcctcagctggacgcatcggatattcccccatttaaagatgaagttgcagagtctacccactacgccgatctgtggctgctgaatgatctgaagactaacgatccatataggtccctgtccaacagttctacagccacaggaactaccgtgatcgagtgtattaagtctcctgagagttccgaatcccagacaagccagagcgagtccagggccacaacaccgtccctcccctccgtcgataatgagttcaagttggcctcaccggagaagttggccggattagctagtccgagctctggttacagcagtcaatcagaaacccccacttcctctttcccaacggcgttcttcagtggccctctgtccccagggggatcaaagaggaaacctaaagtgcccgagcggaaatcaagcttgcagcaaccttcgctgaaagacggaacaatctccctatctaaggacctcgagctgccaattattcccccgacacatttagacttgtccgctctccacaacgtgctcaacaagccgtttcatcatagacacccacttcacgtcttcacccataacaagcagaataccgtgggcgagaccctccgaagcaatcctccaccgtccctggccataacgccaacaattctgaagtctgtgaatctgcgtagtatcaacaagtccgaagaagtgaaacagaaagaggagaacaatacagatttgccttacctcgaggagtcaactctgaccacagctgccctgtccccgagcaagatcagaccccacactgccaacaagtctgtgagtcgacagtattctactgaggacacaatactcagctttctggattctagcgctgttgaaatgggtcctgacaaacttcatctggagaaaaattcaacctttgatgtgaagaatagatgcgatcccgaaaccatcacgtcagccggtagcagtttactagattctaacgtgaccaaggatcaggtacggacagaaacggaaccaattccagaaaatacccctacaaagaactgcgctttccctacggagggttttcagcgagtgtctgccgcccggcctaacgacctggacgggaagattatccagtatggccccggacctgatgagactctggaacaggtccagaaggcaccctctgccggtctcgaagaggtggcccagcccgaatccgtggacgtgattacaagccaatctgattccccgacacgagcgactgacgtgtccaatcagtttaagcaccaattcgtgatgagcaggcatcatgacaaagtccccggcacaatcagctacgagagcgagatcacttcagttaactccttccccgaaaagtgctccaagcaggagaacatcgcaagcggcatcagtgcaaagagcgcttcggacaattctaaagccgaggagacccaggggaacgtggacgaagcttctcttaaagagagtagcccatctgatgatagcatcatctcccccctgagcgaagatagccaggcggaggccgaaggggtgtttgtgagcccgaacaagcctcgtacaacagaagacctcttcgcggtaattcaccgatctaagcgtaaggttctcggtcgtaaggactcaggggatatgtcagtgagaagcaagagtagggcccccctctcttcatcaagcagcagcgcgtcatctatcacctctccctcgtctaatgtaactacaccaaactcccagaggtcacccggcctaatctatcggaatgccaagaagtctaatacttcaaacgaagaattcaagctcctgctgctcaagaaagggtcaagatccgacagcagttataggatgagtgctactgagattctcaaatccccaatcttgcccaaaccacccggagagctgaccgctgagtcccctcagtccactgacgatgcgcaccagggatcccagggggccgaggcactaagccctctgtcgccctgtagccctagggttaacgccgaagggttcagttctaaatcctttgccacaagtgcatctgcccgggtggggcggtctcgcgccccccctgcagccagctcgagccgatattcagtgcgctgccggctgtacaacaccccaatgcaggctatcagcgagggtgagaccgagaactcagatgggagccctcatgatgacagatcctcacagtcttccacgtag

SEQ ID NO: 125819 - DNA, 4893 bp, Artificial Sequence
  Description of Artificial Sequence: Synthetic coding sequence
atgccttttgccaaaaggattgtagaacctcagtggctgtgtcgtcagcgcagacccgctccaggtcctgcggtggacgcgagcggcgggtccgcagaacccccgccaccgctgcagccgcccggcagaagggacctggacgaagttgaggctcctggccctgaagaacccgccagagctgtgcccgcgccctcgggtctccctcccccccctcccccgcttcctgcacctgcagaccagacacagcccccgcacggtgaagcctccgtggccggagaggagagcaccgccgggataccagaggccgctccggcagctggagaggctagtagcgcagccgccgccgccgccgtgttgctgatgctggatctatgtgccgtttctaacgccgccctggcccgcgtactgcgacagcttagtgacgtagcacggcatgcgtgtagcttattccaggagcttgagagtgacatacagctgacgcaccgacgggtttgggccctgcaaggcaaattaggaggagtgcagcgtgtactcagtaccttggatccaaagcaggaagcagtcccagtgagtaatctggacattgaatcaaagctcagcgtgtactaccgggccccctggcaccagcaacggaacatttttctgccagctactagaccaccctgcgtggaagagctgcatagacacgcacgccagtccctccaggctcttcgcagagagcatcggtcacgcagtgatcgacgcgagcagcgggcagccgcgcctctgtccatagctgccccacccctgcccgcatacccccctgcacactcccaaaggaggagagaattcaaggacaggcactttctgacctcacatccccccgaggatgaggataccgatgtgatgttaggccagcgcccaaagaatcccatccacaatatccccagcacccttgataagcaaaccaattggtctaaggccctccccctcccgacaccggaggagaagatgaaacaggacgcccaggtcataagctcctgtatcattcctatcaacgttacaggagttggtttcgatagggaggcttcgataagatgtagccttgtgcattctcagtcggtcttacagcggaggaggaagcttcggcggagaaagacaatctcagggatccctcgacgggtgcagcaagagatcgactctgacgagtctccagtggcccgggaacgcaacgtaatcgttcataccaatcccgacccatctaatacagtgaatagaatcagcggtacgagagacagtgagtgccaaacggaagatatcctgatcgctgccccctcgaggcgaagaataagagctcagagaggccaatccattgcggcatctctttcccattcagcaggaaacattagcgctcttgcagataaaggcgacactatgttcacgcctgccgtgtcttccagaacgcgatctaggagtctgccccgggagggcaaccggggaggcgacgcagaaccaaaagtgggcgctaagccttcagcgtatgaagagggagagtcctttgtgggagatcacgaaagaactcccaatgacttttcggaggcgccaagcagtccaagcgctcaggaccaccagcctactcttggactcgcttgtagccaacaccttcatagcccacagcacaaacttagtgagagggggagaagcagactatctcggatggccgcggattcaggcagttgcgatatatctagcaattctgatacgtttggttctcctatccattgcatcagcaccgccggcgtgctcttgtcatctcacatggaccagaaagacgatcaccaaagctctagcgggaattggtccggctcttcttctacctgtcccagtcagacttctgaaaccatcccgccggcagcgagccccccattgacaggaagcagccattgcgacagcgaattatccctcaacaccgctccgcacgcaaacgaagatgcctccgtgtttgtcactgaacagtacaatgaccatcttgacaaagttagggggcacagggcaaactcgttcacatccacagtagccgacctgcttgacgaccctaacaattcaaacacaagtgattcggagtggaactatctccaccatcatcacgatgcctcttgtagacaggacttctcgcccgagcggcccaaggcagatagtttggggtgtcccagctttaccagcatggcgacgtacgattcatttcttgagaagtcgccttcagacaaagccgacacttcaagccacttcagcgtcgacaccgagggctactatactagcatgcatttcgattgcggcctgaaggggaacaaatcctacgtgtgtcactacgcagcactcggacctgaaaatgggcagggcgtgggcgcatcgcccggcctgcccgactgtgcatggcaggactatttggaccacaagagacagggaaggccaagcattagctttcgtaagccaaaggccaaaccaacacctcccaaacggtcttcttctctacggaagtcagatggcaacgctgatatcagcgaaaagaaggaacctaaaatatccagtggccagcacttacctcatagctcccgggaaatgaaactccctctggacttcgcgaacactccttctagaatggagaatgctaatctgccaactaaacaggagccatcctggatcaatcaaagcgaacagggcatcaaagaaccccagttagatgccagcgatattcccccttttaaagacgaagttgccgagtcgactcactatgccgacttgtggttgctcaacgatctcaaaacgaacgatccataccgttcactgagcaatagtagcacagccactggcacgactgtaatcgagtgcattaagtccccagagtcctcagagtcacaaacatctcagtctgagagccgggccaccactccttcgcttccatcggtagacaatgaatttaaattggctagcccagagaaactggcaggtctagcttcacctagcagcggctattccagtcagagcgaaacccctacaagctccttcccaacggcatttttctctggcccattgtctcctggagggagtaagcgcaagccgaaagtgcctgagagaaaaagcagcctgcagcagccctccttgaaggacggtactatcagtctgagtaaagatctggagttaccaattattcccccaacgcacctggatctcagcgcgctgcataatgtcctgaataaacctttccatcacaggcatcctttgcacgtgttcacacacaacaagcagaacaccgttggcgaaacgctgaggtctaaccctccccccagcctggccattactccgactatcctgaaatcggtcaatctgcggtctataaataagtccgaagaggttaaacagaaagaggaaaacaacacagacctgccatacttggaggagtcaactcttaccacagctgccttatctccctctaaaatacgcccacacaccgcaaacaaatcggtgtcgagacagtatagcacggaagacactatactctctttcttagactcatcagcagtcgagatgggacccgataagctgcatctggagaagaactccacatttgatgtcaagaatcgctgcgacccggaaacaatcaccagtgctggatctagtcttctggacagcaatgtcacaaaggatcaagtgcgcaccgagaccgagcccataccagagaacacacctaccaagaattgcgcatttccaacggaaggcttccagagagtttctgccgcgcggcctaatgatttggatgggaagataatccagtacggccctggtccagacgagaccctcgaacaggttcagaaggcacctagtgccggacttgaggaggttgcccagcctgaatcggtggatgtcataacatcgcaaagcgattcaccaaccagagccaccgatgtgagtaaccaattcaaacatcagttcgtgatgtctcgccaccacgacaaggtccccggcacaataagttatgagagtgaaatcacgagcgttaattcatttcctgaaaaatgtagcaagcaggagaacatcgcgagtggtatctccgccaagtcagcttctgataatagcaaggcggaggagactcaagggaacgtggatgaggcctctttgaaagagtcctctccgtcagacgactcaataatctctcctctttccgaggatagtcaggccgaagctgaaggggtctttgtaagtcctaataagccccgtacgacagaggacctgtttgcagtgattcatcgcagcaagaggaaagtcttagggagaaaagactcgggcgacatgtcggtgagaagcaaatcccgtgcccctctgtctagtagcagctcttctgctagctcaattaccagcccatctagcaatgtgaccaccccaaacagccaaaggagtcccggccttatctaccggaacgccaagaaaagcaacaccagcaacgaagaattcaagctgctgctgttgaaaaaaggaagccgcagtgactcaagttatcgtatgtccgcgacggaaatcttgaaaagcccaatcctccccaaaccgccaggggaactgaccgccgaatcccctcagtctaccgatgatgcccatcagggcagccagggagccgaggccctgagccctttgagtccatgcagtcctcgtgttaacgcagaggggttttcaagcaagagcttcgctacatctgcgtctgccagagtgggaagatccagagctcctcccgcagcgtcgtcctcccgatacagcgtgaggtgccgcctgtacaatacgcccatgcaggcgatttcagagggcgagaccgaaaactcagacggcagtccacacgacgataggagttctcagagctcaacctag

SEQ ID NO: 125820 - DNA, 4425 bp, Artificial Sequence
  Description of Artificial Sequence: Synthetic coding sequence
atggccctggcgtgttgtatgcctaaaaacgccgccgtaagcaacctcgatattgagagcaaactgagcgtttactatcgcgccccatggcatcagcagaggaacatctttctccctgctacccgacccccttgcgttgaggaactgcaccggcatgccagacaaagcctgcaggctcttcggcgggagcatcgcagcaggtccgacaggcgcgagcagcgtgccgctgcccctctctccattgcggctcctcctctccccgcgtacccccctgcccatagccaacgccggagggaattcaaggacaggcattttcttacattcaattccacccggagtccatccccaaccgagtgttgtcacatgaccccatggtctcggaaatcccaccccccagaggatgaagacacggatgtgatgttgggtcaacgacccaagaatcccatccataatataccttctactctggacaaacagacgaattggagtaaagccctgccccttccgaccccagaggagaaaatgaagcaggatgctcaggtcatctcaagctgcataatccccattaacgtaactggcgtgggcttcgaccgagaggcaagcattcgttgctcccttgtccactcccagtccgtcctccagagacggaggaagctgcgaaggaggaagacaatctcagggattccgagacgagtccagcaggaaattgattctgatgaatctcctgtagcccgagagaggaatgtcattgtgcacaccaaccctgacccaagcaacacagtaaacagaattagcggaacgcgagattctgagtgccagaccgaggatatccttatagccgcgccttcacggcgccggatccgggcgcaaagaggtcagtccatcgcggcctcactgtcacatagcgccggtaacatctcagcgctcgccgataaaggcgatactatgttcacaccggctgtgtcctcgaggacacgaagtcgctccctcccacgagagggcaatcgggggggggacgccgagccaaaggtcggtgcaaagccatccgcttatgaggaaggcgaatcatttgtgggagatcatgaacggacacccaatgatttcagtgaggcccccagttctccgtccgcccaggaccatcagcctactctcgggcttgcctgttctcaacacctccactccccacaacacaagctatccgagagaggtcggagcagactgtccagaatggccgctgacagtgggagttgcgacatatcaagcaactctgacacgttcgggagtcccatccactgtatttctacggccggcgtcctcctgtccagtcatatggatcagaaggacgatcatcaatcttccagtgggaactggtccggatcctcttctacttgcccatcccaaacatccgaaactattccacctgccgcctctcctccgctgactggctcatctcattgcgacagtgagttgagcctgaatacagcccctcacgccaacgaggacgcatcagtgttcgtcacagaacagtacaatgatcacttagataaagtccgggggcaccgtgccaattctttcacaagcaccgtggccgatttattggatgacccaaacaattccaacacgtcagattccgagtggaactatctccatcaccaccatgacgcctcttgtcggcaggactttagccccgagcggccaaaagccgattctcttgggtgcccttcattcactagcatggcaacctatgatagtttcctcgagaagagtccttcagataaggccgatactagttcgcatttctccgtggatacggaaggctactatactagtatgcattttgactgtggattaaaaggaaacaaatcctacgtatgccattatgccgcactggggccagagaacgggcagggtgttggtgcttcacctggcctgcctgattgtgcttggcaagattacctcgaccacaaaagacagggtagaccctccatcagcttcagaaagccgaaagcaaagcccaccccccctaagcgtagtagctctctgaggaaatcagacggcaatgctgacataagcgagaagaaagaaccgaagatcagcagcgggcagcatctgccacacagttcacgagagatgaaactgcccttagacttcgccaacaccccttctcggatggagaatgccaatcttccaactaaacaggaaccatcttggataaatcagtccgagcagggaattaaggaaccacagctggatgcctccgacattccgcctttcaaggatgaggtggccgagagtacacactacgccgatctctggctgctcaatgacctgaaaaccaatgatccctaccggagcctgagcaacagcagtacagcgacgggtactaccgtgattgaatgtattaagagtcctgagtcaagtgaatctcagacgtctcagtccgagagcagggccacaaccccgtccttgcccagcgtggataacgagttcaaactagcttcacccgagaaattggcaggactcgcctccccatcctccgggtacagcagtcagtcggagacacccacatcctcctttcccaccgccttcttttccgggcctctgtcacccggtgggtccaagagaaagcccaaggtacccgagcgcaaaagctcattgcaacagccatcgctgaaagacggcacaatctcgttgtctaaagacctggaattgccaatcatcccaccaacccatcttgatctcagtgccctgcacaatgtacttaataaaccctttcaccatagacacccactgcatgttttcacccacaataagcagaatacagtcggggaaactttgcgatccaacccaccccccagcttggctatcacaccaacaattctcaagagtgtgaatcttaggtctatcaacaaatctgaagaggtgaaacagaaggaagaaaacaataccgacctgccttatttagaggaatctaccctgacaacagccgccctctcaccatcaaaaattagaccccacaccgcgaataagtctgtgtctagacagtactcgacagaggacaccatcctgtcctttttggactcctctgctgtagagatgggtccagacaagctccatctggaaaagaacagcacctttgacgtgaagaatagatgcgaccctgagaccataacctctgccggatcttcattactcgattcgaacgtgacaaaagaccaagtacgtaccgagacagagcccattcctgagaatacccctacaaaaaactgcgctttccccaccgagggatttcaacgcgtgtctgctgcacgccctaacgaccttgacggtaagattattcagtatggcccaggcccggatgaaactctggagcaggtacagaaggcaccttcggccgggctcgaggaggttgcccagcctgagagcgtggacgtgatcacctctcagtccgattctcctacacgagccaccgatgtgtctaaccaattcaaacatcagtttgtaatgagccgccaccacgacaaggtgccggggactatttcctacgaatcagagattacatcggtgaactctttccctgagaagtgttccaagcaggaaaatattgccagcggtatttctgctaagtcagcttctgataattctaaagccgaggaaacacagggaaatgttgatgaagcatcccttaaagagtcatctcccagcgacgacagcattatcagtccactcagcgaggattctcaggccgaggctgagggagtgtttgtatctcctaacaaaccaagaacgacggaagacctgtttgccgtaattcatcgctccaagcggaaagtgctggggcgtaaggactctggcgacatgtccgttcgatcaaaatcccgtgccccgctcagttcatcctcctctagtgcatcctctattacatcacccagttccaacgtgacaactcccaatagccagcgaagtccagggctgatctatcggaatgctaaaaagtccaacaccagcaacgaggagtttaaactgttgctcctcaaaaagggaagtagaagtgatagtagctaccgcatgtccgctaccgaaatccttaaaagccccatcctgcccaaacctccaggagagctcaccgcagaaagccctcagagtaccgatgatgcccaccagggctcacagggtgccgaggcactgtcccctttgagcccttgttcaccgcgagttaacgcagaaggattttcttccaaatcttttgccaccagcgcgagcgcaagggtgggacgctccagagctcctcccgccgcctcttcttcacggtacagcgtgcggtgccggctgtataacactcccatgcaggctatcagtgagggggagacagagaattcagacggcagccctcacgacgatcgcagttctcagtccagcacatag

SEQ ID NO: 125821 - DNA, 255 bp, Artificial Sequence
  Description of Artificial Sequence: Synthetic coding sequence
cccgaactccaggtgtgcgtgttttgccgtaacaacaaggaagccatggccttgtatactacacatatactgaaggggcctgacggtcgggtcctgtgccctgtgttgcgccgatatacttgcccactgtgtggagcttcgggcgataacgcccacaccataaagtattgtcctctgtcaaaggtcccaccccctcctgccaggccccccccacgttccgctagagacggtccacctggtaaaaagcttagatag

SEQ ID NO: 125822 - DNA, 879 bp, Artificial Sequence
  Description of Artificial Sequence: Synthetic coding sequence
atggaggctttcccttgggcccctcgtagtccccggcgggggcgggcgccccctcctatggcgctggtcccaagtgcaaggtatgttagcgccccaggtcccgcccacccacaaccgttcagctcatggaacgattatctcggtctggccaccttgatcacgaaggccgtggacggtgagccccgcttcggttgtgcgaggggcgggaatgggggcggcggcagccccccgagcagctctagttcttcctgctgtagcccgcacaccggagcaggccctggggccctcggacccgcccttgggccacctgactacgatgaggacgacgatgacgactccgacgaacccgggtcaagaggacgatatttggggagtgcattagaacttcgggccctcgagctatgtgcaggccccgccgaggccgggctcttggaggagcggttcgcagaactttctccttttgcgggaagagcagctgctgtcttgttaggctgtgctcctgccgcagccgccgccgccactaccacctccgaggccaccccaagggaagagcgagccccggcatgggcagctgagccgcgactgcacgcagcttcgggagctgccgccgcccggcttctgaaaccagagctgcaggtgtgtgtcttttgtcgtaataataaagaggcaatggctctgtacaccacccacattctgaaaggcccagatggaagggtgttgtgtccggtgctgcgccggtatacttgccccctctgtggcgcaagcggtgacaacgcccacacaataaagtactgcccgctgtcaaaggttcccccgccacccgcccgacctcctcctcgctccgcccgcgacggcccaccaggcaagaagcttagatag

SEQ ID NO: 125823 - DNA, 3456 bp, Artificial Sequence
  Description of Artificial Sequence: Synthetic coding sequence
atgctcagacgcgtgaccgtggccgcggtgtgtgcaaccaggagaaaattatgtgaggccggccgggagctagctgcactttggggaatcgagactagggggcggtgcgaagactccgcagctgctcggcccttccctattcttgccatgccgggtcgcaataaggcgaagagcacttgttcctgtcctgaccttcaaccaaacggacaggatctcggtgagaactcaagagtagcgaggctgggggccgacgaaagcgaagaggaggggaggcgagggtctttgtctaatgctggtgaccccgagatagtgaagtctccatcagacccaaagcagtaccgatacattaaactccagaacggtctacaggccctcctgatctctgacctctccaatatggaagggaagacagggaacaccactgacgatgaggaggaggaagaggttgaggaggaagaagaggatgatgatgaggacagcggggcagagattgaggacgacgatgaggaaggcttcgacgatgaggacgagttcgatgatgaacacgatgacgacctagatacagaggacaacgaactcgaagagctggaggagcgggctgaggcccgaaaaaaaacgaccgaaaaacagagcgctgccgcactgtgcgtcggagtgggatcctttgccgaccccgatgacctcccaggactcgcccactttctcgagcatatggtattcatgggtagcctgaagtaccccgacgagaacggctttgacgctttcctcaaaaaacatgggggctcggacaatgcatctaccgactgcgaaagaactgtgtttcaattcgacgtgcagaggaaatacttcaaagaggcactcgacaggtgggcccagttcttcattcatccccttatgatacgagacgccatagatagggaggtggaagccgtggacagtgaataccagctggcccgcccatccgatgccaaccgaaaagaaatgctgtttggcagccttgccagaccggggcaccctatgggcaagtttttttggggcaacgccgagaccctgaagcacgagcctagaaagaataacatcgatactcacgcgcgccttcgcgagttctggatgagatattatagtagccattatatgacgttagtagttcaaagcaaagagacccttgatacccttgagaaatgggtgactgagatattttctcaaattccaaataacggcctgcccaggccaaattttggccacctgaccgacccgtttgataccccggcttttaacaagctgtacagagtagtacctatcagaaagatccatgcgctcaccataacctgggcactgcctcctcaacaacagcactatcgggtgaagccattgcattacattagctggctggttggccacgaaggcaaaggctccatactgagcttccttagaaaaaaatgctgggcactggcattgttcggcggaaatggcgagaccggctttgagcagaactcaacgtattcagttttttccattagcatcactttgactgacgaagggtatgagcatttctatgaggtcgcctacactgtgtttcagtacctgaaaatgctgcaaaagttaggcccagagaagaggatctttgaggagatccgaaagatagaggacaacgagttccactatcaggagcagaccgaccctgtggaatatgtggagaatatgtgcgaaaatatgcagctctatccactccaggacatccttacgggggaccagctcttgtttgagtataaacccgaagtgatcggggaagccctgaaccaactcgtcccccaaaaggctaatctcgtgttactcagtggcgcaaatgagggtaagtgcgatcttaaggaaaagtggtttggaacccagtacagcattgaagacattgagaacagctgggctgagctctggaatagcaattttgaattgaacccagatctccatcttcccgcggagaacaagtatattgccacggacttcaccttgaaagcctttgattgtcccgagacagagtatccagtaaagatagtgaacacgccacaaggctgtctttggtacaaaaaggataacaaatttaagatccctaaggcttacattcggttccatcttatttccccactgatccagaaatccgccgcaaacgtggtcctgtttgatattttcgtgaacattctcacccataacttggcagaacccgcgtatgaagctgatgtagcacaattagagtacaagttagttgcgggcgaacacgggctgattatcagagttaaagggtttaatcacaagctgcctcttctgttccagctgatcatcgactatcttgctgagtttaatagtactcccgcggtctttaccatgatcacagagcagctgaagaagacctacttcaacatactgattaagccggagacattggcaaaggatgtccgtctgctgattctggaatatgctcggtggagcatgattgacaagtatcaggctttgatggatggcctcagcctcgaatctctcctctcctttgtcaaagaattcaagagccagctttttgtggagggactcgtgcaggggaatgtaacaagcactgaaagtatggacttccttaagtatgtggtcgataaattgaattttaagccactcgagcaagagatgcctgtccagtttcaagtggtcgaactccctagcgggcaccatctttgcaaggtcaaggctctgaataaaggcgacgccaactcagaagtaactgtgtactaccagtccgggacaaggagtttgcgcgagtacactcttatggagcttctggtaatgcatatggaagagccatgcttcgattttctgcgcactaaacaaacactggggtaccatgtgtacccaacctgcaggaacacctccgggattttggggttttctgttaccgtaggtacccaggcgaccaaatacaactcagaagtagtggacaaaaagattgaggaattcttgagttccttcgaagaaaaaattgagaacttgacagaagaggcctttaatactcaggtgaccgcacttatcaaattgaaagagtgtgaggatacacacctgggcgaggaggtggatcgcaactggaacgaggtggttacccagcaatatctgttcgacaggctagcccatgaaattgaagcactgaagagcttctccaaaagtgacctcgtcaactggttcaaggcccacaggggccccgggtctaaaatgctatcggtgcatgtcgtggggtacggaaaatacgagctagaggaagacggtacccccagcagtgaagactcaaatagcagttgtgaagtaatgcagctgacatatcttcccaccagcccgttattggctgattgcatcatacctatcactgacattagagccttcactacgactttgaatttgttaccctatcataaaatcgtgaaatag

SEQ ID NO: 125824 - DNA, 3660 bp, Artificial Sequence
  Description of Artificial Sequence: Synthetic coding sequence
atgttgcgccgagtgaccgtggccgcagtatgtgcaacccgaaggaagctctgcgaggctgggcgggaactggccgcactgtggggaatagaaacccgaggcagatgtgaggactctgcagccgccagacccttccctattctggccatgccggggcggaacaaagctaaaagtacctgttcctgcccggatctccagcccaacggccaagacttaggtgaaaatagtagggtggccagactgggggcagacgaatctgaggaagagggacgacgcggatccctatcaaacgctggggatcccgagatcgtgaaatcaccctctgacccaaagcagtataggtatatcaagctgcagaacggattacaagctctgctgatttctgatctgtctaatatggagggaaaaactggcaatactaccgacgatgaagaggaagaggaggtagaggaggaggaggaagacgatgatgaggactcaggcgcggagattgaggatgacgacgaggaggggtttgatgacgaagatgagttcgacgacgaacatgatgacgacttggataccgaagataacgagcttgaagaactggaggagcgagccgaggcacggaagaaaactacagagaagcagcaacttcaatcactctttctgctgtggagtaagctcactgaccgcctgtggtttaagtccacctacagtaagatgagcagcacactgctggtcgagacccggaacctctacggggtggtgggggcagaaagtcgttcagcgcccgtgcagcacctcgcgggatggcaggccgaggagcagcagggcgagacagataccgtccttagtgctgccgccctgtgcgtgggggtcgggagctttgcggatccggacgacctgcccggcctggcccatttcctcgagcacatggtgttcatgggctcattaaagtaccccgacgagaatggcttcgacgcctttctcaagaaacacggcgggtctgacaacgccagcacagactgtgagcggaccgtctttcagttcgacgttcaacggaagtacttcaaagaggccctggaccggtgggctcagttttttattcacccccttatgataagagatgcgattgacagagaggttgaggccgtagacagcgagtaccagctagccagacccagtgacgccaaccgaaaggaaatgctgttcgggtcgctggcaagacccgggcaccctatgggaaagtttttttgggggaatgcggaaaccctgaagcacgagccacgcaagaataacattgatactcacgcccggttgagggagttctggatgagatactactccagccactacatgactctcgtggtacagtccaaggagacgctggatacactggagaagtgggttacagaaatatttagtcagatcccaaacaacggactcccaaggcctaatttcgggcatttgacagatcccttcgatactcctgccttcaataaactgtacagggtggtgcctatcaggaaaattcacgctctgaccattacctgggccctgccaccccaacagcagcactaccgagtgaagcccctgcattacatttcttggctggtgggtcacgaaggaaaaggctcgatcttgagctttttgagaaagaagtgttgggctctggccttatttggcggtaatggagagactggtttcgagcagaactctacctacagcgtatttagtattagtatcacactcacggatgaaggatacgaacacttctatgaggtggcttataccgtatttcagtatctgaagatgctccagaagctgggaccagagaagcggatctttgaggagattcgcaaaattgaagataacgaattccactatcaagagcagacagatcccgttgagtacgtggaaaatatgtgcgagaacatgcaactgtacccccttcaggatatcctgaccggcgatcagttgctatttgagtataagcccgaagtgatcggcgaagctttgaaccagttggtgccccagaaggcgaatctagtgctcctttcaggcgctaacgaaggtaagtgtgatctgaaagagaagtggtttgggacacagtacagcatagaagatatagagaactcctgggctgaactgtggaattcaaacttcgagctaaatcccgacttacatctgcccgccgaaaacaagtacatagccaccgactttactctgaaggcctttgactgccctgagaccgagtaccccgtgaaaattgtcaacactccacagggctgtctatggtacaagaaagataacaagtttaagattcctaaagcctacattcgcttccacctgatctctcccctgattcaaaaatctgcagctaacgtggtgttgttcgatatctttgtcaacatcctgacacataatttggccgaacccgcgtatgaggccgacgttgcccaactggaatataaacttgtcgcaggtgagcatgggctgattatccgggtcaaaggttttaatcataaattgccacttctgttccagctgatcatcgattacttagcggagttcaattcaacacccgctgtcttcaccatgatcacggagcagctgaaaaaaacgtatttcaacattctgattaaacctgaaacactagctaaggatgttcgtctgttgatactcgagtatgcccggtggtcaatgattgacaagtaccaggcacttatggacggcctctcactggagtcattactgagttttgtgaaggagttcaagtcacagctttttgtggaggggctggtccagggaaacgtgacgagcactgaaagcatggactttctcaaatatgtcgtggacaagctcaattttaagcctcttgagcaagagatgcccgtacagtttcaagtagtagagctcccgtccggccatcatctttgcaaagtcaaggctctcaacaagggagacgccaattccgaggtgactgtctattaccaaagcggcactcgcagccttcgggagtacacgctcatggagctgttagttatgcacatggaggaaccctgtttcgatttcttgagaactaaacaaaccctagggtatcatgtgtaccctacctgtaggaacacgagcggaatattggggttctccgtcaccgtaggcactcaggcaaccaagtacaactctgaagtggtggacaaaaaaatcgaggaatttctgtcatcgttcgaggagaagatcgagaacctgaccgaggaagcatttaatactcaagtgactgccctcatcaaactcaaagaatgtgaagatacgcatcttggcgaagaggtagacaggaattggaacgaggtggtgacccagcagtacctgttcgataggctggcccacgaaatagaagccctgaaatcctttagcaagtccgatttagtgaactggttcaaggcacacagaggccccggctctaagatgctgagtgttcacgtcgtgggatatggaaagtacgaacttgaggaagacgggaccccctcctctgaggattccaactcatcctgtgaggtgatgcagctgacatacttacccacgtcccctctcttagccgactgcatcatccccatcacagacatccgagcatttacaacaaccttgaacttactcccctatcacaagatcgttaaatag

SEQ ID NO: 125825 - DNA, 1662 bp, Artificial Sequence
  Description of Artificial Sequence: Synthetic coding sequence
atgttgcaaaaactaggacctgagaaacggatattcgaagagatcagaaaaatcgaggacaacgagtttcactatcaggagcagacagacccagtagagtacgtggagaatatgtgtgagaacatgcagctttaccctctccaggacatcttaaccggcgatcaactcctatttgaatacaagcctgaggttatcggggaagcactgaaccaacttgtgccacagaaagccaacctggtgctgctctctggagccaatgagggcaaatgtgatctcaaggagaaatggtttggcactcagtattccatagaagatatagagaactcatgggccgagctgtggaattcaaattttgagctgaatcctgatctgcatctccctgcagaaaacaagtacatcgcttacatccgttttcacctgatctctcccttaatccaaaagtccgccgctaacgtggttctgttcgatattttcgtaaatatcttgacacataacctcgcggagcctgcgtacgaggcagatgtggcccaactcgaatacaaactggtggccggggagcacggtttgataattagagttaaggggttcaatcataagctgccactcctgttccagctaatcatcgattatctggccgaattcaatagcaccccggctgtgtttacaatgataacagagcagcttaaaaaaacgtacttcaatattctgatcaagcctgagactttggctaaggacgtacgcttactgatcctggaatacgccaggtggagcatgatcgataagtatcaagccttgatggacggtctgagtctggagtcactgctgtcttttgtgaaggaatttaaatcgcagctgtttgtggaggggctggtgcaggggaacgttacctctaccgagagtatggacttcctgaagtacgtggttgacaaactcaacttcaaacccttagagcaggagatgccagtgcaatttcaagtggtcgaattaccctccggtcatcatctgtgcaaagttaaagcactgaataagggcgatgccaattctgaggtgactgtctattaccagtcggggactagatccctgcgcgaatatacccttatggaactgctggtgatgcacatggaggaaccgtgtttcgatttcctgagaacgaagcagactctggggagcgaggtggtggacaagaaaatcgaggagtttctaagctcatttgaagagaagatcgagaacctcaccgaggaagctttcaacactcaagtgacagcccttattaagctgaaagaatgcgaggatacccatcttggggaagaggtagaccgcaattggaacgaggttgtgacacagcaatacctcttcgaccgactagcgcacgaaattgaagccttgaagagcttctccaagtctgatctggtaaactggtttaaggctcaccgcggacccggctctaaaatgctgtccgtccatgttgtcggttacggtaagtacgagctcgaggaagatggcaccccctcctccgaggactctaattcttcctgtgaggtgatgcagctcacctatctcccaacgagtcccctgctcgccgactgcatcatccctatcactgatattcgagctttcaccacaactctaaatcttcttccttatcacaagatcgtaaaatag

SEQ ID NO: 125826 - DNA, 1617 bp, Artificial Sequence
  Description of Artificial Sequence: Synthetic coding sequence
tagaagattgaagataatgagtttcactaccaggagcagactgatccagttgagtatgtcgaaaatatgtgcgaaaacatgcagctgtaccccttgcaggacatccttactggggaccagctgctctttgagtataaaccagaggtcatcggcgaagctcttaatcagttggtgccccagaaagccaacctggtgctactttcaggcgcaaatgaaggaaaatgtgacctcaaagagaaatggttcgggacccagtatagcatcgaagacatcgagaatagttgggcagagttatggaatagtaacttcgagctaaaccccgatctgcatcttccggccgaaaataagtatattgcttacataaggtttcatctaatctctccgctgattcagaagtctgctgcaaacgtggtgctgtttgatatatttgtgaacatactcacccacaacctcgctgagccagcatacgaggccgacgtcgcacagcttgaatacaaacttgtggctggtgagcatggactcatcattcgggtgaagggctttaaccacaagctgccgcttctgttccaacttattatcgactacctagcagagttcaatagcacccccgctgtgttcacaatgatcacagaacagctgaaaaagacttactttaatatcttaattaagccagagacattggctaaagacgtacgcttgctaattctggagtatgcccgctggagcatgattgacaagtaccaggctctgatggatggcctgtcgctggaaagtctgctgtcatttgtcaaggagttcaagagccaactgttcgttgagggattggtgcaggggaacgtgacatccacagaatccatggattttttaaagtacgtggtagataagctcaactttaaacctctcgaacaagaaatgcccgttcagttccaggttgttgaactgccaagcgggcatcatctctgtaaggtgaaggcccttaataaaggagacgctaattccgaagtgaccgtatactaccaatccggcacccgctcactgcgggaatacaccctgatggaactgttggtgatgcacatggaagaaccgtgttttgacttccttaggaccaagcagacactgggtagcgaagtcgtggacaagaagatagaggagttcctgtcatcctttgaagagaaaattgagaatctcactgaggaggcattcaatactcaggtaacagctctgatcaagctgaaggaatgtgaagatactcacttgggagaggaagtggaccgcaattggaatgaagttgtgacccagcaatatcttttcgacagattggctcatgagatcgaagcactcaaaagtttcagcaaaagcgatcttgtgaattggttcaaagcccacagaggcccagggagcaaaatgctctcagtgcacgtagtgggctatgggaagtatgaactggaagaagacggcaccccctcgtccgaggattctaactcttcctgcgaggtcatgcagcttacgtacctccccactagccctctgctcgccgactgcattatcccaattactgacattcgagccttcaccacaacactgaacttgctcccttatcataagatagtcaagtag

SEQ ID NO: 125827 - DNA, 3264 bp, Artificial Sequence
  Description of Artificial Sequence: Synthetic coding sequence
atggaaggaaagacaggcaatactactgacgacgaggaggaagaggaagtcgaggaagaggaagaggatgatgacgaggacagcggggccgaaattgaagacgatgacgaagaggggttcgacgacgaagatgagtttgacgatgagcacgatgacgatcttgataccgaagacaacgaattggaagaactcgaggagcgcgcagaagcccgcaagaagacaacagaaaaacaacagctgcagagtctgttcttgctgtggagcaaacttactgacagattgtggttcaagtccacctattctaaaatgagctcaacactcctagttgaaactcgcaatctgtatggcgtcgtcggcgcggagtctagatccgcacctgtgcagcacctggctggctggcaggcggaggaacagcagggagagacggacactgtgctgagcgctgccgctctctgtgttggagtcggcagttttgctgacccagacgatttaccagggttggcacacttccttgaacacatggtcttcatgggttcattaaagtatcccgatgaaaatggatttgacgccttcctgaagaagcacggtggcagcgacaatgccagcaccgactgtgagcgcactgtctttcagttcgatgtgcaaaggaaatatttcaaagaagcactcgatagatgggctcagttctttatccaccccctgatgatcagggatgctatagaccgcgaggtggaggctgtcgatagcgagtaccaactagcccggccctcagatgcgaatcggaaggagatgctattcgggtccctggctagaccaggacacccgatgggaaagtttttctggggaaacgcggaaaccctgaaacacgaaccacggaagaacaatatcgacacacatgctcgattaagagaattttggatgaggtactactcttcccattatatgacgctcgttgtgcagtctaaggaaaccctggacactcttgagaagtgggtgacagaaattttcagccaaattccaaacaacggactaccacggcccaactttgggcatctgaccgaccccttcgacaccccagcttttaataaactctatcgggtggtgcccattaggaaaattcacgctcttactatcacttgggctctgcctcctcagcaacaacattaccgcgtgaagccccttcattacatttcctggttggtcggtcacgaggggaaaggatctatcctgtccttcctgcgcaagaagtgctgggcccttgcgttgtttggcggtaatggcgagacaggctttgagcagaattcgacctacagtgtgtttagtatatctataaccctgactgacgagggatacgaacatttctacgaggttgcttacaccgtgttccagtacctgaaaatgctgcagaagctgggacccgagaagagaatttttgaggagattaggaagatcgaagacaatgaatttcactatcaggagcagaccgaccctgttgaatacgtcgagaatatgtgcgagaacatgcagctttaccccctgcaggatatcctcactggagaccaactcttgtttgaatataagcccgaggtgatcggagaagccttgaatcagctggtcccccagaaggcaaatcttgtattgctgtcaggagccaatgaaggtaagtgcgatctcaaagagaaatggtttggtacacagtattcaatcgaggatattgagaacagctgggctgaactgtggaactcaaacttcgaactaaacccggatctgcacctgccagctgaaaacaagtatatcgcaacggattttaccctgaaagctttcgattgtccagaaactgaatacccagttaaaatcgtgaatacccctcaggggtgcctgtggtacaagaaggataataagttcaagatccccaaggcttacattcgctttcatctgattagtcctttgatacagaaaagtgccgcaaatgtggtattgtttgacatctttgtgaacatcctgactcacaacctggctgagcccgcgtatgaggctgacgttgcacagctggagtacaagctcgtggcgggtgaacacggactgattatcagagttaagggcttcaatcataagctaccgctgctattccaactgatcatcgactacctcgcggagtttaacagcacgccagcagtattcaccatgatcacagaacagctcaaaaaaacctattttaacatcctaatcaagcccgagaccctggccaaggacgtgagactgcttatccttgaatacgctcgctggtccatgattgacaagtatcaggccctgatggatggcctcagcctggaaagcctcttgagctttgttaaagagttcaagtcgcaactgttcgtcgaaggactagtacaggggaacgtgaccagcacggagagcatggactttttaaaatatgtggtcgacaagctcaattttaagcctttggaacaggagatgcccgtgcaattccaagtggttgagctgccatcaggacaccacctctgcaaggtcaaggcgcttaacaaaggggatgctaattctgaagtgacagtgtactatcagagcgggacaaggagcctcagagagtacacacttatggaactgttggttatgcacatggaagaaccctgcttcgactttcttaggaccaagcaaactctggggtaccacgtctaccccacttgccgaaatacgagcggcattctcggcttcagcgtgaccgtgggcactcaggcaaccaagtataacagcgaggtggttgacaagaaaattgaggagttcctcagttcgttcgaagagaagatcgaaaatctcaccgaagaagccttcaatactcaagtaacagccctgattaaactcaaagaatgtgaagatactcacttgggggaggaagtggatagaaattggaacgaggtcgtcacccagcaatatctgttcgaccggctcgcccatgaaattgaagccctaaagagcttctccaaatcagacctggtgaactggtttaaagcacacagggggccaggtagtaaaatgctgagcgtccacgtagtggggtatgggaagtacgaattggaagaagatggtacccctagcagcgaggactcaaacagcagttgcgaggtgatgcagctcacttacctccccacgagtcccctcctcgcagactgcatcatccccatcacggatattcgggccttcactactacactgaacttactgccctatcacaagattgtgaaatag

SEQ ID NO: 125828 - DNA, 2244 bp, Artificial Sequence
  Description of Artificial Sequence: Synthetic coding sequence
atggaaggaaaaaccggaaacaccactgatgacgaggaagaggaggaggtagaagaagaggaggaggatgacgatgaggacagcggggcagagatagaggatgatgatgaagaaggctttgatgacgaagatgagtttgacgacgagcatgacgacgacttggacacagaggataacgaattggaagagctagaggagcgggccgaggcaaggaaaaagacaaccgagaaacagagtgccgctgccttgtgcgtcggcgtaggctcgttcgcagacccagacgacctgcccggcctagcccacttcctggagcacatggtgtttatgggcagcttaaaatacccagacgagaatgggttcgatgcgttcctgaaaaagcatggcggcagtgacaacgcaagtaccgactgtgaacgtacggtcttccaatttgacgtgcagcgcaaatattttaaggaagctctagacagatgggcacaatttttcattcaccccttgatgattagagatgccattgatagagaggtcgaagcggtggattccgagtaccagctagcgagacctagcgatgccaacagaaaggagatgctgttcggatcactggcaagaccagggcatcccatgggaaagttcttttgggggaacgccgagactttgaagcacgaaccccgaaagaacaatatcgatacgcacgcacgtctgcgcgagttttggatgagatattatagctcacactacatgaccctggtggtacagagtaaagagacactggacacgcttgagaagtgggtgaccgaaatattctcacagatccctaacaacgggcttccaaggccaaacttcggtcacctgactgacccgtttgatacaccagcgtttaacaagctgtatcgagtagtaccaatccggaaaattcatgctttaaccatcacctgggcgttgcctcctcagcagcagcactacagagtgaaacccctgcactacatttcgtggttagtgggacacgaaggtaaaggcagcattctgtccttcctacgaaaaaaatgctgggctcttgccttattcggaggcaacggagagaccggcttcgagcaaaattccacctacagcgtattttctatatccattacgctaactgacgaggggtatgagcatttctatgaagtagcctacactgtgtttcagtacttaaagatgcttcaaaagttggggccagagaaaagaatctttgaagaaatacgcaagattgaggacaatgagtttcattatcaggagcagacagatcccgtggagtacgtggaaaatatgtgtgaaaacatgcagctttaccccttgcaggatatattaaccggcgaccaactgctgtttgagtataaaccagaggttataggcgaggctctgaatcagctggtgcctcaaaaggccaatctggtgctactgtccggagcaaacgaagggaaatgtgatctgaaggagaagtggtttgggactcaatacagtatcgaggacattgagaactcttgggcagaactttggaatagcaacttcgagctgaatccagacctgcatctgccagctgagaataaatacatcgccaccgattttacacttaaagcgttcgactgtcctgaaaccgaatacccagtgaaaattgtcaacacaccgcaaggttgcctctggtacaagaaagacaataaattcaagatccctaaagcatacatcaggttccatctgattagcccactgattcagaaatccgcagccaatgtagtgctgtttgatatttttgtgaatattctcacccacaatttggctgagccagcttacgaggccgatgtcgcacagctggaatataaactggttgccggtgagcatggcctcatcattagagtgaaggggtttaatcacaaactccccctcctgtttcagctcatcatcgattacctggcagagtttaattccaccccggccgtgtttacaatgatcacagagcagctgaagaaaacatacttcaacatattgatcaagccggagactctagcaaaggacgtgagactcctgatcttagagtatgcccgctggtccatgatcgataagtatcaagccttaatggacggcctgtcactagagagtctgttgtctttcgtcaaggagttcaaatcacagcttttcgtggaaggtctcgtgcaaggaaacgtgacaagtacggtgctgtgtcaatgggctcaagactccgaaacatag

SEQ ID NO: 125829 - DNA, 3447 bp, Artificial Sequence
  Description of Artificial Sequence: Synthetic coding sequence
atgcttcggagagtgacagttgccgccgtgtgtgccacccggagaaagctgtgtgaagccgggcgagagctggccgccctgtggggcatcgaaacacggggtcggtgcgaagacagcgcagcagcccgtcccttcccaattctagccatgcccggtcggaataaagccaagagcacgtgtagctgtcctgacttacaaccgaacgggcaggatttaggggagaactcaagggtggcaagactgggagccgatgaaagcgaggaggaaggacgtagaggtagcctttctaacgcaggggatcccgaaatagttaagtccccctccgaccctaagcagtaccgctacatcaaactccagaatggactgcaggccttactaattagtgatctaagcaatatggaggggaaaactggaaatactaccgacgacgaagaagaagaagaagtggaagaagaagaagaggacgatgatgaagattctggcgccgaaatagaagacgacgatgaagagggctttgatgatgaagatgagtttgatgatgaacacgacgatgacctggatactgaggataacgaactggaagagctggaggaaagggccgaggcgcgaaaaaagaccacagaaaagcagagcgcagccgcactgtgcgtcggagttggatctttcgcagatcccgatgacctgccggggctggctcactttctggaacatatggtttttatgggctcactgaaatacccggatgagaatgggttcgacgcttttctcaagaagcatggcgggtctgacaacgcttccacagactgcgaaaggactgtgttccagtttgatgtccaaaggaagtacttcaaagaagcattggaccgatgggctcagtttttcattcaccctctgatgatcagggacgctattgacagagaagtggaggccgttgatagtgagtatcagctcgcgagaccctccgatgccaaccgaaaggaaatgctgttcgggtcccttgccaggccaggccaccccatgggaaagttcttctggggcaacgcggagaccctgaagcatgaacccaggaagaataatattgatacccacgcaaggctgcgggagttttggatgcgctactactcttctcattatatgacactggtggtccaaagcaaagaaactctagacaccttagaaaaatgggtgaccgagatcttttctcagattcccaacaacggattgccaagacctaactttggacatctaaccgatcccttcgacacccctgccttcaataagttgtaccgcgtcgttcccatcaggaagatccatgcactgactattacttgggccctccccccacagcagcagcactaccgcgttaaaccattgcattacatcagttggcttgttgggcatgaagggaaaggaagcattctgtccttccttagaaaaaaatgctgggctctcgcgttatttggagggaatggcgaaacaggatttgaacaaaattcaacctactcagtattcagcattagcattaccctgacagacgaagggtatgaacacttctatgaggtggcttacacagtctttcagtatctgaaaatgctgcagaagctgggccctgaaaaacgtatctttgaggaaattcggaagatcgaagacaacgagttccattatcaagagcagactgaccctgtagagtatgtcgagaacatgtgcgagaatatgcagctttaccccctgcaagacatcctgaccggggaccaactgctgtttgaatataagccagaagtgatcggagaggccctgaatcagcttgttccccagaaggccaatctggtgctgctctcaggtgcaaatgaaggcaagtgcgaccttaaagagaagtggttcggcacccagtatagcatagaagacattgaaaatagctgggctgagctgtggaatagcaatttcgagcttaatcccgacctccatcttcctgccgagaacaagtatatcgcgaccgactttaccttaaaggcatttgactgccctgagaccgagtaccctgtgaagattgttaataccccacagggttgcctgtggtacaagaaagacaataagtttaagatccccaaagcgtatattcgcttccacctcatttccccccttattcagaaatccgccgccaacgtcgtgctgttcgacatctttgtcaatatcttaacacacaacctggctgagcctgcttacgaagccgacgtcgcccagttggagtataagctggtcgctggtgagcacggactcatcattcgggtgaagggttttaatcacaagctacccctgctttttcagctaattattgattacctcgctgaattcaacagtacccctgccgtgttcaccatgataacagagcaactgaaaaagacgtattttaacatccttataaaacctgaaacattggccaaagatgtgagacttctcatccttgaatacgctaggtggtcaatgattgataagtaccaggccctcatggacggactctccctggagtcactcctgtctttcgtcaaggagtttaagtcccagctgtttgtggaaggcttggttcaggggaacgtgactagcaccgagagcatggattttctgaagtacgtcgtggacaagcttaatttcaagccgctggaacaggagatgcctgtccagttccaagtggtggaactgccatccggccaccacctttgcaaagttaaagcactcaacaaaggggatgccaactccgaggttaccgtctattaccagtctggaaccaggtcattacgcgagtataccttgatggagctcttagttatgcatatggaggagccttgctttgactttctgagaacaaaacagaccctgggatatcacgtgtacccgacttgtaggaacaccagcggcatcttagggtttagtgtgactgttggtactcaagctacaaaatacaatagtgaggttgtggacaaaaaaatcgaggaattcctctctagtttcgaggagaaaatagagaatctgactgaagaagctttcaacacacaggttactgccctgatcaagctgaaagaatgcgaggacacacacctcggagaagaggtggaccgcaactggaatgaagtcgtcacgcaacaatacctgttcgaccgtctagcccacgaaatcgaggcgcttaagtctttcagcaagtcagatctggtgaactggtttaaagcccacagaggaccaggaagcaaaatgttgtcagtgcacgtggttggatatgggaaatacgagctggaggaagacgggacaccttccagcgaggactccaattctagctgcgaggttatgcaactgacctacctgcctaccagccccctgctggccatcgttagttctcctctgctgattagtggtcttagccaacagcatagcacttttagtcccaccatcaagtag

SEQ ID NO: 125830 - DNA, 1587 bp, Artificial Sequence
  Description of Artificial Sequence: Synthetic coding sequence
atgggcgctgccgcgtcccggcgacgtgctttgagaagcgaggctatgtcaagtgtggctgctaaggtgcgggccgccagggccttcggcgagtatcttagccagagtcatcccgagaatagaaacggtgctgatcacctccttgcagatgcatactcaggacatgacggtagccccgagatgcagcccgccccccagaataagcggcggcttagtctcgtgtccaatggatgttacgaggggagtcttagcgaggagccatcaattagaaagcctgccggcgagggtccacagcctcgggtttatacaatatccggagagccggccttgctgccatcccctgaagccgaggccatcgagctggcagtggtgaagggaagacggcagcgccatccccatcatcattcacagccactgagggcgagcccggggggtagtcgggaggatgttagtcggccctgccaatcctgggccggatcacggcaggggtcaaaagaatgcccgggctgcgcacagctggctcctggccccacaccaagagcgttcggccttgaccagcccccactgccggaaacgtcgggcagacgcaagaagctagagaggatgtactctgttgaccgcgtgtcggacgacatcccgatccgcacatggttccccaaggaaaatttgtttagctttcaaacagcaacgactaccatgcaggccgtttttcggggatatgctgagcgcaaacgtcggaaacgcgagaacgacagtgcgtctgtcattcagcggaactttaggaaacacttgaggatggttggaagtcggcgagtcaaggcacagacctttgcagagagacgcgaacgatcattctcacgaagctggagtgacccaacccctatgaaagccgacacatctcatgactcaagggattcttccgacctgcagtcctcacactgcactctggacgaggctttcgaggacctggattgggacacggagaaaggtctcgaggcagtggcttgtgacactgaaggttttgtccctcccaaagttatgctgatcagttcaaaggtacccaaagcggaatacatacctacaattatcagacgggacgatcccagcatcatacccatcctgtatgatcacgaacatgctacctttgaggatatcttggaggagatcgagcgaaagctgaacgtgtatcataaaggcgccaaaatctggaaaatgctgattttttgccagggcgggcctggtcacctctatttgctcaagaataaggtcgctactttcgccaaggtcgaaaaagaagaagatatgatccatttttggaagcgactaagtcggttgatgtcaaaagtgaatcccgagcctaacgtgattcacattatgggctgctatatcttgggcaaccccaatggtgagaagctgtttcagaaccttaggaccttgatgaccccctatcgcgtcacatttgagtcaccgctggagctttctgcccagggtaagcagatgatcgagacctactttgacttcaggttgtatcgtctctggaaatcgaggcagcatagcaaactcctggattttgacgacgtgttatag

SEQ ID NO: 125831 - DNA, 984 bp, Artificial Sequence
  Description of Artificial Sequence: Synthetic coding sequence
atgtactctgtcgacagagtgtcagatgacatacccatacggacctggtttcccaaagagaacctcttctccttccagaccgcaaccactactatgcaagcagttttcaggggatacgcagagcggaaacgtaggaaaagggagaacgacagcgcatccgtcatccagcgaaactttcgaaagcatctgcggatggtagggagccgccgtgtgaaggcacagaccttcgccgaaaggagggaaagatctttttcccggtcgtggtctgatcccacaccaatgaaggctgacacgtcccacgatagcagggactcaagcgacctgcagtccagccattgtacactcgacgaagcttttgaggatcttgattgggacacggagaagggattggaagcagtcgcctgcgacacagagggattcgtcccacccaaggtaatgctgataagctccaaggttcctaaggcagaatacatcccaacgatcatcaggcgagacgacccaagcattatcccgattctttacgaccacgagcacgcaacgtttgaggacattttggaggagatcgaacgaaaactgaatgtttaccacaaaggtgccaagatttggaagatgctgattttctgtcagggcgggccaggacacctgtacctgcttaagaacaaggtggcgacattcgccaaggtagagaaggaggaagatatgatccatttctggaagagactttcaagacttatgtcaaaagtcaaccctgaaccaaacgtgattcacattatggggtgttatatcctcgggaacccaaatggggagaagttatttcaaaatctgcgcactcttatgacgccttacagggtgactttcgagtcacctctggagctctccgctcaaggtaagcagatgatcgaaacgtacttcgattttcgcctttacaggctgtggaagagcaggcagcacagtaagctgttggactttgatgatgtcctatag

SEQ ID NO: 125832 - DNA, 438 bp, Artificial Sequence
  Description of Artificial Sequence: Synthetic coding sequence
atggtgggatctagaagggtaaaagcccagacgttcgcagagcggagagaaaggagcttcagtagaagttggtctgatccaacgcccatgaaagccgacacttcgcatgatagcagggattcttccgatctgcagagcagccactgtaccttagacgaggctttcgaagatctcgattgggacactgagaagggcttagaggcagtggcttgtgataccgagggcttcgtgccaccgaaagttatgctgatttcttctaaagtgccaaaagccgagtatatcccaactatcatccggagggacgatcccagcataatccccattttatatgtttcccctgcccccggccttccacccaccgatgccctactacggccccaccctgggcctgcacctgccccacaggtcccaagggtgctatggcgatgctggctttag

SEQ ID NO: 125833 - DNA, 1587 bp, Artificial Sequence
  Description of Artificial Sequence: Synthetic coding sequence
atgggagccgctgctagtcggcgtcgtgctctgcgcagtgaggccatgtccagtgtggccgccaaagtgcgcgctgctcgcgcctttggcgagtatttgtcccagtctcatcccgagaatcggaatggtgccgatcatttgttagccgacgcctacagcggtcatgatggaagccctgagatgcagcctgccccacaaaataagagaagacttagcctcgtttcaaatgggtgctatgagggatccctgagcgaggaaccgtccattaggaaaccagctggagaaggcccccagcctagggtgtacactatttccggcgaaccagccctcctgcctagccctgaggcggaggccattgagctggctgtggtgaaaggacgtcgccaacggcacccccatcaccatagccaaccgttaagggccagccctggcggctctagagaggacgtgtcccggccttgtcagagctgggcaggatcacgccagggttctaaggaatgcccgggatgcgcacaactcgcacctggaccaaccccacgcgccttcggcctggatcagccacccctgcccgagacgtccggtcgtcggaaaaagttggagaggatgtatagtgttgatagagttagtgacgatattccaattcgcacctggtttcccaaagagaatctgtttagttttcaaaccgctactacgactatgcaggccgtctttcggggttatgctgagagaaaaaggcgaaagcgggagaacgattctgcttcagtgatccagcggaatttcagaaaacacctgagaatggtaggttcaaggcgggttaaggcgcagacattcgccgaacgacgggagaggtctttctctaggagttggagcgatccaacccccatgaaggctgatacgagtcacgactcccgagacagttctgaccttcagtcaagccactgcacattggatgaagcttttgaggatctggattgggacacagagaagggcctggaagcggtggcttgtgatacagaggggttcgtgccgcccaaggttatgctcatttcctcaaaagtgcccaaggctgaatatatacctaccattatcagacgtgacgaccccagcatcattccaatactgtacgaccatgagcacgcaactttcgaagatattctagaagaaatcgagcgcaagttgaatgtgtaccacaagggggcgaaaatctggaagatgttgattttctgtcaaggtggtcctggccacctgtatctgttgaagaataaagtagctacatttgctaaagtagagaaggaagaggatatgatccacttctggaagcgactgagtagactgatgtcaaaggtgaaccccgagccaaacgttattcacataatgggttgctacatcctcgggaacccaaatggcgagaagctgttccagaatctcagaacgcttatgactccgtatagggtcacgttcgagtcccccctggaattgagtgcacagggcaagcaaatgattgagacctatttcgacttccggttgtacaggctgtggaagagccggcagcactcaaaactgctggattttgacgatgtgctttag

SEQ ID NO: 125834 - DNA, 1503 bp, Artificial Sequence
  Description of Artificial Sequence: Synthetic coding sequence
atgggcgctgccgccagcagacggcgcgccttgcgaagcgaggcaatgtccagtgttgccgcaaaggtgagggccgcgcgcgcatttggagagtacctgagccagtcgcaccccgaaaatcggaacggcgctgaccatctcctagccgacgcttattccggtcatgatggctccccggagatgcagcccgctccccagaataagagaagactttcgcttgtgtcaaacggatgctatgaaggttcactatcagaggagccctcaattcgcaaaccagcaggggagggaccgcagcccagagtgtataccatctccggcgaacccgctcttctgccgagccccgaggccgaagctatagaactggccgtcgtaaaggggcgcaggcagaggcatccacaccaccattcacagcctctgcgcgcaagccctggcggatctcgcgaggacgttagccggccctgccagagctgggcaggtagcaggcagggtagcaaggagtgccccggatgcgcccagctggccccagggccaaccccacgcgcctttggtctggatcagccaccactgccagaaacttccggaaggcgtaagaagctggagcggatgtacagcgtggatagagtaagcgatgacatcccgatcaggacttggttcccaaaggagaacctttttagcttccagacggccacaacaaccatgcaagccatttctgtgtttagagggtatgccgagaggaaaagacgcaagagggaaaacgacagcgcatctgtaatacagagaaacttccggaaacacctcaggatggtcggttcacgccgagtgaaggcccagtcaagtgacctgcagtccagccactgtactcttgacgaagcctttgaggatctcgattgggacaccgagaagggcctggaagctgtagcctgtgatactgaaggcttcgtccctcctaaggtcatgctgatcagctcaaaagtgccaaaggcagaatatatacctacaattatcagacgagatgatcccagcataattccaatcctgtatgatcacgagcacgccacctttgaagatattcttgaggaaattgaaagaaaactaaatgtctatcacaagggcgccaagatttggaagatgctcatcttttgccagggaggacccggacatctctatctgctgaagaacaaagtggccacattcgctaaggtcgagaaagaggaggatatgatacacttttggaaaaggctgagcagactgatgagtaaagttaatcctgagccaaacgttatccacatcatgggatgttacattctgggcaacccgaatggtgagaaactgttccaaaacctgaggaccctgatgaccccgtaccgagtcacttttgagtccccactggaattgagcgcccaaggaaagcagatgatcgagacgtacttcgacttccgcttatatcggctctggaagtccagacagcatagcaaactgctggatttcgatgacgtactgtag

SEQ ID NO: 125835 - DNA, 1518 bp, Artificial Sequence
  Description of Artificial Sequence: Synthetic coding sequence
atgggggccgcagcttcccggcggagagccctgcgctcagaggccatgtcctccgtagccgcgaaagttcgggccgcccgcgcgtttggcgagtaccttagtcagtcacatcccgaaaaccgcaatggggctgaccatcttttagccgacgcatactccggccatgatggctctcctgagatgcaaccagcgccacagaacaagagaaggctgagtctcgtgtcgaatgggtgctacgagggtagcctaagcgaagaaccaagtatccgaaaacctgcgggggaaggaccccaacccagggtgtacaccatttctggtgaacctgccctgctccccagcccagaagccgaagcgatcgagctggcagtggtgaagggacgacgtcagcgtcacccgcaccatcatagccagcctttgagggcgtctcctggcggctctagagaagacgttagcagaccatgccagtcatgggcaggctcccggcagggatctaaagaatgcccaggctgtgctcagctcgcgccagggcccactccacgtgctttcgggctggaccagcccccccttccagagacatctggtagaagaaaaaaactcgaacgcatgtactccgtggaccgtgtgagcgatgatattcctattcggacctggtttcctaaagaaaacttattcagttttcagactgcaaccaccaccatgcaggctaacttccgcaaacacttgagaatggttgggagcagacgggtgaaggcccaaacttttgccgaacggagggaacggtcattctccagaagctggagtgatcccacacctatgaaagccgatacgtcacacgactcccgtgattcctctgacctgcagtctagccactgtactctcgatgaggcttttgaggacttggactgggacacggaaaaggggctcgaagccgttgcatgtgatactgagggattcgtgcctccaaaggtcatgttgataagctcaaaagtgccaaaagccgagtatattccaacaattattcgacgcgacgatcccagtattatccccattctatacgatcacgagcacgcaactttcgaggatatcctggaagaaattgaacggaagctcaatgtctaccacaagggagccaagatctggaagatgcttatattttgtcaggggggccccggccacctctatttactgaagaacaaggttgctacctttgcaaaagttgagaaggaagaggatatgatccatttttggaagagactgagcagactgatgtccaaagttaatcctgaaccaaatgtcattcatataatgggctgttacattcttggtaatcctaacggtgagaaactatttcagaatcttcggacattgatgacaccttaccgcgtcacgttcgaatcccctttggagctttcggctcaaggcaaacagatgatagagacatacttcgactttagattataccgcctatggaagagtagacagcattccaaactgctcgacttcgatgatgtcctctag

SEQ ID NO: 125836 - DNA, 1593 bp, Artificial Sequence
  Description of Artificial Sequence: Synthetic coding sequence
atgggcgcagcagcctctcggcgacgtgccctgcgctctgaggctatgagtagcgtggccgccaaagtccgggcagcccgcgcttttggagagtatctgagccaaagccaccccgagaatagaaatggcgcggatcacctgttagcagatgcttactctgggcacgacggcagtccagagatgcagccggcccctcaaaacaaacgccggctaagcctggtgagcaacggatgctacgaaggctcactcagtgaggagcccagcataaggaaacctgctggcgaaggaccgcagcccagggtgtacaccatatccggtgagccagctttgcttccttcccccgaggccgaggctatcgagcttgctgttgtgaaaggcaggcgtcaaaggcatccacaccatcattcccaaccattacgcgccagcccgggcgggtcccgggaagacgtgagcagaccttgccagtcatgggccgggtcacgacaggggtctaaggagtgcccaggctgtgctcagttagctccagggccgacccctcgtgccttcggcctcgatcagccaccgttacctgaaacctcagggaggcggaagaaactggagaggatgtattcagtggacagagtatcagacgacattccaatcaggacttggtttcctaaagaaaatctgttctccttccagacagctaccacaacgatgcaagccatctccgtcttccggggctatgctgaacggaaacgccgaaagagagagaatgactcggcctcagtgattcagagaaattttagaaagcatttgaggatggtggggtcaaggcgcgtcaaagctcaaacattcgctgaacgccgcgaaagatcctttagccgaagctggagcgacccaactccaatgaaagctgatacaagccatgactctcgcgactcttctgatctgcagtcctctcactgtacccttgatgaagcattcgaagatttggattgggatactgaaaagggtctggaggctgtggcttgcgataccgaagggttcgtgcctccaaaggtgatgctaatcagctcgaaggttcctaaggccgagtacattccgactatcattcgaagggacgacccaagtatcattccaatcttatacgatcatgaacatgccacgtttgaggacattttggaggagatagaacgtaagttgaatgtgtaccataagggagccaaaatatggaagatgctgatcttctgtcagggcggacccggccatctctacttgctcaaaaataaggtggctactttcgccaaagtagaaaaagaggaggacatgatccatttctggaagcggctctccaggctgatgtccaaagttaaccctgaacccaatgttattcacatcatgggatgttacatattggggaaccctaacggtgagaagttattccagaatcttaggacactaatgaccccttatagggttactttcgaatcacccctggaactcagcgcccagggcaagcagatgattgaaacgtacttcgacttccgactttacagattatggaaatcccggcaacactccaagctcctcgactttgacgatgttttgtag

SEQ ID NO: 125837 - DNA, 585 bp, Artificial Sequence
  Description of Artificial Sequence: Synthetic coding sequence
atggggcttgggcctctgtcctcatcactgagcccacagttgatatcctccaaagtacccaaggctgagtacattcccacaataatccggcgggacgacccgagtatcatacctatcttgtatgatcacgagcacgctactttcgaggacattctggaggagattgaacgcaaactgaatgtgtaccataaaggcgccaaaatttggaaaatgttgattttctgccagggcggacctggacacctgtatctcctgaaaaataaggtggccacctttgcaaaagtcgagaaggaggaagatatgattcacttttggaagagactatcaagactcatgagtaaggtcaatcccgagccaaacgtcattcacattatggggtgctatatactaggcaaccctaacggggaaaagctttttcagaaccttaggacgctgatgacaccctatcgcgtcacctttgagagccccttagagcttagcgcgcaggggaaacagatgatcgaaacctactttgacttcagactctacagactctggaaatccagacaacactctaaactcctcgattttgatgacgtcttatag

SEQ ID NO: 125838 - DNA, 1524 bp, Artificial Sequence
  Description of Artificial Sequence: Synthetic coding sequence
atgggcgctgccgcctcgcgccgccgggctttgaggagtgaggctatgagtagcgtcgccgcaaaagtccgcgctgcccgggcatttggtgagtacctaagccagtcacatcctgaaaaccggaatggagccgaccatctactggcagacgcctacagtggccacgatggttcacccgagatgcaacccgcaccacagaacaagcggcgccttagccttgttagcaatggatgctacgaggggagcctgtcagaggagccttcaattaggaaacccgccggcgagggtccgcagccgcgagtctacactatcagcggtgagccagcactgctccctagccccgaggccgaagccatcgagctcgcagtggtaaagggccggcgccagaggcatccccatcaccatagtcaacccctgagagcatcaccaggcggcagtcgcgaggacgtatcaaggccctgtcagagctgggcaggcagccgacaaggtagtaaggaatgccccggctgtgctcagctggcacccggccctacacctcgcgccttcggcctcgatcaaccgcctctacctgagacgtccggccgccgcaagaaactggagcggatgtacagcgtcgatcgggtgtctgacgatatacccattcgcacctggttccctaaggagaacctgttctctttccaaaccgctacaacaaccatgcaggcagtgggaaacttcaggaagcaccttaggatggtgggaagccgccgagtaaaggcacagaccttcgccgagcgtcgcgaaagatccttctccaggtcttggtctgatcctacgcctatgaaagccgatacgagccatgactctcgtgacagcagcgatttgcagtctagccattgtactctggacgaggcgtttgaggaccttgattgggacaccgagaaaggactagaagccgttgcatgcgatactgagggcttcgtccctcctaaagtgatgctgatcagtagtaaagtgccgaaagcagagtatattccaaccataataaggagggatgacccgtccattattcctatcctgtacgaccacgaacatgccaccttcgaagatatcttggaagagatcgagaggaaacttaacgtgtaccacaagggggctaaaatttggaagatgctcatcttttgccagggcggcccaggccacctgtacttgcttaaaaataaagttgctacctttgcaaaagttgagaaagaggaggacatgattcacttctggaagaggctttcacgactgatgagcaaagtaaatcccgagcccaacgtcatccatataatgggatgctatattctgggtaatccaaatggcgaaaagctgtttcaaaatcttcgcacgttaatgacaccatatagagtgacattcgaatcgcccttggaactatctgcgcaggggaagcagatgatcgagacatacttcgactttagactataccgtctgtggaagagtaggcagcatagtaaattgctcgattttgatgatgtcctgtag

SEQ ID NO: 125839 - DNA, 1524 bp, Artificial Sequence
  Description of Artificial Sequence: Synthetic coding sequence
atgggcgcagccgcatcacgccgtcgggccctgagaagtgaagccatgagttctgtggcggccaaagtacgcgccgctagagcctttggcgagtatctgtctcagtcccatcccgagaatcggaatggagccgaccatcttttggctgatgcttacagcggccacgacgggtcgcccgagatgcaacctgcgccgcagaacaagagacgactcagcttggtttccaacggatgttacgaggggagccttagtgaagagcccagtatccgaaaaccagccggggaggggccacagccccgggtttacaccatcagcggggaacccgcgctactcccttcccctgaagcagaggccattgagttggctgtagtcaaggggaggagacagcgccatccgcaccaccattcacagccgcttcgggcatcgcccgggggatctcgggaggacgtgtccagaccatgccagtcctgggcggggtcacggcaagggagcaaggagtgtccagggtgtgcccagttggcccccggtccaacacctcgcgcttttggactagaccaaccgcctttgcccgagacttccgggcggagaaaaaaattggaacggatgtactccgttgaccgcgtatccgacgacatacctataagaacatggtttccgaaagagaatctgttctccttccagaccgccactacaaccatgcaagccatatcaaattttaggaagcatttgagaatggtgggttcaaggcgcgtaaaggcacaaacctttgctgaacgacgggagaggtccttctcacggagctggtccgaccctacccccatgaaagcggacacctcccatgacagtcgagatagttccgacttgcagagctcccactgcacgctggacgaagccttcgaggatcttgactgggacaccgaaaaaggtctcgaggcagtcgcttgtgacactgagggattcgtgccaccaaaagtcatgctgatctcctcaaaggtgccgaaggctgagtatatccccaccatcatccggagggacgatcccagcattataccaatcctttacgaccatgaacacgccactttcgaagacattctggaggagattgagagaaaattaaacgtttatcacaagggcgctaaaatctggaagatgctgattttttgccaaggaggaccagggcacttatacctcttaaaaaacaaagttgccaccttcgcgaaggttgagaaggaggaggacatgattcatttctggaagcgactctcaaggcttatgagcaaggttaatcccgagccaaacgttatccacatcatgggttgctatatattggggaaccctaatggcgagaaactcttccagaatttgcggacattgatgacaccctatcgtgtgacattcgagagtcccttagaactctccgcgcaagggaagcagatgatcgagacctactttgattttagattgtatagactttggaaaagccgccagcattccaagctgcttgatttcgatgatgtgctgtag

SEQ ID NO: 125840 - DNA, 984 bp, Artificial Sequence
  Description of Artificial Sequence: Synthetic coding sequence
atgcagttgggacgccgccttgatcccgagagacaagcactccacctgtgctcaggggttgaaggggaaccttggaaagccgtcgctgggcgtgcactcggaggaatctgcctgtgggtagggggcggcgccagaagccagggggagcactggctgccaactcccaaggggaacttccgcaaacacctgagaatggttggcagccgccgggtgaaagcccaaaccttcgctgagcgcagagaaagatccttctcccggtcctggagtgacccaacacccatgaaggccgatacgtcccacgactcgcgggactcctctgacctccaaagtagccactgcactttagacgaagccttcgaagacctggactgggataccgagaaaggacttgaagccgtagcctgcgacactgagggattcgttccaccaaaagtcatgttgatcagcagtaaggtgccaaaggctgaatatatcccgacgattattcgaagagacgacccaagcatcatccctatactgtacgatcatgaacatgcgacatttgaagatattctggaggaaatagagcgcaagctcaacgtgtaccacaagggagcaaagatctggaagatgctgatcttctgtcagggtggacccggccatttgtacttactgaagaataaggtcgctacttttgctaaggtggagaaggaggaggacatgatccacttttggaagcggcttagccgcttgatgagtaaggtcaaccccgaacctaatgtgatacacattatgggctgttacatcctcggcaacccaaacggggaaaagctcttccaaaacttgcggacactgatgactccctatcgcgtcaccttcgaatcacctctggagctgtccgcacaaggtaagcaaatgatagagacatatttcgatttccgtctgtatagattgtggaaatctcgtcaacacagcaagctcttggactttgatgatgtactttag

SEQ ID NO: 125841 - DNA, 648 bp, Artificial Sequence
  Description of Artificial Sequence: Synthetic coding sequence
atgcctggtgaggcgaccgaaacagtaccagcaaccgagcaagaacttccacaaccccaagcagagacaggatccggcactgaatcagattccgacgaatcagtgcctgagctagaagagcaggactctacacaggcaactacccaacaggcccaattggctgcagctgcagagatagacgaggaacctgtcagtaaggccaagcagagcaggtctgagaaaaaagctcggaaggccatgagcaaactcggattgagacaggtcacaggggtgacacgggtgaccatccggaaatctaagaacatcctgttcgtcataaccaaacccgacgtatacaaaagtcccgcctccgatacttacatagtgttcggcgaagcaaagattgaagacctttcccaacaggctcagctggctgctgcagaaaaatttaaggtccagggggaggctgtgagcaatatccaggagaacacccagactcccactgttcaggaagaaagtgaggaggaggaggtggacgaaaccggtgtggaggttaaagacatcgaactagttatgagtcaggccaatgtctcaagagcaaaggctgtgagagccctgaagaacaattccaatgatatcgtaaacgctataatggagctcacaatgtag

SEQ ID NO: 125842 - DNA, 648 bp, Artificial Sequence
  Description of Artificial Sequence: Synthetic coding sequence
atgcccggagaggctacagagactgtcccagccacagagcaagagctcccccagccccaggccgagaccggctctggaacggaaagcgatagcgatgaaagtgtccccgagcttgaagagcaggattccacacaggctactactcagcaagctcagctcgctgcggcagctgaaattgacgaagaacccgtgagtaaagccaagcagtcacgctccgaaaaaaaggcccgaaaggccatgagcaagttgggattaagacaagtgactggagttaccagagttactatcagaaagtctaagaacatccttttcgtgattaccaagcctgacgtctacaagagcccggcttcagacacctatatagtcttcggagaggccaagatcgaggatttgtctcagcaggcacagctcgctgccgccgagaagtttaaggtccaaggcgaagccgtgtccaacatccaagagaacacgcagacgccaactgtacaagaggaaagtgaagaggaggaagtcgatgaaacgggagtggaagtgaaggacatagaactcgtaatgagtcaggcgaatgttagccgggccaaggcagttcgcgccctcaaaaacaacagtaacgacattgtgaacgccattatggaactgactatgtag

SEQ ID NO: 125843 - DNA, 6237 bp, Artificial Sequence
  Description of Artificial Sequence: Synthetic coding sequence
atgccaggagaggcaaccgagactgtgcccgcaaccgagcaggagttgccacagccgcaggcagaaaccgcagtgcttcctatgtcttccgcgctgagcgtgaccgctgccctgggccagccagggcccacattgccccctccttgctcccccgcccctcaacagtgcccactgtctgccgctaaccaagcatctccttttccaagcccgtccacaatcgcctccactcccctggaagtgcctttcccccaaagctcgtctgggaccgcactgcccctcggcactgctccagaagcccccactttcttgcccaacctgattggccctccaattagcccggccgccctggctctggcaagtccgatgatcgcacccaccctaaaagggaccccttcatctagcgcacctctggccctggtggcattggcaccacattcagtccagaagtcttccgcatttcctcctaacttgctcacttccccgccgtccgtggccgtcgcagagtccggaagcgttatcaccctgagtgcccccatcgcaccatccgagcctaagactaatttgaacaaagtccctagtgaggtggtgcccaaccctaaagggactccttccccgccttgcatagttagcaccgtgccatatcactgcgtaacccccatggcttctattcaaagtggtgtggccagccttcctcagaccacgcctaccacaaccctggcgatagctagcccgcaggtgaaggacactaccatctcttctgtgctaatctccccccaaaacccgggaagtctgagcttaaaaggccccgtatcccctcccgccgcattgagcctctccacccagtcactgccagtggtcaccagttcacagaagaccgcggggccaaatactccacctgatttccctatatcactgggcagccacctggccccgctgcatcagtcctcattcggaagtgtgcagctccttggacagaccggaccatccgccttgtcagaccccacagtgaaaactatcagcgtggatcacagctccactggggcctcatacccctcgcagcgtagtgtgattccccctctcccaagccggaacgaagtggtgccagccactgtcgctgctttccccgtggtggctccatcggtggacaaagggccctcaactatctcttcaatcacctgctccccctctggttcccttaatgtggctacctcattctccctctcacccactaccagtctcattctgaaatcttcccctaatgcgacataccactacccgctagtggcacagatgccagtttctagtgtagggactacacctctcgtagtcaccaatccatgtacgatcgctgctgcgccaacaaccacattcgaagtggcaacttgtgtgtctccgccgatgtcaagcggccctatctcaaacatcgagcccacctcacctgcagcactcgtgatggcaccggtggctccgaaagagcccagtacacaggtcgcgacaaccctgcggatcccagtcagccctccactgcctgacccagaagatctcaagaatttgccctcctcagttcttgtaaaatttcccacacaaaaggacttacagactgtcccagccagcctcgagggggctcccttcagtccagcgcaggctgggctgacaaccaaaaaagaccctacggtgctgcctctcgttcaagcagcccctaagaattcaccaagttttcagtccacctctagctctcctgaaattcctctgtcccccgaggccacactagccaagaaaagcttgggggaacccctgcctattggcaagcctgcctcctctatgacctcccccctcggagtgaactcttcagcctcagttatcaaaactgacagctatgccggccccgactctgctggaccactgcttaagtccagtctaattacgcctacagtagccgcgtttccccttgagtccgccgaccctgcaggcgttgcacctactactgctaagggtacaagcacatataccaccactgccagtcctttcttagaaggtaccgttagtctcgctcctaagaatcatccagtcaaggaaggtacactcacgacccttccacttgttccaaccgctagtgagaactgccctgtggccccctctccacaaaacacctgtgcccctctggcaaccctcgtgctggctcctgagatacccaagagtgtcccttctccgagtctgcctccggcaggcacccccccagggaccaagaaagtggatggcatttctcacacctccgctctcgcacctgtggcctcctctcctaaggagtgtcccactgaggacagcggtgccagcgccaccgcaagctctaagggtactctcacctaccttgccgacagcccctcacccttgggcgtgtctgtgtccccccagactaagcgccctcctactaaaaagggctcagcggggccagatactcctatcgggaatctgagctcccctgtttctcccgtcgaagcttcatttctgcccgagaacagtcttagcttccaggggagcaaggactcccctgctaccacccacagccccacccccccctcgccaaagggtgccccaacaccgagtgccgtcacgcctctcagtcccaagggtgtcacgctgccgccgaaggagacaccaaccccaagtgtggtgaacctcccttttcctaaagaaggccccgccacacctgctcctaaacaagcgccggccttgtccatgacctccagctctccaaagaaagcccgggcaacccccgcccccaagggtatccctgcctcaccatcacctaaaggggccccaaccccccccgctgcaacccctccctctcctaaaggtggccccgctacaccttctccaaaatgggcccctacccctccagccgccaccccaccatccccaaaggggggcccggccacaccatcaccaaaaggtgcacctactcctcccgcggccactcctcctagtccaaaggggggaccggcgactccttccccaaagggagctcccaccccaccagccgtgactcccccgtcaccgaaaggatctcctgcggccacgccttttcctaaaggagcctcaacccctccagccgcgacccctccatcccccaaggggagtcccgccgcgacacccctcccaaagggcgcaccgaccactcccgcagcaacacttccttctcccaaaggcggacccgccaccccctcactgaagggcgccccaacaccacccgcagctacccccccaagccctaagggaggaccggcaactccttctccaaaaggcgcaccaatgccccccgccgcgactccaccttcccctaagggaggcttggccactcctccgcataaaggcgcccctacaactcctgctgccacaccaccgagtccaaaaggtggattagctacacctccccctaaaggtgctcctactactcccgccgccacacctccctctcccaagggaggtctggccaccccccctccgaagggcgcacctacaactccagctgccactccgcccagtcccaagggggggttggcaacccctagtcctaaaggggcccccacaactccagctgcgacccccccaagtccgaagggcggattggccacgccctcacccaagggggcgccaactactcctgcggccactcctccgagcccgaagggaggtcttgctactcccagccctaaaggagcacccacaacaccagctgccactcctccgtccccaaagggtgggccagcaacaccgccacccaagggcgccccaaccccccctgccgccaccccaccgtccctgaaaggtggcctcgctactcccccccacaaaggggcacctaatccagccgtcgtaactccccctagcccaaaggggggccccgccacttcaccccctaaaggtgctcccacacccccagctgcaacccctcccagtcccaaagggtctcctgggactccgccgccaaagggagcaccaaccccaccagcggttaccccccctagccctaagggaacacctaccctcccagccactacccctagcagcaagggcggccctaccacaccgagttcaaaggaggggcctacacctcccgcggcaactccaagtcataaggggggccctgccatgacacccccctctcccaagcgcggacccgccatccccagccccaagggtgacccaaccagcccggccgtaattcccctgagcccaaaaaaggcgccagcgacccctgttaccagagaaggggccgctaccccatctaaaggcgatctgacacctcccgccgtcactccggtttctctgaaaaaagctcctgcgacttctgccccaaagggaggccccgccacccctagttcaaagggtgaccctacacttccagctgtaaccccccctagtccaaaggagccccctgcccccaagcaggtagctacctcgtccagccccaagaaggcacccgctacacctgcccctatgggcgccccaaccttgcctgctgtcatcccatcctctcctaaggaggtccccgccactccttctagtagacgagatccgatcgcaccaactgcaaccctgttgagtaagaaaaccccagccacccttgcccctaaggaggctctgataccacccgctatgacagttcccagccccaaaaaaacacctgcaatccctaccccgaaagaggccccagccacaccttctagcaaagaggcaagtagccctcccgcggtcacccctagtacatacaagggggccccatccccaaaggaactcctcatccctccagccgtgaccagccccagtccaaaagaggcacctactccaccagcggtgacacctcctagcccagaaaagggccccgcgacccccgcacccaaagggacccctacgtccccccccgtgactccatcgtcactgaaggacagtccaacatcacctgcatctgtcacctgcaagatgggagccaccgtcccacaggcctccaagggtctgcccgctaaaaagggacccactgccttgaaggaggtgctcgtggctcccgctcctgagagcactcctattataaccgcccccaccaggaagggtcctcaaaccaaaaaatcttccgcgacctccccaccaatctgtccagatccttctgctaaaaacggtagcaaagggccactgagtaccgttgctcccgcgcctctcctgccagtgcagaaggactcaagcaagacggccaaagggaaggacgcatcacattctcctaagggtccactggcgccgccagagagcaaagccagcactccacttacggctgcagcttttgagaaggtgctccccaaaccggagtccgccagtgtttctgctgccccgtcccctcctgtgagcctgccgctcgcaccttccccagtccccaccctaccccccaaacagcagttcttaccttcaagccccggcctggtccttgagtccccgagcaagcctttggctcccgcagatgaagatgagctgcttcctctaattcccccagagccaatctcaggtggggtccctttccaaagcgttctggtcaacatgccaacgcccaaaagtgctggtattcctgtaccaaccccttccgctaaacagccggtcaccaagaataacaaagggagcggcacagaaagcgattccgatgaatccgtaccggaactggaggagcaggatagcactcaggctaccacccagcaagcacaactggcggctgctgctgaaatcgatgaggaaccagtgtctaaggctaaacaatcccgcagcgaaaagaaggccagaaaagctatgtccaagctggggctgaggcaggtcacaggagtgacacgggtaactattaggaagtccaagaacatcctctttgtcattactaagccggacgtctataagagtcccgcatcagacacttacatcgtctttggagaggcaaagatcgaggacctgagccagcaggcccaattagcagcggctgagaagttcaaggtgcagggcgaagctgtgtctaatattcaagaaaacacgcagactccaacagttcaggaggagagcgaggaagaggaggtggacgaaactggcgtggaggtaaaagatatcgagttagtcatgagccaggcaaacgtctctcgtgcaaaggcagtcagggctctcaagaacaactctaatgacatcgtgaatgcgatcatggagctaacaatgtag

SEQ ID NO: 125844 - DNA, 648 bp, Artificial Sequence
  Description of Artificial Sequence: Synthetic coding sequence
atgccaggggaagcaaccgaaaccgtgcccgccacggaacaggagcttccgcagccacaggctgagacaggctctggcactgagtccgattccgacgaatccgttcccgaacttgaagagcaggactctactcaggccactacccagcaggcccagttggctgccgccgctgagattgacgaagagccagtatcaaaagccaagcagagtagatccgagaagaaagctcgaaaggccatgagcaagttgggactgcggcaagtgaccggggtgactcgcgtcaccattagaaaatctaaaaatattcttttcgtcatcactaaaccagacgtgtacaagtcccctgcctccgatacttatattgtctttggcgaggcaaagatcgaagacttgtcacagcaggctcagttagctgctgccgagaagtttaaggtccaaggagaagctgtgtcaaacatccaagagaatactcagactccaaccgtgcaggaggagagtgaggaagaagaggttgacgaaactggggtggaagtgaaagatatagagctggtaatgagccaagcaaacgtctccagagccaaagctgtgcgtgccctcaagaataattctaacgacatagtgaatgccatcatggaactcaccatgtag

SEQ ID NO: 125845 - DNA, 21 bp, Artificial Sequence
  Description of Artificial Sequence: Synthetic coding sequence
atgccaggcgaggccacgtag

SEQ ID NO: 125846 - DNA, 597 bp, Artificial Sequence
  Description of Artificial Sequence: Synthetic coding sequence
atgcccggcgaggccacagaaacagtgcccgcaacagagcaggagctcccacagccccaggcagagactggctctgggaccgagtccgacagcgatgaatctgtccccgaacttgaggagcaggactccacccaagctaccacccaacaagcccaattggctgcagctgctgagatcgacgaggagccggtgagcaaggccaagcagtccagatcagagaaaaaggcacgtaaggcgatgtccaaactgggtctgaggcaggtcaccggagtcactcgcgtaactattcgcaaatccaaaaacatcctgttcgtgattactaaaccagacgtgtataagagtcctgccagtgacacctacatagtgtttggagaagctaaaatcgaagatctgagccagcaggctcagctggccgcggccgagaaattcaaagtccagggcgaagctgtatcaaatatccaggagaatacccaaactcccacggtgcaggaagagtccgaagaagaagaagtggacgaaactggagtcgaggtgaaggacattgagctcgtgatgtcacaggcaaatgtgtcgagggctaaggcggttcgagcctag

SEQ ID NO: 125847 - DNA, 381 bp, Artificial Sequence
  Description of Artificial Sequence: Synthetic coding sequence
atgcccggcgaggccacggagacggtaccagccacggagcaggaactgccacagccacaggccgagactggatccggcactgagagcgactccgacgaatcggtgcccgagctggaagagcaggacagcacccaggccacaacccagcaggcccagctcgccgctgccgcagaaatagacgaggagcctgtgtcgaaggcaaaacagtccaggagcgaaaaaaaagcgcgtaaggccatgagcaaactgggcttgcggcaggtgaccggtgtgacccgcgtgactataagaaagtctaagaacatactgtttgtgattactaaaccagacgtgtacaagagcccggccagcgatacttacatcgtatttggagaagcctag

SEQ ID NO: 125848 - DNA, 648 bp, Artificial Sequence
  Description of Artificial Sequence: Synthetic coding sequence
atgccgggtgaagccacagaaacagtgccagctactgagcaggagctacctcagcctcaagccgaaactgggagtggcacagagtctgactccgacgaatctgtgcctgagctcgaggagcaagactcaacccaggccaccacacagcaggcccagttggctgccgcagctgaaattgatgaagagcccgtgtctaaagccaaacagtcacgctcggagaagaaggccagaaaggctatgagtaaattgggactgcgtcaggttacaggagtcacaagggtcacaatccggaagtctaaaaatattctgtttgtgatcaccaaaccagatgtttataagtctcctgcgtctgacacctacatcgtgtttggcgaggctaagatcgaagacctgtcgcagcaggcacaacttgcggctgccgagaagttcaaagtacagggggaagccgtgagtaacatccaggagaacacccaaactccaaccgtgcaggaggaatcagaggaggaggaggtggatgagactggagtcgaggtaaaggatattgaattggtgatgtctcaggctaatgtctcccgcgcaaaagccgttagggctctgaagaataattcaaatgacattgtaaacgctataatggagttgaccatgtag

SEQ ID NO: 125849 - DNA, 2778 bp, Artificial Sequence
  Description of Artificial Sequence: Synthetic coding sequence
atgcccggggaagcaacagagaccgtgccagcaacagagcaggaactgcctcaaccacaagccgagacagcggttttaccaatgagcagcgctctgagtgtcactgcagcactggggcagcctggtcccacactaccaccgccatgctcccctgccccccagcaatgccctctgtcagccgcgaaccaggccagtccgttcccatcccctagcacaattgcctctacccctttggaagtaccattcccacagagttcctctggaaccgccctccccctggggactgcccctgaggcccctacctttctgcccaacttgatcggtcctcctatatccccagccgcactggcccttgcatcgcctatgattgctcctactctaaagggaaccccaagctcctccgccccgttggctctcgtagcgctcgccccacattcggtgcagaaatctagcgcattcccccccaatctactcacgtccccaccatccgtcgccgtggcggagagtgggagtgttattactctaagtgcccccatcgccccatctgaaccaaagactaacctgaataaggtgccctccgaggttgtccccaatccgaaagggacgccatccccaccttgtatagtgagcacggtaccctatcactgcgtgaccccaatggccagtatccagtccggagtggcttccctgccacagactactcccactaccacgctggctatcgcgagtccccaagtgaaggataccacaatctcttccgttctcatcagcccgcagaaccccggcagtctgagcctgaagggaccggtctcaccaccagcagccctttcactgtctactcaatcactgcctgttgtgactagctcccaaaagacagccggcccgaacaccccacctgactttcctatttccctggggtctcacctagcccctttacatcagtcctccttcggttctgtccagctgcttggccagacgggtcctagcgccctctcagacccaacagtgaagacaattagtgttgaccattcatctactggagcctcctacccgtcccagaggagcgtcataccccctctgccgtcacgcaatgaggtcgtacctgccaccgttgcggcattcccagtggtagcgccctcagtggataagggccctagcacaatttcatcaatcacttgtagccctagcggcagcctgaacgtggccacaagtttctcactgtcccccactacatctctgatactgaaaagttccccgaacgccacctatcactacccccttgtggcccagatgccagtcagctccgtgggtacaacaccgctggtggtgaccaatccatgtacgatcgcggctgctccaaccaccacctttgaggtcgccacatgtgtgagcccacccatgtccagcggaccaattagtaacatcgagcctacatcgcctgctgctttagtgatggcgccggttgcgccaaaggagcccagcacccaggtcgccacaacattgagaattccagtttcccccccattgccagatcccgaggatctgaaaaatttaccatcatccgtgctcgtcaaattccccacccagaaggatctgcagaccgtccccgccagtctggagggagctcctttctcccccgctcaagccggtctgactacgaaaaaagatcccacggtgctcccactggtccaggctgctcccaagaattcccccagctttcaaagcacgtcaagttcacccgagatcccgctgtcacctgaagcaacactggctaagaaatcactaggggagccattgcccatagttgccgcttttcctctcgagtcagccgatcctgccggggttgccccgaccaccgcaaaggccgcagcctttgagaaggtcctgccaaaacctgagtcagcaagcgtgagtgcggctccctccccgccagtgtccctgcccctggccccctcacctgtgccaactctgcctccgaagcagcagtttctgccctcttctccaggattagttctcgagagtccaagtaagccgctggcccctgctgacgaggatgagttgctccctctgattccccctgagccaattagcggcggtgtcccttttcaatcagtcctggtcaacatgcccaccccaaaaagtgccgggattcctgttccaactcctagcgcaaagcaacctgtgactaagaataacaagggatcaggaacggaatccgacagcgatgaatccgtgcctgaactggaggaacaggatagcacgcaggcgaccacgcaacaggcccaactagctgcagcagccgaaattgacgaggagcctgtgagcaaagcaaaacagagccgctcagaaaaaaaggccagaaaagctatgtcaaagctgggcttgagacaagtgactggggtgactcgagtgaccatccgaaaatccaagaatatcctgtttgttatcacgaagcctgacgtttataaatcgccagccagcgacacctatatcgtctttggcgaagctaaaatagaggatctttcacaacaggcccagttggcagcagctgagaaattcaaagtgcagggggaggcggtgagcaacattcaagagaatactcagacacctacagtgcaggaggagagcgaagaagaagaggtggatgagactggcgtcgaagtgaaggatatcgagctggtgatgtcccaggcaaacgtgagcagggcaaaagctgtgagggccctgaaaaacaacagtaatgatatcgtaaatgctataatggaacttaccatgtag

SEQ ID NO: 125850 - DNA, 306 bp, Artificial Sequence
  Description of Artificial Sequence: Synthetic coding sequence
atgcctctagaggatgaggtcgtgcccccccaagtcctgtcagagccaaatgaagaagccggggccgcgctgagcccattgccagaggtacccccctggaccggggaggtttcacctgcccagagagacggaggcgccctcgggcggggcccatgggactcttctgaccgcagcgcactgttaaaatcaaaattgagagccctcctcaccgcccccagatcactccgccgctcttcatgctttggagggcgaatggaccggattggagcccagagtgggttggggtgtaatagctttcgctactag

SEQ ID NO: 125851 - DNA, 456 bp, Artificial Sequence
  Description of Artificial Sequence: Synthetic coding sequence
atgagctccttttcgaccactactgtgtcctttctcttgttgctggcatttcagctactcggccagactagggccaatcccatgtacaacgccgtctctaacgctgacctgatggactttaagaacctcctcgaccacctcgaagagaaaatgcctctcgaagacgaggtagttccgccacaggtgctgtccgaacccaacgaagaagcaggcgcagccttgtctcctctgcctgaggtgccaccttggactggagaggtgtctcccgcacagcgggatggaggtgcactgggacgaggaccctgggactctagtgacaggtcagctctcctcaaatcaaagttgagggccctgctcacggctccccgaagcttgcgtagaagcagttgctttgggggaaggatggaccgcatcggcgcccagagcggtctgggctgcaattcttttagatactag

SEQ ID NO: 125852 - DNA, 768 bp, Artificial Sequence
  Description of Artificial Sequence: Synthetic coding sequence
atggaacagtacgccaacaatttagaggaactggttgaagagcgaacccaggcgtaccttgaggagaagcggaaggcggaggcgttgctataccagatcctacctcacagtgtggcagagcaactcaaaagaggcgaaactgtgcaagcagaagccttcgactccgtgaccatctatttcagtgatatcgtgggcttcactgccttgagcgcggagtctacgccaatgcaggtggtgactctgttaaatgatctctacacctgcttcgatgccgtgatcgataactttgacgtctacaaggttgaaaccataggcgatgcatatatggtagtcagtggcttgccagtccgtaatggccggcttcatgcctgcgaagttgctcgaatggctctcgccttacttgatgcagtccgttctttcaggatccgtcatcggcctcaggagcaacttcggctccgtatcggtatacacaccggacccgtgtgcgctggagttgtaggcctcaaaatgccacgctactgccttttcggggatacggtcaacacagcgtcccgcatggagagcaacggtgaggcactgaaaattcacttgtcctcagagaccaaggcggttctggaagagttcggcggatttgagctagagctgcggggagacgtggaaatgaaagttgaaggggaggcatccgcccttcccactttctgggggccaagaggctcttatcccagccaagccgctaacgctacacctattccgaaagccctgatatag

SEQ ID NO: 125853 - DNA, 3186 bp, Artificial Sequence
  Description of Artificial Sequence: Synthetic coding sequence
atgcccggcccacggcgacccgccggttcccgattgcgcctacttctcctgctgctcctaccccctttgttgttgttgctgaggggatcccatgccggaaatttgactgtcgcagtggtgcttccactggcgaataccagttacccctggagctgggcacgcgtgggacccgctgtggagcttgccctggcccaggtgaaagctcgcccggacctcctgcccggctggacggtacgcaccgtgctgggaagtagcgagaacgcgctgggagtctgttccgatactgcagcgcctcttgctgccgtggatcttaagtgggaacataatccagccgtctttctaggccctggctgcgtgtatgccgccgcacccgtgggacggtttaccgcccactggagagtgccactactcactgcaggggccccagcactagggttcggagtcaaggacgaatatgctctgacaacaagggcgggaccaagctatgccaaattaggcgactttgttgcggcactccaccggcggctgggatgggagaggcaggctctgatgctctatgcatatagaccaggtgatgaggagcattgcttctttcttgtggagggcttgttcatgcgtgtgcgggaccggctgaacattacagtggatcacttagagttcgctgaggatgatctgtcacattacactaggcttctgagaaccatgccaagaaaagggcgggtgatctacatctgtagttcaccagacgctttcagaacgctcatgcttttagccctggaggccggtctctgcggggaggactacgtatttttccacctggacatatttggccagtcactccagggcgggcagggtcctgcccctaggagaccgtgggagcggggcgatggacaggatgtgtcggcacgccaagctttccaagccgctaaaataatcacctacaaagaccctgataatcccgaatatttggagtttctgaaacagctcaagcatctcgcctacgaacagtttaatttcacaatggaagacgggcttgtgaacaccataccagcgtcttttcacgatggccttctcctttatatccaggccgtcacagagaccttagctcatgggggcaccgtcacggacggtgagaatatcacgcaaaggatgtggaatcggtccttccagggagtgacgggttacctgaagattgactcttcaggagacagggagacagatttctctttgtgggacatggacccagaaaatggcgcattcagggtggtactcaattacaacgggaccagccaggaactagtggccgtttctggccgaaagctcaattggcctctggggtacccgcctccagacataccaaagtgcgggtttgataatgaagatccagcttgtaaccaggaccatctgagcactctggaagtgctggcattggtaggatcactcagcctgctgggtattctcatcgtgtctttcttcatttaccgcaaaatgcagctggagaaagagctcgccagcgaactgtggcgagtgcgctgggaagacgttgagcctagttctttggagaggcatttgcgatcagctggaagccgcctgacattgtctggcaggggatctaactatggttctctcttgaccaccgagggccagttccaagtcttcgctaagacggcctactataaggggaacctggtcgcggtcaaacgtgtaaatcggaaaagaattgaactgactcgaaaagtgctatttgagctcaaacatatgagagatgtgcagaatgaacatttgacaagatttgtgggtgcatgcacagaccctcctaacatctgcatcctgacagagtactgcccccgaggttcccttcaagatattctggagaacgaaagtatcacgttggactggatgtttcggtacagcctgactaacgacatcgtgaagggtatgttatttctccacaacggcgccatctgtagccacggaaacttaaagtcctctaactgtgtcgtggatggtagatttgtgctgaagatcaccgactacggactcgagagttttagagatctcgatcctgagcaggggcataccgtttacgccaagaaactgtggaccgccccggagctactgcgaatggcctccccccctgtccgcggtagccaggcaggagatgtttactcgttcggcataatccttcaagagattgccctacggagtggagtgttccatgtggaaggactggacttgtcgcccaaggagattatcgagcgtgtgacaagaggcgagcagccaccatttcgcccctctcttgccctccagagccacttagaagagctgggcttgctcatgcaacgctgttgggcagaggatcctcaggagagaccccctttccagcagatccgactcactctaaggaagtttaacagggagaattctagtaacatcctggacaatctgctgagcaggatggagcagtacgctaataacctggaagagctcgtcgaggagcgcactcaagcctacctagaggaaaaacgcaaagccgaagccctgctttaccagatcctgcctcacagtgtcgctgagcagctgaagcggggtgagacggttcaggcagaagccttcgactcagtgaccatctacttcagtgatatcgtgggatttacggccctgagtgcagagtccacgcctatgcaagttgtcacgctattgaacgacctgtacacatgctttgacgcagtgatcgacaacttcgatgtgtataaggtagaaaccattggggacgcgtatatggttgtgagtgggctccccgtcaggaacgggcggctgcacgcttgcgaggtggctcggatggcactggcgctgctcgatgccgtgcgctcattccggatcaggcaccgcccccaagagcagctgaggctaagaatcggcattcacactggtcccgtgtgcgccggagttgtgggattgaagatgcctcgctactgtttatttggcgacacagtcaacactgcctctagaatggaatccaacggcgaggctttgaagattcatctgtctagcgagacaaaggcagtgctggaggaatttggcggctttgaactcgaacttagaggcgacgtggagatgaaaggtaagggtaaagtgcgcacctactggctcttaggcgaacgcggctcaagcactcgggggtag

SEQ ID NO: 125854 - DNA, 1623 bp, Artificial Sequence
  Description of Artificial Sequence: Synthetic coding sequence
aaaatgcagcttgaaaaggagctcgcatctgagttgtggagggttcggtgggaagacgtggaaccaagctctttagaaaggcatctaagatcagccggcagtcgccttaccctctcaggaaggggttccaattatgggtccctgttaacaactgagggccagtttcaggtattcgctaagacggcatactataagatgcgggatgttcagaacgaacacttaaccaggtttgtgggggcctgtaccgacccacctaacatctgtattctgaccgaatactgtcctaggggctctttacaggatattctcgagaacgagtccattactctcgactggatgttcagatatagcctgactaacgacattgtcaaaggtatgctgttccttcataatggagcaatctgtagtcatggaaacttgaagagctccaactgcgtcgttgatggcagattcgttctgaaaattactgattacggacttgagtccttccgtgatctggaccctgaacagggccacacggtgtatgcaaagaagttgtggacggcccccgagcttctgagaatggcatcaccccccgtgagaggaagtcaggctggcgatgtctactcattcggaatcattctccaggagatcgcactgcgctctggcgtctttcacgtggaggggctcgacctgagtcccaaagagattattgaacgagttactcggggggagcagcctccttttcggccctctctcgcacttcagtcgcatttagaagagctaggactgttgatgcagcgatgttgggccgaggatccccaggagcgtcccccgtttcaacaaataaggctgacactacggaagtttaatcgcgaaaactccagtaacatcctggacaacttactgtctaggatggaacaatatgctaataacctggaagagctcgtggaagaaagaacacaggcatacctcgaagaaaagagaaaggccgaagctcttctgtatcagatcttgccccacagcgtggcggaacaattaaagaggggagagactgtccaggctgaagcattcgactcagtaactatctacttctcggacatcgtgggctttacagccctatcagccgagagtacccctatgcaagtggttacactcttgaacgatctgtacacctgtttcgatgcagtcatcgacaactttgatgtgtataaagtggaaacgatcggtgacgcttatatggtggtttccgggcttcccgttagaaacggcaggcttcacgcttgtgaggtggcacggatggctcttgccctgctcgacgccgtgcgcagcttcagaattagacatagaccacaggaacagctgcgtctgcgcatcgggattcacacagggcctgtttgcgcaggagtcgttggacttaagatgcctcggtactgcctatttggcgacaccgtgaataccgcttcacggatggagagcaatggcgaggcattgaaaatacacttgagttctgaaacgaaggccgtgctcgaggaattcggcggcttcgagttggagctgagaggcgacgtggaaatgaagggcaagggcaaagtcaggacgtactggctacttggcgagcgcggcagcagtacccgcggttag

SEQ ID NO: 125855 - DNA, 3144 bp, Artificial Sequence
  Description of Artificial Sequence: Synthetic coding sequence
atggccctcccaagtttattgctgctagtcgcggctttagctggcggagttaggccccctggggcacgaaacctgacactcgcagtggtactgccagaacacaacctttcctatgcctgggcctggcctagggttgggccggcagtagctttggctgtcgaagccctaggtagggccctgcccgtggatctccgctttgtcagttcagagctggaaggagcctgctccgagtatctggcgcccctatcagccgtcgacctcaagctttatcatgatcctgacttgctgttggggcctggatgcgtataccccgctgccagcgtggcccggtttgcatctcactggcggcttcccctgctgactgctggcgccgtggcatccgggttcagcgctaagaatgatcattaccggacattggtgcgtacaggcccttccgctccaaagctgggcgagtttgtagttactcttcacgggcattttaattggaccgccagggctgccctgctgtacctggatgctcggactgatgaccggccccattatttcacaatcgaaggcgtgtttgaagcactacaggggagcaacctttccgtgcagcaccaggtgtatgcaagagaaccaggtgggcctgaacaggctacacacttcatcagggccaatggccgcatcgtatatatctgtggaccgctcgagatgctgcatgaaatactgctgcaggctcagcgagaaaatctcaccaacggggactacgtgtttttttacttggatgtgttcggggagagcctgcgcgccgggcctaccagagctacaggacggccctggcaggataaccgcacacgcgaacaagctcaggcgctgagggaagcctttcaaactgtgctcgttattacctaccgggaacccccaaatccagaatatcaggagttccagaatagacttctgatacgtgcccgggaggatttcggggtagaacttggtccatccctgatgaaccttatagctggatgtttttatgacggcattctgttatatgccgaagtccttaacgaaactatccaggagggaggtacccgcgaagacgggctgaggattgtggagaagatgcagggtaggagatatcacggagttacaggcctggttgttatggataaaaataacgatcgcgagacagacttcgtgttgtgggctatgggcgatctcgatagcggagatttccagcccgcagcgcactacagcggagcggaaaaacagatatggtggaccggacggccaatcccttgggtcaaaggggcaccccctagcgataaccctccctgtgcattcgacctggacgatcccagctgcgacaagacacctctgagcaccttggctattgttgccttgggtacgggcattacgttcattatgtttggggtctcttccttcttgatcttccgcaaactcatgctcgaaaaggagctggcttcaatgttatggcgaataagatgggaagagctccaatttggaaactcagagagatatcataagggggctgggtcccggcttacactcagtctaagagggagctcctacgggtccctgatgacagcgcatggaaaataccagatctttgcaaacactggacactttaaagggaacgttgttgcaatcaagcatgtaaataagaagaggatcgaactgactcggcaagtcttgttcgagctgaaacatatgcgtgacgtccaatttaaccacctgacaaggtttatcggcgcgtgtatcgaccctccgaacatctgcattgtcactgagtactgccctagagggagtctccaagacattctggaaaacgattctattaatctcgactggatgttccgctatagccttatcaacgacttagtaaaaggcatggcttttctgcataactcaattattagcagccacgggtctttaaaaagctccaactgcgttgtggatagtcgtttcgtgctcaaaatcacggattatgggttggcctcatttcggagcaccgcggagccagatgatagtcatgccctctatgccaaaaagctgtggaccgcaccagagctgctgtcaggcaatcccctcccgacaacaggcatgcagaaagccgatgtctattcctttgggattatactacaagagatagcacttagatctgggccgttctacctcgaaggattggacttgtctcctaaagaaatcgtccaaaaggtgagaaatgggcaacggccatacttccgtccctctatcgacagaactcagctgaatgaagagctcgttctgctcatggagagatgctgggcgcaggacccagcagaacggcccgactttggccagatcaagggattcattaggcgcttcaataaagagggggggacgagtatcctggacaacctgctactgagaatggaacagtacgctaataacctcgagaaactggtcgaggagagaacacaggcctatctggaggagaaaagaaaagccgaggcactactgtatcagattctcccccatagcgttgctgagcagctcaaacggggggaaaccgtacaagcggaggccttcgactctgtgaccatctacttctccgacattgtcgggtttactgcattgtccgctgagtcgacaccaatgcaagtagtgacccttcttaatgatctttacacatgctttgatgccatcattgataattttgatgtatacaaggtggagacaattggtgatgcctatatggttgtgtctggactgccaggtagaaacgggcagcgccacgctcctgagatagctaggatggctctggccctcctcgacgctgtcagcagttttcgaattagacaccgacctcacgaccagctccgcctccgtataggagtccacacagggcccgtgtgcgcaggagttgtcggacttaagatgccgagatattgtctgttcggcgataccgtcaacacagctagccggatggaatctaatggccaggctttgaagattcacgtctcctctactactaaggatgcactcgatgagctgggctgcttccagctagaactccgaggagacgtggagatgaaagggaaaggcaagatgaggacctattggttgttgggcgaacggaaaggacccccaggtttgctatag

SEQ ID NO: 125856 - DNA, 1626 bp, Artificial Sequence
  Description of Artificial Sequence: Synthetic coding sequence
atgccttccctgctagttctgaccttctccccctgcgttctactgggctgggctctgctcgcaggtggaaccggcggtgggggcgtagggggagggggagggggagccggaattggaggggggcggcaggaacgcgaagctttgccaccgcaaaaaatcgaggtccttgtcctcctgccacaggatgactcatacctcttttccctgaccagggtaagacccgccatcgagtatgctttaagatctgtcgagggtaacggaaccggtagaaggctgcttccccctggaacgaggttccaggtggcctatgaagactccgattgtggcaatcgcgccctgttctctctggtggatcgagtggcagccgccagaggcgctaagccagacctaatacttggacctgtatgtgagtatgccgcggccccggtggcccggctcgcctctcattgggacctgcccatgttaagtgccggggccctcgctgccggcttccagcacaaggattcagaatatagtcacctgacgagggtcgctcctgcctacgcaaaaatgggtgagatgatgctggccctttttaggcaccaccactggtccagggccgctttagtgtactcagatgacaaactcgagaggaattgctacttcaccctcgaaggggttcacgaggttttccaagaggagggtctccatacttcgatttacagcttcgatgagaccaaagaccttgacttggaggatattgtgcgaaacattcaagcatcagaaagagtggtcataatgtgcgccagttcagatactattcgctccatcatgttagtagcacaccgacatggcatgacttcaggcgactacgccttctttaatatcgaactgttcaactcatcaagctatggtgacggctcttggaaacgaggggacaagcacgattttgaagccaagcaagcttattcttccttacaaactgttacccttctccggaccgtgaagcccgagttcgagaagttctctatggaggttaaatcttcagtggaaaaacagggactcaatatggaggactatgttaacatgtttgtcgaagggttccatgacgctattctgctctacgtcctggccctgcacgaagtcctaagggcagggtacagcaaaaaggacgggggaaagatcatacagcagacatggaataggactttcgagggcattgcgggccaggtcagtattgatgcaaatggggatcgttatggagatttttctgttattgctatgacagatgtggaagctggcacccaggaggtgattggcgactacttcggtaaagaaggaagatttgaaatgcgccctaatgtcaaatatccttggggccctcttaaactccgcatcgatgagaataggatcgtcgaacatacaaattcgtccccatgcaagtcatctggcggcctcgaagaatccgctgtgactggaattgtcgtcggtgcactactgggcgcgggcctgttgatggcgttctatttctttagaaagaaatatcgaataaccatcgagcggcggacccagcaggaggagtcaaatctcggaaagcaccgagaacttagagaggacagcattaggagccacttttccgttgcctag

SEQ ID NO: 125857 - DNA, 1623 bp, Artificial Sequence
  Description of Artificial Sequence: Synthetic coding sequence
atgccctccctgttagtgctgactttttcaccctgtgtcctgctaggttgggcacttctggccgggggaaccggtggaggcggggtgggaggtggcggcggaggtgccggaataggcgggggacggcaagagagggaggctttgccaccacagaagatcgaggtgctagtcctgctgccccaggatgatagctatttgttttcacttacgcgcgttcggccagccatcgaatatgcccttcgtagcgttgaggggaacgggacagggagacgtctcctgccaccgggtacaagatttcaagtggcttatgaagattcggattgcggcaatagagctctgttcagcctagtagaccgcgtggctgccgcacggggcgccaagccagatctcatcttaggacctgtctgtgaatacgccgcagcgcccgtggccagattggcctcgcattgggatctgcccatgctcagcgctggggctttggcagctggatttcagcacaaggactctgagtactctcacctgacacgagtcgcacctgcgtacgcgaagatgggggagatgatgctggcgttatttcggcatcatcattggtcaagagccgccctggtgtacagcgatgataaactggaaagaaattgctacttcacactcgagggggtccacgaagtattccaggaagagggactgcatacatcaatctattcatttgacgagacaaaagacctagacctggaggacattgtcagaaacatccaggcttcagaaagggttgtaatcatgtgtgctagttcagacactattcgctctattatgcttgttgcgcacaggcatggtatgacctctggcgactacgccttctttaatatcgaacttttcaatagctcttcatatggggatgggtcatggaagaggggtgataagcatgatttcgaggccaaacaggcctactcaagcctccagactgtgactctgctgcgcactgtgaagcctgagtttgaaaagttctcgatggaggtgaaaagctcagtggagaagcaggggctgaacatggaagactacgtcaatatgttcgtcgaagggttccacgatgcaattctcctgtatgtgcttgctctccatgaagtgctgcgggcaggatactccaagaaggatggaggaaagatcattcagcagacctggaatcgcacattcgaaggaatcgccggacaagtgtctatcgatgcaaatggagaccgctacggtgacttctcagttattgcaatgactgacgttgaagccgggacccaggaagtgatcggcgattactttggaaaggaagggagatttgagatgcggcctaatgtgaaatacccttgggggcctctaaagctgaggatagacgaaaacagaatcgtcgaacacaccaattcctctccttgtaaaagctgcggcctggaggaatccgccgtaaccggcattgtcgtgggggccctacttggggctggcctgctgatggcattttatttctttaggaaaaagtatcgcattaccattgagcgtaggacacagcaggaagaatccaacctgggtaagcatagagagctacgtgaggatagtatacgaagccacttctccgttgcatag

SEQ ID NO: 125858 - DNA, 975 bp, Artificial Sequence
  Description of Artificial Sequence: Synthetic coding sequence
atggagccctccgctctgggcccctggagcctctttcccgatctggcaccacgagaccaagaaggacaggtgcttgcgccaagacgttgctttaggcgggagtgcggccagaatgaaaaggttgtgattatgtgtgcctctagtgacaccatccgcagcattatgttagtagctcaccgccatgggatgacttctggggactatgcctttttcaatatcgagttatttaactcaagctcttacggcgatggaagttggaagcggggggacaagcacgatttcgaagcgaaacaagcctattcctctctgcagactgtcacactgttgcgtactgtgaagcctgagttcgagaagttctcgatggaggtgaagtcatccgtggagaaacagggcttgaacatggaggattacgtcaacatgtttgttgaggggtttcatgacgccatcttgctgtatgtgctggccttgcacgaggtgctaagagcaggttactcaaaaaaagacggaggtaaaataattcagcagacctggaaccggacctttgaaggcatagccgggcaggtgagcatcgacgcaaatggagatcggtacggcgatttctcggtgatagccatgaccgatgtggaagccgggacacaggaggtgattggcgattatttcggtaaggagggtcgctttgagatgcgcccaaacgtgaagtatccatggggtcctttaaagctgcgcattgatgagaacagaatcgtggagcacaccaattcttctccatgtaaaagctgcggcctggaggagagcgcggtcactgggatcgtggttggcgcacttctaggcgccgggttactgatggccttttactttttccgaaagaaataccggatcaccatcgaaaggcgcacacagcaggaggagtcaaacctgggaaagcaccgcgagcttcgagaagattctattagatcacacttttcagtcgcgtag

SEQ ID NO: 125859 - DNA, 915 bp, Artificial Sequence
  Description of Artificial Sequence: Synthetic coding sequence
atgtcatctacactgcctgccttgttatgcgtgggtctctgtcttagccaacggatttccgcccagcagcagacactgcccaaaccgttcatctgggcagaaccgcattttatggtgccaaaggagaaacaggtgacaatttgctgtcaaggcaactacggggcggtggaataccagctgcacttcgaagggagtctctttgccgtggatcgaccaaaacctccagaacgcatcaacaaagtgaagttctacatccctgacatgaattcccgcatggcgggtcagtactcttgcatatacagggtgggggagttgtggtccgagccctccaatctgcttgatctggtggtgactgagatgtacgacactccgacactgagcgtgcacccaggacctgaggttatctcaggagagaaggtcacattctattgccggctcgatacggctactagcatgtttctgctgctgaaggaaggacggtctagtcacgtgcagaggggttatggcaaagtgcaggcagaatttcccctcgggcccgtgaccacagctcacagagggacgtatcggtgctttggttcgtacaacaatcatgcctggagctttccaagcgagcctgttaaactcttggttaccggagacatcgagaataccagtctcgctcctgaggaccctaccttccctgccgacacatggggaacatatctgctgactactgagacaggcttgcagaaagatcacgctctttgggaccacacagcgcaaaacttgttacgcatggggctcgccttcctggtcctggtggctctggtgtggtttctggttgaggactggctgtcgcggaagcggaccagggaacgtgcaagccgagcatcaacctgggaaggtaggcggaggctcaatacccaaaccttatag

SEQ ID NO: 125860 - DNA, 864 bp, Artificial Sequence
  Description of Artificial Sequence: Synthetic coding sequence
atgtcatcaaccctccccgccttactgtgtgtcggtctgtgtctgtcccagcgaatttccgcacagcagcagaccttgcctaaaccattcatttgggccgagcctcattttatggttcccaaagagaagcaggtcacaatttgctgccagggcaattacggggcagtcgagtaccagctgcatttcgaaggttccttgttcgcagtcgacagacccaagcctccggagcgcatcaacaaggtaaaattctacatcccagacatgaacagtaggatggcagggcagtacagctgcatctatagagttggggagttgtggtcggagccgtctaacttgttggacttagtggtcactgaaatgtacgacactcccactctctctgtccatcctggccccgaggtgatttctggtgagaaggttactttctactgccgcctggatactgccacttccatgttcctgcttctaaaagagggacgctcaagtcatgtgcaacggggctatggcaaggtgcaggctgaatttcccctgggtccagtgacgaccgcccaccggggaacctaccgctgcttcggctcctataacaatcacgcatggagcttcccttctgagccagttaaactgctggtgactggtgacatcgaaaacacatcactggccccggaagatccgaccttccctgaccacgccctgtgggatcacaccgctcaaaacttgctgaggatgggcctggcattcctggtgctagtagcactggtgtggttcttggtagaagactggctctccaggaagcggacgcgcgaaagagccagtagagcttccacttgggaaggacggcggagattgaatacacagacactctag

SEQ ID NO: 125861 - DNA, 630 bp, Artificial Sequence
  Description of Artificial Sequence: Synthetic coding sequence
atgtcttcaacactgcctgctctcttatgtgtggggctctgtctttcccaacgaatatctgcgcagcagcaaatgtacgatacgccgactctttcagtacatccgggtcctgaggtcatatccggagagaaagtgacattttactgcaggctagatacagcaacttccatgtttctgctgctgaaagaaggacgctctagtcacgtgcagcgcgggtatggaaaagtacaggccgagttcccattgggccctgtaacaacagcccatcgcggcacctaccgctgctttggctcttataacaatcacgcatggagtttcccctccgaacctgtaaagctcttagtgacaggcgatatcgagaacacatcactcgccccagaggatcctacgttccccgcagacacatggggcacgtacctcctgacaacagaaacaggtctccagaaggaccacgccctgtgggatcacaccgcacaaaacctgctgcggatgggcctggctttcttggtgctcgtggctctcgtgtggttcctggtggaagactggctctcaaggaagagaacccgcgaacgggcatctagagctagtacctgggaagggcggcgcagactgaacactcagactctgtag

SEQ ID NO: 125862 - DNA, 594 bp, Artificial Sequence
  Description of Artificial Sequence: Synthetic coding sequence
atgtcctccacattgcctgccctcctctgtgttgaaatgtatgacacccccactctatccgtgcatcctggccccgaggttatatccggcgagaaggtgaccttttactgtaggctggataccgccacctcaatgtttttactgctaaaggagggaagaagctcccatgtccaaagaggatatgggaaggtccaggccgagtttcctctgggaccagttaccacagctcatagagggacatacaggtgttttggaagctacaataaccatgcttggagttttcctagcgagccagttaagctgcttgtcaccggagatatagaaaatacctccctggcacccgaagacccaacttttccagccgatacttggggaacttatctcctcactaccgagacgggacttcaaaaggaccacgctctatgggatcatacggcgcagaacctgctgagaatgggccttgctttccttgttctcgtcgcgctggtctggttcctggtggaagactggttgagtcgtaaaaggactagggaacgagctagcagagctagcacctgggaggggagaagacgactgaacacccagactttatag

SEQ ID NO: 125863 - DNA, 912 bp, Artificial Sequence
  Description of Artificial Sequence: Synthetic coding sequence
atgagcagcacattgccagccctgctgtgcgtagggttgtgtctttcccaaaggatctctgcacaacagcagactctgcccaagccctttatctgggcagaacctcactttatggtgcccaaagaaaagcaggtgacaatatgctgccagggcaactatggagccgtggagtatcaacttcacttcgaaggaagtctgtttgccgtggacagaccaaaaccccccgagagaatcaacaaggtgaagttctacatccctgacatgaacagtagaatggcaggccaatacagctgcatctatcgggtgggcgaattgtggtctgaaccaagtaatctgttggatctggtggttacagaaatgtacgacacaccgacactgtcggtgcaccctggacccgaggttataagcggagagaaggttaccttctattgccgactggacaccgctacgagtatgtttctgctgctgaaagagggccgctcatcgcacgtccagcggggctatggaaaggtgcaagcagagttcccactaggcccggtgacaaccgcccacagggggacttacagatgttttggcagctacaacaatcacgcttggtcttttccttctgaaccggtaaagctgctcgtgactggcgacatcgagaacacgagtttagcgccagaggatccgacatttccggacacttggggcacctacctgttgacgaccgagactggacttcaaaaggatcatgcactctgggaccataccgcccagaaccttctgcgcatgggcctggctttcctggttctggtggcacttgtgtggtttctagtagaagattggctttcacgtaagcgcacacgtgaaagggctagtagagcatcaacctgggagggcagaaggcggcttaacacgcagacactctag

SEQ ID NO: 125864 - DNA, 777 bp, Artificial Sequence
  Description of Artificial Sequence: Synthetic coding sequence
atggcttggagggccctccaccctttactactgctgctcctcctgtttccgggcagccaggcacagtccaaggcccaagtgctgcaatccgtcgcgggacagaccctcaccgtacggtgtcagtatcctcccaccgggagtctttatgaaaaaaaagggtggtgcaaggaagcctccgccctggtctgtataagacttgttaccagctcgaagccacggactatggcatggacatcccgctttactatctgggacgacccggatgctgggttcttcactgtcacaatgaccgacctcagagaagaagattcggggcattattggtgtcgtatttacagaccctccgataacagcgtaagtaaatctgtgcgattctacttagtagtgtccccagcctcagctagcacccagacgagttggacaccgagagatttggtgagctcccagacccagacccagtcctgtgtgcccccaactgccggcgctcggcaggcccccgagagtccgagcaccattcctgtcccttcccagccccagaactctacactgaggcccggccctgcagccccaattgcgctggtgcctgtattttgcggcctcctcgtcgccaaatccctggtgctgagcgctctcctagtgtggtgggtgctccggaacagacacatgcaacaccagggcaggtccctccttcaccccgctcagcccagacctcaggctcataggcattttcctctgagtcatagagcgccaggcggaacctacgggggaaagccttag

SEQ ID NO: 125865 - DNA, 813 bp, Artificial Sequence
  Description of Artificial Sequence: Synthetic coding sequence
atggcctggagggccctccacccactgcttttgctgttactgctctttcctggaagtcaagctcagtctaaggcgcaagttctgcaatccgtggccgggcagactttaactgtgcggtgccagtaccctcctaccggttccctctatgagaagaagggctggtgtaaggaagcttctgccctggtgtgcattcggttagttacatcatctaagccacggactatggcctggacctcgcggttcactatctgggacgatccagacgccggattctttacagtcaccatgaccgacctgagagaggaagactccggccactattggtgccggatctacaggccatctgacaactctgtatccaagtcggtgaggttttacctcgtagtctcacccgcctctgctagtacgcaaacctcatggaccccacgagacctggtatcgtcacagacacaaactcagagctgcgtgccccctaccgccggagctcggcaagcacctgaatccccttccacaattcctgtaccttctcatccttccagtccgctacccgtgcccctgccatcccgcccccagaactccacactccgccccggccccgccgcgcccattgcattggtgccagtcttctgcggactcttggtggccaagagtttggtactgagtgctctgctggtctggtgggtcctgcgcaaccgacatatgcagcatcagggcagatcactactgcatccagcacaaccaaggccccaggcacacagacacttcccactctcacaccgggcacctggcggaacttacggcggaaagccgtag

SEQ ID NO: 125866 - DNA, 831 bp, Artificial Sequence
  Description of Artificial Sequence: Synthetic coding sequence
atggcatggagggccctgcacccactgctcctgcttttgctgctattccctggatcacaggctcagtctaaggcacaagtgctccagagcgtcgcaggtcaaacactgactgtgaggtgtcagtatccccctaccggcagcctgtatgagaaaaagggttggtgcaaggaggccagtgccttagtgtgtattcgcctggtcacctcctctaaaccccgaacaatggcatggacatcgcggttcacgatctgggatgacccagacgctggctttttcacagtcactatgacagatctgagagaagaagactcaggccactactggtgtagaatttatagaccctcagacaacagtgttagcaaaagcgtccgcttttatctggtcgtgagccctgccagcgcgagtacgcaaacaagctggaccccccgcgacctcgtttcgtcacagactcagacacaatcatgtgtaccacctaccgcaggcgccaggcaggccccggagtcccctagcactattccggtgccgagtcagccgcagaacagcacgcttagacccgggcctgccgcccccattgcgctggttccggtgttttgcggcctcctcgttgcaaagagccttgttttgtcagctctgctcgtttggtggggagacatttggtggaagaccatgatggagcttcgttccttagacacacagaaagctacttgtcatcttcagcaggtgaccgatcttccatggacctccgtgtcatcccctgtggaaagggagattctgtaccacactgtggctaggaccaagatatctgatgacgatgatgagcacaccctgtag

SEQ ID NO: 125867 - DNA, 606 bp, Artificial Sequence
  Description of Artificial Sequence: Synthetic coding sequence
atggcctggatgctcctgctgatcctcattatggtgcaccccggttcctgcgcactatgggtgtcgcagcccccagagatccggacgcttgagggtagcagcgcttttctcccttgttcttttaacgcttcccaaggcagactcgccattggatcggtaacgtggtttagagatgaggtggtccctggcaaagaagtgagaaatggaacgccagaattccgcggccgccttgcaccgctcgctagttcgcggttcttgcacgaccaccaggccgagcttcacatccgtgacgttcgggggcacgacgcctcaatttatgtctgcagggtggaggtgctgggcctcggcgtgggtaccggtaacggcactagactcgtagtggagaaggagcacccccagttgggcgctggaaccgtgctcctcttaagagccggattttacgctgtgtcctttttgtcggtcgccgtggggtccactgtttactaccaggggaagtgtctgacatggaaagggcccagacggcagctgcctgcagtcgttcccgcgcccctgccccccccctgcggtagcagcgcccacctgctccctcccgtccccggcgggtag

SEQ ID NO: 125868 - DNA, 498 bp, Artificial Sequence
  Description of Artificial Sequence: Synthetic coding sequence
atggcctggatgcttctgctaatcttgatcatggtgcaccccgggtcctgcgctctgtgggtcagccagccccctgagatccgcactctggaggggtcctcagcgttcttaccttgtagtttcaatgcgtcccaaggtcgccttgccattggcagcgtgacatggttccgagatgaggtggttccgggcaaagaggcagagttacacatccgagatgtgcggggtcatgacgctagcatctacgtgtgcagagtcgaagtgctgggcctgggtgttggcacaggcaatggaacacgcctagttgtggagaaagaacacccccagctcggagcaggtaccgtgctcttgctgcgcgctggattttacgcagtgtcatttctctccgtggctgtcggaagtaccgtctactaccaggggaagtgtcattgccacatgggaactcactgccatagttctgacggcccacggggcgtcatccccgagccccggtgcccttag

SEQ ID NO: 125869 - DNA, 573 bp, Artificial Sequence
  Description of Artificial Sequence: Synthetic coding sequence
atggcatggatgctgttactgattctgataatggtgcaccctggctcctgtgccctctgggtgtctcagccccccgagatccggaccctggaaggcagcagtgcgttcctgccctgttcgtttaatgcctcacaaggacgcctggctatcgggtcagttacttggtttcgggacgaggtggtgcccggcaaagaggttaggaatggaacacccgaatttaggggtcgattggctcccctcgcaagcagcagattcctccatgaccaccaggctgagctgcatatcagagatgttcgcggacacgacgcatctatttatgtatgtcgcgtggaagtactggggctcggcgtgggaaccggcaacgggacacgcttggtggtcgagaaagagcacccacagctgggtgcggggacagttctgttgctcagagcaggcttctacgccgtcagttttctgagcgtggccgtcggatctacagtgtactaccaaggcaaatgtcactgccacatggggacacattgtcactcctccgacggtcccagaggggtaatccccgaaccaagatgcccttag

SEQ ID NO: 125870 - DNA, 534 bp, Artificial Sequence
  Description of Artificial Sequence: Synthetic coding sequence
atggcctggatgctgctcctgatccttataatggtccaccctgggagttgtgccctgtgggttagtcagcccccagaaatacgcactctggaaggcagtagcgcgtttctgccctgttcttttaatgcttcccaggggagattagctatcgggagtgtaacttggtttagggatgaagtggttcctgggaaagaggtgcggaatggcactcccgagttccgagggcgccttgccccgctggcttcttctagatttctgcatgatcaccaggctgaactacatattcgtgacgtgaggggccatgatgccagtatctatgtgtgtagggtcgaagtgttgggcctgggagtgggtacaggcaacgggacgcgccttgtcgttgagaaggaacatccgcagcttggggcaggtactgtcctgcttctccgggcaggtttctacgcggtgtcttttttgagtgtcgcagtcgggtccacagtctattatcagggaaagtatgctaaaagtactctttctggcttccctcaactctag

SEQ ID NO: 125871 - DNA, 573 bp, Artificial Sequence
  Description of Artificial Sequence: Synthetic coding sequence
atggcatggatgctgctgcttatcctaataatggtgcaccctggctcttgcgctctctgggtgtcacaacctcctgaaataagaaccctggagggcagctcagccttccttccctgctcctttaatgctagccagggacgcttggcgattggcagtgtgacctggtttcgcgacgaagtcgtgccagggaaggaggttcgcaacggcacaccggagtttcgtggccggctggcccccttggcttctagcagattcttgcacgatcaccaggccgaactgcacataagagatgtgcgtggccatgatgcatccatctacgtttgcagggtggaggtgctgggcctgggcgtgggtacaggaaacggaacccgcctggttgtggaaaaagaacaccctcaactcggcgctgggacagtcctgctactaagggcaggcttttacgcggtgtcctttttgagcgtggccgttggtagtaccgtttactatcagggcaaatgtcattgtcacatgggcacccactgccattcttccgacggcccgcgcggcgtaataccggagccacgctgtccctag

SEQ ID NO: 125872 - DNA, 606 bp, Artificial Sequence
  Description of Artificial Sequence: Synthetic coding sequence
atggcctggatgctgctgctgatcctgattatggtgcatcccggcagctgcgccctctgggtgtcacagccaccagaaatcagaacactggagggaagttccgcctttctgccttgtagctttaatgcttcacaggggcgtctggctatcgggagcgttacctggttccgagacgaagtggtgcccggcaaagaggttcgaaacggaacacccgaattcaggggcagactcgcccccctcgcctcctctcgcttcctgcatgatcaccaagctgagctacacattcgcgatgtcagggggcatgatgcatctatctacgtttgtagagtcgaagttctgggactaggtgttggcacaggaaacgggacccgactcgttgtggagaaggaacacccgcaactgggcgcaggcactgtgctgctccttagggccgggttttatgccgtaagctttctcagcgtggccgtgggatcgacagtgtattaccaggggaagtgccttacttggaagggaccgcggaggcaattaccagccgtggtccccgcgccacttccaccaccctgcggcagcagtgcgcacttgctgcctccggtgcccggtgggtag

SEQ ID NO: 125873 - DNA, 534 bp, Artificial Sequence
  Description of Artificial Sequence: Synthetic coding sequence
atggcgtggatgctactgctcatcctgattatggtgcaccccgggtcttgtgccctgtgggtatctcagccacccgagatcaggactctggaaggctcctctgcttttcttccatgcagtttcaacgcctcccaagggcgactagcaattggctccgttacctggttccgcgacgaagtggtgccggggaaagaagtgcggaacggaactcctgagttcagaggacggctggcacccctggcctcaagccgatttctgcatgatcaccaggccgaactgcacatcagagatgtacgggggcacgatgcatcaatttacgtgtgccgtgtggaagtgctcggattgggggtcggaactggaaacggtactaggttggtggtggaaaaagaacacccccagctcggcgccggaaccgtcctgctgcttagagcagggttctacgcggtttcctttttgagtgtggctgtaggatctaccgtctactaccagggcaaatatgctaagtccaccctgtctggctttccccaattatag

SEQ ID NO: 125874 - DNA, 498 bp, Artificial Sequence
  Description of Artificial Sequence: Synthetic coding sequence
atggcctggatgctgcttctgatcctgatcatggtgcatcctggttcctgcgcgctgtgggtgtcacaacccccagagatcagaaccctcgagggttcaagcgccttcctcccgtgctcattcaacgcgtcccagggaagactcgctattggatccgtcacctggtttcgcgacgaagttgtgcctggcaaggaagctgagctgcatattcgtgacgtccggggccatgacgccagcatttacgtgtgcagagtcgaggttctcggattgggtgtgggaactgggaatggtacaaggctggtggtggagaaagagcatcctcagctgggggccgggacagtcctgctgctgagagcaggcttctacgccgtctcttttttgagtgtggcagttggatccactgtgtactaccagggcaagtgccactgtcacatgggaactcattgtcactcctcagacggaccaagaggagtaatccccgagccgcggtgtccgtag

SEQ ID NO: 125875 - DNA, 573 bp, Artificial Sequence
  Description of Artificial Sequence: Synthetic coding sequence
atggcttggatgctgcttttgatccttatcatggtacaccctggcagttgtgcactgtgggttagccagcctcccgagattcgcacactggaggggtcctcagcctttcttccctgctcctttaacgcatcgcagggtcgcctagccataggatccgttacgtggtttcgcgacgaagttgtgcctggcaaagaggtgcggaatggaactcctgagtttcgcggcagactggcccccctagcttccagccgattcttgcacgatcaccaagccgagctgcatatacgcgacgtcagaggccatgatgctagcatttacgtgtgtagggtggaggttctgggactgggagtcggaactggcaatggaacccgcctggttgtggagaaagaacaccctcaattgggtgccgggaccgtgctgttactgcgcgccggattttacgcagtgtccttcctctcggttgcggttggttctaccgtgtattaccagggaaaatgtcattgccatatgggaacccactgtcactcttcagacgggcctaggggcgtgatcccagagcctcggtgtccgtag

SEQ ID NO: 125876 - DNA, 606 bp, Artificial Sequence
  Description of Artificial Sequence: Synthetic coding sequence
atggcatggatgctgcttctgattcttatcatggtgcaccctggctcgtgcgccctgtgggtgtcccagccacccgagataaggacactggaaggatcctccgcattcctcccgtgcagtttcaacgcctctcagggtagactggcaatagggtcagtcacctggttccgggatgaggtagttcctggcaaggaggttcgtaatggcactcccgagttcaggggacgactggctccactcgcaagtagcaggtttctacacgatcatcaggccgagctccacatccgggacgttcggggccatgacgcctccatatatgtgtgtcgagtggaggtgctcggcttgggggtgggaaccggcaatggtacaagactggttgttgagaaggagcacccccaacttggtgcaggcactgtcttgttgctgcgagccgggttttatgctgtctccttcctcagtgtggccgtcggaagcactgtttactaccagggtaagtgtctgacctggaagggcccaagacgacagctgcctgctgtggtgccagcaccactgcctcccccctgtgggagtagcgcccatttgctgcctcctgtccctgggggctag

SEQ ID NO: 125877 - DNA, 573 bp, Artificial Sequence
  Description of Artificial Sequence: Synthetic coding sequence
atggcctggatgctgctactgattctaataatggtgcacccaggtagctgcgcactatgggtgagtcaacctccagaaatcagaacattagaaggatccagtgcttttcttccatgctcgtttaacgccagccagggtcgactggcaatcggcagtgtaacatggttccgcgatgaagtggtccccgggaaggaagtacgcaatggtacaccggaattcagaggccgactggctccactggcaagttccaggtttttacacgaccaccaggcggagctgcacatccgggatgtgaggggccacgatgccagcatctatgtctgtagagtcgaagtgttggggctgggagttgggactggcaatggcactcgtctcgtcgtggagaaagagcaccctcagcttggtgctggcaccgtgctcctcttacgcgctggattctacgccgtgtctttcctctctgtggcagtcggctcaacggtctattaccagggcaagtgccattgccacatggggacgcattgccacagttcggatggtccgagaggcgtgatacctgaacccagatgcccttag

SEQ ID NO: 125878 - DNA, 498 bp, Artificial Sequence
  Description of Artificial Sequence: Synthetic coding sequence
atggcatggatgctgctgcttattctgatcatggtgcatccaggatcttgcgcactgtgggtatcccagccaccggagattcgaactctggaaggctcttctgctttcctgccatgctcattcaacgcctcgcagggtaggttggcaatcggatcggtgacttggttcagggatgaagtcgtgccagggaaagaagctgaactgcatattcgggatgtccggggtcacgatgcctctatttacgtctgtcgggtcgaagttcttggactcggcgtcggaacaggtaacggtactcggctggttgtcgagaaagaacatccccagctcggcgctggtactgttctgctgctgcgagcaggcttctatgccgtgagcttcctctccgttgcggtaggatccacagtttactaccagggaaaatgtcactgtcacatgggcacccactgccactccagtgacggccccagaggcgttattccggagccacggtgtccttag

SEQ ID NO: 125879 - DNA, 498 bp, Artificial Sequence
  Description of Artificial Sequence: Synthetic coding sequence
atggcttggatgcttctccttatcctgatcatggtccatccaggctcgtgtgccctatgggtgtcacaacccccggagatcaggacacttgagggctcttctgccttcttgccctgttcttttaatgcctcccagggaagattggctattggctcagtcacctggttccgggacgaggtagtgccagggaaagaggccgaactgcatatacgcgacgtcaggggccatgatgcttcaatatatgtgtgcagagttgaggtactgggtctgggtgttggcaccggcaacgggaccagactggtagttgagaaggagcatccacagctgggcgccggtactgtgttgttactgagggcgggattttacgccgtctccttcctaagcgtagcagttgggagtactgtctattatcagggcaagtgtcactgccatatggggacccattgccacagcagcgatggtcctagaggagtgatccccgagcccagatgcccttag

SEQ ID NO: 125880 - DNA, 498 bp, Artificial Sequence
  Description of Artificial Sequence: Synthetic coding sequence
atggcgtggatgcttttgctcattctgattatggtgcatcctgggtcctgtgcactgtgggtcagccagcctcctgaaattcggacactggagggcagttcagcgtttctgccgtgtagtttcaatgcctctcaagggaggctagcaatcgggtccgtcacatggttccgtgacgaggtggtacccggcaaagaggctgaactccacatccgagacgtgcggggccatgacgcatccatatacgtttgtcgcgtggaggtgctaggtttgggggtgggcacaggcaacggaactaggttggtagtagagaaggagcacccacagctgggggccgggaccgtcctcctgctgcgtgctggtttctatgcagtgtcgtttttaagcgtggcggttggctccaccgtctactatcagggaaagtgccactgccacatggggacacactgtcatagttcggacgggcccaggggggtgatcccagaaccacgctgcccttag

SEQ ID NO: 125881 - DNA, 606 bp, Artificial Sequence
  Description of Artificial Sequence: Synthetic coding sequence
atggcttggatgctcttactgattctcataatggtacatcccggttcctgtgccctgtgggtgtcccaaccacctgaaatcagaactctggagggcagtagtgccttcctaccgtgctcctttaacgctagccagggccgacttgccattggaagcgtgacctggttccgcgacgaagtggtcccgggcaaagaagtgaggaacggcaccccagaatttaggggcagacttgctcccctggccagctcaagattcttgcatgaccatcaggccgagttacatatcagggatgtccgaggtcatgacgccagcatttatgtctgtcgcgtcgaagttctcggacttggtgtcggaaccgggaatggcactcgtttggtcgtggaaaaagagcacccccagctgggcgccgggacggtgttactcctccgggctggattttatgccgtgagctttctcagtgtggcagtggggtcaacggtgtactaccagggaaagtgcctgacctggaaagggccgcgaagacagctgccggccgtggttcccgctcctctgcctcctccatgcggatcaagtgcacacctgctcccacctgttcctggcgggtag

SEQ ID NO: 125882 - DNA, 606 bp, Artificial Sequence
  Description of Artificial Sequence: Synthetic coding sequence
atggcttggatgttgttgctcatcctgattatggtgcaccctggctcgtgtgctctctgggtgtcccagccaccagagatacgcacactcgaaggttcatccgccttcctgccctgcagcttcaatgcttcccagggtcggctggcaatcgggtcagtcacctggtttagggatgaggtagtcccggggaaagaagttcggaacggcacacccgagttcaggggcaggctcgccccactagccagctccagatttctgcacgatcatcaagctgagctgcatattagagatgttaggggacacgacgcctccatctatgtgtgtagggtggaggtgctgggcttaggtgtcggtacgggaaatggcacccgtttagtggtggagaaagaacacccccagctgggcgcgggaacagtcttgctgctgagggcaggcttctacgccgtgagtttcctgtcggtggccgtggggagcactgtgtactaccagggaaagtgcctgacgtggaagggcccgcgtcggcaactgcccgcggtagttccagcccccttgcctcccccctgtggatcgagcgctcacctcctgcccccagtgcctggaggttag

SEQ ID NO: 125883 - DNA, 534 bp, Artificial Sequence
  Description of Artificial Sequence: Synthetic coding sequence
atggcgtggatgctcctcctgatacttatcatggttcatcctggcagttgcgcactgtgggttagtcagccacctgagatccggaccctcgagggctcttccgcctttctgccttgttcgtttaatgctagccaagggcgattagccatcggttcagtcacgtggtttagagatgaggtggtacccggaaaagaagtgcggaatgggacaccagagtttcgcggcaggttggcccccctggcgtcttccaggtttttgcatgatcaccaggcagagctgcacattagggacgtacgaggtcacgacgcatctatatatgtctgtagggtggaggtcctgggtttaggggtgggcaccggtaatggcaccagactcgtggtggagaaggagcaccctcagcttggagcagggaccgtgctactgctccgcgcaggcttttacgccgtgtcgttcctatccgtggctgtgggctctaccgtatattatcaaggcaagtacgctaagtccacactctcaggcttcccccagctctag

SEQ ID NO: 125884 - DNA, 534 bp, Artificial Sequence
  Description of Artificial Sequence: Synthetic coding sequence
atggcctggatgctcctgctgatactcatcatggtgcatcctggttcttgcgccctatgggtgagccagcccccagagatcagaaccctggagggctcctccgccttcctgccttgttcgtttaatgcctctcaagggcgtcttgctatcggatctgtgacctggttccgggacgaagttgtgccgggtaaagaggtgagaaacggcacccctgagttcagggggagactagctcccctcgcctcctctagatttcttcacgaccatcaggcagagctccacattagggacgtgcgaggacacgacgcttctatctacgtgtgccgagtggaggtcctgggactcggcgttggtacaggaaacggtaccaggctcgtggtcgaaaaagagcaccctcagctcggagccggcacagtcctcttgctgagggccggcttctacgcagtcagctttttaagcgtggccgtgggatctactgtgtactaccaggggaagtatgccaagtctaccttatctggattcccccagctctag

SEQ ID NO: 125885 - DNA, 606 bp, Artificial Sequence
  Description of Artificial Sequence: Synthetic coding sequence
atggcttggatgctgctgctgatactcattatggttcatcctggatcctgcgccctatgggtgtctcagccccctgagattcggacattagaaggatcttccgcctttttgccctgcagctttaacgcatcccagggccggcttgctatagggtccgtgacttggttccgcgacgaggtggttcccggaaaagaggttcgcaacggcacacctgagttccgcggacggctcgcccctctcgctagctcaagattccttcatgatcatcaggcagaactccatatacgagacgtccgggggcatgacgcctcaatctacgtgtgcagagtggaggtgcttggcctgggggtcggcaccggcaatgggactcgtctggtggttgaaaaggaacatccacaactgggcgcaggcacagtcttgcttttgcgcgccgggttctacgccgtgagttttctcagcgtggccgtcggtagtactgtctactatcagggcaagtgcctcacttggaagggccctcggagacagttgcccgctgtggtgcccgcccccctcccaccgccgtgtgggtccagcgctcatcttcttcctcccgttccagggggctag

SEQ ID NO: 125886 - DNA, 534 bp, Artificial Sequence
  Description of Artificial Sequence: Synthetic coding sequence
atggcttggatgcttcttctgattcttattatggtgcatccgggaagttgcgccttgtgggtatctcagccacctgaaattaggaccctggagggaagctctgcatttcttccttgttctttcaatgcctcccagggccggctggcaattggtagcgtgacttggtttagagatgaggtcgtaccaggcaaggaagtgaggaatgggacccctgagttccgcggtcgcctggcccccctagccagttctcgttttctccatgatcatcaggccgagctgcatataagagatgtgcgcggacatgacgcctccatctatgtatgtcgggtcgaagtccttgggctaggagtcggtacggggaatgggactcgattagtggtggaaaaagaacacccccagttgggcgccggcaccgttctgctgttacgggccggattttatgctgtctcttttctgagcgtggcagtgggaagtactgtgtactatcaaggcaagtacgccaaaagcacactgtccgggttccctcagctgtag

SEQ ID NO: 125887 - DNA, 573 bp, Artificial Sequence
  Description of Artificial Sequence: Synthetic coding sequence
atggcctggatgttgctacttatcttaattatggtgcatcccggctcatgtgcactgtgggtctcccagccccctgaaattagaacactggagggcagctccgcatttcttccatgctcatttaatgccagtcagggaagactcgccatcgggtcggtcacgtggttccgggatgaggtggtcccaggaaaggaggtacgcaacgggacacccgagtttagagggcgcttggccccccttgcctcttctcggtttctgcatgaccatcaggctgaactgcacatccgcgatgtgaggggccatgatgcctctatttacgtatgcagggtggaagttttagggttaggggtgggaaccgggaacggaacaaggttggttgtagagaaggaacacccccaactgggcgccggtactgtgctgctgttgagggcaggtttttatgctgtgtcctttctgtctgtggcggttggatctacagtctattaccagggaaagtgccattgccacatggggacccattgtcacagctcagatgggccacggggggttatccctgagccgcggtgcccatag

SEQ ID NO: 125888 - DNA, 606 bp, Artificial Sequence
  Description of Artificial Sequence: Synthetic coding sequence
atggcctggatgcttctcctgatcctgattatggtgcaccctggaagctgtgccctttgggttagccagcctcccgaaatacgaacccttgagggctcctccgcttttctgccttgctcatttaatgcttctcaaggaaggctggccatcgggtccgttacatggttccgtgacgaagtggtccctggtaaggaggtgcgtaatggaactcccgagttcagggggaggctggcccccctcgctagcagtagattcttgcacgaccaccaggccgagctgcacattcgggacgttagggggcacgatgcttccatttacgtgtgtcgggtagaagttctcggcctgggcgtcggcaccggtaatgggacaaggttagtagtagagaaagaacatccacaacttggtgccgggacagttttgcttctgagggccggattctatgccgtaagtttcctgtctgtcgctgtcggcagcaccgtgtactaccaaggcaagtgcctgacctggaagggcccgaggcggcagctgcccgccgtggtccccgccccattgcccccaccctgtggttcttctgctcatctcctgcccccggtccccgggggatag

SEQ ID NO: 125889 - DNA, 498 bp, Artificial Sequence
  Description of Artificial Sequence: Synthetic coding sequence
atggcctggatgttattattaatcttaattatggtccaccccggctcatgcgcgttatgggtttctcaaccgcccgagatccgcaccctggaggggagcagcgcattcctgccgtgcagcttcaacgcctcacagggaaggttggccattggatccgttacatggtttagagatgaagtcgtccctgggaaagaggccgaactccacatacgtgacgtcagaggccacgatgcatcaatttacgtgtgccgcgtggaagtgctggggctgggggtcgggacgggtaacggtactaggctggttgttgagaaggaacacccccaacttggagccgggacagtgcttcttctcagagcagggttctatgccgtgtcatttcttagcgtggctgtgggtagtaccgtctactatcaggggaaatgccactgtcacatggggacccactgccattcctccgacggaccaagaggcgtgatccctgagcctagatgtccttag

SEQ ID NO: 125890 - DNA, 534 bp, Artificial Sequence
  Description of Artificial Sequence: Synthetic coding sequence
atggcctggatgttattattgatcctgattatggtccaccccgggtcttgcgctctctgggtgtcccagccaccggagattaggaccctggaaggatcctccgccttcctgccctgcagcttcaatgccagtcagggacggctcgccataggctcagtaacttggttcagggacgaagtggtaccgggcaaagaggtgcgtaacggcacccctgaatttcgggggcggcttgcacctctcgccagctccagattccttcatgaccatcaggcggagctgcatattagagacgtcaggggtcacgatgcttcgatctacgtgtgtcgggtggaagtcttgggcttgggcgtaggaacgggcaacggtacccggttggtcgtcgagaaagagcaccctcagctcggcgccggtacagtcctgctgctgcgcgcgggcttttatgcagtgtcattcctttccgtggcagttgggagcacagtttactatcagggcaagtacgccaaatccacactgagcggatttccgcagctgtag

SEQ ID NO: 125891 - DNA, 573 bp, Artificial Sequence
  Description of Artificial Sequence: Synthetic coding sequence
atggcttggatgctgctgctgattctgataatggtgcacccaggttcttgtgccttgtgggttagccagccaccggaaatccgcaccctggagggttcctcggctttccttccatgtagcttcaatgcttcccaagggcggctggctattggctccgtaacgtggttccgcgacgaggtggtccccggtaaggaagtgcggaatggaactcccgagttccggggtagactcgcgcccctagcttcctctcgattccttcacgatcatcaagctgaattgcacataagggatgtgaggggtcatgacgcctctatttacgtgtgtagagtggaggtgctgggactcggagttggcacaggaaacggcactcgactggtggtcgagaaggagcatcctcagctgggggctggcaccgtgctactcctacgagcgggattctacgcggtaagcttcctttctgttgcggttggatccactgtctactatcaggggaagtgtcactgtcatatgggcacccactgtcacagttccgatggaccgcggggagtcatacccgagccacggtgtccatag

SEQ ID NO: 125892 - DNA, 534 bp, Artificial Sequence
  Description of Artificial Sequence: Synthetic coding sequence
atggcgtggatgctcctgctgatactcatcatggtccatccaggtagttgcgccctgtgggtatcacaacccccagagattagaaccctcgagggatcctctgcctttctcccttgctccttcaatgcttctcaaggcagactcgccatcggaagtgttacttggtttcgcgatgaggtggtacccggcaaggaagtgaggaacggcacgccagaatttagaggacgacttgctccacttgcaagctctcggtttttgcacgaccatcaggccgagttacacatcagggacgtccggggacacgacgcttcaatctacgtgtgcagggtggaggtgctgggccttggcgtgggtaccgggaacggcacgcgactggtggtcgaaaaggagcacccccagctcggggccggcacagtcctcctgctgcgcgcagggttttacgcagtctctttcctctccgttgccgtggggtccactgtatactaccaagggaaatacgcaaaaagcacgctgtcgggtttcccgcagctatag

SEQ ID NO: 125893 - DNA, 606 bp, Artificial Sequence
  Description of Artificial Sequence: Synthetic coding sequence
atggcttggatgctactactgatcctgatcatggtccaccccggttcctgtgccctgtgggtctctcagccaccagagatcaggacactggagggttcgtccgcctttctaccttgcagtttcaacgcttcgcaagggcgactggctatcggctctgtgacctggttccgtgacgaagtggttcctggaaaggaagtgcggaacggaaccccagagttccggggcagactcgctcccctcgctagtagccggttcctgcacgaccatcaagcagagctgcacatccgcgatgtccggggtcatgacgcttctatttatgtctgcagggtcgaagtgctaggactgggcgtagggaccgggaatggaaccaggttggtggttgaaaaagagcaccctcagctgggagctgggactgtcttgctcctgcgggccggcttctatgcggtgagctttctcagcgtggccgtgggtagcaccgtctactatcaaggaaagtgtctcacatggaagggcccaaggcggcagctaccagcggtggtccctgcaccgttgcccccaccctgtggtagctctgcccacttgctccccccagtgccagggggttag

SEQ ID NO: 125894 - DNA, 573 bp, Artificial Sequence
  Description of Artificial Sequence: Synthetic coding sequence
atggcctggatgctgttgcttatcctcattatggtccaccccggcagttgcgctctctgggtgagccagccacctgagataaggaccctggagggcagctcagctttcctcccctgcagttttaacgcttcacaaggcagacttgccatcggatccgttacatggtttcgcgacgaagttgtgcctggcaaggaagtccgcaatggaactcccgagttcagaggccgactggctccattggcctcaagccgattcctccacgatcaccaggccgagctccatataagggatgtcagaggacacgatgcctcgatctacgtgtgccgcgtggaagtgctgggtctcggcgtggggaccgggaacggtacaaggctggtggtggaaaaggaacacccgcagctgggcgctggaacagtgttgctgctgcgggcaggattctatgctgtttcttttctgtctgtggccgttgggtctacagtatactaccaggggaaatgccactgtcacatgggaactcactgccacagctccgacggacctagaggtgtcattccagagccccggtgtccttag

SEQ ID NO: 125895 - DNA, 498 bp, Artificial Sequence
  Description of Artificial Sequence: Synthetic coding sequence
atggcctggatgctgctcttaatactcatcatggtgcacccaggcagttgtgccctgtgggtgtctcaaccccctgaaattcgaacactcgagggtagctcagcatttctgccttgttcttttaacgcaagtcaaggtcgacttgctattgggtccgttacctggtttagggatgaagtggtgccaggaaaagaggccgagcttcatatccgcgacgtgcggggccacgatgcctctatctacgtttgtagggtggaggtcctggggcttggggtcggcacaggcaacgggactcgacttgttgtggagaaagaacaccctcaacttggagcaggcacagtgttgctgttgagagctggattctatgccgtaagcttcttgtcggtcgccgtgggcagcacagtatactaccagggtaagtgtcactgtcatatgggcacccactgccattccagcgatggacccaggggagtgattccggaaccccgatgcccatag

SEQ ID NO: 125896 - DNA, 498 bp, Artificial Sequence
  Description of Artificial Sequence: Synthetic coding sequence
atggcatggatgctgttgctaatactcatcatggtacaccctggctcctgtgctctttgggtttcacagcccccagaaatccggacattggaggggtcctctgcttttcttccgtgctctttcaacgcaagccaggggcggctggccatcgggtctgtgacttggttccgcgacgaggtcgtgcccggtaaggaagcagagcttcacattagggatgtgcgcggtcatgacgcgtccatctatgtctgccgcgtagaggttcttggtctgggcgtcggcaccggcaacggcacccgccttgtcgtagaaaaagagcacccccaattgggagccgggaccgtcctactgctgcgcgctgggttttatgccgtgagttttctcagtgttgccgtcgggtcaactgtttactaccagggaaagtgccactgtcatatgggtacccattgccacagcagcgacggccccagaggtgtcattccagaaccacgttgtccttag

SEQ ID NO: 125897 - DNA, 534 bp, Artificial Sequence
  Description of Artificial Sequence: Synthetic coding sequence
atggcatggatgctgctcctcatcctcataatggtgcatccgggctcttgtgcattgtgggtcagccagccccccgaaatccgaactctggaaggcagttctgccttcctgccctgctcctttaatgcctcccagggccgcctggcaataggtagcgtaacatggtttcgagatgaagtggtgcctgggaaggaggtgcgtaacgggacccctgagttccgcggcagattggcaccattggctagctctagattcctacacgatcatcaggccgaactgcacatacgggacgttagaggacacgacgctagtatctatgtgtgtagggtggaagtgcttgggttgggagtggggacaggaaacgggacaaggttggtggtcgagaaggagcatccacagttgggcgccggaactgtcctcctcctccgcgctggtttctatgcggtcagttttttaagcgtggccgtcggctcaaccgtgtactatcagggcaaatatgcaaaatctacattgtccgggtttccacaactgtag

SEQ ID NO: 125898 - DNA, 573 bp, Artificial Sequence
  Description of Artificial Sequence: Synthetic coding sequence
atggcttggatgctgctgttaatcctgattatggtccacccagggtcctgcgcactttgggtgtcacaaccccccgagattcgaaccctagaaggcagttccgcgttccttccatgcagcttcaatgccagccagggacgccttgccatcggctctgtcacttggtttcgcgatgaggtggtccctggtaaggaggtacggaatgggaccccggaatttcggggacgactcgcccctctggcctcttccagatttctgcacgaccaccaggctgaactgcatattcgtgatgttcggggtcacgatgcatcaatttatgtgtgtagagttgaagttctcggccttggcgtgggtactggcaatgggactcgtctagtcgtggaaaaagaacacccgcaattaggagccggcacagtgcttttgttgagagctgggttctatgcggtgtccttcctgagcgtggccgtaggatctaccgtgtattaccaggggaagtgccactgtcacatgggaactcactgtcatagtagcgatgggcccaggggcgttattccagaaccccgatgcccctag

SEQ ID NO: 125899 - DNA, 486 bp, Artificial Sequence
  Description of Artificial Sequence: Synthetic coding sequence
atggatgacatctataaggccgcggtcgagcagcttacggaggaacagaagaatgagttcaaggctgcatttgatatcttcgtgcttggggccgaagacgggtgtatcagcacaaaagagcttgggaaagtaatgaggatgctcggacagaatccgacccccgaagagctgcaagaaatgatagatgaggtggacgaggacggaagcggtaccgttgatttcgatgagttcctggtaatgatggtccgctgcatgaaagacgattccaagggaaaaagcgaagaggaactgtccgatctattccgaatgttcgataaaaacgcggatggctacattgatctcgacgagctgaaaatcatgctacaagctaccggcgaaacgatcaccgaggacgacatcgaggaactgatgaaggatggcgacaagaataatgacggcaggattgactacgatgaattcttagaattcatgaagggagtcgaatag

SEQ ID NO: 125900 - DNA, 315 bp, Artificial Sequence
  Description of Artificial Sequence: Synthetic coding sequence
atgggggcccaagatcggccccaatgccacttcgacatcgagatcaacagggaaccagtcggacgaatcatgtttcagttattctctgatatctgccccaagacatgtaagaacttcttatgcctgtgctctggcgaaaagggtttgggcaaaactaccggtaagaaactgtgttacaagggcagtacgttccacagagtcgtgaagaactttatgatccaaggcggtgatttctcagaggggaacgggaaaggcggagagtccatctatggcggatatttcaaggagaatgtggtgttctgtaagatgaaatag

SEQ ID NO: 125901 - DNA, 2805 bp, Artificial Sequence
  Description of Artificial Sequence: Synthetic coding sequence
atggctgtccagccgaaagagactctgcagttagagagtgctgccgaggtcggcttcgtaaggttctttcaaggaatgcccgaaaaaccgactactaccgtgcgcttattcgaccgtggggacttttacactgcccacggagaggatgccctgctggccgctagggaagtattcaaaacacagggggtaattaaatatatgggaccagctggtgctaaaaacctccagtcagtagtgctctcaaagatgaatttcgagagtttcgtcaaagacctgttgctggtgcggcagtaccgagtggaagtatacaaaaaccgggccggcaataaagccagcaaggagaacgactggtacctcgcgtacaaggctagtccgggcaatctgtcacaattcgaagacattttgtttggcaacaacgatatgtccgcttcgataggcgtcgtcggcgttaagatgtctgcggtggatggccaaagacaggtaggcgtcggctacgtggattctatccaacggaagttaggcctgtgcgaattccccgataacgaccaatttagcaaccttgaagccctgctcatccagattggccctaaggaatgtgtgctccccgggggggagacagctggggacatgggcaagctcagacagataatccaacgtggcggcattctgattacagaacggaagaaggccgactttagtacaaaagacatctatcaggacttgaacaggcttttaaaaggtaagaaaggagaacagatgaactctgccgtactgccggaaatggaaaatcaagttgccgtttcttcgctgtctgccgtgatcaaatttctggaactgctgtccgatgactcaaactttggccagtttgagctgacgactttcgatttctctcagtatatgaaattggatatcgcggcggtccgagccctgaatctattccagggctcagtggaggacactactgggtctcagagtctggccgccctactcaacaagtgtaaaaccccccaggggcagcggcttgtgaaccagtggattaagcagcccctgatggacaagaatcgcattgaagagcggctcaatttggtcgaggcctttgtcgaagacgccgagctgcggcagacactgcaagaagatcttctgagacgattccctgatctcaatcggcttgccaagaagtttcaaaggcaggctgcgaacctccaggattgttaccggctgtaccaaggtattaatcagctacctaatgttatccaggctcttgaaaaacacgagggcaagcaccaaaagctgctgttggctgtgttcgtgaccccactaactgacctaagatccgatttttctaaatttcaggaaatgattgagactacattggacatggatcaagtggagaatcatgagttccttgtcaaacctagcttcgatcctaatttatccgagctgagagaaataatgaatgacctggaaaagaaaatgcagtccaccttaatttccgctgctcgtgatttaggactcgatccggggaagcagatcaaactcgattcttctgctcagtttggatactactttcgtgtaacctgtaaagaggaaaaggtcctgaggaacaacaaaaatttttccacggtggacatccagaaaaatggggtgaagttcaccaactctaaactgacctccctgaacgaggagtataccaagaataaaactgaatatgaagaggcacaggatgctatcgtcaaggagatcgtgaatatcagctcagggtacgtggaacccatgcagacgctaaacgatgtgctcgcacagttagacgcggtcgtctcctttgcgcacgtttctaacggagcacctgtgccttatgtgaggcccgccatactggagaaaggacagggtcgaatcatcctgaaagcaagtaggcacgcttgcgtagaggtgcaggacgaaatcgcattcatcccgaacgacgtgtacttcgagaaggacaaacagatgttccatattattaccgggccgaacatgggcggcaagtctacatatattcgtcaaactggagtgatagttcttatggcacagatcggttgctttgtcccttgcgagagcgcagaagtgagcatcgtggactgcatcttggctagagttggcgcaggcgatagtcagttgaagggagtttctacatttatggccgagatgctggagaccgcttccattctgcggtctgcgactaaagattctttgataattatagatgaactgggtcgcggaacatcaacttacgatggatttgggctcgcatgggccatcagtgagtacatagccacaaagattggcgctttctgcatgtttgcaacacactttcacgaacttacagcactggctaaccagataccaactgtgaacaacctgcacgtcaccgccctaacaacagaggaaaccctgaccatgctgtaccaggtgaaaaaaggagtgtgtgatcagagttttggaattcatgtcgccgagctggctaacttcccgaaacacgttatcgaatgtgccaaacagaaggccttggaacttgaggagttccagtatataggcgagtcccagggatacgacattatggaaccagccgcaaaaaagtgctatttggagagagagcagggagagaagattatacaggaattcctcagtaaagtaaagcaaatgccattcacagaaatgtcggaggagaatattacaatcaaactgaaacagcttaaggcggaggtgatcgcaaagaataactcctttgtgaatgagattatcagtaggatcaaagtaacaacgtag

SEQ ID NO: 125902 - DNA, 435 bp, Artificial Sequence
  Description of Artificial Sequence: Synthetic coding sequence
atgacagaggaagtaatcgtcattgccaagtgggattacaccgcccaacaggatcaggaactggatattaagaaaaacgagcgactgtggcttctcgacgactccaagacgtggtggagagtgcgaaacgcggccaatcgcacgggctacgtgccttccaactacgtggaacggaagaactccctaaagaagggatctctggttaaaaatttaaaggatactctggggctcggcaagacacgccggaaaacttcagcacgggatgcgagccccacaccctccaccgacgccgagtacccggccaatgggtctggagcagatcgtatctatgatctgaatatccccgctttcgtgaagttcgcctacgtggctgagcgggaagacgagttaagtttagtgaaggggtctcgggtcaccgtgatggagaaatgctag

SEQ ID NO: 125903 - DNA, 1143 bp, Artificial Sequence
  Description of Artificial Sequence: Synthetic coding sequence
atgactgaggaggtcatcgtgatcgcgaagtgggactacaccgcccagcaggatcaggaactcgatatcaaaaagaacgaaagattgtggctgctcgacgactctaagacctggtggagagtccggaacgccgcgaacagaactggatacgtgccatccaactacgtggagcgaaagaatagccttaaaaaaggatccctggttaaaaatctaaaggatactctgggattgggcaaaacccgtcgtaagacaagcgcacgggatgcgtcgccaactccaagtaccgacgcggagtatccagccaatggttcgggggcagataggatatacgacctcaatatcccggctttcgtgaaattcgcctatgtcgccgaaagagaggacgaactgagcctggtcaagggttcccgagtgaccgtgatggagaagtgcagcgacggctggtggcgtggctcctataatggtcagatcggctggttccctagcaactatgtcctcgaggaggtcgacgaagcggccgccgagagtccaagcttcttatctcttcggaagggggccagcctgtccaatgggcaggggtctcgcgtcctccacgttgtgcagaccctgtatcccttctcttctgtcaccgaggaagaactgaattttgaaaagggcgaaacaatggaagtgatagagaagccagagaacgaccctgagtggtggaagtgcaaaaacgcccgtggccaggtaggtctcgtccctaaaaactacgttgtggtgttgtctgatgggcccgccttgcacccggctcatgccccacagattagctatactgggccttcttcttctgggcggttcgctggacgggagtggtactatggtaacgtgactagacatcaggccgaatgcgctctgaatgagcgaggcgtggaaggtgatttcctgattcgggacagcgaatctagccctagtgacttttctgtgagtctcaaggcctccggcaaaaataagcactttaaagttcagctcgtggataatgtgtactgtatcggacaacgccgctttcataccatggacgaacttgtcgagcattacaagaaagcaccgatcttcaccagcgagcatggcgagaagctatacctagttagagctttgcagtag

SEQ ID NO: 125904 - DNA, 333 bp, Artificial Sequence
  Description of Artificial Sequence: Synthetic coding sequence
atgactgaggaggtaatagtaatcgctaaatgggactacaccgcgcagcaggatcaggaactggatatcaagaagaacgaacggttgtggttgctcgatgattctaaaacatggtggagagttcgcaatgcggctaatcggaccggatatgttccatcaaactacgtggaacgcaagaattctttgaagaagggttcccttgtcaaaaatctgaaggatacactggggctcggaaaaacccgaagaaagacatctgcgcgcgatgctagccctacaccgtccaccgacgcggagtatccagctaatggatctggtgccgaccgcatctattag

SEQ ID NO: 125905 - DNA, 252 bp, Artificial Sequence
  Description of Artificial Sequence: Synthetic coding sequence
atgactgaggaagtgattgtgatcgctaaatgggactacaccgcacagcaggaccaggagctggacatcaagaagaacgagcgcttatggctgcttgatgattctaagacctggtggcgcgttcgcaatgccgcaaatcgaactggctatgttccctcgaactacgtggaaagaaaaaactccttgaaaaaaggaagcttggtcaagaacctgaaagacaccctcgctcaacgcctgttgcgggtgccatag

SEQ ID NO: 125906 - DNA, 252 bp, Artificial Sequence
  Description of Artificial Sequence: Synthetic coding sequence
atgactgaggaggtgatcgttatagccaagtgggactacacagctcagcaggaccaggagcttgatataaagaaaaacgagagattatggctgcttgatgactccaaaacatggtggcgcgtccgaaacgccgccaatcgaacaggttacgttccatctaactacgtagagcggaagaattctttaaaaaaaggctcactcgtaaagaatctgaaggataccctggctcagcggttgctacgagtgccatag

SEQ ID NO: 125907 - DNA, 2169 bp, Artificial Sequence
  Description of Artificial Sequence: Synthetic coding sequence
atgtacagagccctttacgcgtttcggagcgcggagccaaacgccctggcttttgccgccggcgaaaccttcctggtactggaacggtcctccgcccactggtggctggccgctagggcccggagcggcgagaccggctacgtcccgccggcttacttacggagacttcaaggactcgaacaagatgtgctgcaggccattgaccgcgccattgaggcagtgcacaatacagcaatgagggacgggggaaaatactccctggagcaacgcggagtgttgcagaagttaattcaccaccggaaagaaaccctatcaagaagaggccctagcgcttcaagcgtcgctgtgatgacttcctcaacgagtgatcatcatctcgacgccgcagctgcacgtcaacccaacggagtctgccgcgcggggttcgaacggcaacactcgttgccatcctcagagcaccttggggcggacgggggtctttaccagatcccactgcctagctctcaaatcccaccccagcctcgacgagccgcccctaccactcctcccccccccgtcaaacggcgcgaccgagaggccctgatggcttctggttccggggggcataacacgatgccatctggcgggaacagtgtgagctctggtagtagtgtgtcctcgacaagtcttgacacactgtataccagtagttctccatccgaacccgggagcagctgctccccaactccccctcctgtgccccgcagggggacacataccactgtttcccaggttcagccacccccttccaaggcgtccgcgccggagcctcccgctgaagaagaggttgccaccgggacaaccagtgcttctgacgatcttgaagcgctggggacgctaagtctggggactacagaagaaaaagctgccgccgaagcagccgttccacgcactattggcgcggagctcatggaactcgtgcggcggaataccggccttagccacgaactgtgtagagtcgcaattggaatcatagtgggccatatccaggcgagcgtacccgcctctagtcctgttatggaacaggtgctgctttccctggtggaaggaaaggacttgagcatggccttgccctcaggacaggtctgtcacgatcagcaacgactagaggtgatttttgcggacctggcccgcagaaaagacgacgcacaacaacgcagttgggcgctctacgaagacgagggagttatccgctgctatctggaggagctgcttcatatcctgaccgacgccgacccagaggtgtgcaaaaagatgtgcaagcgcaatgagttcgagtccgtcctagcgctggtggcctattaccagatggagcatagggcatccctgaggctactactcctgaaatgtttcggggctatgtgcagtctagacgcagctataatctcaactctcgttagctcagtgctgccagtggaactggcacgggatatgcaaaccgatacacaggaccatcagaagctgtgctacagcgcgttgatcctcgcgatggtatttagtatgggcgaggctgtaccctacgcacattacgaacacttggggaccccctttgcccagttcctgctgaacattgtcgaagatggtctacccctggacaccacagagcagttacccgacttgtgtgtgaatctgctcctcgccctgaacttacacctgccggcggccgaccaaaatgtgataatggctgcgctttcgaaacacgcaaacgtgaagatcttcagtgagaagttactcttactcctgaacaggggtgacgatccagtccgtattttcaaacacgagcctcaacccccccacagtgttctcaagttccttcaggatgttttcggcagtcccgctaccgcagccatcttctaccatacggatatgatggccctgattgatatcacagtccgccacatcgccgacctcagcccaggagataagctgagaatggagtacctatctctcatgcacgcaatcgtccgcactacaccgtacctccagcacaggcacagattacctgatctgcaggcgatcctacggaggatcctcaatgaggaagagactagcccacagtgccagatggatcggatgatcgttagagaaatgtgcaaggaatttctggttttaggggaagctccaagttag

SEQ ID NO: 125908 - DNA, 2169 bp, Artificial Sequence
  Description of Artificial Sequence: Synthetic coding sequence
atgtatcgcgccttgtacgcttttcggtcagctgagccaaacgctctcgccttcgccgctggggagacgttcctggttctagagcgtagttcagcccattggtggctggcggctcgggcccgatctggagagacaggatatgtgccacctgcttacctgcgcagattgcagggtctggaacaggatgttctgcaggctatcgacagggccatcgaagcagtccacaataccgcaatgagagacgggggcaaatattcactggaacagcggggagtcctgcagaagctcattcaccatcgaaaagagacactcagcagaagagggcccagcgcctcttctgtggcggtcatgacaagcagtaccagcgaccatcacttagacgccgccgctgcccggcagcctaacggggtttgtcgggcagggttcgaacgacaacatagtctccccagctcagaacatctcggcgctgacggtggtttgtaccagattccactccccagttcacagattccgccccaaccccgccgggccgcccccacgaccccacccccacctgtgaagaggagggatcgcgaagctttgatggccagcggctccggcggacataatacaatgccgagcggcggtaattccgtgtcatccgggagctccgtttctagcacttcgctagacaccctctataccagcagttcaccctctgagccggggagttcctgttctcctacacctcctcccgttcctagacgaggcacccacactaccgttagccaagttcagccaccaccttcaaaggcgagtgcacctgagccaccagcagaggaggaggttgcgactggaaccacgtccgcctctgatgacctcgaggccctgggcaccctgtcactgggaaccacagaagagaaagccgccgcagaggccgctgtgcctcgtactataggcgcggagctcatggagctcgtccgccgcaacactggactgtcacatgagctgtgccgcgtggcgatcggcattatagtgggtcacatacaggcctcagttcccgcatcctccccagtgatggaacaggtgctattaagcctggtagaaggaaaagatctcagcatggctttaccgtcaggccaagtgtgtcatgaccaacagcgtctggaggtgatctttgctgatctggcacgccggaaagacgatgctcagcagaggtcctgggcgctctacgaggatgaaggtgtgatcagatgttacctcgaggaactccttcacatcctgacagatgcagaccccgaagtgtgcaaaaagatgtgtaaacgcaacgagttcgaaagcgtgctcgcgttagtggcatattaccagatggaacatagggcctcactgcggctgttgctgctgaagtgctttggcgccatgtgctccttggatgcagccattatctcaactctggttagtagtgtacttcccgtggagctcgcccgtgacatgcagaccgacacccaagaccatcagaagctttgttactccgcccttattctcgccatggtgttctcaatgggcgaagctgtgccttacgcccactacgagcatctcggcaccccattcgcacagtttctgctgaatatagttgaggacggcttgcctctggacactacagagcaactcccggacttatgcgtcaacttattgttagccctcaacctgcacctcccggcagccgatcaaaatgttattatggcggcactaagcaaacacgccaacgtgaagatcttctctgaaaagctcctgctcctgttgaacagaggagatgatcctgtgcggatctttaaacacgagccgcagccacctcatagcgtgctaaagtttctgcaggacgttttcggctcgccagcaacggctgctatcttttaccatacagacatgatggccctaattgacattactgtgcgccacatcgcagatctgtctcctggggacaagggcccgtttggggccgggcagcgtccctggccaggggtccccagactccttgagcctggtagcacaccatcccgcgagccccaccctgtggagaggtctggcgtacctgctctcacgagctcctgggcgtccggttgtcccaggccacttcaccctgctctgcagcttgttatcgactccgctttcggcgggaggtctgtatag

SEQ ID NO: 125909 - DNA, 2148 bp, Artificial Sequence
  Description of Artificial Sequence: Synthetic coding sequence
atgtaccgggccttgtatgcgttcagatccgccgagccgaatgccctggcgttcgcagcgggcgagacctttttagtccttgagaggtcttccgcacattggtggttggccgcccgcgcgagatccggcgagacaggatacgtccctcctgcctatctgaggaggttgcagggtttggagcaggatgtgctgcaggctatcgaccgtgccattgaggcggtgcataatacagccatgcgggatggggggaagtactccctagagcagaggggagtcctgcaaaaactaatacaccatcggaaggaaactctctcaaggcgtgggccttccgcatctagcgtggccgtgatgacatcttctacatctgaccaccatctggacgccgccgccgctcgtcaacccaacggggtgtgtagggcgggctttgagcgccaacattctctccctagcagcgagcacctgggtgcagacggtggattgtaccagatccctccccaacctcgtcgcgccgcccccaccacgccccccccgcccgtgaagcgcagggacagagaggcactgatggcgtccggcagcggggggcataataccatgccatcgggtggaaacagtgtcagttcggggagctcagtcagctccaccagcctggacactttgtacacaagctccagcccatccgagccagggtcaagctgtagtcccacacctcctccagtgccgcggagagggacccacacaactgtcagccaggtacaaccccccccgtctaaggcctcggcacccgaaccacccgcagaagaagaggtagccacagggacaacatctgctagcgatgatctggaagccctcgggacactttctctcgggaccacggaggagaaggccgccgccgaggccgcggtgcctaggacgatcggcgcagagctgatggagctcgttcgtcgaaacactgggctcagtcatgaactctgcagggtggctatagggatcattgttgggcacattcaggctagtgtcccagcttccagtccagtcatggagcaagtcctgttgtcactcgtggaaggaaaggacctctctatggcactacctagtgggcaagtgtgccatgaccaacagaggctggaggtgatctttgccgacctggcaaggagaaaagacgacgcacagcaacgttcgtgggccctgtatgaggacgaaggtgtgatcagatgctaccttgaagagctgctccacatcctaacagacgctgacccagaagtgtgcaagaagatgtgtaagcgcaatgagtttgagagcgtactggcgttagtggcttattatcagatggagcaccgcgcttccttgcggctgttgctgttgaagtgttttggggcaatgtgcagcctcgacgcagccatcatcagcactctcgtgagctccgtcctgccagtggagctagcccgtgacatgcagaccgacactcaggaccatcagaaactatgttactctgcactgattctggctatggtgttctccatgggagaggcagtcccttatgcccactacgaacacctcgggacgcctttcgcacagttcttgctaaacatcgtggaggacggcctgccgctcgacactactgagcagttgccggatctttgcgtgaatctgctgctcgctcttaacctgcatctgcccgccgccgatcaaaatgtgattatggcggcactgtctaaacacgcgaacgtgaagatcttcagtgagaaactcctactgttgctgaatcggggagacgaccctgtgaggatcttcaagcatgaaccgcagccgcctcacagcgttctcaaatttttacaggacgttttcggatcacccgcgacggcggccatcttttaccataccgacatgatggcccttatcgatatcaccgtgcgtcacatcgctgatttgtcaccaggtgacaaactgcgtatggaatacctgagcctgatgcacgcaatcgtgaggaccaccccttatcttcaacaccgacaccggctgcccgatctgcaggccatcctgagacgtatattgaatgaagaggaaacttcgccccagtgtcagatggatcggatgattgtaagagaaatgtgcaaggagttcctggtcctgggagaagctcctagctag

SEQ ID NO: 125910 - DNA, 3405 bp, Artificial Sequence
  Description of Artificial Sequence: Synthetic coding sequence
atgagtaggtccgtgctacagccctcacaacagaaactcgctgaaaagctgaccatactaaacgacagaggcgtagggatgctaacccggctatacaatatcaagaagcaaggacaagtatggaaagcctgtggcgaccccaaagcaaaaccttcatacctcatcgacaagaacctggaaagcgctgtaaaattcatagtgaggaagtttcccgctgtcgagacgaggaacaacaaccaacagctcgcccagctgcagaaagagaagagcgaaattttgaagaatctggccctctactatttcacttttgtagatgttatggagttcaaagaccacgtgtgcgagctgttgaataccatagacgtctgtcaggtgtttttcgatatcacagtcaatttcgatctcaccaagaactatctcgatctgatcataacatatacgactcttatgatattacttagcaggatcgaggaacggaaggccattatcgggctttacaactacgcccacgagatgacccacggcgcatccgatcgggaatatccccggctggggcaaatgatcgtggactatgagaaccctctcaagaagatgatggaggagttcgtcccgcactctaaatctctgtccgatgccctgattagtttgcagatggtgtatcctagaagaaatctttcagctgatcaatggaggaacgcacagcttttatccctcatttctgcacccagcacaatgcttaatcccgcccaaagcgacactatgccttgcgaatatctgtccctggatgctatggagaagtggatcatttttggcttcatcctgtgccacggtattttaaacacagacgccacagctctgaacctgtggaagctcgcattgcaatctagctcatgtctctcgctttttcgtgacgaagtgttccatatacacaaggctgccgaggacctcttcgtcaatatacgaggctacaacaagcgcattaatgatatacgcgagtgtaaggaagctgctgtgtcccacgccggatccatgcaccgagagcgtcgtaagtttttacgaagtgccttgaaagaactggcgactgtcctcagcgaccaacccgggctgcttggtcctaaagcgctgtttgtgtttatggcgctgtccttcgctcgtgatgaaatcatatggttgctgcgacatgcagataacatgcccaagaaatccgcggacgattttattgataagcacattgcggagctgatcttttacatggaggagttgagggctcatgtaagaaaatatggacccgttatgcagcggtactacgtgcagtatttaagcggatttgatgcagtggtgctgaacgagcttgtgcaaaacctcagtgtttgcccagaggacgaaagcatcatcatgtcctctttcgtgaacactatgactagtctgagtgtcaagcaggtggaagacggggaagtttttgacttccgcggtatgagactggactggtttcggctccaggcgtatactagcgttagcaaagcctcactcggactcgctgatcatcgtgaactgggtaagatgatgaataccatcatattccatactaagatggtggactctctcgtcgaaatgctggtggagacttcggatctctctatcttttgtttctatagtagggctttcgagaaaatgtttcagcaatgtctcgaattgcccagtcagtcccggtatagcatcgctttcccactcctgtgcacgcactttatgtcctgcactcacgagctgtgtcctgaggagcgacaccatattggagatcgtagcctgtcactgtgtaatatgtttctcgatgagatggccaagcaagctagaaatctcattaccgatatatgcaccgagcagtgcacacttagtgatcaactgcttcctaaacactgcgctaagaccatctcacaggccgtcaacaagaaaagcaaaaaacagaccgggaaaaaaggggaacctgagcgtgaaaagccgggagttgaaagtatgcggaaaaaccgtctggtggtcaccaatctcgacaaacttcatactgctctgtctgagctctgcttctctatcaattacgtgccgaatatggtcgtgtgggagcatacttttactccaagagaatacctgacgtcacacctggaaatccgttttaccaagtcaatcgtcgggatgacaatgtataatcaggctactcaggagattgccaagccaagtgagttactcacttccgtgcgcgcctacatgaccgtactgcagagtatagagaactacgtgcaaattgatattaccagagtgtttaacaatgtgctgttgcaacaaacccagcacttagatagtcatggcgaaccaaccatcacctcactgtacaccaattggtacctggagaccttactgcgccaggtatcaaacgggcatattgcatacttccccgccatgaaagccttcgtgaacctccccactgaaaacgagctgaccttcaacgccgaggaatactccgacataagcgaaatgaggtctctatcagagctcctgggcccctatggtatgaagttcctgtctgagagtttgatgtggcacatcagctctcaggtagctgaactgaaaaaactggtcgtcgagaatgtggatgtgcttacccaaatgcggacctcattcgataaacccgaccaaatggccgcattgtttaaacgcctctcaagcgtggatagcgtactcaagcgaatgacaattattggcgtcattctgtcatttaggtcactggcacaagaagcgctccgggacgtactgtcctaccacatccccttcttagtatcttccattgaggatttcaaggaccacataccgagagagacagacatgaaagtggctatgaacgtctacgaactgagttcagccgcaggcctcccctgcgaaatcgatcctgccttagtcgtcgctctgagtagccagaagagcgagaatattagccccgaggaggagtacaaaatcgcgtgcctgctcatggtctttgtcgccgtgtccctcccaaccctcgcgtctaatgtgatgtcccagtactcccctgccatagagggccactgcaacaacatccactgcctggccaaggccattaaccaaatcgccgcagccctgtttacaatccacaaggggtctatcgaagatcgactgaaggaattcctggcacttgcatcctcaagccttttgaaaatcgggcaggagacagacaagactacaacccgtaatcgcgaatcagtgtacctccttctcgacatgattgtgcaagagagtccctttcttaccatggatcttctggaaagctgcttcccgtacgtgttacttcgaaatgcttaccacgcagtgtacaagcagagtgtcaccagtagcgcctag

SEQ ID NO: 125911 - DNA, 3387 bp, Artificial Sequence
  Description of Artificial Sequence: Synthetic coding sequence
atgagtagatccgtattgcagccaagtcaacagaagcttgcagagaagctgaccattttgaacgacaggggcgtcggaatgctgacccggctttataacattaaaaaagcctgtggtgacccaaaggccaagcccagttacctcatcgataaaaatttggagagcgctgttaagtttattgtcaggaaattccctgcagtggaaaccaggaataataatcaacaactggcacagctgcagaaagagaagagcgaaatcctcaagaacctggcactttattatttcacatttgttgacgttatggagtttaaggaccacgtgtgtgaactgttgaatacgatcgatgtgtgccaggtgttttttgacatcacagtaaacttcgacctcactaagaattatctggacttgatcattacctataccactttgatgatcttactgtcccggatcgaagagcggaaagcaattattggactatacaactatgcccatgaaatgacccacggcgcttcagacagggagtatccccgcctaggccagatgattgtggattacgagaatccactcaagaaaatgatggaggagtttgtccctcactctaaatccctcagtgatgccctgatatcactccagatggtgtatccaagacgcaatctgagcgccgaccaatggaggaacgcccagctgttgtccttaatatccgcccccagtaccatgttaaacccagcacagagcgatacgatgccctgtgaatatctgtcactcgacgctatggaaaagtggataattttcggatttattctctgtcacggcatactaaatacagacgcgaccgcactgaatctttggaaattggccctccagtccagttcctgtctcagcctcttccgggacgaggtcttccatatacacaaggcagcagaggatctatttgtgaatatcagaggatacaataagcgtatcaacgatattcgtgagtgcaaagaagcagctgtgtcacacgctggcagtatgcacagggaaaggcgaaagtttctgcgcagtgccctaaaagagctcgccactgtcctctccgatcagccagggctgctcggtcccaaagctctgtttgtgtttatggccctcagcttcgctcgggacgagataatttggctcctcaggcacgccgataatatgccgaagaagtcagctgatgactttatcgataaacatatagctgaactgattttctatatggaggagctccgggcacatgtgagaaagtatggacccgtcatgcagcgttactacgtgcaatatctcagcggatttgacgccgttgtactgaatgagcttgtgcagaacctgtccgtgtgccccgaggatgagtcaatcataatgtcctccttcgtgaataccatgacttctctgtctgtaaagcaggttgaggacggcgaagtgttcgactttaggggaatgcgcttagattggtttcggctacaggcttacacatccgtctctaaagcgagtctgggcctggccgatcatagagagctcggcaagatgatgaataccatcatcttccacacaaaaatggtggatagcctcgtggaaatgctggtcgagacatctgacttgtctattttttgtttttattcccgggcatttgagaagatgtttcaacagtgtctggagctgcctagccagtcccggtactctattgccttccccctgctgtgtacccatttcatgtcttgcacgcatgagctgtgtcccgaagagaggcaccacataggcgatcgcagtctgtcactgtgtaacatgtttctggacgaaatggccaagcaggccaggaatctcattacagatatttgcactgaacaatgtactttaagcgaccagctgctgcctaaacactgtgcgaaaactatcagtcaagccgtgaacaagaaaagcaaaaagcagaccggcaagaagggggagccagaaagagagaagccaggagtggaaagcatgagaaaaaaccggctcgtggtgaccaacctcgataagctgcacacagctctgagtgaactctgcttctcaatcaattacgtcccaaatatggtggtctgggagcatacattcactccccgcgaatatcttacctcgcacctcgaaatccggtttaccaagagtatagtcggcatgaccatgtataaccaggcgactcaggagattgctaaaccttcagaattactgacttcagtgcgagcctatatgacagtgctacagagtatagagaattacgtgcaaattgatattacccgcgtgttcaacaatgtgctgcttcaacagactcagcacctagacagtcatggagaacctactatcactagtctctacacgaattggtaccttgaaacattgctccgacaggtgagcaacggtcatatcgcctatttcccggctatgaaagcttttgtgaatttaccaactgagaatgaactgactttcaatgccgaagagtattcggatatctctgaaatgagatctctgtccgagctcctggggccctatggcatgaaatttctgtctgaaagcctgatgtggcatatttccagccaggtggctgaacttaagaagcttgtggttgaaaatgtagacgtgctgactcagatgagaaccagcttcgataagcccgaccagatggccgccctgtttaagagactctcgtcggtcgattccgttttgaaaaggatgaccattatcggcgtgatcttgtctttccggagtctggctcaggaagcacttagggacgtcttgtcctatcacatacccttcctggtgtctagtatcgaggacttcaaggatcacatcccacgggagactgacatgaaggtcgccatgaacgtgtacgagttgagttccgccgcaggtttaccatgtgagatagacccagctctcgtcgtagctctctcctcacaaaagtcggagaacatttctcccgaggaagaatacaaaatcgcatgtctgctaatggtcttcgtcgctgtgtcactcccgacactggccagcaatgttatgagtcaatacagcccggctattgaaggacactgtaacaacatacactgcctcgccaaagcaataaatcagatcgctgccgcgctcttcactatccacaaaggctctatagaagacagactgaaagagttcttggccctggcaagctcctcactcttgaaaatcggtcaagaaacagacaaaacaaccacccgcaatagagagtctgtgtaccttcttctggacatgatcgtccaggaatcgccgtttctaaccatggatctcctcgagtcttgtttcccatacgtactgctccgcaacgcctaccatgcagtgtataagcaatcggttaccagtagtgcttag

SEQ ID NO: 125912 - DNA, 2649 bp, Artificial Sequence
  Description of Artificial Sequence: Synthetic coding sequence
atgcctgctctagcttgcctcaggcggttgtgccggcatgttagtccacaggccgttcttttcttattgtttatcttctgcctcttcagcgtattcatcagcgcctactacctttacggttggaagcgagggcttgaaccgtcggcagatgctcccgagccagattgtggggatccacctccagtggcacctagcagactcctgcccctgaagccggtgcaggcagctacaccaagtcggaccgatcctctcgtgttggtcttcgttgagtctctgtactcgcagctcggccaagaggtcgtggctatcctggagtcaagcagatttaagtacagaaccgagatagcccctgggaagggcgatatgcccactctgactgataagggcaggggcaggtttgccttgattatttacgagaacattctgaaatatgtgaacctcgacgcatggaatcgtgaactattagacaagtactgtgtggcatacggcgtaggaattattggttttttcaaagcgaacgagaactccctcctcagtgcccaactgaagggcttcccgctctttcttcacagtaacctcggattaaaggactgttctattaatcccaagtcacctctgttgtacgtgacacgtccaagtgaagtggaaaagggcgtcctcccaggtgaagattggaccgtgtttcagtccaatcacagtacttacgagccggttttgctcgcaaagacaaggagttccgaatccataccacacctcggcgctgacgccggattacatgccgccctgcacgccacagttgtgcaggacttagggctccacgacggaatccagcgggtcttgtttggaaacaatctgaatttctggctgcataagctggtgttcgtcgatgccgtggccttcctgacaggaaaacgcctcagtctgcctcttgatcgttatattcttgtggatattgacgacattttcgtaggaaaggaaggcacgaggatgaaggtcgaagacgtgaaggccctgttcgacactcagaatgagctgcgcgcccacattcctaactttacttttaaccttgggtactcaggtaagttctttcatacgggcactaacgcagaggacgccggcgacgacctcctgctctcttacgtcaaagagttctggtggtttccccatatgtggtcacacatgcaaccgcaccttttccataaccagtcagttctggccgagcaaatggccttgaataagaaatttgctgtggagcacgggattccaactgatatgggctacgccgtcgccccgcaccatagtggggtgtaccctgtgcacgtgcagctgtacgaggcctggaagcaagtatggagcatccgagtgaccagtactgaggagtacccccacctgaagcccgcaagatatagacgaggctttatccacaacggcatcatggttctgccacgacagacttgcggtctctttacacacaccattttctacaacgaataccccggtggctccagtgagttagacaaaattatcaatgggggcgaactatttttgactgttttgctgaatcctatttctatctttatgacccatctctcaaactacggcaatgataggctgggactttacacctttaagcacctcgtacgatttctacacagctggactaatttgcgactgcagactctaccaccagttcagctggcccagaagtactttcagatcttcagcgaggagaaggaccctctatggcaggacccatgcgaggataagcgacacaaggacatatggtccaaagagaagacttgcgatcggttccccaagctcttaatcatcggaccgcagaagactgggacaacagctctgtatctattcctgggtatgcatcccgatctcagcagcaattatccctccagcgagacctttgaagaaatccagtttttcaacggccacaattatcataagggaattgattggtacatggagttcttcccaatcccttctaatactacgtctgacttctacttcgagaagagtgccaactattttgatagcgaagtggcacctagacgcgcggctgctctcctgcctaaagctaaagtgttaacaatactgattaatccagcggacagggcctattcttggtaccagcaccaaagggctcatgatgatcccgtagcgctcaaatataccttccacgaggtcattaccgcaggcagcgacgcttcctctaagctccgtgccctacagaaccgatgtctcgtgcctggatggtatgccactcatattgagaggtggctgagcgcttatcacgctaaccagatcctggtcttggacgggaagctgttgcgcactgaacctgcaaaagtgatggacatggttcagaaatttctcggggtcactaacacgattgattatcacaaaactctagctttcgacccgaagaagggtttctggtgccaactgctggaaggggggaaaaccaaatgccttggtaagagtaagggacggaagtatcccgaaatggacctggattctagagcgtttcttaaggattattaccgggatcacaacattgaactatccaagctgctgtataagatgggccaaacattacctacctggctgcgcgaagatcttcaaaacacgcgttag

SEQ ID NO: 125913 - DNA, 72 bp, Artificial Sequence
  Description of Artificial Sequence: Synthetic coding sequence
atgccagcgctggcatgtctcaggcgcttgtgtcgccacgtctccccccaggcagttttgttcctgctgtag

SEQ ID NO: 125914 - DNA, 480 bp, Artificial Sequence
  Description of Artificial Sequence: Synthetic coding sequence
atgccggccctcgcatgtcttcgacggctgtgtcggcacgtcagcccccaggccgtgctgtttttgctgttcattttctgcctgttttccgtgtttattagcgcttattatctttacgggtggaagcggggcttagaaccttccgccgacgctcccgaacccgactgtggtgatccccccccagtggccccttcaaggcttctgccactgaaaccagtgcaggcagcaactccttcccggaccgatcctctggtgctggtcttcgtggagagcctgtactcccaactggggcaggaagtagtggcaatccttgaatcttctcgctttaaatataggacagaaatagctcccggcaaaggggatatgcccacactaacagataagggcaggggaagattcgcactaatcatatacgagaatatcctgaagtacgttaatctggatgcctggaatcgggagctcctcgacaaatactgctag

SEQ ID NO: 125915 - DNA, 207 bp, Artificial Sequence
  Description of Artificial Sequence: Synthetic coding sequence
atgcccgctctggcttgtctgcgacggctgtgccgccacgtgtcacctcaggctgtgctattcttgctcttcattttttgcctgtttagtgtttttatttccgcatactatctttatggctggaagagaggtctggagccctcagccgacgcccccgagcctgattgcggtgaccctccgcccgtagctccaagcaggctgctatag

SEQ ID NO: 125916 - DNA, 2283 bp, Artificial Sequence
  Description of Artificial Sequence: Synthetic coding sequence
atgccaaccttaacagacaatacacatggacggtatgtgttggtcatttacgaaaacctcctgaagtatgtgaacctagatgcatggagtagggaactcctggacaggtattgtgtggagtatggggtcggaataatagggttttttagagcccacgagcattcccttcttagtgcacagttaaaaggatttcccctgttccttcattcaaaccttggtttaagagactaccaggtgaatccttcagctccgctcctccacctcacgcggccctccaggctagagccaggccctttgcccggggacgactggacaatctttcagtccaaccactctacctatgagcccgtgcttctagcctcgctgcggcccgccgagccagctgttcccggtccagttctgcggagagcaaggctgccaacagtggtccaggacctggggcttcatgatggaatccagagagtactctttggacacggtctctccttttggctccacaagctgattttcgtagatgcagttgcctatctaaccggcaaacgtctgtgtctggacctggatcgctatatcctcgtggacatagatgatatttttgtgggaaaagaaggtactcggatgaaggtggctgacgtggaagccctgctgaccacccagaataagctcagaacactcgttcctaactttacctttaacttgggattctccggcaagttctatcatacaggaacagaggaggaagacgccggagatgatatgttgctgaaacacaggaaggaattctggtggtttccacacatgtggtcacatatgcaacctcatctcttccataaccgttcagttctggcggaccaaatgcgcctgaataagcaattcgccctggaacacggcatccctacggatctcgggtatgccgtggccccacaccatagtggggtgtatcccattcacacccagttatatgaagcttggaagtccgtttggggcattcaggtgacctccaccgaagagtatccccacctacgtccagcccgctatcggcgcggcttcatacataatggaatcatggtgctgcctaggcagacgtgtggactttttacacacactattttctacaatgagtatccgggcgggtcccgagagctggataggtctatcaggggcggcgagctgttcctgacggtgctgctcaaccctatttctatctttatgactcatctcagtaactacggcaatgaccgattagggttgtatacattcgagtcactggttagattcctgcaatgctggacccggcttagattacaaaccctgcctccagtgccgctggcgcagaagtacttcgagctgtttccccaggaacggtctcctctttggcagaacccctgtgatgataaaaggcataaggacatctggtcaaaagagaaaacctgcgaccggttaccgaaattcctaatcgtgggccctcagaagacagggaccacagcaatccacttcttcctgtcactccatccagctgtcacttcatcctttccctctcccagcactttcgaagaaatacagtttttcaacagcccgaattaccacaagggcatcgattggtacatggactttttcccagtcccctctaacgcgagtacagacttcctttttgaaaaaagcgccacatattttgattcagaggtggttcctcggcgcggggctgctctgctgccacgagcaaagatcatcactgtcctgacaaaccccgccgatcgcgcctactcttggtaccagcatcagcgggctcacggcgaccccgtggcgttgaattacactttctatcaggtgatatccgcatcctcccagactcccctagccctgcgatccctgcagaaccggtgcctggtcccgggttactattccactcacttgcagcggtggcttacatactatccaagcggtcagctgctcattgtggacggacaggaactgcggaccaaccccgctgcaagcatggaaagtatccagaagtttttagggatcactccgtttctaaattatacacgaactctaagatttgacgacgacaaagggttctggtgccagggtctagaaggggggaaaacacgctgtctgggccgatccaagggtcgccgctacccggacatggacactgaaagccgtctcttcctgaccgatttcttcaggaatcataatttagagctatcaaagctcctttcacgtctgggccaacccgtgccctcatggcttagggaagagctgcagcactcatcactcggatag

SEQ ID NO: 125917 - DNA, 2652 bp, Artificial Sequence
  Description of Artificial Sequence: Synthetic coding sequence
atgctgcaactctggaaggtggtcaggcccgcaaggcaactggagttgcaccgattaatcctgctcctcatcgccttcagcttgggctcgatgggattcttagcctactacgtgagtacctcccctaaagcgaaggagccactgccacttccgttgggggattgttcctccgggggagcagcaggtcctgggcctgctcgcccccccgtgcctccccgcccccctcgacctccagaaacggcaagaaccgagccggtggtcctggtgttcgttgagtcggcctactcccagttgggacaggagatcgtggccatccttgaatcttctcggttccgttacagtacggagctggcacctggacgcggagacatgcccacccttactgataatacacatggcaggtacgtgttagttatctacgagaatcttcttaagtacgtgaacctcgatgcgtggtcccgcgaattactggatcggtactgtgtagaatacggtgtgggcatcattgggtttttcagagcacatgaacatagcctcttgtctgcccagctgaagggcttccccctcttcttacacagtaacctgggcctccgggactatcaagttaacccgtcagcccctctattacacctcacccgacccagcaggctagaacccggacctctcccgggtgatgattggaccatctttcaatcaaatcacagcacatacgagcccgtgttgctcgctagtttgaggcccgccgaaccagcagtgccgggcccggtgctgcgtcgggcaagactgcctaccgtggttcaggacttgggtttgcacgacggcattcagcgtgtcctttttggccacggcttgtccttctggcttcacaagctgatattcgtcgacgctgtcgcttatctaactgggaaaagactgtgcttagacctagatcggtacattctagtggacattgacgacatatttgtggggaaggagggaacccgcatgaaggttgcagatgtggaggcacttctgactacccaaaacaagctcagaacactcgtgcctaattttacatttaatctcggtttctccgggaaattttatcatacagggaccgaagaagaggacgctggcgacgacatgctcctgaagcacaggaaagagttttggtggtttccgcacatgtggtcccatatgcagcctcatctatttcacaatcgctctgtgctggccgatcagatgaggctgaataagcaattcgctctggaacacgggatacctaccgatttaggttacgccgtcgctccccatcacagtggagtgtatcctatccacacgcaactctatgaggcctggaaaagcgtctgggggatccaggtcacctccaccgaagagtatccgcatctgcggccagccagatatagaaggggctttatccataatggcattatggtcctgcctcgacagacgtgtgggttgttcacacacaccatcttctacaatgaatatcccgggggctcgcgcgaactcgacaggagtatcagagggggcgagctctttctgacggtcttgctgaaccctatcagcatcttcatgacccatctgtctaattacggaaatgaccgactcgggttgtacacatttgaatcactggtcaggtttctgcagtgttggaccagactccggctgcagacacttccccccgtgcccctggcacagaaatatttcgagttatttccccaggagcgatcaccgctatggcagaatccgtgtgacgataaacggcataaggatatttggtctaaggagaagacctgcgaccggctcccaaagttcctgatcgtgggaccccagaagactgggacaaccgctatccacttctttcttagtttgcaccctgccgtaacgagttccttcccatcaccttctactttcgaagagatacagttctttaactctccaaactaccacaaaggaattgattggtatatggatttttttcccgtcccctcaaacgcaagcaccgattttttgttcgagaaaagtgcaacttacttcgactcagaggtagtgcctcgccggggcgcagcgttgctcccgagggccaagatcattaccgttctgactaacccagcagatagggcgtactcttggtaccaacaccaacgggcgcacggtgatcccgtcgccctcaattacaccttctatcaggttattagcgcttcctctcaaacccctctcgcactgaggagcttgcagaaccggtgcctcgtgcccggctattacagtactcaccttcagcgctggcttacctattacccctccggccagctgttgattgtagatgggcaggagctgcgcacaaatccggccgcgtcaatggagtctatccagaaatttctgggtatcacgccctttctgaactacacccgtacactgaggttcgacgacgataaaggtttctggtgtcagggactggaaggtggaaagactcgatgcctgggccgctcaaaaggcagacggtaccccgatatggacactgagtctcgcctcttcctcactgatttcttccgaaatcataacttggaactgtccaaactcctgtccagactgggccagcctgtgcccagttggctgcgtgaggagttacagcattccagcctcggctag

SEQ ID NO: 125918 - DNA, 450 bp, Artificial Sequence
  Description of Artificial Sequence: Synthetic coding sequence
ggcgatcccgtggccttgaattatactttctatcaagtgatcagtgcctccagtcagaccccccttgctctgcgaagcctgcaaaatagatgccttgttcccgggtactattcgacacacctgcaacggtggctgacctattatccgtccggccaactcctgatagtagatggtcaggagcttaggactaaccctgctgcttccatggagtccatacagaaatttttgggaataactcctttcctgaactacacccggaccctgaggtttgacgacgataagggtttctggtgccaaggactggagggcggaaagactcgctgcctgggtagatctaaaggaaggaggtaccccgatatggacaccgaggtgagcaaagctcggggtcgcggcatacccctgcatttccaggatctgatcctatgtcccacctcctatcatttctgctag

SEQ ID NO: 125919 - DNA, 696 bp, Artificial Sequence
  Description of Artificial Sequence: Synthetic coding sequence
atgcgagtgcccgtgttcgaagacatcaaagacgagaccgaagaggaaaaaatcggggaggaagaaaatgaagaggaccaggtcttttataagcccgtcatcgaagatctgtcgatggagctggccagaaagtgcaccgagctaattagtgacatccggtataaggaagagtttaagaaatcaaaagacaagtgtaccttcgtgaccgatagtcctatgctgaatcatgtcaagaacatcggagcctttatctccgaagctaaatataagggaacgatcaaggcagatttgtccaatagtttgtacaaacgtatgcccgccaccattgactcggtgttcgctggagaggtgactcagctgcaaagcgaggttgcatacaaacagaaacacgatgcagccaaggggttttctgactatgctcatatgaaggaaccccctgaagtcaagcacgccatggaggtgaacaagcatcagagtaacatttcctatagaaaagacgtgcaggatacacacacttatagcgcagaactggaccgccccgacataaagatggctacacaaatttccaagattattagcaacgccgaatataaaaagggtcaagggataatgaacaaagagcccgcggtgattgggaggcctgactttgaacacgcagtggaagcctctaaacttagtagtcaggtgagactctag

SEQ ID NO: 125920 - DNA, 3045 bp, Artificial Sequence
  Description of Artificial Sequence: Synthetic coding sequence
atgagggtgcccgtgtttgaggacattaaagatgagaccgaagaggagaaaatcggggaggaggagaatgaggaagaccaggtgttttataagcccgttattgaggacctgtcgatggaactggcccggaaatgcaccgaactcatctcggacatacgctataaggaggaatttaagaagagcaaggataagtgcacattcgttactgactctcctatgcttaaccatgtcaaaaacataggcgcttttatctcggaggcaaaatataagggcaccatcaaagccgacctgagtaactctctgtataagaggatgcccgcaacgatcgactctgtatttgccggcgaggtgactcagcttcagtctgaagtggcttacaaacagaaacacgatgccgcgaaaggtttttctgactacgcccacatgaaagagccgccagaggtgaaacatgctatggaggtcaacaagcatcagtcaaatatatcataccgcaaagatgtgcaggacactcatacgtactctgctgagctggatcgacccgatataaagatggctacacagatttctaaaatcatcagtaacgctgagtataaaaagggacagggcatcatgaataaggagcctgcagtgattggacggccggactttgagcatgccgtggaggctagtaagctctcctctcagatcaagtataaggagaagtttgacaatgagatgaaagacaaaaagcatcattataaccctttggagagcgcaagctttcgccagaatcaactggccgctactctggccagcaacgtcaaatacaaaaaggacatccagaatatgcatgacccggtgagcgacctgcctaatcttctgtttctggaccatgtgctaaaggccagcaaaatgctcagtggccgggagtataagaagctgttcgaagaaaacaagggaatgtatcacttcgacgctgatgccgtggagcacctgcaccacaaaggtaacgctgtgctacagtctcaggtgaagtataaagaggagtatgagaagaacaaaggtaaaccaatgttggagttcgttgaaaccccctcttatcaggcctctaaagaggcccagaagatgcaatctgagaaggtatacaaggaagacttcgagaaggagattaagggcaggtcttcccttgatctggacaagacacccgaatttctccatgttaaatacatcacaaacctgctgagagagaaggagtataaaaaagatctagaaaatgaaattaaagggaaaggcatggagctgaatagtgaggtcctagatatccagcgggctaagagagccagtgaaatggcttctgaaaaggagtacaaaaaggatctcgaatctattataaaaggcaaagggatgcaggcaggaactgatacactggagatgcagcacgctaagaaggccgcagagatcgcttcggaaaaggactataagcgggacctggaaaccgaaatcaaaggcaagggaatgcaggtgagcacggataccctggatgtacagcgcgcaaaaaaggcaagcgagatggcatcccaaaagcagtataagaaggacctggagaacgagatcaaggggaaaggcatgcaagtctccatggacatacccgacattcttagagcgaagcgcacatcggagatatactcccagagaaaatacaaagatgaggccgaaaagatgcttagcaattacagtacgattgccgacaccccggaaattcaacgaattaagaccacccagcagaacatcagcgcggtgttctacaagaaggaagtcggtgcaggcaccgccgtcaaagactcaccagagattgaaagagtgaagaaaaaccagcagaacatttcctccgttaagtataaagaagaaatcaagcatgccacagctatcagcgatcctccggagttaaaaagagttaaggagaatcagaaaaacatatctaaccttcagtacaaagagcagaactataaagccacccctgtgtctatgacccctgagatcgagagggtgagacgaaatcaggaacagttgagcgccgtgaagtacaaaggcgaattgcagagagggactgctatttcggatcccccggaacttaagcgcgcaaaagagaaccagaagaacattagcaatgtctactacagaggccaactgggaagggccacaacgctgagcgtgacccctgaaatggaaagagtcaaaaagaatcaggagaacatatcatcagtaaagtacacgcaggaccataaacagatgaagggccgaccatccctaatcctggacacccccgccatgagacacgttaaggaagctcagaaccacattagtatggtgaaatatcatgaggactttgaaaaaactaagggaagaggatttacacccgtggtggacgacccagtgaccgagagggtgcgcaagaacacacaggttgtcagtgatgcagcctataaaggtgtgcacccccatatagtcgagatggaccgtcgaccaggtattatcgtcgacttaaaggtgtggcgaactgatcccggaagtatctttgatctggacccgcttgaagacaatattcagtccagatccctgcacatgcttagcgagaaggccagccattaccgacggcattggagtagaagtcatagctctagcacattcggcaccggactaggggatgaccgctccgagatctctgaaatttacccatccttttcttgctgcagtgaggtgacacgcccaagcgatgagggggcccccgttcttccaggtgcgtaccagcagagccacagccaggggtatggctatatgcatcagacaagtgtgtcctctatgcggtccatgcagcattcacccaaccttcgaacgtaccgagccatgtacgactactccgcgcaggatgaggatgaggtaagctttcgggatggtgactacatcgttaacgttcaaccaatcgacgacggctggatgtacggaacagttcagcgaacaggaagaacaggtatgctgcctgccaattatatagagtttgtgaactag

SEQ ID NO: 125921 - DNA, 711 bp, Artificial Sequence
  Description of Artificial Sequence: Synthetic coding sequence
atgctgcatttttactacgaatggttacattctggcagccgcggtgcagtccctaaaccactgcactaccccaaacaaagttttacaactgtcgctgatacccctgaaaatcttagactgaagcagcagtccgaactccagagccaagtgaagtataaaagggattttgaggagagtaaggggagggggttctcaatcgttactgataccccagaattgcagagactgaaaaggactcaggaacaaatttctaatgtgaagtatcatgaggattttgagaaaaccaagggacgtgggttcacgccagtggttgatgatcctgtgactgaaagagtcagaaagaacacccaagtggtgagtgacgcagcctacaagggggtgcatcctcatatagtcgaaatggatagaaggccgggaatcatcgtggcaccggtgctcccaggcgcttaccagcaaagtcactcccagggttatgggtatatgcaccagacgagcgtgtcttcaatgcgatccatgcagcactcaccgaacctacgtacctacagagcgatgtacgactactccgcccaggacgaggatgaggtatcctttcgggatggcgattacattgtcaatgtgcagcccatcgacgatggatggatgtacgggaccgttcagcggacaggtcgcacaggcatgctccccgccaattacattgaatttgtgaactag

SEQ ID NO: 125922 - DNA, 813 bp, Artificial Sequence
  Description of Artificial Sequence: Synthetic coding sequence
atgaatccacagtgcgctcggtgtggcaaggtggtgtatccgacagagaaggtcaattgcctggacaaatactggcacaagggatgttttcactgtgaagtatgcaaaatggccttaaatatgaacaactacaagggctatgaaaagaagccgtactgcaacgcccactatccgaaacagtctttcaccaccgtggcagacactcccgagaatctcagactcaaacagcagagtgagctgcaaagccaagttaaatataaaagagacttcgaagaatccaaaggccgcgggttttctattgtcactgacacccctgaacttcagcgcctgaagagaacccaagagcaaatttcaaatgtcaaataccatgaagacttcgagaaaaccaaaggacgtgggtttacccctgtggtagacgaccccgttactgaaagagttaggaaaaatactcaagtcgtgtccgacgccgcatacaaaggtgtccacccccatattgttgaaatggaccggcgcccaggcatcatcgtggctcctgtcctgcccggcgcctatcagcaatctcacagtcaaggatacgggtatatgcaccagactagcgtttcaagcatgcggtctatgcagcacagccccaatctgcgaacgtatcgggcgatgtatgactattccgctcaggatgaggatgaggtgagctttcgcgacggcgactacatagtgaatgtgcaacccattgatgatggatggatgtatggaactgtgcagcggaccggtcgcacaggtatgcttcctgcaaactatatcgagtttgtaaactag

SEQ ID NO: 125923 - DNA, 354 bp, Artificial Sequence
  Description of Artificial Sequence: Synthetic coding sequence
atgagaaataactgtacagccagtctcatgaaagtcttttataaacccgtaatcgaagacctgtccatggagctggccagaaagtgcacggaactcatctccgatatacgatacaaggaggagtttaagaaatccaaagacaagtgtaccttcgtcaccgactctccaatgctgaatcacgtcaaaaatatcggtgcctttatttctgaggccaagtataagggcactataaaggcagacctatctaattctctgtacaagcgcatgcctgccacaattgattccgtgttcgcaggagaggtcactcagttacagtcggaggtggcatacaagcaaaaacatgacgcagcgtag

SEQ ID NO: 125924 - DNA, 20010 bp, Artificial Sequence
  Description of Artificial Sequence: Synthetic coding sequence
atggccgacgacgaggattacgaggaagtcgtggaatactacactgaagaagtcgtgtacgaagaggtcccgggagagacaattaccaaaatctacgagactactactacccggaccagtgactatgagcagagtgagacaagcaaacccgctctggcgcagcctgctctggcccagccagctagcgccaaacctgtcgagcgcaggaaagtgatacgcaaaaaagtcgacccttcaaagtttatgaccccttatattgctcacagccagaaaatgcaggatctctttagccctaacaagtataaagaaaaatttgagaagactaagggtcaaccctatgcctcaaccactgatacacctgagctgagacggatcaagaaggttcaggaccagttaagcgaggtgaagtacaggatggatggcgacgtcgccaaaacaatttgtcacgtggacgagaaagcaaaggatattgaacacgcgaagaaagtgagccaacaagtgtctaaggtgctgtataaacaaaactgggaggataccaaagataagtacttgcttcctccagacgccccagagctagtgcaggctgttaagaacaccgccatgtttagcaagaagttatatactgaggactgggaagccgacaaaagcctgttctacccgtacaacgactcacccgaactgcgacgggtggcccaggcacaaaaggctcttagcgacgttgcctataagaagggcctggccgaacagcaagcgcagttcacaccactggccgaccccccggacatagaattcgcgaagaaagtcactaaccaggtgagcaaacagaagtataaagaagattacgagaataagatcaagggaaagtggagcgagaccccttgcttcgaggtggcaaatgcaaggatgaatgctgataacatcagtacgcgcaaataccaagaggactttgagaacatgaaggaccagatttattttatgcagacggagaccccagaatataaaatgaacaagaaggctggcgtggcggcctctaaggtgaagtataaggaagactatgagaagaataaggggaaggcagattacaatgtgctccctgcctctgagaatccacagctgcgccagctgaaagcagccggcgatgccctgtcagataagttgtataaggaaaattacgaaaagacgaaagccaaatctattaattactgcgagactcccaaatttaaactggacaccgtgttgcagaacttcagctccgataaaaaatacaaagacagctatttaaaggatatcctcgggcactacgtcggctcctttgaagatccttaccattcccactgcatgaaagtgacagctcagaactcagataagaactacaaggccgaatacgaagaggatcgcgggaagggcttcttcccccagacgataacacaagagtatgaagctataaagaagctcgatcagtgtaaagaccatacttataaggtccaccccgacaaaaccaaatttacgcaggtgactgattcacctgttttgctgcaagctcaggtgaattcgaagcaattgtccgatctgaattacaaggccaagcacgaatccgaaaagttcaagtgccacattccccccgacacccctgccttcattcaacacaaagtgaacgcatacaacctcagcgacaacctgtataagcaggattgggaaaagtcaaaagccaagaagttcgatataaaggtcgacgccatacccctgctcgccgcgaaagctaacacaaagaatacctctgatgtaatgtataagaaggattacgaaaaaaacaagggaaaaatgataggtgtgctgtccatcaatgatgaccctaaaatgctgcacagcctgaaagtagctaagaatcagtctgacaggctgtacaaagagaattacgaaaagactaaggccaaaagtatgaattattgcgaaacccctaaatatcagctggatactcagctcaagaatttttctgaggccagatataaggacttatacgtgaaggatgtgttgggtcactacgtcggttcgatggaagacccctaccatactcattgtatgaaagttgccgcccagaacagtgataagtcttacaaggccgaatatgaagaggacaaaggtaagtgctacttcccccagacaattacccaagagtatgaggcaattaaaaagctggaccagtgcaaagaccacacttacaaggttcaccctgataaaacaaaatttacagcggttaccgattcacccgtgttactccaagcacagctaaatacaaaacagctgagcgacttaaattacaaggccaaacatgagggcgaaaaatttaagtgccatatacctgcagacgccccacagtttatccaacacagggtgaatgcatacaatctgtccgacaatgtgtacaaacaggactgggaaaaatctaaggcgaaaaagttcgatatcaaggtggatgctatcccactgctcgcagcaaaggccaatacaaagaacactagcgacgttatgtacaagaaggactacgaaaaaagcaaaggaaaaatgatcggcgccttgtcaattaacgatgatcctaagatgttacattcactcaaaactgccaagaatcagagcgaccgcgagtatcgcaaggactatgaaaaatccaaaacaatttacactgcaccactggacatgctacaggtcacccaggccaagaaaagtcaggcaattgcaagcgatgtcgactacaaacatatattgcattcttatagctatccgcccgacagtattaatgtggacctggccaagaaggcatatgccctgcagtctgacgttgagtacaaagcggactataacagctggatgaaaggctgtggctgggtgcccttcggaagtctggaaatggagaaggctaagcgcgcttccgacattctgaatgagaaaaaatatagacaacatccagacaccttaaagttcactagcattgaagatgcccctatcactgttcagagcaagattaatcaagcccaaagatcagatattgcctacaaggctaagggggaagagattattcacaagtacaacctgccacccgatcttccacagtttatccaagcaaaggtcaatgcatataatatatctgaaaatatgtataaggcagacctgaaagatttatctaaaaagggttacgacctcaggactgacgcaattccgattagggcagcaaaggctgctcggcaggctgcaagcgacgtacagtataaaaaggattatgagaaagctaaggggaagatggttggattccagtcactacaggatgatcccaaactcgtccattatatgaacgtggctaagatccaaagcgaccgtgagtataagaaagattacgaaaagaccaagtctaaatacaatacaccacacgatatgtttaacgtcgtcgcagcaaaaaaagctcaggacgtagtgagcaacgtcaactataagcattctctgcatcattatacctacttgcctgatgccatggacctggagctgagcaagaatatgatgcagatacagtctgacaacgtgtacaaagaggattataataactggatgaaagggatcggttggattcccattgggtctctggacgttgaaaaggtgaagaaggccggagacgcgctcaatgaaaaaaaataccgacagcatccagatacactcaagttcacttctattgtggattcacccgtgatggtgcaggccaagcagaacacgaaacaggtttccgatattctgtataaggctaagggggaagacgtgaagcacaaatacactatgtccccagacctgccacagtttctgcaagccaaatgtaatgcatacaatatctcagacgtgtgttacaaacgcgactggtacgacctgattgctaagggaaacaacgtacttggtgacgccattccaatcactgccgccaaggcgtctcgaaatatcgccagcgattacaaatataaggaagcctatgaaaagagtaagggcaagcacgttggctttcggagtctacaggatgatccaaagctcgtgcactacatgaatgtggctaaactccagagtgatcgagagtataaaaagaactacgagaatacaaaaacatcctaccatacccctggcgacatggtcagcattacagcggccaagatggctcaagacgtagcaaccaacgtcaattacaagcagcctttgcaccattacacgtaccttccagacgcaatgtccttagaacacactagaaatgtgaaccagatacagagcgacaatgtatataaggacgaatacaactcatttctcaagggcattggatggattccaatagggtccctggaagtggagaaggtaaagaaggcaggtgacgccttgaatgagaggaagtacagacagcacccggatactgtaaaattcaccagtgttccagatagcatggggatggtactggcccagcacaacaccaagcaactttccgacttaaactacaaggtggagggtgaaaaactgaaacataagtatactattgatccggaattgcctcagtttatacaggcaaaagtgaatgcactaaacatgagcgatgcacattataaagcagattggaaaaagaccatagccaaaggctatgatcttaggcccgatgctattcccattgtggccgccaaaagctctaggaacatcgcctcagactgcaagtataaagaggcttacgaaaaggccaagggtaagcaggtcggattcctatctttacaggacgaccccaagctcgtccactatatgaacgtggccaaaatccagtcagatcgtgagtacaaaaagggttacgaggcaagcaagactaaatatcacacgccactagatatggtctccgtcactgctgcaaaaaagtctcaggaagtcgcaacaaacgccaattaccgccagtcataccatcactatactttactgcccgatgccttaaatgtcgaacattcgaggaatgcaatgcagattcagagcgataatttgtacaagtccgactttaccaactggatgaaggggatcggttgggtgccgattgaaagtttagaagtggaaaaggctaagaaggccggggagatcctgtccgaaaagaagtacagacagcaccccgagaagctgaagttcacatacgcaatggacacaatggagcaggctcttaataagtccaataagcttaacatggacaaacgcttgtatacggaaaagtggaataaggataagacgaccatccacgtgatgcccgatacacctgacatccttctatctcgggtcaaccaaatcacaatgtccgataagttgtacaaagccgggtgggaagaggagaaaaagaagggctatgatctgagacctgacgctatcgccatcaaggccgccagggccagtcgcgacatagcttcagattacaaatacaaaaaggcctatgagcaggctaaaggaaagcacattgggtttagaagcctcgaggacgaccccaaattggtgcattttatgcaggtggccaaaatgcagtccgatagagaatacaagaaaggatatgagaagagcaaaacttcgtttcacacacctgtggacatgctgtcggttgtggccgctaaaaagtcccaggaagttgccactaatgctaactatagaaatgttatacatacctataacatgctccccgatgcgatgtccttcgagctcgcaaagaacatgatgcagattcagagcgacaaccagtataaagccgattacgcagatttcatgaaaggtatcggctggttgccactgggttcccttgaagctgaaaagaataagaaagctatggagatcattagcgagaagaagtacagacaacatccggataccttgaagtactcgacgctcatggacagcatgaacatggtgcttgcgcaaaataatgccaagatcatgaatgagcacctgtacaagcaggcgtgggaggccgacaagaccaaagtgcacatcatgccagacataccacagatcattctagctaaagctaatgcgataaacatgtccgataagttatacaagctgagtctggaagaaagcaagaagaagggctacgatctgcggcctgatgccatacccattaaggctgctaaagcttccagagacattgcctccgattataagtacaaatacaattatgaaaagggaaaggggaagatggttggctttcgatcgcttgaagatgatcctaagcttgtccattccatgcaggtggctaagatgcagtcggatcgggaatataagaaaaattacgaaaatacaaagacctcttaccacaccccagctgacatgctgtcagttacagcagcaaaagatgctcaagccaacataactaacacaaactacaagcacctgatccacaaatatattttgttgccagatgctatgaatatcgagctgaccagaaatatgaaccgtattcagagcgacaacgaatataagcaggattacaacgagtggtataaggggttaggatggagcccagccgggtccctggaggtggagaaggcgaagaaggcaactgaatacgcctccgatcagaagtatagacagcacccttcaaatttccagtttaaaaagctgacagactcaatggatatggttctagccaagcagaacgctcacacaatgaataaacacctatatacaatcgactggaacaaggataagacgaaaatccacgtgatgccagatacaccagatatcctgcaggcgaagcaaaaccagacactttacagccaaaagctttacaagttaggatgggaggaagcactgaagaagggatacgaccttcccgtggatgccatttccgttcaactggctaaagccagccgggacatcgccagcgactataagtataagcagggataccggaagcagctgggccaccatgtgggttttcggagcctgcaggatgacccaaagttggtactgagcatgaatgtcgcaaagatgcaatcagagagggagtacaaaaaggactttgagaagtggaaaaccaagttttcttctccagtggacatgcttggcgtcgtgttagctaaaaagtgtcaggagttggtgtctgatgtggattacaaaaattacctgcaccagtggacatgcttaccagaccaaaatgatgtggtccaggccaagaaggtatacgagctgcaatctgaaaatctttacaagtccgacctggagtggcttcgggggattggctggagcccacttggctccctggaggccgagaagaacaagcgcgcctctgagattatttctgaaaaaaaatacaggcaaccacctgacagaaacaaatttacttcaattccagacgccatggacattgttctggctaagaccaatgcaaagaacaggtcggatagactctatcgagaggcctgggacaaggacaagactcagattcacataatgcctgacacacctgacatcgtacttgctaaagccaatcttataaacacctccgacaaactgtaccgcatgggctacgaggaattaaagagaaaaggctacgatctgcctgtggacgctatcccaattaaagccgcaaaagcatccagagaaatcgcgtccgagtacaagtacaaggaaggctttcgcaagcagctcggtcaccatatcggtgcgaggaacatagaagacgacccaaaaatgatgtggtcgatgcacgtggctaagatccagtccgatcgggaatacaagaaagactttgagaagtggaaaactaagttctcttcacctgtggacatgctcggcgtagttctcgcgaagaaatgccagactctcgtgagtgacgttgactacaagaactacctacaccagtggacctgcctcccagaccaaagcgatgtcatccatgcccgacaggcatatgacctgcaatccgataatctgtacaaatctgatcttcagtggctgaaaggaataggctggatgacatcaggctctctggaggatgaaaagaataagagggcaacccagatcctgagcgatcacgtgtatagacagcaccccgatcagttcaaattctcctcactgatggactcgattcccatggtcctcgccaagaacaacgcaattaccatgaaccaccgcctatataccgaggcttgggacaaagacaagaccacggttcatatcatgccagacaccccagaggtgctgctcgcaaagcagaataaagtcaactactctgagaaactctacaagcttggccttgaagaggccaaacgcaaaggctacgatatgagggtggatgctataccaatcaaggcggcaaaggcatctcgggatatagcttctgagttcaagtacaaggaaggctacagaaaacagttaggccatcatatcggagccagagccatccgggatgatcccaagatgatgtggagcatgcatgtcgcaaaaattcagagcgacagggagtacaaaaaggattttgagaagtggaagacaaaattcagcagcccggtggacatgttaggggtcgtgctggcaaaaaaatgccaaacactggtcagcgacgtggactacaagaattatctgcaccagtggacttgtctgcccgaccagagcgacgtgatacatgcacggcaggcgtatgatctacagagtgacaacatgtataaaagcgacctacagtggatgagagggattgggtgggtcagtatcgggtctctggatgtcgagaagtgcaagcgggctaccgagattctgtcagacaaaatttatcggcagcccccagaccggtttaaattcactagcgtgacagacagcttagaacaggtattggccaagaacaatgccatcaccatgaataaacggctgtacaccgaggcctgggacaaagataagacacagatccatattatgcctgacacacctgaaattatgctggcccggcaaaataaaatcaactattcagagaccctttataagctggcaaatgaggaggcgaagaagaagggttacgacctcagatcggatgctataccaatagtggcggcaaaggcgagccgcgacgtcatttcagactataagtataaagacgggtatcggaaacagttaggtcatcacatcggagccagaaacatcgaagacgatcccaaaatgatgtggagcatgcacgtcgcgaaaattcagagtgatagagaatacaaaaaagacttcgagaagtggaaaactaaattctcctcacccgtcgatatgctgggggtcgtattggccaaaaagtgccagacactcgtgtcagatgtcgattacaaaaattacttgcacgagtggacatgcctgccagaccagaatgatgtgatccatgctagacaggcctacgacttacagagtgacaatatctataagtcagatctgcagtggctgcggggaatcggttgggttccaatcggaagcatggatgtcgtcaagtgcaaacgggctgccgagatcctctctgacaatatatatcgacagccacccgataaactgaagtttacatcggtaaccgatagtctcgagcaggtgctcgcaaagaataacgcacttaacatgaacaagagattgtacactgaagcctgggacaaagataaaacccaggttcacattatgccagatacccccgagattatgctggcccgtcagaataagattaattattctgaatccctgtaccgacaggctatggaggaagctaagaaggagggctatgatctgaggtcggatgcaataccgattgtggccgccaaggcctcccgcgacatcgcctccgattacaaatataaggaggcatacagaaaacagctcggtcaccacatcggggcgcgagccgtgcatgatgaccccaaaattatgtggagcctccacatcgcaaaagtccagagtgatagggagtataagaaggatttcgagaagtataagacacgctattcttcccctgtggatatgctcggtatcgtgctggcaaagaagtgtcagaccttagtgtctgacgttgattacaaacatccattgcatgagtggatctgcttgccagatcagaatgatatcattcacgcacggaaagcctacgatctacagtccgataatctttacaagagcgatctggaatggatgaagggaataggatgggtccctatcgacagcctggaggttgttcgagcaaagagagccggcgagcttttgagcgataccatataccggcagcggccagagacgcttaagttcacctccattactgataccccagagcaggtcttagccaagaataacgcactgaacatgaacaaacggctgtacacggaagcctgggacaatgacaaaaagaccatccatgtcatgccagatacgcccgaaattatgctggcgaaactaaaccggattaattatagcgataagctgtacaagctggccctggaagagtctaagaaggaagggtatgacctgcgcttggatgccattcctatccaggcagctaaagcaagcagggatattgcatccgattacaaatacaaggagggctataggaagcagctaggacaccatattggggctcgcaatatcaaggatgatccaaaaatgatgtggagcattcacgttgcaaaaatccagtctgaccgggagtacaagaaggaattcgaaaagtggaagactaagttcagctccccagtcgatatgttgggcgtggtgcttgctaaaaagtgtcagatccttgtcagcgacatcgactataagcatcctctgcacgagtggacctgtctcccggatcaaaacgatgtcattcaggcccgcaaggcctatgatctgcagtctgatgctatatacaagtccgatctcgagtggctcagaggcattgggtgggtaccaattgggtccgtcgaagtcgagaaggtgaagcgagcaggtgaaatattgtccgataggaagtacagacaacccgctgaccaactgaaatttacctgcattactgacacccctgaaatcgtactcgccaaaaacaatgctctgaccatgtctaaacacctgtacaccgaggcgtgggacgcggacaaaacttcgatccacgtgatgcctgacactcccgatatacttctcgctaagagcaactcagcaaatatatctcaaaaactctacaccaaaggttgggacgagagtaagatgaaagattatgatctcagggccgatgccatcagcataaagtctgcaaaagcctctcgagacattgcttctgattataagtacaaagaggcctatgagaagcaaaagggacaccacattggcgcccaatccatagaagatgatcctaagattatgtgcgcaatccacgccggcaaaatacagtctgagcgggagtacaaaaaagaattccaaaaatggaagactaaattctcaagcccagtcgatatgctgtccatcctcctggctaagaagtgccagacactggtgactgatattgactatagaaattacctgcatgaatggacgtgtatgccagatcaaaacgacatcatccaagccaaaaaagcctacgaccttcaatccgacgccctgtataaggctgatctggaatggctgcgcggcattggctggatgccccaggggagcccggaggttttacgggtgaagaacgcacagaatattttctgcgactcagtctatcgcacgcccgttgtgaacctgaagtatacctccatagtcgataccccagaggtggtgcttgcaaagagtaatgccgaaaatatctcaatacctaaatacagagaggtatgggacaaagacaaaacaagcatacacattatgccagatactccagagatcaacctggcccgcgctaatgcactcaatgtttccaacaagctgtatcgcgagggctgggatgagatgaaggcaggctgcgatgtaagactagacgccatcccgatccaggccgccaaggccagccgggagattgctagtgactacaagtacaagcttgaccacgaaaagcagaaagggcactatgttggtaccctcaccgcccgcgatgacaataaaatccggtgggccctcatagcagataagttgcaaaatgagcgagaatatcgccttgactgggctaaatggaaagctaagattcaatctcctgtagacatgctgtctatcctccatagcaagaatagtcaagccctcgtctcagacatggattatagaaactatctccatcaatggacatgtatgccagaccagaatgacgttattcaagccaagaaggcttacgagcttcagtccgacaacgtatataaggccgacctagagtggctccgagggattggttggatgcccaacgattcagtcagcgttaatcacgccaaacatgcggcagatatcttctccgaaaaaaagtatcgtacgaaaatagagactttgaacttcacacccgtggacgaccgcgtcgattatgtgactgccaaacagtccggagagatcctcgacgatatcaagtaccggaaagattggaacgccacaaaatcgaaatacacactgaccgagacacctctgttgcatacagctcaagaggccgcgagaattctggatcagtacctttataaggagggctgggagagacaaaaagctacaggctacatactccctcctgatgcagtgccatttgttcacgctcaccactgcaacgatgttcagtcagaactcaagtataaggctgaacacgtgaagcagaagggtcattatgtaggggtcccaacaatgcgtgatgacccaaaactggtttggtttgagcacgccgggcagatccagaatgagcggttatataaggaagactaccacaaaaccaaggcaaaaatcaacatcccagccgacatggtatcggtcttagctgctaaacagggtcagaccctggtttccgatatagattatagaaattacctccaccagtggatgtgccacccagaccaaaacgacgtgatccaggctcgcaaggcatatgacctacagagcgacaatgtgtatcgagcagatcttgaatggttacgggggattgggtggatccccctggactccgtcgatcacgttagagtcaccaaaaaccaggaaatgatgtcccaaatcaaatacaaaaagaacgctctggagaactacccgaatttcagatccgtggtcgatccaccagaaatcgtattagccaaaatcaattccgtgaatcaatctgacgtgaagtacaaagagacattcaacaaggccaagggcaaatatactttctcacctgatacacctcacatttctcattctaaggacatgggcaaactctacagcactattctttacaaaggtgcttgggaagggacgaaggcctatgggtatacccttgatgagcggtatattcctattgtgggtgctaagcatgccgatcttgttaattccgaactcaaatacaaggagacctatgaaaaacagaaaggccactatctcgctggaaaggtcattggggagtttcctggggttgtgcattgcctagactttcagaaaatgcgatctgccctgaattacaggaaacactatgaagacaccaaggctaacgtgcatattcctaatgacatgatgaaccacgtcttggctaaaagatgtcagtatatactgtctgatcttgaatatcggcattattttcaccagtggacctctctcctggaggagccgaacgtgattcgcgtgcgcaatgcccaggaaattctgtctgataatgtttacaaagatgatctgaattggctcaagggaatcggctgctatgtgtgggatacaccccaaatcctgcatgctaaaaagtcctatgacttacagtctcagcttcagtatactgcagccggtaaggagaacctgcagaattacaacctggtgaccgatacgccattgtacgtgacagccgtgcagagtggcatcaacgcttcagaggtcaagtataaagaaaactatcatcagataaaggacaagtataccacagtacttgaaacagtggattatgaccggactcgcaacttgaagaatctctactcttcaaacctgtacaaggaggcttgggaccgtgtcaaagccacttcctatatcctaccttctagcacactgtccctgacccacgccaagaaccagaagcaccttgcctctcacataaaatacagggaggagtatgaaaagttcaaggccctctatacgttgcctcgctcagtggatgacgacccgaacacggccagatgtctccgggtcgggaaactgaacatagatcggttatacagaagcgtgtatgaaaaaaacaaaatgaagatacatattgtgcctgatatggtggagatggtgactgcaaaggattcacagaagaaggtgtctgagatagactatagactgcggcttcatgaatggatctgtcacccagaccttcaggtgaatgatcacgtacgaaaagtaacagaccaaatatcggacatagtgtataaggacgatctgaactggctgaaggggataggttgctacgtgtgggacacgcccgagatcttgcacgctaaacacgcctatgatctgagagatgacataaagtacaaagcgcacatgctcaaaacacggaatgattataaactcgtgaccgataccccagtatacgtccaagctgtcaaatcgggtaaacaactgtcagatgcagtgtaccactacgactacgtgcactctgtgagggggaaggtggccccgactacaaagacagtggacctcgaccgagcactgcatgcctacaaactgcagtccagtaacctttacaagacatcactcagaacacttcctacaggttatagactccctggagataccccacacttcaagcacatcaaggacacccgttacatgtcctcctactttaagtataaagaggcatatgaacacaccaaggcttatgggtacacccttggcccgaaggacgtgccctttgttcacgtgcggagagtgaacaatgtaacatcggaaagactgtacagagagctgtaccacaaactcaaggacaagattcatactacccctgacacacccgaaattcgacaggtcaaaaaaacccaggaagctgtgtcagagctaatctacaaatcggacttttttaagatgcaagggcacatgatctcattgccgtacacccctcaagttattcactgcaggtatgttggtgatatcacaagcgacatcaagtacaaggaagacctgcaggtcctcaagggctttgggtgcttcctgtatgatacaccagacatggttcggtccagacacctcagaaagctgtggagcaactatctgtacactgacaaagctcggaagatgcgggataagtacaaggtggtcttagacacccccgaatatcggaaagtgcaggagctaaagactcacttgagcgaactggtatatcgggccgcagggaaaaaacaaaaatccatatttaccagcgttcctgatacgccggatctgttgagggcgaagagaggacagaagctgcagagccagtacctgtatgttgaactcgccactaaagaaaggccccaccaccacgcgggtaatcagactacagccctgaagcacgctaaggatgtgaaggatatggtgtcagaaaaaaagtataaaatacagtacgaaaaaatgaaagataaatacacccccgtgcccgatacgcctattctcattcgggccaaacgagcctattggaacgcctcagatctccgatacaaggagacgttccagaagaccaagggaaagtaccacactgtgaaggatgcactggatatcgtgtaccatcgcaaggttaccgatgacatctccaaaatcaagtacaaagaaaactatatgtctcagttgggtatttggaggtcaataccagatcggcccgagcacttccatcacagagctgtgactgatacagtctctgacgtgaagtacaaagaggacctgacttggctgaagggcatcgggtgctacgcctatgacacccccgattttaccctcgccgagaagaacaaaactttatacagtaaatacaagtacaaagaggtgttcgaacgaaccaagtctgactttaagtatgtcgccgacagtcccatcaacagacatttcaagtatgctacacaactgatgaacgagaagaagtaccgagcagattacgagcagcgaaaagacaagtaccaccttgtggtggacgaacctcggcacctgttggccaagactgcgggagatcagatctcccagataaagtacaggaagaattacgaaaagtctaaagacaaatttacttctattgtggatacaccagagcacttaaggaccactaaggttaacaagcagatctccgacatcctttataagctcgaatacaacaaagctaagccaaggggctatactacaatccacgatactcctatgttgctacacgtgagaaaggtcaaagatgaagtgtctgacttaaagtacaaggaggtctaccagcgaaataaatcaaactgtaccattgagccagatgcagtgcacataaaggcagccaaagacgcatacaaagtgaatacaaatctggactacaagaagcagtatgaggccaacaaggctcattggaaatggactcccgatcggcccgattttttgcaagccgctaaatcatcactgcagcaatctgacttcgagtacaaactggaccgggaatttctgaaaggatgcaaactgtccgttacggatgacaagaataccgttttggctttgcgcaatactctgatcgaatctgatctcaagtacaaggagaagcatgtaaaggagagaggaacatgccacgcagtcccagacacaccccagatcctgttagctaagactgttagcaatctggtgtctgagaataagtacaaggaccacgtgaaaaaacatctggcgcaagggagctataccactttacccgagacacgggacactgttcatgtgaaagaggttactaagcatgtgtcagacacgaattataaaaaaaaattcgttaaagagaaaggaaaaagtaattactccataatgctcgagcccccagaggtcaaacacgcaatggaagttgcaaaaaagcagtcagacgtggcttaccggaaggatgccaaggagaacttacattacacaacggtggcagaccgtccagatataaaaaaagctacacaggcggccaagcaggcgtcagaggtggaataccgagctaaacatcggaaggaagggagtcacggtctgagcatgttgggcagaccagacatagagatggcaaagaaagctgcaaaactctcgagtcaggtgaagtatcgcgaaaatttcgacaaagagaaaggcaaaacgccgaagtacaatcctaaagatagccagctgtataaggtaatgaaagatgcaaataacctcgctagtgaggtcaagtataaagctgacctaaagaagctgcataagccagtgacggatatgaaagaatcactcatcatgaaccacgtgctaaacacttctcagctggcttcaagctaccagtataaaaagaaatacgaaaaaagtaaggggcactatcacaccatcccagataatctagaacagttacacttgaaagaggctaccgaactgcagagtatagtgaagtacaaagaaaagtacgaaaaggagaggggaaaacccatgctcgactttgagacccccacttacataacagccaaggaatctcagcagatgcaaagcggtaaggaataccgcaaggattatgaagaaagtattaaaggtagaaacctgactggactggaagtaacacccgctctgctacacgtcaaatatgctactaagatcgctagtgagaaggagtaccgcaaagacctggaggaatcaattaggggaaaaggcttgacagagatggaggatactccagatatgcttcgcgctaaaaacgcaacacagatcctcaatgaaaaggaatacaagcgggatctcgaactcgaggttaaaggtaggggactgaatgcaatggcgaatgagacgcccgacttcatgagagctcgaaatgctacagacattgccagccagatcaaatataagcagtccgctgagatggagaaggcgaactttactagtgttgtcgacacccccgaaatcattcacgcccagcaggtgaagaacctgtccagccaaaagaaatacaaggaggatgcagagaaaagtatgtcttactatgagacagtactggacacccctgagatccagagagtgagagagaatcaaaaaaacttttcgctgctgcagtaccagtgtgacctcaaaaactctaaggggaagattaccgtcgtgcaggatactcccgagattctgcgcgtaaaagaaaaccagaaaaacttcagctcagtgctgtacaaggaagacgtgtccccgggaacagcgattgggaagactccagagatgatgcgcgtgaagcagacgcaagatcacatttcgagcgtaaaatacaaggaggcaataggacagggtactccaatccctgacctcccagaagttaaacgcgtgaaggagacacagaagcacatctcgtctgtgatgtacaaggagaacctgggcacgggaattcctaccacggtgaccccggaaattgagcgggtcaagaggaaccaggagaatttttcatccgtcctttataaagagaacctggggaagggtataccaactcccatcacccccgagatggagcgcgtgaaacggaatcaggagaacttttccagcgtactctataaggagaacatgggaaaagggaccccgttagccgtgactccagaaatggaaagagtgaagcacaatcaagagaacatttcctctgtcttatataaggagaatgtggggaaagctaccgcaacgccagtgacgccagagatgcagcgcgttaaacgcaaccaggagaatattagtagcgtgctgtataaagagaatcttggaaaagcgacacccactccattcactcccgaaatggaacgggtcaagaggaatcaggagaacttcagctctgtgctttataaagagaacatgcgcaaagctactccaacaccagttaccccagaaatggagagggctaagagaaatcaagagaacatctcgagcgtcctgtacagcgactcttttcgaaaacagattcagggcaaggcagcatatgtattggatacacctgaaatgcgtcgggtgagagagactcagcgccacatcagcactgttaaatatcacgaagatttcgagaagcataagggttgctttactcccgtcgtcactgatccgattacggaaagggtaaaaaagaatatgcaggacttcagtgacatcaattaccgggggattcagaggaaagtggtggaaatggagcagaaaaggaacgatcaagatcaagagaccatcaccggtcttagggtgtggcgaaccaaccccggcagcgtcttcgactatgatcccgccgaagacaacattcagtcacggtcgctccacatgataaacgttcaggcgcagcggaggtctagagagcagagccgttccgcctcggccttgtctattagcgggggggaggagaaatcagagcactccgaggctccggaccatcacctgtcgacgtatagtgacggaggcgtattcgccgtcagtacagcttacaagcacgctaaaaccacggagctgcctcagcagaggtcttcatctgttgcaacgcaacaaaccacagtgtccagcatcccatcacatcctagcactgcgggaaagattttccgcgccatgtacgactatatggccgcggatgccgacgaagttagcttcaaagatggagacgccatcatcaatgtccaggcaattgacgaaggttggatgtacggcacagtgcaacgaaccggccgcactggcatgctacctgccaattatgtggaagcgatttag

SEQ ID NO: 125925 - DNA, 1503 bp, Artificial Sequence
  Description of Artificial Sequence: Synthetic coding sequence
atggagagggtgaagcgcaatcaggagaactttagctccgtgctttacaaggaaaatttgggcaccggaattcccatccctatcacccccgagatgcagagggttaaacataaccaggaaaatctcagctccgttctatacaaggagaatatgggcaaggggactcccctgcccgtcacccccgagatggagcgggttaagcacaaccaggaaaatatttcctctgtcctctacaaggagaacatggggaagggcacgcctctgcctgtcacaccagagatggaacgagttaagcataatcaggaaaatatcagcagtgttctgtacaaagagaatatgggtaagggtacccctctggcggtgacccccgaaatggagcgagtgaaacataaccaggaaaacatttctagtgtgctgtacaaagagaacgttggcaaggccactgcaacacctgtgactcccgaaatgcagcgggttaaacggaaccaagaaaacatcagctccgttttgtacaaggagaacctcggaaaagccactcctacgccttttacacctgaaatggagagagtaaagagaaaccaagaaaatttctctagcgtcctgtacaaagagaatatgcgcaaggcgactcccactcccgtgacgcctgaaatggagcgagcaaaacgcaaccaggagaacatctcttcagttctctacagcgactcattcaggaaacagatccaagggaaggccgcatatgttttggatacacctgaaatgcggcgcgtccgagaaacacaacgacacatatcaactgtgaagtaccatgaagacttcgagaagcacaaaggatgtttcacccccgtggtcaccgacccaattaccgagagagtgaaaaaaaatatgcaggattttagtgatatcaattatcgagggatacagcgcaaagttgtggaaatggagcagaaaagaaacgatcaggatcaggagactattacaggcctgagagtgtggcgcaccaatcccggcagtgtgtttgactacgaccccgctgaggacaatatacagtcaaggagcctacacatgatcaacgttcaggcccaaagacgcagtcgagagcagagtagatctgccagcgcactctctattagtggtggcgaggagaagtctgagcactctgaggctccggatcaccatttaagcacatactccgatggcggggttttcgcagtttcaacagcgtacaaacacgcgaagactaccgagctcccccagcagcgatcctcctcagttgcaacacagcagactaccgtgtcttcaattccatcccacccaagcaccgcaggaaaaatctttcgcgcaatgtatgattacatggcagcagacgctgatgaagtcagtttcaaagatggcgacgccatcatcaatgttcaagcgatcgatgaaggatggatgtatggcacagtacagcggactgggaggactggcatgttgcccgcaaattacgtggaggcgatctag

SEQ ID NO: 125926 - DNA, 7878 bp, Artificial Sequence
  Description of Artificial Sequence: Synthetic coding sequence
atgcccgacactcccgagatcaatctggcacgtgcgaatgcactgaatgtgtccaacaagctgtatcgcgaggggtgggacgaaatgaaggcaggatgtgacgtgaggctagatgccatccctattcaagcagctaaagcctcgcgggagattgcttccgattacaagtacaaactggaccatgagaagcagaaggggcactacgtcggaaccctcacagcccgggatgataataagatcagatgggctttgatcgccgacaaactacaaaatgaaagggagtaccgcctcgattgggcaaaatggaaggcaaagatacagagcccagtggacatgctgtctattctccacagcaagaattcccaggcactggtttcagacatggactaccgtaactaccttcatcagtggacgtgtatgcctgaccagaacgacgtgatccaggcaaagaaggcatatgagctgcagagcgacaacgtatacaaagctgatctggagtggcttcggggcattgggtggatgcctaacgattctgtgagcgtgaaccatgccaagcacgccgctgatatcttttccgagaagaaatatagaaccaagatagagactctaaatttcactccggtggacgaccgggtcgactatgttactgccaaacagtccggggagatcctggacgatatcaagtatcggaaggattggaacgctactaaatccaaatatacattgacagagactcctctcctgcatactgcacaggaggccgcccggatactggaccagtacctgtacaaggaggggtgggagcgacaaaaggctactggctatattctgccccctgatgccgtcccattcgtccatgcacaccactgcaacgatgtgcagtccgagctgaagtataaggcggaacacgtgaagcaaaagggacactacgttggcgttcccaccatgcgtgacgacccaaagctggtgtggtttgagcatgccggccagattcagaatgaaaggctttacaaagaagattaccataagactaaggctaagataaacatcccagctgatatggtctccgttctggcggccaagcagggccagacactcgtttccgatattgattatcggaactaccttcaccaatggatgtgtcatcccgaccagaatgacgtgatccaggctcgcaaagcatatgacctgcagagcgataatgtgtacagagccgacctcgagtggctgcgcggcatcgggtggatccctttagattcagtggaccatgtgcgagtgaccaagaaccaggagatgatgtctcagattaagtacaagaagaacgccctggaaaactaccccaacttccgctccgttgtggatcctcctgagattgtgctggccaaaatcaacagcgtgaatcagagtgacgtaaagtacaaggagacgtttaataaagccaagggaaagtataccttctcacccgatacaccacacattagccattcaaaggacatgggcaaattgtactctaccatactgtataagggggcctgggaaggcaccaaggcttatggatacactctggacgagcgctacatccctatcgtgggtgcaaaacatgccgacctggtcaatagcgagctaaagtacaaggagacgtatgagaagcagaagggtcactacttagctggaaaggtgatcggcgagtttcccggggtggtgcactgcctcgacttccagaagatgcggtccgcacttaattatcgcaagcactacgaggacacaaaggctaatgtgcacatccccaacgacatgatgaatcacgtgctcgccaagaggtgccaatacattctgtcggatctggaatatcgacattactttcaccagtggacctctctcttagaagaaccaaacgtgatacgagtgagaaacgcccaggaaatactaagtgacaacgtgtataaagatgacctcaattggctgaaggggatcggctgttacgtctgggacaccccacagatcctccacgctaaaaagtcctacgacttgcaatcccagttgcagtacaccgctgctggaaaggagaaccttcagaattataacctcgtgacagatacacccttatatgtgactgccgtgcagtccggaataaacgcctctgaagtgaaatacaaagaaaactaccaccagatcaaggataagtacaccactgttctagaaaccgtggattacgacaggacccgcaacctgaagaacctttattcgtcaaatctatataaggaagcatgggaccgagttaaggcaacatcatatattcttccctctagcactttatctctgacgcatgccaaaaaccagaagcacctggccagccacataaagtatcgagaggagtatgagaaattcaaggcactgtacacactcccgaggtccgttgacgacgaccctaatactgcacgctgcctgcgcgttggcaaactgaacattgatcgtctctatcggagcgtatacgagaagaataagatgaaaattcacatcgtgccggacatggttgaaatggtaactgcaaaggactctcagaaaaaggtttcagagatcgactatcgactccgcctgcacgagtggatctgtcatcctgatctgcaggtcaacgatcacgtgagaaaggtcacagatcagatctccgacatcgtttataaggacgacttgaattggctcaagggcatcggttgctacgtttgggacactcccgaaatcttgcatgctaaacatgcatacgatctgagggatgatatcaaatataaggcgcatatgctcaaaacccggaacgactacaagctggtgacagacacacctgtttatgtgcaggccgtgaaaagcggcaaacaactcagcgatgccgtataccactacgattatgtgcatagtgtcagagggaaggtggctccgaccactaaaactgttgatttagatagagctctacatgcctataagcttcagtcgagtaacctgtataagacctctttacgcactttgcctaccggttaccgcctccctggagatacccctcacttcaaacacatcaaagatacacggtatatgtcctcttattttaagtataaagaggcatacgaacacactaaggcttacgggtacactctgggacccaaggacgtccctttcgtccatgttcgtagagttaacaatgttacctctgagcgactctaccgtgagctgtaccataaactgaaagacaagatccatacgacgccagacaccccagagatccgacaggtgaaaaagacacaagaggccgtttctgaactgatatacaaaagcgacttcttcaaaatgcaaggtcacatgatctctcttccctacactccgcaggtaatccattgcaggtacgtcggagatataacgtctgacattaagtacaaggaagatctgcaggtactcaagggctttggttgcttcttatatgatacacccgatatggttaggtcgcggcatctgcgcaagctatggagtaattacttatacacagacaaggcccgcaagatgagagataaatacaaggtcgttctcgatactccagaataccggaaggtgcaagaactgaaaacacacctctcagagcttgtataccgcgctgccgggaagaagcaaaagtcgatcttcacaagcgtgccagacacacccgacctacttagggcaaaaagaggtcagaagttgcagtctcagtacttgtacgtggagctcgcaaccaaagagaggccacatcatcacgctggaaatcaaactactgcattaaagcacgccaaggatgttaaagacatggtgtctgaaaagaagtacaagattcagtacgagaagatgaaagacaagtataccccagtgccagacacccccattctgattcgggcaaaaagggcctactggaatgcatctgacctccgttacaaggagacattccagaaaactaaggggaagtaccataccgtaaaagacgcactggacattgtgtaccacagaaaggtgacggacgacatatcgaaaattaagtataaagagaactacatgagtcagttgggtatttggagatcgatcccagatcgcccagagcatttccaccatcgagcagtgacagacaccgtcagtgacgtaaagtacaaggaagatttgacgtggttgaaggggattggttgttacgcttacgataccccagattttaccctggctgaaaagaataagaccctgtacagtaagtacaaatacaaggaggtgttcgagaggactaaaagtgatttcaaatacgtcgccgactcaccaatcaaccgccacttcaaatatgctacccagctaatgaacgaaaagaaatatagagctgattatgaacaaaggaaagacaaataccatctcgtggtagatgaacccaggcatctgttagccaagacagcgggagatcagatttctcaaatcaagtaccgcaagaattacgagaagtctaaggacaaattcacttccatcgtggacacgccggaacacctgagaaccacaaaggtcaataagcagattagtgatattttgtataaacttgagtacaataaagccaagccgaggggatacaccacaatacatgataccccgatgctcctccatgtgaggaaagtaaaagacgaggttagcgacctcaagtacaaagaggtctaccaacgaaataaatccaattgcaccattgaacctgatgctgtgcacattaaagctgcaaaagacgcttataaagtcaataccaacctcgactataaaaaacaatatgaggccaacaaggctcactggaaatggacgcctgacagacccgactttctgcaggccgccaaatcctctcttcagcagtcagatttcgagtacaagctcgaccgcgagttcctgaaggggtgcaaactgtcggtgacagacgacaagaacacagtcctggctcttcgtaacactctcattgaatcagatctaaagtacaaagaaaaacatgtgaaagagaggggcacatgccacgctgtgccggatactccgcaaatcctgcttgccaagaccgtcagcaaccttgtctccgaaaacaagtataaagatcatgtgaagaaacacctcgcacagggatcctacaccactttgccagaaaccagggacaccgtgcatgtgaaagaagtaactaagcacgtttctgatacaaattacaagaagaagttcgtgaaggaaaaagggaaatctaactactctatcatgttggaaccaccagaggttaaacatgccatggaggtggccaagaagcagtcagatgtcgcctaccgcaaggatgccaaggagaatctccattatactaccgtcgctgaccgtccggatattaagaaagccactcaggccgcaaaacaggccagcgaagtggagtatcgagccaagcatcggaaggaaggcagccacggtctgagtatgcttggaagacccgacatcgagatggcaaagaaagctgctaagctcagctcgcaggttaagtaccgtgaaaacttcgacaaagagaaaggcaagacaccgaagtacaaccctaaggattcccagctttacaaagttatgaaagacgccaacaatctggctagcgaggtgaaatacaaggccgacctgaagaagttgcacaaaccggtgacagatatgaaggagagccttattatgaatcatgtcttgaatacgtctcagctggcctcctcctaccagtacaaaaaaaagtacgaaaaatctaagggccactaccacactattccagacaacctagagcagttacatcttaaggaggctacggagctacaatctattgtgaaatataaggaaaagtatgaaaaggagcgcggcaagccaatgttggactttgagaccccaacatatattacggccaaagagagccagcagatgcagagcggcaaagaatataggaaggactacgaggaaagcatcaaggggcgcaatttgacagggttggaagtcactcctgctctcttgcatgtgaagtacgctaccaagatcgcaagtgagaaagaataccgtaaggacctggaggagtcaatccgaggaaagggcctaaccgagatggaagacacccctgatatgctcagggctaaaaacgccacgcagatattgaacgagaaggaatataagcgtgatttagaattagaggtgaaaggcagaggtctcaacgcaatggccaacgagacaccggatttcatgcgagccaggaacgccactgacattgccagtcaaattaagtataagcaatctgccgagatggagaaggcgaactttacatcggttgtggatacacccgaaatcatccacgcccaacaggtcaagaacctgagctctcagaaaaaatataaggaggatgcagaaaaatctatgtcttactatgaaaccgtgctggacacgcctgaaattcagagggtccgggagaatcagaagaatttctccctgcttcaatatcagtgcgatttgaagaacagtaaaggcaagattacggtggtgcaagacactcccgaaatactacgggtaaaggaaaaccagaaaaacttcagcagtgtgctctataaggaggatgtatctcccgggaccgcgatcggtaaaacgccagaaatgatgcgcgtcaaacagacccaggatcacatctcctccgttaaatacaaagaagccattggccaagggacccctattcctgatttgcccgaggtgaagcgggtaaaggagacccaaaagcacatcagcagcgtgatgtacaaggagaacctgggaaccggaatacctaccaccgtcactcccgaaatagaacgtgtgaagcgcaatcaagagaacttctcctcagtgttatacaaggagaatatgggtaagggtacgccactgcctgtcacccctgaaatggaacgcgtaaagcacaaccaggagaatatctccagcgtgctctataaggaaaacgtggggaaggccacagctacaccagttacacctgagatgcagcgagttaaaagaaaccaggaaaatattagctccgtgctgtacagcgattcatttcgcaagcaaatccaggggaaagccgcgtatgtgcttgatactcctgagatgcggagagtgcgcgagacacaaaggcacatttcgaccgtgaaataccatgaggattttgaaaaacacaaaggctgcttcacccctgtagtcaccgaccccattactgaacgggttaagaaaaatatgcaggatttttccgacattaactaccgtgggattcagaggaaggtcgtcgagatggagcagaaacgcaatgaccaagatcaagagacaatcaccgggctgagggtgtggcgcacaaaccctggttcagtgttcgactatgatcccgccgaagataatatacagtctcgatctctgcacatgatcaacgtgcaagcccagcggcgatccagggagcagtcgcgttcagcaagcgccttgagcatctccggcggcgaagaaaagagtgaacatagcgaggctcctgatcaccatctctccacgtacagcgatggaggagtgttcgcggtgagtacagcctacaagcacgctaagacaacagagttgccacagcagcgctcatcgtccgtcgccactcagcagaccacagtgtcatccattccaagccacccctctaccgccggaaagatctttcgagccatgtacgattacatggccgctgatgcagatgaggtcagtttcaaagatggtgacgccattatcaacgttcaggcgatagacgaaggatggatgtatgggaccgtacaacgaaccggacgcactggcatgctgccagctaactacgttgaggcaatttag

SEQ ID NO: 125927 - DNA, 25578 bp, Artificial Sequence
  Description of Artificial Sequence: Synthetic coding sequence
atggcggacgacgaggattacgaggaggttgtggagtactacaccgaggaggtggtgtacgaggaagtgcctggcgagacgataacaaagatttatgaaaccacaaccacacgcacctcagactatgaacagtcagagacatcaaaacctgcgttggcccagcccgctcttgctcagccagccagcgccaaaccggtggagagaagaaaagtgattcggaagaaagtggacccctctaaatttatgacaccctacatcgcgcattcacagaaaatgcaagatctgttctctccgaataaatacaaagaaaagtttgaaaagaccaaaggccaaccctacgcctctactacagatacccccgagctccgccgtattaagaaagtccaagaccagctgtctgaagtgaaatatagaatggacggcgacgtggccaaaactatttgtcacgtggacgagaaagcaaaagacatcgagcatgccaagaaagtttctcagcaggtatcaaaagtactgtataagcaaaactgggaggatacaaaagataagtaccttctgcctcctgacgcgcctgagctggttcaggctgtgaaaaatactgcaatgtttagcaagaaactgtacacagaagactgggaggctgacaagagcttgttttacccttataatgactcccccgagctaaggcgggtagcacaagcccaaaaggctctgtctgatgttgcctataagaagggcctggccgaacagcaggcacagttcaccccacttgcggacccccctgacatcgagttcgcaaaaaaagttacaaatcaagttagtaaacagaaatacaaagaggactatgagaacaaaattaagggcaagtggagcgagaccccctgcttcgaggtggccaacgctagaatgaacgctgataatatctccaccagaaagtaccaggaagattttgaaaatatgaaagatcagatatattttatgcagacggaaactcccgagtacaagatgaataagaaagctggcgtcgccgctagcaaagtgaaatataaggaggattacgagaagaacaagggcaaggctgactacaacgtcctgccagctagcgaaaacccacagctaaggcaactgaaagccgccggagatgcccttagcgataaattatacaaggagaactatgagaagacgaaggccaaatcaattaattactgcgagacacccaagttcaagctcgacactgtgctgcaaaacttttcgagtgacaagaaatataaagactcctatctgaaagatattctggggcactacgtggggtctttcgaggacccatatcattcacattgcatgaaagtgactgctcagaatagcgacaaaaattacaaagctgagtacgaggaggataggggtaaaggattcttccctcaaaccatcactcaggaatacgaggccattaagaagctcgatcagtgcaaggatcatacgtataaagtacaccccgacaagaccaaattcacacaggtgactgattcaccagtgctgctccaagcacaggtcaacagtaaacagctgtccgaccttaactacaaagctaagcatgaatctgagaagttcaagtgtcatatacctccagatacaccggcattcattcagcacaaagtaaacgcctataacttgagtgacaatctatataaacaggactgggaaaaatctaaggccaagaagtttgatattaaggtagatgcaatcccccttcttgctgccaaagccaatacaaaaaacacctccgacgtgatgtataaaaaagattatgagaaaaacaaggggaagatgatcggagtgctgagcatcaacgatgaccctaaaatgctccactctttgaaagtcgccaagaaccaatcggacaggctgtacaaggagaactacgagaaaacgaaagcaaagtctatgaattattgtgagacccccaaataccaactggatacacagctgaagaacttctccgaagctcgctacaaggatttgtacgtaaaagacgttctgggacactacgtcggcagtatggaggatccctatcacacacattgtatgaaggtcgcggctcagaacagtgacaagtcatacaaggcggaatacgaggaggataaaggcaagtgctacttccctcagactattacacaggaatatgaggccattaaaaagctcgaccagtgcaaggaccacacttacaaagttcacccagataaaaccaaatttaccgcagtgactgatagccccgtgctgcttcaggctcaattgaacacgaagcaactgagcgacctgaattataaagcaaaacatgagggtgagaagtttaagtgccacattcccgccgatgccccccagttcattcagcatagagtgaacgcttataatctctcagataatgtgtacaagcaggattgggagaaaagcaaagctaagaagttcgacatcaaagttgatgcaattccactcctggctgcaaaagccaacacaaaaaatacatccgacgtgatgtacaaaaaggattacgagaaatctaagggtaaaatgatcggcgccctctcaattaacgatgaccccaagatgttgcattctctgaaaactgccaagaaccagtcagacagagagtatcggaaagactacgagaagtcaaagaccatttataccgcccccctcgacatgctgcaggtcacacaggctaagaaatcccaggccatcgctagtgatgtggactataaacacattctccacagttactcttatccacccgactcaattaacgtcgatctggcaaaaaaggcctacgctttacaatccgacgtggagtataaggccgactacaactcgtggatgaaagggtgtggatgggtccccttcggttctctggagatggaaaaagcaaagagagcttccgatatcttgaatgagaaaaagtaccgtcagcatccagacaccctcaagttcacatctattgaagacgcccccatcacagtgcagagcaaaatcaaccaggcgcagagatccgacatcgcctataaggccaaaggggaggagatcatccacaaatataacctgccacctgacctgcctcaatttatccaggccaaggtcaatgcctataatatttccgaaaatatgtataaggccgatctcaaagatctctcaaagaaagggtacgacctcaggacggatgctatccccatccgagccgccaaggcagcgaggcaggcagcatctgatgtgcagtataaaaaggactatgagaaggctaagggaaaaatggtgggatttcagtcactgcaggacgatcccaagcttgttcattacatgaacgtggctaagatccagtctgaccgcgagtataagaaggattacgagaagacaaagagcaagtacaatacccctcacgacatgtttaatgtcgtggctgccaagaaggcccaggacgtggtctctaacgtaaattataagcactccctgcaccactacacatacctgccagatgctatggaccttgagctttcaaaaaatatgatgcagatacagtccgacaatgtgtacaaagaggactacaataattggatgaagggaattggatggatcccaattggatcgctggatgtcgagaaggtgaagaaagcgggcgatgctctcaacgaaaagaaatatcgacaacatcccgatacacttaagttcacatcaatcgtggacagccctgtaatggtgcaggctaaacagaacaccaaacaggtgagtgacattttatacaaggccaagggagaagacgtgaagcacaagtatactatgtcccctgacttgccgcaatttcttcaggcaaagtgtaacgcgtacaacatatctgatgtgtgctacaagagggattggtacgacctgattgccaaaggaaacaacgtcttgggagatgccataccaatcacagctgccaaagcctcaaggaatatagcatccgactacaaatacaaggaagcttatgaaaagagtaaaggaaagcacgtgggttttcgctcacttcaggatgaccccaagctggtacattatatgaacgtggccaaattgcagagtgaccgggagtataagaaaaactatgaaaacactaagacatcctaccatacacctggcgacatggtgagcattactgcagctaagatggcccaagatgtggcaactaatgtgaattacaagcagcctctccatcattatacctatcttccagatgcaatgagtttagaacatacccgcaatgttaatcagatccaaagtgacaacgtgtacaaggatgagtacaattccttcctgaagggaattggatggatcccgatcggcagcctggaagtggaaaaagttaagaaagcgggtgatgctctgaatgaacgtaagtaccggcagcatccagataccgtgaaattcacttccgtacctgacagcatgggcatggtcctcgcccagcataatactaagcagctcagcgatctgaattacaaagtggaaggggagaaactcaagcacaaatatacaattgaccccgaactgccccagttcattcaggccaaagtcaatgccctcaacatgtccgacgctcattacaaagcggattggaagaaaactatcgctaaggggtacgatctgaggcctgatgccatccctatagtggccgctaagtccagcaggaatattgcatctgattgtaagtacaaagaggcttacgagaaggctaaaggaaaacaagtaggatttctgtctctacaggacgacccaaaactggtccattacatgaacgttgcgaaaatccagagtgaccgggaatataaaaaggggtacgaggcttctaaaactaaatatcataccccacttgacatggtgagtgtaactgctgctaagaagagccaggaagttgcaacaaatgccaactatcgccagagctatcaccattacacactccttcccgacgccctgaatgttgagcattcaagaaacgccatgcaaattcaatctgacaatctttacaaatccgactttacgaattggatgaaaggaatcggctgggtgcccattgaaagcctggaggtcgagaaagccaaaaaggctggagaaattctgagcgagaagaagtaccgacagcaccctgagaaactgaagtttacatacgccatggataccatggagcaagctttaaacaaatcaaacaagctcaacatggataaacggctttacacggagaagtggaataaggataaaaccactattcatgtgatgcccgacaccccagacatcctgctgtccagggtcaaccagataactatgagtgacaagctttacaaagccggctgggaggaggagaagaagaaaggctacgatttaaggcctgacgccatcgcaataaaagcagcacgcgcctctagagacatcgcctccgactacaagtacaagaaagcctatgagcaggcaaaaggaaagcatatcggctttagatccttggaggacgatccaaaactggtgcacttcatgcaggttgcaaagatgcagtctgacagagaatacaaaaaaggatatgaaaagagcaagactagttttcacacgcccgtcgacatgctgtctgtggtagccgccaaaaagtcccaagaggtggcaacgaacgccaattaccgcaatgttattcatacgtacaatatgctccccgacgccatgagttttgaactcgccaaaaacatgatgcagattcagtcagataaccagtataaagcagactacgcggactttatgaaggggattggatggttaccactcggcagcctggaggcggaaaagaacaaaaaggcaatggagataatctccgagaagaagtatcggcagcaccccgatactctaaaatactcaaccttgatggactctatgaatatggtgctggctcagaacaacgccaaaatcatgaacgagcatctgtacaagcaggcctgggaagctgataaaaccaaagtacacattatgcctgacatccctcagatcatactggccaaagcaaatgccatcaacatgagcgataagctttacaaattatctctcgaagagagcaagaagaagggatatgacttacgccctgacgccatccctatcaaggctgcaaaggcaagcagggacatcgcatctgattacaagtataagtacaattatgaaaaggggaagggtaaaatggtggggtttaggagtctggaagacgatcccaaactggtgcatagcatgcaggtagctaagatgcagagtgaccgcgagtacaagaaaaattatgaaaacaccaagacaagctaccatacccctgccgatatgctcagtgtcaccgctgctaaggacgctcaggcgaatataaccaatacgaattataaacaccttatacacaaatatatcctcttgcctgatgccatgaatattgagctgaccagaaatatgaaccgcatccagtccgacaatgaatacaagcaggactataacgagtggtacaagggtcttggatggtcacctgcgggatccttggaggtggagaaggctaaaaaggccacggagtacgcgagcgatcagaagtacaggcaacacccctcaaatttccagttcaagaaattgacagactcaatggacatggtgctcgcgaagcaaaatgctcacaccatgaacaagcacctctacacgatcgattggaataaagacaaaaccaagatccacgtgatgcctgatacccccgatatcttacaggccaaacagaatcagaccctctatagtcagaaactgtataaactgggctgggaggaagcactcaaaaagggttatgacttacccgtagatgccatttccgtgcaattggccaaggcaagccgcgacatagccagcgactacaagtataaacagggctaccgaaagcagctcggacaccatgtaggttttcgctcactccaggatgatcctaaactcgttctcagcatgaacgttgcaaagatgcaatctgaacgggaatacaagaaggattttgagaaatggaagaccaaattctcaagcccggtcgatatgttgggggtggtcctggcaaagaaatgtcaggaactagtgagtgatgtagattataagaattacctgcatcagtggacgtgcctgcctgaccagaatgatgtggtccaggccaagaaggtgtacgagcttcaaagtgaaaacctgtacaagtccgacttggagtggttgcgaggcatcggttggagccctctgggatccttggaggctgagaaaaataagcgcgcatctgagatcatcagcgagaagaagtaccggcagccaccagacaggaacaaatttacaagtatcccagacgctatggacatagtgcttgccaagacaaacgctaagaataggtcagatcgcctctaccgtgaagcgtgggacaaggataaaacgcaaatccacattatgcccgatactcccgacattgtgcttgccaaggctaaccttatcaacacttctgacaagctctatcggatgggttacgaagagctgaagcggaaaggttatgatctgcctgtagatgcaatcccgattaaagctgcgaaggcgtcccgggagattgcttccgaatacaaatataaggagggtttcagaaaacagctcgggcatcatattggggcaaggaatatcgaggatgatcccaaaatgatgtggtcaatgcacgtcgctaagattcagagcgatagagaatataagaaagacttcgaaaaatggaagaccaagtttagttccccggttgacatgctgggagtggttctggcaaaaaaatgccagacccttgttagcgatgtggactataaaaactatttgcaccagtggacttgcctccccgaccagagtgatgttatccacgcaaggcaggcttacgacttgcagagcgataacctgtataaaagcgacttgcaatggttgaagggcatcggatggatgacctccggatcccttgaagatgaaaagaataagcgggcaacccagatcttgagtgatcatgtctatcgccagcaccctgatcaattcaaattcagttccctcatggacagtatccctatggtattggccaagaacaatgctatcactatgaatcacagattgtacaccgaagcctgggacaaggacaaaactaccgtccatatcatgcccgacacacctgaggtattgttggctaagcagaataaggtcaactattcggagaaattgtataagcttgggttggaagaggcgaagagaaaaggttacgacatgagagttgatgcaatcccgatcaaagccgcaaaagctagccgggacattgcttccgagtttaaatacaaagaaggctaccgaaaacagctcgggcatcacattggcgccagagccattcgggacgaccccaagatgatgtggagcatgcatgtagccaagatccagagtgatcgcgaatataagaaagattttgagaagtggaagacaaagttcagctctcctgttgatatgcttggagtcgtgctggccaagaaatgtcagacgctcgtgtcagacgtggattacaagaactacctgcaccagtggacctgtctgccagatcagtctgatgtcatccatgcgaggcaagcctacgatctgcagtcggacaacatgtacaagagcgacctgcagtggatgcgcgggattggttgggtaagcatcggatctctggacgtcgagaaatgtaagagagctacggagattctgtccgataagatttaccggcagcccccggacaggttcaagttcactagcgtgaccgacagcctggagcaggtgttagccaaaaataatgcaatcacaatgaataagcgactctacaccgaggcatgggacaaggacaaaactcagatccatatcatgcccgataccccagagatcatgctggctagaatgaataaaattaactactcagaatccttatataagctggcgaacgaggaagccaaaaaaaagggctatgaccttaggtcagacgcaattcccattgtcgcggcaaaggcaagccgagacatcataagcgactacaagtataaggatggctattgcaagcaattgggccaccacattggcgcccgtaacattgaggacgaccccaagatgatgtggtccatgcatgttgcaaagattcagagcgatagagagtataaaaaagatttcgagaagtggaagacaaaatttagttcacccgtggacatgttaggagtcgtattggcaaagaaatgtcagaccctggtctctgatgtcgattacaaaaattaccttcacgaatggacttgcctgcctgaccagtcagatgttattcacgcaagacaagcttacgatctgcagtcagacaacatctacaaatctgacctgcaatggctgaggggtataggatgggtgcctatcggtagcatggatgtcgtgaaatgtaaaagggccaccgaaatcctgagtgacaacatctatagacagcctccggataagctcaaattcaccagcgtgaccgacagcctggagcaggttctggctaagaacaatgcattgaatatgaacaaacgtctctatactgaggcatgggacaaagataaaacccaaatacacattatgcctgacacacctgagatcatgctcgcacggcagaacaaaatcaattactcagagacactgtataaactagcgaatgaggaggcaaagaagaagggctacgatctgaggtctgatgccattcccatagtcgccgcaaaggcctctcgcgacgtgatttccgattataagtacaaggacggatacaggaaacagttgggccaccatattggcgcccgcaatatcgaagacgatcctaagatgatgtggtctatgcatgtcgcaaagatacaaagcgatcgggagtataagaaggacttcgagaagtggaagactaagttcagttctcccgtggatatgttgggagtcgtcttggccaaaaaatgccaaacactcgtctcagatgtggactataagaactatctccacgagtggacctgcctgccagatcaaaacgacgtcatacacgcacggcaggcctacgatctacagtctgataacatttacaaatcggatttacagtggcttcggggcatcggctgggtgcccattggaagcatggatgtggtcaaatgcaaacgggccgcggagattttgagcgataacatttacaggcaaccacccgacaagctaaaattcaccagtgtcaccgattcacttgaacaggttcttgctaagaataacgccctcaacatgaataaacgcctgtatactgaggcctgggacaaagataaaacacaagtacacattatgccggatacacccgagattatgcttgcaaggcaaaacaagattaactacagtgagtctctctaccgccaggccatggaggaggctaagaaagagggatatgatctgagatctgatgccatcccaattgttgccgcaaaagctagccgcgacattgcatcggattataagtataaggaagcctaccgcaaacagctgggccaccacattggggccagagccgtgcacgatgatcctaagatcatgtggtccctgcatattgctaaagtgcagtcagacagagaatataagaaggacttcgaaaagtataagacccgttactcctctcctgtcgacatgctggggattgtgttggccaaaaagtgccagacactggttagtgatgtggattataaacaccctctgcacgaatggatttgcctgcccgaccaaaacgacattattcacgctcggaaggcctatgatctccaaagcgacaacctctacaagagtgatctggaatggatgaagggaatcggttgggtgccgattgattctcttgaagtagtaagggccaaaagagcaggtgaactgctgagcgatactatttatcgccagaggcctgagaccttaaagttcacttccatcaccgacaccccagaacaagtgctggccaaaaataacgctctgaacatgaacaaaagattgtacacggaggcctgggataacgacaagaaaaccatccacgtgatgccagatacacccgagattatgctggccaagttaaaccgaataaattactccgataaactgtataaactagctcttgaagaaagcaaaaaagaagggtatgatttacggcttgacgcaattcccattcaggctgcaaaggcctctcgggatattgccagcgactataagtacaaagaagggtacagaaagcaattgggacatcatatcggggcacgcaacattaaagatgatcctaagatgatgtggagtatccacgtagcaaagatacagagcgacagggagtataagaaggagtttgagaagtggaagacaaagttttctagtccagtggacatgctcggtgtcgtactggcaaagaaatgccagatcctcgtgtctgatatcgattacaagcatccgctccacgagtggacgtgcctgcccgatcagaatgatgtgattcaggccagaaaggcgtatgacttacaatctgacgcaatctacaagagcgatttagagtggctgcgagggattggatgggtccctatcggctctgtcgaggtcgagaaggtcaagcgggcaggagagattttatcggaccgcaagtacaggcagcctgcagaccaactcaaattcacttgcatcactgataccccagagattgtgctggctaaaaataatgcgctgaccatgtcaaagcatctatacaccgaagcatgggacgcagataaaacaagtatacatgtgatgcccgataccccggatatcctgttggccaaaagcaattcagccaacatttcccagaaattatacacaaaaggctgggacgaatcaaagatgaaggattatgacctgagggcagacgccatctccattaagagcgctaaagctagcagggacattgcctcagattataagtacaaagaggcctacgagaagcagaaaggccatcacatcggcgcccaatccattgaagatgatccaaagatcatgtgcgctatccacgccggcaagatacagtccgaaagagaatacaaaaaggagtttcagaagtggaagacaaagttttccagccccgtagatatgctgtcaatcctgctggccaaaaaatgtcagaccctggtcactgatattgactatcgcaactatctgcacgaatggacgtgcatgccagaccagaatgacatcatccaggctaagaaagcctacgatctccagtcagactctgtgtacaaggctgacctcgagtggcttcggggaataggctggatgcctgaagggtctgtggaaatgaatcgcgtcaaggtagctcaagacctggttaatgaacgcctgtacagaactcgccctgaggccctctcttttaccagcatcgtggatacgcccgaagtagtcctagccaaggccaattctctccagatcagtgaaaaactgtatcaggaagcgtggaacaaagataagagcaacatcacgatcccgagtgatacgccagaaatgctgcaggcccatatcaacgccctgcagatttcgaacaagttatatcagaaagactggaatgacgctaagcagaaagggtatgacatcagagccgatgccatcgagattaagcatgcgaaggcttcccgagagattgcctcggagtacaagtataaagagggctataggaagcaacttggtcaccacatgggatttagaactctccaggatgatccgaaaagtgtgtgggcaatccatgcagctaaaatacagagcgaccgagagtacaaaaaggcatatgagaaatcaaagggtattcataatacaccactggatatgatgtcaattgtgcaggcgaaaaaatgccaagtcctggttagcgacatcgactatcgcaattacttgcaccaatggacatgtctgccagaccaaaacgacgtgatccaggccaaaaaggcctatgatctccagtctgataatctgtacaagtccgacctggaatggctcaagggaataggatggttgcctgagggctccgtcgaggtgatgcgcgttaagaatgcccagaacctcctgaacgaaagactctaccgcatcaagccagaggcactgaaatttacatccattgtcgacactccagaagtgatccaagccaagatcaatgctgttcaaatctcagaaccactctatagggatgcttgggagaaggaaaaagctaatgtgaacgtacccgccgatacgccgctgatgctgcagagcaagatcaacgcccttcaaatttcaaataagcgatatcagcaagcctgggaggacgtaaagatgaccgggtacgatctgcgggccgacgctatcggcatccagcacgccaaagcatcaagagatatcgcctcagactacctatataagacagcctacgagaaacagaaaggtcattatatcggatgccgctccgcaaaggaagatcccaagctagtctgggcggccaacgtcctaaaaatgcagaacgatagactatacaaaaaggcctacaatgatcacaaggccaaaatttcaattccggtagatatggtgtcaataagtgcagctaaagaaggtcaggccctggccagcgacgtcgactacaggcattacttgcaccactggtcctgcttcccggatcagaacgatgtaatccaggcacgcaaggcctacgatctccagtctgatagcgtgtataaagccgatctggagtggctgagagggatcgggtggatgcctgaagggtctgtggaaatgaacagagtcaaagtcgcacaggatctggttaatgaacggctatatcggacacgacccgaggccctgagcttcacgagtatcgtggacacgcctgaagtcgtgctcgctaaggccaattccctgcagattagcgagaagctctatcaagaagcttggaataaggacaaaagcaatattacaatcccttcagacacaccagagatgctgcaagcccacatcaacgccctccagattagtaataagctctaccagaaggactggaacgataccaaacaaaagggatacgatataagggccgatgctatcgagataaagcacgctaaagctagccgggaaatcgcctcagagtacaagtacaaagaggggtaccggaagcagctcggacaccacatggggttcaggacactccaggacgacccaaagtccgtgtgggccatccacgcggccaagatccaatctgaccgggagtacaaaaaggcttacgagaagtctaagggaatccacaacacacctttggatatgatgagtatcgtacaggcgaagaaatgccaagtactagtctccgacatcgattatcgcaactacctgcaccagtggacctgcctgcccgatcagaatgacgtcattcaggctaagaaggcctacgacctgcagtctgataatctttacaaatccgacctagaatggttgaaaggcattggctggctgcctgagggatcagtggaggtcatgcgtgtcaagaacgcccagaatttgcttaacgagaggttgtatcgcatcaaaccggaggcattaaagtttacttccatcgtggatactccagaggtgattcaggctaagattaatgccgtgcagatcagtgaacctttgtatcggaatgcttgggaaaaggaaaaggcaaatgttaatgtgcctgctgacacaccactgatgctacagagcaaaattaatgccttgcagatcagtaataagaggtaccagcaggcttgggaggacgtgaagatgaccggatacgacctgcgtgcagacgcaattggcatccagcacgcaaaagccagtagagacatcgcaagtgactatttatataagacagcctacgaaaagcagaagggacattacatcgggtgccgcagcgcaaaggaagaccccaaattggtatgggccgccaatgtactgaagatgcagaatgatcggttatataagaaagcatataatgaccataaagcaaagattagcatacccgtcgatatggtgagcatctccgccgctaaggagggtcaggctttggcttctgacgtagattatcgccattacctacaccattggtcctgctttccagatcagaacgacgtgatccaggcccgaaaagcatatgatcttcagtcggattctgtatacaaagccgatttggagtggttgagaggcataggctggatgcccgagggctcggtggaaatgaatcgcgtaaaggtggcgcaagacttggtcaacgagcgcctgtacaggacacgcccggaagcactgtctttcacaagcattgtagacacacccgaggtggtgctggccaaagctaatagtttgcagatttctgagaagttgtaccaggaagcatggaacaaagacaagagcaatatcacaattccctccgatacgccagagatgctgcaggcacacatcaacgccctgcaaatctcgaataagctgtaccagaaagattggaacgacaccaaacagaaaggctacgacattagggcagacgctatcgaaattaaacacgcaaaggcctcacgggaaatcgctagcgagtataagtacaaagaagggtaccgcaaacagctgggccaccatatgggattccgcaccctgcaggatgatcccaagagcgtctgggcaatccatgctgctaaaattcagtccgatcgggagtataaaaaagcttacgaaaaatccaaaggcatacacaatactcccctcgacatgatgagcatcgtacaagccaagaagtgtcaagtgttagttagcgatatagattatcgcaactatctccaccagtggacctgcctgcccgatcagaacgacgtgatccaagccaaaaaagcctatgatttacaaagcgataacctatataagtccgatcttgaatggctgaagggcatcggctggctccctgagggcagcgtcgaggtgatgagggttaaaaacgctcaaaacctgctcaatgagcggctgtacaggattaagcctgaggctttaaaattcacttcaattgtggacacacctgaagtaatacaagctaagatcaacgccgtgcagatcagtgagccgctgtatcgcgatgcctgggaaaaggaaaaggccaacgtgaacgtccccgcagatacgcccctcatgctgcagagtaagattaatgcactgcagatctctaataagagataccagcaggcatgggaagatgtgaaaatgaccggatacgatctgcgggccgacgctattggcatccagcacgcaaaggcctctcgcgacatcgccagcgactacttatataagactgcctacgaaaaacagaaggggcattatatagggtgccgttcggctaaggaggatccgaagctcgtatgggccgcaaatgtgcttaagatgcagaacgatagactctataagaaggcctataacgatcacaaagccaaaatctctatccccgtggacatggtgtccatctccgctgctaaagagggacaggccctggcatctgacgtggattatagacactacctacataggtggagctgtttccctgaccagaacgatgtgatccaagcacggaaggcttacgacttacagtcagacgcactgtataaagccgatcttgagtggttgcgcggaatcggttggatgccgcagggctcccctgaggtccttcgagtgaagaacgcacagaacattttctgtgacagtgtataccgcactcccgtagtgaatctgaagtacaccagcatcgttgacacgccggaggtagtgctggctaaaagtaatgcagagaacatcagcatccctaagtaccgtgaggtatgggacaaggacaagacctcgattcatatcatgcccgatacgccggaaatcaacctcgctcgcgctaacgctctcaacgtcagcaataagctgtaccgggaagggtgggacgagatgaaagcaggatgtgatgtccgcttggatgccatacccatccaggcagctaaagcttcccgtgagatcgcctctgactacaaatataaattggatcacgagaagcagaagggccactacgtgggtaccctgacggccagggacgacaacaagatccgctgggcccttattgccgacaagcttcagaacgagcgtgagtaccggctcgattgggcaaaatggaaagcaaaaattcaaagccctgtcgacatgctgagcatcctgcactctaaaaatagtcaagcactggtcagcgatatggattatcggaattatctgcatcagtggacatgcatgcctgatcaaaatgacgtgatacaggccaagaaggcctacgaactgcaatccgataacgtctacaaggctgacctcgagtggctccgcggaatcgggtggatgcctaatgatagcgtgtccgtgaaccacgctaaacacgccgcagatattttcagtgaaaaaaagtataggacaaagattgagaccctaaactttacacccgtcgatgaccgggtagactacgtgactgccaagcagtccggagaaatcctggatgacataaaatatcggaaagactggaacgcaactaagtctaaatacactctgaccgagacccccctcctccacactgcccaggaggcggcccgaatcctggaccagtatctctataaggaaggctgggaaagacagaaagcgacggggtacatcctgccacctgacgctgtccctttcgtgcacgcccaccactgcaatgacgtccaatctgaattgaaatataaagccgagcacgtgaagcaaaagggccattacgtgggcgtccccacaatgcgggatgatccaaagctcgtatggttcgaacacgcaggccagatacagaatgaacgtctatataaggaagactaccacaagaccaaagcgaaaattaacattccggctgatatggtgtccgtgcttgccgctaaacaggggcaaactctggtttccgacattgattaccgaaactacttgcatcagtggatgtgccacccagatcaaaatgatgtgatccaggcgcggaaggcctatgatctgcagtctgataatgtgtacagagccgatctggagtggctgagggggatcggctggattcccctggattcagtagatcacgtgagagtgacaaaaaaccaagaaatgatgtcacagattaaatacaagaaaaacgctttggaaaattaccccaactttcgctcggtggtggacccgcctgagatagttctggctaagatcaattccgttaaccagagcgatgtcaagtataaggagacatttaacaaggctaagggaaaatataccttctctccagacacaccacacatttctcactcaaaggacatgggcaaactgtatagcactattttgtacaaaggagcctgggaaggcacgaaggcctatggatacaccctggatgaaaggtatatccctatcgtgggggccaaacacgcagatctcgtaaactctgaattaaagtataaagaaacctatgagaaacagaaggggcattacctcgcagggaaagtcatcggcgagtttccgggcgtggttcattgcctggacttccagaaaatgcgaagcgcattgaactaccgcaagcattatgaggacacaaaggctaacgttcatatccccaacgacatgatgaaccatgtcctagcaaaaagatgtcagtacattctaagcgatctggagtataggcactatttccatcagtggaccagcctcctggaagagccgaatgtgattcgagtccggaacgcgcaggaaattctctcagataatgtctataaggacgatctcaactggctaaagggtataggctgctatgtgtgggacaccccgcagatccttcacgctaagaaatcttacgatcttcagtctcagttgcagtacacagctgccggcaaagagaatctgcagaattataatctcgtgacagacactccgctttatgttaccgcagtgcaatccggcattaatgctagcgaggtcaagtacaaggaaaactatcaccagatcaaagataagtacactaccgtgctggaaaccgtcgactacgacaggactcgcaaccttaagaacttgtatagttcaaacctttataaggaggcatgggatcgagtgaaggctactagttatatacttccgtcaagcacgctcagcttaactcacgcaaagaatcagaagcatctggccagccatatcaagtaccgagaagaatatgagaagttcaaggccctgtacacgctacccagatcagtggatgacgatcccaacaccgctagatgtctcagggttgggaagctgaatattgatcggctatataggagcgtatacgaaaagaacaagatgaaaatccacatcgtccccgatatggtcgagatggttacggcaaaagacagccagaaaaaggtatcggagatagactacagactgcggctgcacgagtggatttgtcaccccgacttacaggtcaatgatcatgtgaggaaagtcaccgaccagattagcgatatcgtttataaggatgacttgaactggctcaaaggaatcggttgttatgtgtgggacacaccagagatccttcatgccaagcacgcatacgatctgcgtgacgatattaaatacaaggcacacatgctgaagactcgcaatgactacaaattggtgactgatactccagtctacgttcaggccgtgaagtccggaaaacagctctctgatgccgtgtatcactacgactacgtacactctgtgaggggcaaagtcgcccccaccactaagaccgtcgatctagacagggccctgcacgcgtacaagctgcaatctagcaacctatataaaaccagtctgcgcactcttcccacaggataccgcctccctggagacacgccacattttaaacatattaaggataccaggtatatgtccagttatttcaaatacaaggaggcttacgaacacacaaaggcctatgggtacaccctgggacccaaagacgtaccttttgtgcatgtacgccgtgtcaataatgtgacctccgaaagactgtatcgggagctgtatcacaaactgaaggacaagattcacacaaccccagatactcctgagatccggcaggttaaaaagactcaagaggctgtctccgaattgatttataaatctgattttttcaaaatgcagggccatatgatttctctgccctacacaccacaggtgatccactgtcgatatgtgggagacatcaccagtgatattaaatacaaagaggatttgcaggtcttgaaaggattcgggtgtttcctttacgatacccctgatatggtccgtagccggcacctgcggaaactatggagtaactacctctatacagataaggccagaaagatgcgcgataagtacaaggtggtcttagacacaccagaatacaggaaagtccaagagctgaagacgcatctgtctgagctggtttatcgagctgcgggcaagaagcagaagagcattttcactagcgtgccggataccccagatctgctgcgagcaaagcggggccaaaaactgcaatctcagtacctttacgtggaactcgccacaaaggaacgacctcaccaccatgccggtaaccaaaccactgcactgaagcatgcaaaagatgtgaaggatatggtaagcgagaagaaatacaaaatccaatacgagaaaatgaaagacaagtatacccctgtgccagacacacccattctaattcgcgctaaaagggcctattggaacgccagcgatttacgatataaggaaacatttcagaagaccaaaggcaaataccataccgtgaaggacgccctggatattgtgtaccaccggaaggtgaccgacgatattagcaagatcaaatacaaggagaattacatgagtcaactgggcatctggcgttcaattccagacagaccggaacacttccaccaccgggctgttaccgataccgttagcgatgtcaagtataaagaagatctgacctggctgaaagggatcggttgttacgcttatgacacacccgatttcacccttgctgaaaagaacaaaaccctatacagtaagtacaagtacaaggaggtttttgaacgaacaaaatccgattttaaatatgtagccgactctcccattaatcggcactttaagtatgccacacaactgatgaatgagagaaaatacaaaagctcagctaagatgttccttcagcacggttgtaatgaaattctgaggccagatatgctcaccgccttgtataatagccacatgtggagtcaaattaagtacaggaagaattacgagaaatcaaaagacaagtttactagtatagttgatacacctgagcacttacggactacgaaggtcaataagcagatcagcgacattctatataaactggaatacaataaggccaaacctcgcggctacaccaccatccacgatactcccatgttgctgcatgtgaggaaagtcaaggacgaggtgagcgatttgaaatacaaagaggtgtaccagagaaacaagagcaattgcaccatcgaaccagacgcagtgcacattaaggcagcaaaagacgcatacaaggtcaacactaacctggattataagaaacagtacgaagctaataaagcccactggaagtggactcctgaccgaccggatttccttcaggcggccaaaagttctctccaacagagcgacttcgagtacaaattggacagggaatttctcaaaggctgcaaactgtctgtgactgacgacaagaacactgttctggcactccggaatacactgatcgagtctgatttaaagtacaaagagaagcacgttaaggagagaggcacttgtcatgccgtccctgacactcctcagatccttttggccaaaaccgtttccaacttggtatctgagaataagtacaaggaccacgtcaaaaaacacctcgcccagggttcctacacaacattgcccgagacaagggacactgtccacgtcaaagaagtaacaaagcacgtctccgacactaactataaaaagaagttcgtaaaggaaaaggggaagtccaactattctataatgctagagcctcctgaagtgaagcacgctatggaagtggcaaagaaacagtctgatgtggcttaccgcaaagacgcaaaggagaaccttcattacacgacggtcgccgatcgcccagatattaagaaggccacacaggctgccaaacaggcctccgaggtcgagtacagggcaaagcatagaaaggagggctcccatggcctcagcatgctcggtcgacccgacatagaaatggctaagaaggcggcaaagctgtcgagtcaagtaaaatatcgcgaaaatttcgataaagaaaagggaaaaaccccaaagtataacccaaaagacagccagctctataaagttatgaaagacgctaataacttggcctccgaagtgaaatataaggctgacttaaaaaagctgcataagccagtgaccgacatgaaggagtcactcatcatgaatcacgttctgaacacaagccagttagccagttcatatcagtacaaaaagaaatacgagaaatctaaaggacattatcatactattcccgacaatctagagcagttgcatctgaaggaggcaaccgaactgcagtccattgtaaagtacaaagagaagtacgaaaaggagcgcgggaagcctatgctggactttgagacacccacatacattacggcgaaggagagccaacagatgcagtccggcaaggagtaccggaaggactacgaggagtccatcaaagggaggaaccttacgggcctggaagtaacacctgcactgctgcacgtgaaatatgctaccaaaatcgccagcgaaaaggagtaccgcaaagatttagaggagagtatcagaggtaaaggcttgacagaaatggaagacactccagacatgctgagagccaagaatgctacccagatcttgaacgaaaaggagtataaacgcgatctggagttggaagtaaagggaagggggctgaatgccatggccaatgaaaccccagactttatgagggcgagaaatgccactgatatcgcgagccagattaagtacaaacagtctgccgaaatggagaaagcaaactttacgtctgtggtagacacccccgagatcattcatgcccagcaagttaagaacctgtcttctcagaaaaagtacaaggaggatgctgagaagtctatgtcatactacgagacagtcctggataccccggaaatccagagagtgcgggaaaatcagaaaaacttttccttgttacaatatcagtgcgatttgaagaactccaaaggtaagattacagtcgtccaagacacgccggagatcctgcgggtaaaagagaatcagaaaaatttctcaagcgtgctgtacaaagaggatgtgagccctggaaccgcaatcgggaagactccagagatgatgcgggttaagcagacccaggatcatatttctagcgtgaagtacaaggaggcaatcggtcagggaactccaatccccgatttaccagaagtgaagagggtgaaggagacccagaaacatatcagctccgtgatgtataaggaaaatctgggtactgggatcccaacaacggtcactccagagatcgaacgggtgaaacggaatcaggaaaacttcagttcagtactctacaaagaaaatctagggaagggcataccaactcccatcactcccgagatggaaagggtaaaacggaaccaggagaatttctcaagtattttatacaaagaaaatctttcaaaaggaacaccactgccagtcactcccgagatggaacgcgtcaagctaaaccaggaaaacttctccagtgtgttgtacaaagaaaacgtggggaaaggaatccctatccccatcacaccagaaatggagcgggtgaaacacaatcaagaaaacttttcctcagttctgtataaggagaatctggggacggggataccaatcccgatcacacccgagatgcagcgggtcaaacacaatcaggagaacctatcttctgtgctctataaggagaatatgggaaagggaacccctctgccggtgacgccagagatggaacgcgttaaacacaatcaggaaaacatctcaagcgtgctttataaggagaatatgggaaaaggcacacccctgcccgtgacacccgagatggaacgcgtaaagcataatcaagagaatatctccagcgtgctgtacaaggagaatatgggcaaaggcaccccattagcagtgacacctgaaatggagcgcgtgaaacacaatcaggagaatatctcttctgtgctgtacaaagagaacgtgggaaaggccacagccacccccgtgacccctgagatgcagcgagttaagcgcaaccaggagaacattagttccgtcctgtataaggaaaacctagggaaagccactcccacaccgtttacaccggagatggagcgggtaaaacgtaatcaggagaacttcagttcagtcctgtataaagaaaacatgcgcaaagccacacctacaccggtgactcccgaaatggagcgcgctaagcgaaaccaggaaaacatctcgtccgttctctacagcgattctttcagaaagcagatacaaggtaaggctgcttatgttttggatacacctgagatgaggcgggtgcgggaaacccagcggcacatatcaaccgtgaagtaccacgaggatttcgagaagcataagggctgctttaccccagtcgtaactgatcctatcaccgagcgggtgaaaaagaacatgcaggacttcagcgatatcaattaccgcggcattcagcgaaaagtggtagagatggagcagaagcggaacgatcaggatcaggagaccattactgggctacgtgtgtggaggacgaatcctggctccgtcttcgactacgaccctgcggaggataatattcagtcacggagcctgcacatgattaacgtgcaggcccagcggcgaagtagagaacaaagcaggagcgcttccgctctgagcatcagtggaggggaggagaagagcgaacacagcgaggcacctgatcatcatctgagcacctactctgatggcggagtgtttgccgtgtccactgcgtacaaacacgcaaaaacaaccgagctgcctcagcaacgctccagctcagttgctacccagcagacaacggtatcatcaatacctagtcacccatctacagcaggaaagatttttagagctatgtacgactacatggcggccgacgctgacgaagtgtcctttaaagatggcgatgctatcatcaacgttcaggcgatcgacgagggttggatgtacgggaccgttcagcgaacaggaagaacagggatgctacctgccaattacgttgaagcgatctag

SEQ ID NO: 125928 - DNA, 20010 bp, Artificial Sequence
  Description of Artificial Sequence: Synthetic coding sequence
atggccgacgatgaagactacgaggaggtggttgagtactataccgaggaggtggtttatgaagaagtgcccggcgagaccataacgaagatatatgaaaccacgaccactcgaaccagcgactacgaacagtcagaaactagtaagcctgccctagcacagccagctctggcacagcccgcgtccgccaagcctgtagagagacgcaaagtcattcgtaagaaagtcgatccgagtaaattcatgacaccgtacattgcccattcacaaaaaatgcaagatctgttttcaccaaacaaatacaaggaaaaatttgaaaagactaaaggccagccttacgcttccaccacagatacaccagaattgagacgtattaaaaaggtgcaggatcagctgtccgaagttaaatatcgcatggacggagatgtggccaagactatttgtcatgtcgatgaaaaagccaaagacattgaacatgccaagaaagtttcccaacaggtaagtaaggtgctttataaacagaactgggaagatacaaaagacaagtacctgctcccccctgatgcacccgagctggtccaggccgtgaaaaataccgcaatgttcagtaagaagctttatacagaagactgggaggccgacaaatcccttttttatccatataacgatagtccggagctacggagagtggcacaagcccagaaggcgctgagtgatgtcgcgtataaaaaaggcttagcggaacaacaagctcagttcacacctctcgctgaccctccagacatagaatttgccaagaaggttacaaaccaggtttctaagcagaaatacaaagaggactatgagaataagatcaagggcaagtggtctgagactccctgctttgaagtagctaatgccaggatgaatgcagacaacattagcactagaaagtaccaggaagacttcgagaatatgaaagaccagatttacttcatgcagactgaaacaccagaatacaagatgaataagaaggccggcgttgccgccagcaaggtgaagtacaaggaggattatgaaaaaaataaaggaaaggccgactacaacgtgttacccgcaagcgagaatccacagctacgccagctcaaagctgcaggcgatgcactctccgataaactttataaagaaaactacgagaaaaccaaggccaagtctataaactactgcgaaacaccaaaattcaagcttgacacagtgttgcagaatttcagcagtgacaaaaaatataaagatagttacctaaaagatattctgggccattatgtggggtctttcgaagacccctatcacagccattgcatgaaggtcactgcccaaaattctgataagaattataaagcagaatatgaagaggacaggggcaagggcttttttccacagacaattacccaagagtacgaagcgatcaaaaaactggatcagtgtaaggatcacacctataaagtgcatccagataagaccaaatttacccaggtgactgacagccccgtgttgctgcaggcccaagtgaactccaaacaactctctgatctgaattacaaggccaaacacgaatccgaaaagttcaagtgccacatcccaccagacacacccgcattcattcagcacaaggtcaacgcctacaatttgagcgacaatttgtataaacaggactgggagaagagcaaggccaaaaaatttgatatcaaagtcgacgcaatcccacttttggccgccaaggccaacacaaagaacacaagtgatgtcatgtacaagaaagattacgaaaaaaacaagggaaaaatgataggagtgttgtccatcaacgatgatccaaagatgctccattcactcaaagtcgctaaaaatcagagcgacagactgtacaaagagaactacgagaaaactaaggccaaatccatgaactactgtgaaaccccaaagtatcagctggatacacagctgaaaaacttctccgaggctcgatacaaagatctctatgtgaaggatgtgttaggtcattacgtgggctctatggaagatccgtaccacacccattgcatgaaggtggctgcccaaaacagcgacaagtcgtacaaagctgagtacgaggaggacaagggcaagtgttattttccccagacaatcactcaggagtatgaggcaatcaagaagttggaccagtgcaaggaccacacatacaaggttcaccctgacaagaccaaatttactgctgttaccgatagccctgtcctgctccaggcccagctgaataccaagcaattgagcgacctcaactacaaggcgaagcatgaaggcgaaaagtttaagtgtcatatccccgccgatgctccccaattcatccagcatagagttaacgcttataatctcagcgataatgtatacaaacaagactgggagaagagcaaagcaaagaaattcgacataaaggtggatgctatcccattgctggccgctaaagcaaacaccaagaatacaagtgatgtcatgtataaaaaagattacgaaaaaagcaagggcaagatgataggcgccctctctatcaacgacgatcccaagatgctccactctctcaagaccgcaaagaaccagtctgatcgagagtaccgcaaagactacgaaaaaagcaaaaccatttacactgctcccttggatatgctacaggtgacccaagccaaaaagtcacaggccattgcttccgacgtggactacaaacacatcctgcattcttactcctaccctcccgattccattaatgtcgatctggcgaagaaggcttatgctttgcagtctgatgtggaatataaagccgactacaatagttggatgaagggctgtgggtgggtgccttttggttcgctcgagatggagaaagcgaagcgcgcttcggatatcttaaatgagaaaaaatatagacagcaccccgacaccctcaaatttacatccattgaagacgcaccaataactgtgcagagcaagatcaaccaggcccaaagaagcgacatcgcatacaaagcaaagggcgaggagatcatccacaagtacaatttgccgccggatctgcctcaattcatccaagccaaggtgaacgcctacaacatctcggagaacatgtacaaggccgatcttaaagacctctctaagaaagggtatgatctgcggactgacgctatccccattcgagccgcgaaggctgccagacaagccgcgagcgatgtccagtacaagaaggattacgagaaagccaaaggaaaaatggtgggcttccagagccttcaggacgacccaaaactcgtacattacatgaacgttgctaagatccagagtgatagggaatacaagaaagactatgaaaagactaagagcaagtacaacaccccacacgatatgttcaatgttgtggccgctaagaaggcacaggacgtggtgagtaacgttaactacaaacattcccttcatcattacacgtatctgccagatgccatggacctggaactgagtaagaatatgatgcagatacagtcagacaacgtatataaggaggactacaacaattggatgaagggtatcggctggatccctatagggtcactggatgtggaaaaggtgaagaaggcaggagatgcactgaatgagaaaaagtacaggcagcatccagatacattgaagttcacatccatagtggattcacccgttatggtgcaggcgaaacaaaataccaagcaggtttccgacattctgtacaaggcaaagggagaggatgtcaaacacaagtacacgatgtcgccggatctgccacagttcctccaggcaaagtgcaatgcatacaatatctcagacgtttgctacaagagagattggtacgacctcattgccaaagggaacaacgtcctgggtgatgccattcccatcacagccgccaaggccagtcgcaacatcgcttctgactataagtacaaggaagcatatgagaaatcaaaaggaaagcacgtcggatttcgatctctgcaggacgatccaaagctggtgcattatatgaatgtggctaaactacagtcagatagagagtacaaaaaaaattacgagaatacaaagaccagttatcacacccccggggacatggtgtcgatcacagccgctaaaatggcacaagatgtggccactaatgtgaattacaagcagccattacaccactatacttacctgcctgacgccatgagtctggagcacaccagaaacgtcaatcagattcagtcagataatgtttataaggacgagtacaattccttcctgaagggcataggctggatccctataggctccctggaggtcgaaaaggtgaagaaggctggcgacgccctaaacgaaagaaagtacagacagcacccggacaccgtaaaattcacctccgtaccagatagcatgggcatggtgctggcccagcacaatactaagcagttaagtgacctgaactataaagtggaaggagagaagctgaagcacaagtacaccatcgatcctgaactgccacagttcattcaggccaaagtgaacgctctcaatatgtccgatgctcactataaggccgattggaaaaaaaccatcgccaagggctacgatctcagacctgacgctattccgatcgtggccgccaaaagctctcggaacatcgcatccgattgcaaatacaaggaggcatatgagaaggctaagggcaagcaggtgggctttttatcgttgcaggatgacccaaaactggtgcattatatgaacgtcgccaaaattcagagtgacagagagtataagaagggctacgaggcgagtaagaccaagtaccatacaccattggacatggtgtccgtcacggcggctaagaagtcgcaagaggtggccaccaacgctaactacaggcagagctaccatcactatactcttctgcccgacgctctcaacgtcgagcactcaaggaatgcaatgcaaatccagtcagacaatctctataaatctgactttaccaattggatgaaaggaatcggatgggtacccatcgagagcctggaggttgagaaggccaagaaagcaggcgagatcctcagtgaaaaaaagtaccgccagcatcccgaaaagcttaagttcacttacgccatggatacaatggaacaggcacttaacaagtccaataaactcaacatggacaagcggctgtacactgagaaatggaacaaagacaagacaactatacacgtcatgccagacacacctgatatcctccttagccgggtgaaccagattactatgagcgataagctgtataaagccgggtgggaggaagagaagaaaaaggggtatgaccttcgtcccgatgcaattgccatcaaggccgcccgcgcttccagagacattgcatctgactacaaatataaaaaggcatatgagcaagcgaagggcaagcatatcgggttcagatctctagaggacgaccccaaactagtacattttatgcaggttgctaaaatgcagagcgatcgggaatataaaaaaggttacgaaaaatccaaaaccagttttcacacgcccgttgacatgctctctgtcgtcgcagctaaaaaatcacaggaggtcgccaccaatgctaactacaggaatgttatccacacgtacaacatgctgcctgatgcaatgtcatttgagttagccaagaacatgatgcagatccagtctgacaaccagtacaaggcagattacgcagacttcatgaaggggataggctggctgcccctagggagcttggaagccgaaaagaacaaaaaggctatggaaattatttccgaaaagaagtaccgccagcatcctgatacactgaaatattccacactgatggacagcatgaatatggtgctggcacaaaacaacgccaaaattatgaacgagcacctctacaagcaggcctgggaggctgataaaactaaagtccacatcatgccggacatcccccagatcatcctcgcgaaggcgaatgccattaacatgagcgacaaactgtataagctgtctctggaggagagcaaaaagaagggatatgacttgcgcccagatgcgattcctatcaaagcggccaaagcctcacgcgacatcgctagcgattataagtacaagtacaattatgaaaagggaaagggcaaaatggttggcttccgatctctggaagatgatccaaagttggtgcattccatgcaggtcgccaagatgcagtctgatagagaatataagaagaattatgagaataccaagacctcctatcatacccctgcggacatgctttctgtgacagcagccaaagatgcccaggccaacatcaccaatactaactataaacatctaattcataaatacatcctcttgcctgacgcaatgaatattgagctgactcgcaacatgaatcgcatacagagtgacaacgaatataaacaagactataacgagtggtataagggcctgggatggagtccagccggcagtctcgaggttgagaaggccaagaaagcgaccgaatatgctagtgatcagaaatatcgtcagcacccatcaaattttcaatttaaaaagctgaccgattctatggacatggtactcgccaagcagaatgcacacaccatgaacaaacacctgtacacgattgactggaacaaggataaaacaaaaattcacgtgatgccggatacccctgatatccttcaggctaaacagaaccagaccctctatagccaaaagctgtataagctgggctgggaagaggcgttgaagaagggttacgatttacccgtggatgcaatcagcgttcagctggctaaggcgagccgggacattgcttctgactacaaatataagcagggataccgaaaacagctggggcaccacgtaggttttagatctcttcaggacgacccaaaacttgtgctgagcatgaatgtagcaaagatgcagagtgaacgggagtataaaaaggatttcgagaagtggaaaaccaagtttagcagtccggttgacatgctcggcgtggtgctggcaaaaaagtgccaagaactggtgtcggatgtggactacaagaattatttgcaccagtggacctgcctgcctgatcagaatgatgtagtgcaggctaagaaagtctatgagcttcagtccgaaaacctgtacaagtcagacctggaatggttacgcgggatcggatggagtcccctgggcagcttggaagccgaaaagaataagcgcgcatctgagattataagcgagaagaaatataggcaacccccagataggaacaagtttacatccatcccagatgcaatggatatcgtgttggctaagactaatgccaagaatcgctccgaccggctgtatcgggaggcgtgggataaggacaaaacccagatccatataatgccagacacaccagacattgtgttggccaaggctaatctcatcaacacgagcgacaagttataccgaatggggtacgaggagcttaagcgaaagggatacgatctaccagtggatgccatccccatcaaagctgccaaggctagccgcgaaatcgccagcgagtacaaatataaggagggcttcaggaaacagcttggacaccatattggtgcccggaatatagaggacgacccaaagatgatgtggtccatgcatgtagcgaagatccagtctgacagggagtacaagaaagatttcgaaaaatggaagactaaattctcatctcccgtcgacatgcttggcgtcgtgctggcaaagaagtgccagactttggttagtgatgtggactataaaaactacctgcatcaatggacctgcttaccggatcaaagtgacgtgattcatgcccgacaagcgtacgatctgcaaagcgacaacctgtataagtcagatctgcagtggctcaaaggaattgggtggatgacctccggctcattggaggacgaaaagaataagcgtgccacgcagattctcagcgaccacgtgtatagacaacacccagatcagttcaagttttcatctttaatggacagtataccaatggtcctcgcaaagaataacgccatcaccatgaaccatcggctgtacaccgaggcctgggacaaagataagactacagtgcacattatgcccgatacacctgaggtcttgttggccaaacagaacaaagtgaactatagtgagaagctttacaagctcggcctagaggaagctaagcgaaaggggtatgacatgcgagtggacgccatcccgatcaaagcagccaaggcctctagggacatcgccagcgaatttaagtataaggagggctatagaaaacagctcgggcaccatattggcgcacgcgccattagggacgacccgaaaatgatgtggagtatgcacgtggccaaaatccaatctgatagggaatacaagaaggacttcgagaagtggaagaccaagttctcgagccctgtggatatgctcggtgtcgtgctagctaagaagtgccagaccctggtttctgacgtggattataagaactatctacatcagtggacgtgcttacccgatcaatctgatgtcattcacgcacgccaggcatacgatttgcagagtgacaatatgtacaagtcagacctccagtggatgcgtggcatcggatgggtgagtataggcagtcttgatgtggaaaagtgtaaacgggctaccgagatcctgtccgacaaaatttatagacagccacctgaccgtttcaagttcacttctgtgacagatagtttggaacaggtcctggctaaaaataatgcactgaatatgaacaagcgcctctataccgaagcttgggacaaggataaaacgcagatacacatcatgccggacactcccgaaattatgctcgcccgtcaaaacaagatcaactacagtgaaaccctgtacaagctagctaacgaggaagctaagaaaaagggatacgatctaagatcagatgccattcccatcgtggcggccaaggcttcccgcgatgtgattagcgactataagtataaagacggctaccgaaagcaactcggccaccatatcggagcgcgaaacatcgaagatgatcctaaaatgatgtggagtatgcacgtagccaaaatccaatccgatcgggagtacaaaaaggacttcgagaagtggaagactaagttctcctctcctgtggatatgctaggcgtcgtcctcgcaaagaaatgtcaaacattagtttctgacgtggactacaagaattatctgcacgagtggacttgtttgcctgaccagaatgatgtcatccacgcacgtcaagcttacgacctccaatcggataacatctataaaagcgacttgcagtggttaaggggaatagggtgggttcctatcggcagcatggatgtggtgaaatgcaagcgcgccgccgaaatcttgtcagataatatttatcgccagcccccagacaaacttaagttcacaagtgtcacagactcccttgagcaagtgctcgctaagaataacgccctgaacatgaataagaggctgtacacggaggcatgggataaagacaagactcaggtccacattatgcctgatactccagaaataatgttggcgaggcagaacaagattaattactctgagtcgctgtaccggcaggccatggaagaggccaagaaagaagggtacgacctgaggagcgatgctataccaatcgtggcagccaaggctagccgcgacatcgccagcgactacaagtataaggaagcataccgcaagcagctggggcatcacatcggggccagggcggttcacgatgaccctaagattatgtggtcgcttcatatagctaaagttcaaagcgatagggagtataaaaaggacttcgagaagtataaaacacgctatagctccccggtggacatgcttgggattgtgctggcgaaaaaatgccaaaccctcgtctccgatgtggactacaaacatccccttcatgaatggatttgcctccctgaccaaaacgatataattcacgcccggaaggcctatgatcttcagtcagacaacctgtacaagtctgacttggaatggatgaagggcataggttgggtacctatcgactctttggaggttgtcagagccaaacgggccggtgagctactgtcagataccatctatcgccagagacccgaaactcttaaattcacctcaattacggacacccccgagcaggtgctggcaaagaataatgctctgaatatgaataagcggctgtataccgaagcctgggacaacgataagaaaaccattcacgtcatgcccgacactcctgagatcatgctcgcaaagctgaatagaattaattactccgacaagttgtataaactggcacttgaggagtccaaaaaggaaggctatgacttgagactggatgcaattccgattcaggcagctaaagcctcccgggacattgcatcggactataagtacaaagagggttatcggaaacagctcgggcatcatattggagctcgaaacatcaaggatgatcccaaaatgatgtggtccatccacgttgccaagatccaaagtgaccgcgaatacaagaaagaattcgagaagtggaagactaaattcagctcccccgtggatatgttgggagtcgtcctggccaagaaatgccagatcttagttagcgacatagactataagcaccccctgcacgaatggacttgtctgcccgaccaaaacgacgtcatccaggccagaaaggcttatgacctgcaatcagatgccatctataaatccgatctggaatggctcagaggtatcggctgggtgccaattggtagcgtagaagttgagaaggtaaaaagagcaggcgaaattctgtcggataggaagtataggcaacccgcggatcaactcaaattcacgtgcataacagatacacctgagatcgtccttgccaaaaataacgcactgactatgtctaagcacctctacaccgaggcgtgggacgcggacaagacatcaatccacgtaatgccagacacaccagacatcttgctcgcaaagagcaattctgcaaacataagccagaagctgtacacgaagggatgggatgaaagcaagatgaaggactatgacctgcgtgccgatgctattagcatcaaatcagcaaaagccagccgtgatattgccagtgactataagtataaagaggcctacgaaaaacaaaaaggacatcacataggcgctcagtccatcgaagacgatcccaagatcatgtgcgctattcacgctggcaaaattcagagcgaaagagaatataagaaagagtttcagaagtggaagacaaaattctcctcacctgtggacatgctgagtatcctcctagccaagaaatgtcagaccctggtgacggatatagactacagaaactatctccatgagtggacctgcatgccagatcagaacgatatcatccaggcaaagaaagcttatgatcttcagtccgacgctttgtacaaagcggatctggagtggttacgcgggatcgggtggatgccacaagggtctcccgaggtcctgcgcgtcaagaatgcgcaaaacattttttgcgacagtgtatatagaacaccagttgtaaatctgaagtacaccagtatcgttgacacgcctgaggtggtgctggctaagtccaatgccgagaatatctctatcccaaagtaccgcgaagtgtgggacaaggacaaaacctctattcacattatgccagatacaccagaaatcaatctggcgagggccaatgcactcaatgtctccaacaaactttatagggaaggctgggatgaaatgaaggcagggtgcgatgtccgcctggacgccatccccattcaggctgctaaagcctcgcgagagattgcctcggattacaagtacaaacttgaccacgagaagcagaagggccattacgttggtaccctgaccgcccgagacgacaacaagattcggtgggctctgatcgccgacaagctgcaaaatgaacgggagtaccgactggactgggccaagtggaaggccaagatccagtcgcctgtggacatgctctctattctccattcaaagaatagccaggctcttgtgagtgacatggactaccgtaactatctgcaccagtggacatgtatgcccgaccagaacgacgttatccaagctaaaaaagcctacgagcttcagtctgacaatgtgtacaaggctgatctggagtggttgagaggcatcggatggatgccgaacgattccgtcagcgtcaatcatgccaagcacgccgctgatatctttagcgaaaaaaagtataggacaaagatagagacccttaatttcacccccgtcgacgacagagtcgactatgtgaccgctaaacaatctggggaaatcctcgacgatatcaagtatcgcaaagactggaacgcgacgaagtcaaagtatacactgactgaaactccacttctgcatacagctcaggaagcagcaaggattctggaccagtacctttacaaggaggggtgggagaggcagaaggctaccggttatatcctcccaccagatgctgtaccatttgtccatgcacaccactgtaacgacgtgcaatcagagctgaagtacaaagccgagcacgtcaaacagaagggccactatgtgggggtgcccacaatgcgggatgatccaaagctggtgtggtttgagcatgctgggcagatccagaacgagcgcctttacaaggaagactatcataagactaaggccaagatcaacattcccgccgacatggtctcagttcttgctgccaagcagggccagactctggtcagtgacattgattaccggaattacctgcaccaatggatgtgccatcccgatcagaatgatgttatacaggcaaggaaagcctatgacctgcaaagtgacaacgtctaccgagctgacctagaatggctacgtggcatcggttggataccattggattctgtcgatcacgtgcgcgtgacaaaaaaccaggaaatgatgagtcagattaagtataaaaagaacgcccttgaaaattacccaaacttccgatctgtggtggatcccccagagatagtcttggctaagattaactctgtgaaccaaagcgatgtgaaatataaagaaactttcaataaagctaaagggaagtacacattctcaccggacactccacacatttcccatagtaaagatatgggtaagctgtattctaccatcctctacaaaggcgcatgggaaggcacaaaggcttacggttacacgttggacgagagatacatccctatcgtaggcgcaaagcacgctgatctggtcaactccgagctgaagtacaaggagacctatgagaaacagaaaggacattatctggctggcaaggtcataggcgaatttcccggggtcgtccactgtctcgacttccagaaaatgcgcagcgccttaaattataggaagcactatgaggatactaaggccaatgttcatatacccaacgacatgatgaatcacgttttagcgaagcgctgtcagtacatactgtcggacctcgaatacagacattactttcatcaatggacaagccttctggaggagcctaacgtaatccgtgttcggaatgctcaggaaatcctgtccgacaatgtgtataaagatgacttaaactggttgaaggggatcggctgttacgtatgggacacaccacagattctgcacgcgaagaaaagttatgatctccaaagccagctgcagtataccgccgccggcaaagaaaacctgcaaaactacaacctggtgacagatactccgctgtacgtgacagcagttcagtctggtattaacgctagtgaagtaaaatataaagaaaattaccatcagattaaggacaaatatactactgtgttggagacagtcgactacgatcggacacgcaatctgaagaatctttactctagtaatctctacaaggaggcatgggacagagtcaaagctaccagttatatcttaccaagctccacactgagcctcactcacgccaaaaatcaaaagcatttggcctctcacataaagtatcgcgaagagtacgagaaattcaaggcattgtacaccctcccgcggagcgtagatgacgaccccaataccgctcggtgcctgagagttgggaagctgaacatcgaccgactctatagatccgtctacgaaaagaataagatgaagattcatatcgtcccagatatggttgaaatggtcaccgctaaggacagtcagaagaaggtcagcgaaatcgattatcgactgcggcttcacgagtggatctgccatccagacttacaagtgaatgaccacgtgcgcaaagtgactgatcagatctcagatatcgtctacaaggatgacctgaattggctcaagggcattggatgctatgtatgggatacgcccgagattctgcacgcgaaacacgcctacgacctgcgagatgacatcaaatataaggctcacatgcttaagacgagaaacgattacaagttggtcacagacacacccgtgtacgttcaggcggtaaaatccgggaaacagctttcagacgccgtatatcactacgactatgtccactccgtgagagggaaagtagcccccaccactaagaccgtggatcttgatcgagctctgcatgcatataagctgcagagctcaaatttgtataaaacgagtttgcgcacattgccaactggctatagacttccaggagatactccccattttaaacatataaaagacactcgctacatgtcatcatattttaagtacaaggaagcgtacgagcacactaaagcttatggctacactctggggcctaaggacgtgccattcgttcatgtgcgccgagtcaataacgtgacctcggaaaggttgtatagagagctgtaccacaagcttaaagacaaaatccacaccacacctgacaccccggagatccgacaggttaagaaaacacaggaggcggtaagcgaattaatttacaagtctgatttcttcaagatgcagggacacatgatttctctcccttatactccacaagtcatacattgcaggtacgtgggagatattacctctgatatcaagtataaagaagatctccaggtactgaaaggatttggctgttttctgtacgataccccagatatggtcagatccagacacctgaggaaattgtggagcaactacctgtatactgataaagccaggaagatgcgggataagtacaaagtcgtgttggatacaccagagtaccgtaaagtgcaggagttaaaaacccatctcagcgaactcgtttatcgagcagcaggaaagaagcagaaatccattttcactagcgtgcctgatacccccgacctcttacgagccaaacgcgggcaaaagctccagtcccaatatctttacgtcgagctggctacaaaggagaggcctcatcatcacgcaggcaatcaaacgaccgccctgaagcatgcgaaggacgttaaagacatggtgtccgaaaaaaaatacaaaattcagtatgaaaaaatgaaggataagtacacccctgtaccagacaccccaatcctgattcgcgccaagcgcgcatactggaatgcatccgatcttagatataaagaaacctttcagaagacaaagggaaaatatcacacagtgaaagacgcattggacatcgtataccaccgaaaggttaccgatgatattagtaagatcaaatataaggagaattacatgtcccaactgggtatctggcgatctattccagacagaccagagcatttccatcacagggcagttacagacaccgtgagcgatgtaaaatacaaagaggatctgacctggctgaaaggaatcggctgctacgcctatgacactcctgattttactctggctgaaaagaacaaaacactatattctaaatacaaatataaagaagtgttcgagcggaccaagtcagacttcaaatatgttgctgactccccaataaatcggcactttaagtacgcgacacaactgatgaacgagaagaaatacagagctgactacgagcaacgcaaggacaaatatcacttggtggtggacgagccccgtcacttactggccaagacggccggcgatcaaatctctcagatcaagtatcgcaagaattacgagaaatccaaggataagttcaccagcattgtagacacccccgaacaccttcggactacgaaggtaaataagcagattagtgacattctgtacaagctggagtataataaagccaagccccggggctacaccacgatacacgacacaccaatgctcctccatgttaggaaggtaaaggacgaggtgtcagacttgaaatacaaggaggtttatcagaggaacaaaagtaattgcactatagaaccggatgcggtgcatataaaggctgcaaaggatgcctacaaggtcaacacgaacttggattacaaaaagcagtatgaggcaaacaaggcccactggaaatggacccccgaccgtcccgactttctgcaggcagcaaagtccagtctgcagcagtcagattttgagtacaaactcgacagagaattcttgaaaggctgcaaactttctgtgacggatgataagaatacagtcctcgcgttaaggaacactttgatcgagagtgacttaaagtataaggaaaagcacgtaaaagaaagaggcacatgccacgccgtcccagacactccacaaatccttcttgccaagacagtgagtaatctcgtttctgagaataaatacaaggatcatgttaagaagcacctcgcacagggcagctataccactctgccagaaacccgggacactgtacacgtaaaggaagtgaccaaacacgtgtccgacactaattacaaaaagaagttcgttaaagaaaagggtaagtcgaactatagtataatgttggaaccccctgaagtgaaacacgccatggaggtggccaagaagcaaagtgatgtggcctatcggaaggacgcaaaggagaatctgcattacaccaccgtcgcagacagacctgatattaaaaaggctacacaagcagctaagcaagcttccgaagtggagtatcgcgccaaacatcgaaaagaagggtcccatgggctgagtatgctgggcaggcccgatatcgaaatggccaaaaaagctgcgaaacttagcagtcaggttaagtatcgggagaactttgacaaggagaaaggcaagacaccaaaatataaccccaaggactctcaactctacaaagtgatgaaagacgccaacaacctggcaagtgaagtgaagtataaagccgatctgaagaagttgcataagcctgtcacggacatgaaggaatccctcattatgaatcatgttctgaacacctcacagctggcctcaagctatcaatacaagaagaaatacgagaagagtaaaggacactaccacactatccccgacaacctagagcagctccatcttaaggaagctacagagctccagtctatcgtcaagtacaaagagaagtatgagaaagagcgaggaaagccaatgctggacttcgaaacaccaacctacattaccgctaaagaatcgcaacagatgcagagtggaaaagagtacaggaaagattatgaagaatctataaaaggaagaaatttgaccggcctggaggttacgcctgcccttctgcacgtgaagtatgccactaagatcgcatcagaaaaggagtaccgaaaggatcttgaggaaagcattagaggaaagggcctcaccgagatggaagacacaccagacatgttgagggccaagaatgcaacgcagatactgaacgagaaagaatacaaaagagacttggagctggaggttaagggacgaggcctcaacgctatggccaacgagacccctgactttatgagggcgcgaaacgccaccgacattgcctcacagatcaaatacaaacagtccgccgagatggagaaagcgaatttcacctccgtggtggacacgccagagataatccatgctcagcaggtcaagaacctgtcctctcagaaaaaatataaggaagacgcggagaagagcatgtcttactatgaaaccgtgctggatactcctgagatccagagggtccgcgaaaatcaaaagaatttcagtttactccagtaccagtgcgatttaaaaaacagcaaaggaaaaatcactgtggtgcaggacactccagagatcctgcgcgtaaaggaaaatcaaaagaattttagctccgtactgtataaggaggacgtctctccggggacggcaatagggaagacccccgagatgatgcgtgtgaaacaaacccaggatcatatttcaagtgtgaagtataaagaggccatcgggcagggcacacccatacctgacctgcctgaagtgaaaagagtaaaggagactcagaagcacatctcaagtgtgatgtacaaggaaaatctcggtaccggcattcccacaacagttaccccagaaatcgagcgggtgaagcgaaatcaggaaaacttctcctctgtgctttacaaggagaacctgggcaaggggattcccacaccaataacaccagagatggagcgtgttaagcgcaaccaggagaattttagttccgtgctttacaaggaaaacatgggtaagggtactcccctggcagtgacaccagagatggaacgggtgaagcataatcaagaaaatatatcatcagtcctttataaggaaaacgtggggaaggctaccgccaccccagtcacccctgagatgcaacgcgtgaaacgaaatcaggaaaacatatccagtgttctatataaggagaatttgggcaaagccacacctacaccatttaccccagaaatggagagggtcaagaggaatcaagaaaattttagctccgttctttataaagaaaatatgaggaaggcgacccctactcccgttacacctgaaatggaacgcgcaaaacgtaatcaggaaaatatttccagcgtgctatactccgatagtttccggaagcagatccagggaaaggcagcttacgtccttgatactccagaaatgcgccgggtgagggagacacagcggcatatatccacagtgaagtatcatgaagattttgagaagcataagggatgtttcaccccagtggtcaccgaccctatcaccgagcgtgtcaaaaaaaacatgcaggatttttcagatatcaactatcgtgggattcaaagaaaagtggtggagatggaacaaaagcggaacgatcaggaccaggagaccattacaggtctgagagtgtggaggacaaatcccggatctgtctttgactacgatcccgcagaagataatattcagtctcgatctttgcatatgatcaatgtccaagcacagcggcgatcccgtgaacagtccaggagtgcaagcgcgctctctatctccggcggggaagaaaagagtgaacatagcgaggcacctgaccaccacctctccacttacagcgatggaggggtgttcgctgtctctacagcctacaaacatgcaaaaactaccgagctaccacaacaacggtcaagctccgtggccacccaacagacgaccgtgagctctatcccatctcacccctcgactgcagggaaaatattccgcgctatgtacgattacatggccgcagatgccgatgaggtatccttcaaagacggggatgccatcatcaatgtccaggctatagatgaggggtggatgtatggtactgtccaaaggacgggcagaaccggaatgctgcctgctaactacgttgaggctatctag

SEQ ID NO: 125929 - DNA, 25578 bp, Artificial Sequence
  Description of Artificial Sequence: Synthetic coding sequence
atggctgatgacgaggattatgaagaggtcgtggagtattatacggaggaggtggtgtatgaggaggtgcccggagagacgattaccaagatttatgagaccacaactacccgcacttctgattatgagcagagtgaaacatccaagcctgcccttgctcaacctgccctagctcaaccggcatccgcaaaacccgtcgagaggcgaaaagtgatcaggaaaaaagttgatcccagcaaatttatgaccccttacatcgcccatagccaaaagatgcaggacctgttctctcctaacaagtacaaagaaaaattcgaaaaaaccaaaggtcagccatatgccagcacaacagatacacccgagcttaggagaatcaaaaaagtccaagaccagctgtcagaagtcaaataccgaatggatggcgacgtggccaagactatctgtcacgtggacgagaaggcaaaagacatcgaacacgccaagaaggtctcccagcaggttagcaaggtgctgtataagcagaattgggaggacacgaaggataaataccttctgccccctgacgcccccgaattagtgcaggctgtgaagaacaccgctatgttctctaagaagttatacaccgaggattgggaagctgataagtcactgttttacccttataacgactcaccggaactgagacgggttgcgcaggcgcagaaggccctcagtgatgttgcttacaagaagggattggccgagcagcaggcacagtttacacccctcgctgatccaccagacattgaatttgcaaaaaaggtcaccaatcaagttagcaagcagaagtataaggaggattacgagaacaagattaagggcaagtggagcgaaacaccatgcttcgaggtggcaaacgcaagaatgaatgccgataatatctcaactagaaaatatcaggaggatttcgaaaacatgaaagatcagatctatttcatgcagactgagacaccagaatacaagatgaataaaaaagccggagttgctgcaagcaaggtgaagtataaggaggattacgaaaagaataaaggcaaagcagactataacgtcttgcctgcttccgagaatccccagctgcgccagcttaaggccgctggagatgctctgtccgataaattatacaaagaaaattatgagaaaacaaaagccaagtcaatcaattactgcgaaacacccaaatttaaacttgatactgtcctgcagaacttcagttctgacaaaaagtacaaagattcctacctgaaagacatcctgggccactacgttggtagctttgaagatccataccatagtcactgtatgaaggtcaccgcacagaacagcgataagaactataaagccgagtatgaagaagatagaggcaaaggatttttcccccagacgatcacacaggagtacgaggctatcaagaagctggaccaatgcaaggaccacacatataaggtccatccggacaagacaaaatttacccaggtgacagattcacccgtgttacttcaggcacaagtcaactccaaacagctgagtgaccttaactataaggcgaagcacgaatcggaaaaatttaagtgccatatacccccggacacaccagccttcatacagcacaaagtgaatgcatataacctgtccgataacctctacaagcaggactgggagaagtccaaggccaagaaattcgatattaaagtggatgcgattccactgcttgctgccaaggccaataccaagaacacatcagatgtgatgtacaagaaagactatgaaaagaacaagggcaagatgattggtgttctttcgattaacgacgaccccaaaatgctgcactcgctgaaagtcgctaagaaccagtcggacagactctacaaagaaaattatgaaaagacgaaggcgaagtcaatgaattactgcgaaacaccaaaatatcaactggacactcagctgaagaatttcagcgaagctcggtataaggacctctacgtgaaagatgtgctgggacactatgtcggaagcatggaggacccctaccatactcactgtatgaaggtggccgcacagaatagcgataaaagctataaggcagaatatgaagaggacaaaggcaagtgctacttccctcaaacgattacacaggagtacgaggccatcaagaagctggaccagtgcaaggaccacacctataaagttcaccccgataaaaccaagttcacggcagtgactgatagccctgtcctgcttcaggcccagctgaacacaaagcagctgtctgatctgaactacaaggcaaagcatgaaggggagaaatttaaatgtcatatcccagcagacgcaccccagtttatccagcatcgcgtcaacgcctacaatctctctgacaacgtctataaacaggattgggagaaatctaaagccaagaaattcgacattaaagttgatgccattcccttactggctgccaaggccaacacaaagaatacttcagacgtgatgtataaaaaggattatgaaaagagtaaggggaagatgattggggctttgagcataaacgatgaccccaaaatgctccacagcttgaaaacagccaaaaaccagagtgatcgggagtatcgcaaggactacgagaaaagcaaaaccatttacaccgctcctcttgacatgctccaagtcacacaggccaaaaaaagccaggctatcgcctcagatgttgactataaacatattttacatagctattcctatccacctgacagcatcaatgttgacctcgccaagaaagcgtacgctctgcagagcgacgtcgaatataaggccgactataatagctggatgaaaggctgcggctgggtcccattcggcagtttggagatggagaaggctaagcgcgccagcgacattctgaacgagaaaaagtacagacagcatccggacactctcaaatttaccagcatcgaagacgcccctataaccgtgcagagtaagataaaccaggcccagaggtcagatatcgcttataaagctaagggcgaggagatcatccataaatataaccttccgcctgatctacctcagttcatccaggctaaggtcaatgcgtacaatatctccgagaatatgtataaggcagacctgaaagacctttccaagaaagggtacgacctcaggacagatgccattccgattcgtgccgccaaggccgcccgacaggccgcctcggacgtgcagtataaaaaagactatgagaaggccaaagggaaaatggtaggcttccagtcattacaggacgaccctaaactcgtccactacatgaatgtggccaagatacagtctgatagagagtataagaaggactacgaaaagacaaaaagcaagtataatacaccccacgacatgtttaacgtggtggccgctaagaaggctcaagatgttgtaagcaacgttaactacaagcattccctccaccactacacttacctgcctgacgcaatggacttggaactcagtaagaatatgatgcagatacagtctgataacgtgtataaggaggattacaataactggatgaagggtataggctggattccaatcggatctctggacgtggaaaaggtcaaaaaagccggcgacgcgctaaacgagaagaaataccgccagcaccctgatacacttaagtttacatcaatagtagactccccagtgatggtgcaagccaagcaaaacaccaaacaagtgtccgacatcctttacaaggccaagggagaagacgtcaaacacaaatatactatgtcccccgacctgccccagtttttacaagcaaaatgcaacgcctacaatatttctgatgtctgctacaagcgagactggtacgatttaattgccaaggggaataacgtactcggcgacgccatacccataacagctgccaaggcctcacggaacattgccagtgattacaagtacaaggaggcttacgagaagagcaagggaaaacacgtgggtttcagaagcctccaagatgaccccaaattagtccattacatgaatgtcgcgaagcttcagtccgaccgggagtacaagaagaattatgaaaatacaaaaacatcatatcacacacccggcgatatggtgtccatcactgcggcaaaaatggcacaggacgtcgctaccaatgtcaactataaacaacctctgcaccactacacttacctgcccgacgccatgtccctggagcatacaagaaacgtcaatcagatccagagtgataatgtttacaaggacgagtacaacagctttctgaaaggtattgggtggatcccgatcggtagtctggaggtggaaaaagtcaagaaggccggcgatgcactcaacgagcgcaaatatcgccagcatccggacaccgtcaagttcacctccgtgcctgattcaatggggatggttctcgcccaacataacacgaaacaactatcggacctaaactacaaagtggaaggtgaaaagctgaagcacaagtacacaattgatcctgaacttcctcaattcatccaggccaaggtcaacgctctgaatatgtcagacgcacactataaagccgactggaaaaagacaattgccaaggggtacgatttacggcctgatgcaatacctatcgtggccgcaaaatctagtcggaacatcgcctctgactgtaagtacaaagaagcatacgagaaagccaaagggaagcaggttggctttttgtctctgcaggacgacccaaagttggtgcattacatgaacgtcgccaaaatccagtccgacagagaatacaaaaagggctatgaggccagtaagacaaaatatcatactccattagacatggtctcggtgaccgctgctaaaaaatcccaagaagtagctacaaatgccaattaccggcagtcttatcaccactacacactcctgcccgacgccctcaatgtagagcactctaggaacgccatgcagattcagtccgataacctctataagtccgattttactaactggatgaagggcattggatgggtccccattgagagcctggaagttgagaaggctaaaaaagcaggcgagatcctgagcgaaaagaaatatcgacaacatccagagaaattgaaatttacttacgcaatggacactatggagcaggctcttaataaatccaataaattgaatatggataaacggctatacacagagaaatggaacaaagacaaaacaacaattcatgtgatgccagatacaccggacatcctgctatctcgagtcaaccagattaccatgagcgacaagctatacaaggcgggatgggaagaggagaaaaagaagggctatgacctccgacccgatgctatagccatcaaggcagcgagggcctcacgggatatcgcgagcgattacaagtacaagaaggcgtacgaacaagccaagggcaaacacattggctttagatctctcgaggacgaccctaagttggtgcacttcatgcaagttgcaaagatgcagtccgaccgcgaatacaagaagggatacgaaaagagcaaaactagctttcataccccggttgatatgttgtcagtagtcgccgccaagaagtctcaggaggttgccacaaatgccaattatcgaaatgtcatccatacctacaacatgttacccgacgcgatgtcctttgaattggcaaaaaacatgatgcagatccagtcagacaatcagtacaaagccgattacgcagatttcatgaaaggaatcggctggctgccgctcggctcactcgaagcagaaaaaaacaaaaaggcgatggaaattattagcgagaagaaatacaggcagcaccctgacactttgaaatattctacattaatggattcgatgaacatggtcctagcccagaacaacgctaaaatcatgaacgaacacctttacaagcaggcctgggaggcagataaaactaaggttcacatcatgcccgacataccccaaatcattctggcgaaagctaacgcaataaacatgtccgataaactgtacaagctgagtctcgaggagagcaagaagaagggctacgacctgcgacctgatgccatccctatcaaagcggctaaggctagtagagacatcgcttccgactataagtacaagtataactatgagaaaggcaaaggcaaaatggtggggttcaggtccctggaagatgacccaaagctggtccattcgatgcaggtcgcaaagatgcaatccgacagagagtataaaaagaattacgaaaacaccaagacttcataccatacaccggctgatatgctaagtgtcacagccgccaaggatgctcaggcaaacatcacgaacacgaattataagcatcttattcacaagtacattttgcttcctgacgcaatgaacattgaactgacgcgcaacatgaatcggattcaatccgacaatgagtataagcaggactacaatgagtggtacaaggggctaggttggagcccagctgggtcactcgaggtcgagaaggcaaaaaaggccactgagtatgcctccgaccagaagtacaggcagcatccttccaacttccagttcaaaaagttaaccgactcaatggatatggtgctggccaagcagaatgcgcacacgatgaataagcatctatacacaatcgactggaacaaagataaaaccaaaatacacgtgatgccagacaccccagacatcttacaggcaaagcagaatcagactctgtacagccagaaactctacaagctggggtgggaggaagccctgaagaaaggctatgatctgcccgtggacgccatcagcgtgcagctcgctaaggctagccgggacatcgctagtgactacaagtacaagcagggataccggaagcagctaggacaccatgtcggattccgaagcctgcaggacgacccaaagctggtgctctcaatgaatgtggccaaaatgcaaagcgaacgggagtacaagaaagacttcgagaagtggaaaactaagttttcaagtcctgtggacatgctgggcgttgtgctggcgaaaaaatgccaggagctggttagcgatgtggactacaaaaattatctgcaccaatggacgtgtctacccgatcaaaacgacgtggtgcaggccaagaaagtgtacgaattgcagagcgagaatctgtataagtccgatctagaatggctcaggggcatagggtggtcacccctcggcagtctggaggccgaaaaaaacaagagagccagtgaaatcatctctgagaagaagtatcgacagcctcccgaccgtaataagttcactagtatcccagatgcaatggatattgtcctcgccaagactaatgcaaagaataggtcggacaggttatacagagaggcctgggacaaagacaagactcagattcacattatgccagatacgcctgacattgtcctggcaaaagcaaacctgattaataccagcgacaagctctatagaatgggctacgaggaactcaaacggaagggttacgacctacccgtggacgctattccgatcaaggcagctaaggcatcccgagaaatagcttcagaatacaagtacaaggaggggttccgcaagcaactggggcatcacattggtgctagaaatattgaggatgacccaaagatgatgtggagtatgcacgttgccaagatccagtcagacagagaatacaaaaaagattttgagaagtggaagacaaagttttcaagtcctgtcgatatgctaggggttgtgctcgccaagaagtgccagactcttgtctccgatgtggattacaagaattacttgcaccagtggacatgtttgccagatcagtctgatgtgatccacgctcggcaagcatacgacctccagagcgacaacctctacaaaagcgatctgcagtggttaaaaggcatcggctggatgacaagcgggagcctcgaggatgagaaaaataaaagggccactcagatactctcagatcatgtctaccggcaacaccctgaccagttcaagttctcctcactgatggattccatccccatggttctggccaagaataatgcaataacgatgaatcaccgcctgtacacagaggcatgggacaaggataagacaactgttcacattatgcctgatacgccagaggtgcttttggccaaacagaacaaagtgaattactctgagaaattatataagttggggctagaggaagctaagcgcaagggctacgatatgagagtggatgcaataccaatcaaggcagccaaagccagcagggatatcgcgtccgagtttaaatataaggaggggtaccggaagcagctgggtcatcatatcggggcacgagcaataagagatgaccctaagatgatgtggtctatgcacgtggccaaaatccaatctgaccgggagtacaaaaaagatttcgagaagtggaagacaaaattctcctcccctgtcgacatgcttggcgtcgtgctggccaaaaagtgccaaaccctggtaagcgatgtcgactacaagaactacctccaccagtggacctgtctacctgatcagagcgacgtgattcacgcccgtcaagcttatgacctacagtccgataatatgtacaagagcgatctgcagtggatgagaggcataggctgggtttcgatcgggtctctcgatgttgagaaatgcaaaagagcaacagaaatattgtcagataaaatatatcggcagcctcccgaccgcttcaagtttactagtgtgaccgatagcctggaacaggtactggccaagaacaacgccataacaatgaacaagcgcctctacactgaagcctgggataaggataagacccagatccacatcatgcccgacaccccggaaatcatgctggcccggatgaataaaatcaattatagcgaatctctgtataagctggcaaatgaggaggctaaaaaaaaaggttatgacctaagaagcgacgctatccctattgtcgctgccaaggcttcacgagatattatttctgattacaaatacaaagatggctattgcaaacagctcggtcaccacattggcgcccgtaacattgaagatgaccccaaaatgatgtggagcatgcacgtggccaagatccaatctgatagagagtacaaaaaggacttcgagaagtggaagacaaaatttagctcacctgttgatatgctgggcgtagtcctcgcaaaaaagtgccaaacactggtgtcagatgttgattacaagaactacttgcacgagtggacatgtcttcccgaccagtccgatgtcatccacgcacggcaagcatacgacctgcagtcggataatatctataagtctgacctgcagtggttgagaggcattggttgggtgccgatcgggtccatggatgtagttaaatgcaaacgcgctacagaaatactgtcagataacatttacagacaacctccagacaagctgaagtttactagcgttaccgatagtctagagcaggtgctggccaagaataacgccctgaatatgaacaagcgtctttacaccgaagcatgggacaaggataaaacccagattcacatcatgcccgacaccccggagataatgcttgcacgtcagaataaaattaactatagtgagactctttataaactcgcgaatgaggaagcaaagaaaaagggttatgatctgcggtctgacgcgatcccaatcgtggcggccaaggcctcccgcgacgtgatttccgattataaatataaggacggatacagaaagcagctcggacaccacataggagcgaggaacattgaagacgatcccaagatgatgtggtccatgcacgttgccaagatccagtcggacagggagtacaaaaaggatttcgagaaatggaagacgaagttttccagcccggtggatatgcttggagtggtcctggccaaaaagtgtcagaccctagtgagtgacgttgactacaaaaactatctccatgaatggacttgtcttcctgaccagaatgacgtcattcatgcacgccaggcctacgacctgcagtccgataacatttacaaatctgacctacagtggctcagagggattggatgggtgcctattggttccatggatgtggtgaaatgtaaaagggcagccgagatcctgagcgataatatctacagacaaccacctgataagcttaagtttacaagcgtgactgacagccttgagcaggtgctagcaaagaacaacgcattaaatatgaacaagcgcctctataccgaggcttgggacaaggacaaaacccaggttcatattatgccagatactccagaaattatgctagccagacagaataaaatcaactacagtgagtctctgtaccgtcaggccatggaggaggctaagaaggagggatatgatctgaggagcgatgcaatacctattgtagcagcaaaggcctcaagagacatcgcgtctgactacaaatataaggaggcttacaggaaacagctggggcaccacatcggagcgcgagccgtgcatgacgatcctaagatcatgtggtccttacatatcgctaaggtccagtcagatcgtgagtataagaaggattttgagaagtacaagacccggtacagcagtccggtcgatatgctcggaatcgtgctcgcaaagaagtgccaaaccctggtctctgatgtagattataaacaccctctgcacgagtggatatgtttgccagaccagaacgatattatccacgcacgaaaggcctatgatctgcagtcggacaacttatacaagagcgacctggagtggatgaagggcatcgggtgggttcctatcgattccctcgaagtggtccgcgctaagagagccggcgagctcctttccgataccatttataggcagcgtcccgaaacattgaagtttaccagtattaccgatactcccgaacaggtgcttgctaaaaacaatgccctgaatatgaataagcggctctacaccgaagcctgggacaatgacaagaagaccattcatgtcatgccagatactccagagatcatgttagcaaaactgaatagaatcaactacagcgacaagctgtacaagttagctctggaagaaagcaaaaaggagggttacgaccttaggctcgatgctatccctattcaggccgcgaaagcctctagggacatagcctctgactacaagtacaaagaaggctaccggaagcaactaggccatcatatcggcgctagaaacattaaggatgatccaaagatgatgtggtcaatccatgtggcgaaaatccaatcagatcgcgagtataagaaagaattcgagaaatggaaaaccaagttctcatctccagtggatatgctgggcgtggtgctggcaaaaaagtgccagattcttgtgtctgatatcgattataagcatcccttgcacgagtggacctgtttgccagatcagaacgatgtaatccaggcccgcaaagcgtacgatcttcagtcagacgcaatttacaagtcagacctcgagtggctgaggggcatcggctgggttcctatcggttctgtcgaggtggagaaggtgaagcgtgcaggcgagatcctctccgatagaaaatatcgtcagccggccgatcagctgaaattcacctgcatcacggacactcccgaaattgtcctcgctaaaaataacgccttgaccatgtccaaacatctctatacagaagcttgggacgctgacaagacatccattcacgtgatgccagacacgcctgacattttgcttgcgaaatctaattctgctaatatcagccagaagttgtataccaaggggtgggatgaatccaaaatgaaggactatgacctaagggccgacgccatttctatcaagtcagccaaggcctcgagggacatcgcatctgattacaaatataaggaagcctacgagaaacagaagggccaccacattggggcccagtccattgaggacgaccctaaaattatgtgtgccattcacgctggcaagatccaaagtgagcgtgagtataagaaagagttccagaagtggaagactaaattctcgagtccagtggacatgctttccatcctcttagcaaaaaaatgccagacactggtaaccgacatcgactacaggaattatcttcacgagtggacatgtatgccggaccagaatgacatcatccaagccaagaaggcttacgatctgcagagtgattcggtgtacaaagccgatttagaatggctccgaggaattggatggatgccagaaggatccgtagaaatgaatcgggtgaaggttgctcaggatttggtgaatgagcgcctgtacaggacccgtccagaagctcttagctttacaagtatagtggacaccccggaggtggtcctggcaaaggcaaactccctgcagatctccgagaagctgtaccaggaagcatggaataaagacaagtccaatattaccatcccgtcagatacccccgagatgctgcaagctcacatcaatgccctgcaaatatccaacaaactttatcagaaagattggaacgacgctaagcagaagggctacgatattagagctgatgctatcgagattaagcatgccaaagcctcaagggagatcgcctcagagtacaagtacaaggaggggtatagaaaacagctagggcatcatatgggctttaggacactgcaggatgacccaaagagcgtgtgggccatccatgcagcaaaaatccagagcgatcgggagtacaagaaggcttacgaaaagtccaagggtatccacaacacccccctggatatgatgagcatcgttcaggcaaagaagtgtcaggtattggtgagcgacattgactaccggaattatctgcatcagtggacctgcttacctgatcaaaacgatgtgattcaggccaaaaaagcctatgacttacagtccgataacctttacaaatccgaccttgagtggctcaagggcattggctggctcccagaaggttccgtcgaagtgatgcgagtcaaaaatgctcaaaacctgctgaacgagagactataccgaattaaacctgaggccctcaaattcacatcgatcgtggacactcctgaagtgattcaggctaagataaatgcagtgcagatctcagaaccactctatagggacgcttgggaaaaggaaaaagccaatgtaaacgtgccagcagacacacctctgatgttgcaatctaagatcaatgccctacaaatatcgaacaaacgctaccagcaggcgtgggaggacgttaagatgaccggctatgatctccgcgcagacgccataggaattcaacacgccaaggcatcccgggatattgcaagcgattatttgtacaagaccgcctacgagaaacagaagggacattatatcggttgtcgaagtgcgaaagaggaccccaaactggtgtgggccgccaacgtgctgaagatgcagaatgaccgactctataagaaagcatacaatgaccacaaggccaagatcagcattcctgttgatatggtaagcatttccgccgccaaggaaggccaggcgctggcgtccgacgtggactatcgccactacttgcaccattggagttgtttccccgaccagaacgacgtgatacaggcaagaaaagcctatgatttgcagtccgactcagtatataaggccgacttggagtggctgcgaggcattggctggatgcctgagggtagcgttgagatgaatcgggtgaaagtagcccaggacctcgttaacgaaaggttgtatcggaccagacccgaggcccttagttttacgtcaatagtggacacccctgaagtcgtactggctaaagccaactctctgcagattagcgaaaaactgtaccaggaggcctggaacaaagacaagagtaacattacaatcccgagcgatacacccgagatgctgcaggctcatattaacgcacttcagatcagtaacaagctctatcagaaggactggaacgacaccaagcagaagggctacgatatcagggctgacgcaatagagattaaacatgcaaaggccagccgtgaaatcgccagcgagtacaaatacaaagagggctaccgcaagcagctggggcaccatatgggtttccggacactgcaggacgaccctaagagtgtatgggccattcacgcagccaaaattcagagtgaccgagagtacaagaaggcttacgagaagtcaaaggggattcataatacaccattggacatgatgagcatcgtgcaggccaagaagtgccaggtgctggtatcggacatcgattaccgcaactacctacaccagtggacctgcctgcctgaccagaatgacgtaatccaagctaaaaaagcttatgacctccagagtgataacttgtacaaaagcgacctcgagtggttgaagggcatcggatggctgcccgagggctctgtggaggtcatgcgcgtcaagaatgcacagaatttgctaaacgagagattgtaccgaatcaaacccgaggccttgaagtttacaagcattgtggatacccccgaggtgatacaggctaaaataaatgctgtgcagatttcagagcccctgtatcgtaatgcttgggaaaaggagaaggccaatgtgaacgtgcccgcagacacacccctaatgttgcaaagcaagatcaacgcattgcaaatcagtaacaagcggtaccaacaagcatgggaggatgtcaagatgacagggtacgacctgcgggcagatgcaataggaattcagcacgcaaaggcctccagggatatcgccagcgactatttatacaaaacagcctacgaaaagcagaaagggcattatattggttgcaggagcgcaaaggaggatccaaaacttgtgtgggccgccaatgttctgaagatgcagaatgaccgtttgtacaagaaagcatataacgaccacaaagccaagatttcaatcccagtcgacatggtgtccatttcagccgccaaggagggccaagccttggcctctgacgtcgattacagacactacctgcaccactggtcctgcttcccagatcagaatgatgtcatacaggcacggaaggcctacgaccttcagtccgactcagtctacaaagccgacctagagtggctcaggggcatagggtggatgccggaagggagtgtggagatgaaccgggtcaaggtggcacaggatctggtgaacgagaggctgtaccgcacccgcccagaggctttaagcttcacctccattgtcgatactcccgaggttgtgcttgccaaagccaactcgctccaaatctcagagaagttgtatcaagaggcttggaataaagacaagtcaaatataaccattccttcggataccccggagatgttgcaggcccacattaacgcgctgcagattagtaacaaactgtaccagaaggactggaacgacacgaagcagaaggggtatgatataagggccgacgccattgagattaaacacgcaaaggcctctcgggagatcgccagcgagtacaaatacaaagaagggtaccgcaagcagcttggacaccacatgggcttccgcacactgcaggatgacccaaagagtgtttgggccatccacgccgctaagattcagagcgaccgagaatataaaaaagcctacgaaaaatccaagggaattcacaatacacctcttgatatgatgagcattgtgcaggccaagaagtgccaagtgttggtgtccgacatagactacaggaactatctacatcagtggacttgtctcccagaccagaatgacgtgatccaggcgaaaaaggcctatgacctccagtcagacaatctgtataaaagtgatttagagtggctgaagggcatcgggtggctgcctgaggggagcgtggaggtgatgcgggtaaagaacgcccagaacttactgaacgagcgcctgtataggatcaaaccggaagcgctcaaattcacgagcattgtggacactcccgaggtgatccaggcgaagatcaatgccgtacaaatcagcgaacccctgtatcgggacgcatgggaaaaggagaaagcaaatgtgaatgttcccgccgacaccccccttatgttacagtccaaaatcaacgcactccagatcagcaacaagaggtaccaacaggcctgggaggatgtgaaaatgacaggatatgacctcagagccgatgcaattgggattcagcacgcgaaagccagtcgcgacattgcctctgactacctctataagacagcatatgaaaaacagaagggccattatattgggtgtcgttccgcgaaagaggaccccaagctggtctgggcagcaaatgtgttgaagatgcagaacgatcgattgtataagaaagcttacaacgatcacaaagccaaaattagcatcccggtggacatggtgagcatctctgcagccaaggagggacaagctttagccagcgatgtggattaccgacactacttgcatcgatggtcttgctttcctgatcagaacgacgtaatccaagccaggaaggcttatgatctgcagtcagacgccctgtataaagccgacttggagtggctcaggggaatcggatggatgcctcaaggctctccggaggtgctgcgggtgaaaaacgctcaaaatatcttctgtgatagtgtgtataggaccccagtcgtgaatctgaagtacacctccatcgttgatactcccgaagtggtcttagctaaaagtaatgcagagaatattagcatcccaaaatacagagaggtgtgggataaagataagacatctatacacattatgccagatactccagaaattaaccttgcccgagccaatgctctcaatgtgagcaacaaactgtacagggaaggctgggacgagatgaaagctgggtgcgatgtgagactggatgcaatccccatccaggcggccaaagcctcgagggaaatcgcctccgattataaatacaaattagaccacgaaaagcagaaggggcactacgtggggactctgaccgccagggatgataacaagatcagatgggccttgatcgcggacaaattacagaatgaacgggaatacaggctagattgggccaaatggaaggcgaaaatccagtctcccgtcgatatgcttagcatcttgcactcaaagaattcacaggccctcgtatccgacatggattaccgcaattaccttcatcagtggacttgcatgcccgatcagaatgatgtcatccaggctaagaaggcatacgaactgcagtctgacaatgtttataaggctgatttggagtggctgcgcggcatcggctggatgcctaatgacagcgtgagcgtgaaccatgccaaacatgcagccgatattttcagcgaaaaaaagtacaggaccaagattgagactcttaactttacaccagtggacgatcgggttgattatgtaacagctaagcaatctggtgaaatcctggatgacattaaataccggaaagattggaatgctactaaatccaagtatacgctcaccgagacccccttattgcacaccgctcaggaggccgcccggatcctggaccaatacctgtacaaggagggttgggaaagacaaaaggccacaggctatatccttccacctgatgcagtcccttttgtccacgcccatcactgcaatgacgtgcagtccgaactgaagtacaaggcggaacacgtgaagcagaaggggcactacgtgggagtaccaactatgagagacgacccaaagttagtgtggttcgaacatgctggccagatacagaacgagcggctgtataaggaggattaccacaagacaaaagccaagataaatatccccgccgatatggtgtccgtgctcgcagcgaaacaaggtcagacattagtgagtgatatagactaccggaattatcttcatcaatggatgtgccaccctgaccagaacgatgtgattcaagcaagaaaggcatacgacctccagagcgataacgtctaccgcgctgatctagaatggctgagaggcatcgggtggattccactggattccgtggaccatgttagggtgactaagaaccaggagatgatgtcccagatcaagtataagaagaatgcattggagaattaccccaactttcgctctgttgtagacccccccgagattgttctggctaaaattaatagcgtcaaccagtcagatgtgaaatacaaagaaaccttcaacaaggcgaagggaaagtacaccttttccccggatacaccccacattagtcattctaaggacatgggaaagctgtatagtaccattctctataagggtgcatgggaaggaaccaaggcttatggttacacattggatgagaggtacatcccaatcgttggcgctaaacacgcagatctggttaatagtgaacttaagtacaaggaaacctatgagaaacagaagggccactacctggcaggcaaggtcattggggaattcccaggcgtcgtgcattgcctggactttcaaaaaatgcgatcggccctgaactaccgtaagcactacgaagataccaaggcaaacgtgcacatccctaatgacatgatgaaccatgtgcttgccaaacgatgtcagtacatcctctcagacctggagtatcggcactacttccatcagtggaccagtctcctggaagagcctaatgtgattagggtacgaaacgcacaggaaatcctaagcgacaacgtgtacaaggatgatttgaactggctgaaagggattggttgttatgtatgggataccccacagattctgcatgctaaaaagtcttacgatcttcagagccaactacagtacaccgcagccggcaaagagaacctccagaactataatctggtgactgacacacccctttacgttacagcggtgcagagcggaattaacgctagtgaggtaaagtataaggagaattaccaccagatcaaagataagtacaccacagttctggaaacggtggactatgaccgaactcggaatctcaaaaatttatattccagcaacctgtacaaggaggcctgggaccgtgtaaaggctacctcttatatcctcccctcctccacgttaagcctgacgcacgctaagaatcagaagcacttggcatctcatattaagtaccgtgaagaatatgaaaagtttaaggctttgtacaccttgcctcggagcgtagacgatgacccaaacaccgcaaggtgtctgagagtgggaaaattgaatatcgaccgactctatcggtccgtatatgagaaaaacaaaatgaaaatccacatcgtccctgatatggtggagatggttaccgccaaggattctcagaagaaggtgtccgagatcgactataggctccggctgcatgagtggatctgtcatccagatctacaagtcaatgaccatgttcgcaaggtcacggatcagattagcgatattgtgtacaaagacgacctgaattggttaaagggaatcgggtgctacgtgtgggatactccagaaattctacatgccaagcacgcctatgatctgcgggatgacatcaagtacaaggcccacatgctgaagacgcgcaatgattacaagctcgtgaccgacacacccgtttacgtgcaggccgtaaagagtggaaaacagcttagcgacgccgtctatcactacgattacgtgcactctgttagaggcaaggtggcacccacgacgaagacagtggatttagacagagctttgcacgcatataaattgcaatcttctaatctttacaaaaccagcctgcggactctgccgacgggatataggcttccaggtgacaccccacattttaagcatatcaaggatacacggtacatgtctagctacttcaagtacaaggaggcttacgagcatactaaggcatacgggtacaccctcgggccaaaggatgtcccttttgtgcatgtgcggcgtgtaaacaatgtaacatccgagcggctgtatcgggagctctatcacaagctaaaggataagatccatacaacccccgacacacccgaaattagacaggttaagaagacccaggaagcagtgtccgaactgatttacaagtcagatttcttcaaaatgcagggccatatgatttcattaccttataccccacaagtgattcattgtagatatgtgggtgacattacctcagacattaaatacaaagaggacctccaggtgttgaaggggttcggatgcttcctttacgatactcccgatatggtgcggtcccggcacctaaggaaactgtggagcaattatctctataccgacaaagcacgaaagatgagggataaatacaaggtagttctggacactccagaatatcgcaaggtccaggagctcaagacccacttaagcgaattagtctatcgagcagcaggcaaaaaacagaaatctattttcacctccgtcccagacacccccgacctcctcagagcaaagagagggcaaaaacttcagtcacagtacctttacgtagagctggctaccaaagaaaggcctcaccatcatgccggaaaccagacgaccgcacttaaacacgccaaggacgttaaagacatggtgagtgagaaaaagtataagattcagtacgaaaagatgaaagataagtacacccccgtgccagatacgcccattttgatacgggccaagcgcgcatattggaacgcgtctgatctccggtacaaggagactttccagaagaccaagggtaaatatcacactgttaaagatgctttggatatcgtttaccatcgcaaggtgactgacgacatctcgaagattaagtacaaggagaattatatgtcgcagctgggaatatggaggagtattcccgacaggccagagcactttcaccaccgagccgtgacagacacagtctctgacgtcaaatataaggaagatcttacttggctgaagggcattgggtgttacgcatacgacactcccgatttcaccctggccgaaaaaaataaaaccttgtattccaaatacaaatataaggaggtctttgagcgcaccaagagcgattttaaatatgtggccgactctcccatcaacaggcactttaagtacgccacacagctcatgaatgagaaaaaatacagggccgattacgagcagaggaaagataaatatcacttggttgttgacgaaccccgtcatctgctcgccaagaccgctggggaccaaatcagtcagataaagtaccgcaagaactacgaaaagtccaaggacaaatttactagcatcgtagacactcccgaacatcttcgaaccacaaaggtcaataaacaaatctccgacatactgtataaactcgagtacaataaggccaaacctagaggatataccacaattcatgatacccccatgttactgcatgtcaggaaagttaaagatgaggttagcgaccttaagtataaggaagtctaccagaggaacaagagcaattgcacgattgaacctgatgctgtccatatcaaggccgccaaagacgcttacaaagtcaacaccaatttggattacaagaagcagtatgaggcgaacaaggcacattggaaatggacacctgacaggcccgactttctccaggccgctaagtcttccctccagcagagcgattttgagtataagctggacagagaatttctgaagggatgcaaactgagtgtaacggacgataaaaacaccgtgttggcccttcgtaatactttgatcgaaagtgatttgaagtataaagaaaaacacgtgaaagagcgcggaacttgccacgctgtgccggacacaccacagatactcttggctaagactgtcagcaatttagtgtcagagaataagtacaaggatcatgtcaaaaagcacctcgcgcaggggagttacaccactctgcctgaaactcgagatacggtccatgtgaaagaagtgaccaagcacgtttcagataccaactataaaaagaagttcgtcaaggagaaaggcaagagtaattattcgattatgctggagcccccggaggtcaagcatgccatggaagtggcaaaaaagcaaagcgacgtcgcttacagaaaggatgcgaaggagaatctgcattataccacggtcgcggaccgccccgacataaaaaaagcaacccaagccgcaaagcaagcttctgaggtcgagtacagagccaaacatcgtaaggaagggtcccacgggcttagcatgctaggccggcccgatatcgagatggcaaaaaaggctgccaagctgagcagccaagtgaagtaccgagagaactttgacaaagagaaaggtaagactcccaaatacaatcctaaagacagtcagctgtacaaggttatgaaggatgccaataacttagcctccgaggtgaagtataaggctgacttgaagaaactccataagcctgtgactgatatgaaagagagtctaattatgaaccacgtgctcaacacaagtcagcttgccagctcataccaatataagaagaagtacgaaaaatccaaagggcactaccacactatacctgataacctggagcaactgcacctcaaagaggctaccgaactgcagtcaattgtcaaatacaaagaaaaatatgaaaaggagcggggtaagccaatgctggactttgaaaccccaacgtacattaccgcaaaagagtcacagcagatgcaatccgggaaagagtaccggaaagattacgaggagtcaatcaaaggcagaaatctgactggcctggaggtgacgcccgctctccttcacgtgaaatacgccactaagattgcgtccgagaaggagtaccgtaaggacctggaggagtctattcgggggaagggactgaccgaaatggaagacaccccggacatgctcagggctaagaacgccactcagattctgaatgagaaggagtacaaacgggacctcgaactggaggtgaagggacgagggttgaatgctatggccaacgaaactccagattttatgcgggcaaggaacgccacggacatagcttcgcagatcaagtacaagcagtctgctgagatggagaaagccaatttcacatctgtcgtcgacacacctgagatcattcatgcacagcaggtgaagaacctgagctctcagaaaaagtataaagaagacgccgaaaaatcaatgtcctattacgagaccgtccttgacactccagaaatccagcgcgtgcgtgagaaccagaaaaacttcagcttgctgcaataccagtgcgacctgaagaacagcaaaggaaaaataacagtggtacaggatacccccgaaattctgagggtgaaggaaaatcagaagaatttcagtagtgtcctgtacaaggaggacgtttctcccggtaccgccattggcaagacaccagagatgatgcgagtcaagcaaacacaggatcacatatctagcgtgaaatacaaggaggcgatcggccagggcactccaattccagatctccccgaggtgaagcgagtgaaggaaacccagaagcatatcagtagcgtgatgtacaaagagaaccttggcacaggcatccccacaactgtgaccccggagatcgagcgggtgaaaagaaaccaagagaacttctcctccgtgttgtataaggagaacctgggcaaaggaatccccacacctattaccccagaaatggagcgagttaaacgaaaccaagagaatttctcctccattctttacaaggaaaaccttagcaaaggaacacccctgcccgtcacccctgaaatggaaagggtaaagctgaatcaggaaaacttctccagtgtgctatacaaagagaacgtcggcaaggggatacctatcccaattactccagaaatggaaagagtgaaacataatcaggagaacttttccagcgtgttatacaaggagaatctaggcactggtatccctattcctatcacgccagaaatgcagagagtaaaacacaatcaggaaaaccttagttctgtgctgtataaagaaaacatgggaaaaggaaccccactgcccgtgacccctgaaatggagcgggtgaaacacaatcaagaaaatataagctccgttttgtataaggagaacatgggtaaaggaacacccctgccagtaactccagagatggaacgcgtgaagcataatcaggagaatatctcgtccgtcctctataaggaaaatatgggaaagggcactccattagctgtcacaccagagatggagcgggtcaagcacaaccaggagaatataagctcagtactgtacaaagaaaatgtgggtaaagctacagctacccctgtaacgcctgagatgcagagggtcaagagaaaccaggagaatatttctagtgtcctatacaaggagaacctgggaaaggccacccctacaccgttcacccctgagatggaaagggttaaacgcaaccaggagaacttcagttcagtcctttacaaggagaatatgaggaaagcaactcccacccccgtcacccccgagatggagcgggctaagagaaatcaagaaaatatctctagcgtactctattctgactcctttaggaagcagatccaggggaaggccgcctatgtgcttgatacccccgaaatgcggagggtccgcgaaacccagagacatatctccacagttaagtatcacgaagatttcgagaagcacaaagggtgtttcactcccgttgtgactgatcctattactgaaagagtgaagaaaaatatgcaggacttcagcgatatcaattacagggggattcagaggaaggtagtcgagatggagcagaagcgcaacgaccaggaccaggagaccatcaccggcctgcgggtctggaggactaatccaggtagtgtgtttgactatgatcctgcagaggataacatccagtctaggtcactgcacatgattaacgtgcaggcgcagagacgcagtcgagaacagagccggagcgcaagcgccctctccatctccgggggagaggaaaagtccgagcactcagaagcccccgaccatcatctgtcaacctattcagacggaggggtttttgctgtgtcaacggcctacaagcatgccaaaacaaccgagttgccgcagcagcggtcatctagcgttgctacgcagcaaaccacagtgtccagcattccatcccacccttctactgccggtaaaatcttccgggctatgtatgattacatggctgccgacgcggatgaggtgagcttcaaggatggcgatgcaataattaatgtccaagcgattgacgaaggttggatgtatggcacagttcagcggacagggaggaccggaatgctgcccgctaactatgtggaagctatctag

SEQ ID NO: 125930 - DNA, 864 bp, Artificial Sequence
  Description of Artificial Sequence: Synthetic coding sequence
atggctgatgacgaggattatgaggaggtagtcgaatactacaccgaggaggtggtgtacgaggaagtgcctggcgaaaccattacaaagatatacgagacaactacaacaaggacctccgactatgagcagtcagaaaccagcaaacccgctctggctcagcccgctttagcacagccagcaagtgcaaaacccgttgagcggaggaaagtgatacggaaaaaagtggacccttcaaaattcatgacaccatacattgcgcatagccaaaaaatgcaagaccttttctccccaaacaaatacaaagagaagtttgaaaaaacaaagggtcagccatatgcttcaaccacagatacacccgaactccggaggattaaaaaagtccaggatcagctatcggaagttaagtatcgcatggatggcgacgtggcaaaaacaatctgtcatgttgacgagaaagcaaaggatattgagcatgccaagaaagtgtcacagcaggtgtctaaggtactgtataaacagaattgggaagataccaaggataagtacctgctgccaccagatgcacctgagctggtgcaggctgtaaagaacactgccatgttcagcaagaaactgtacaccgaggactgggaggctgacaaatcactgttttatccatacaatgactcacctgaactgcgacgtgtcgctcaggcccaaaaggcgctaagtgacgtggcctacaagaagggcttggccgaacagcaggcccagtttacacccttggcggacccccctgatattgaatttgctaagaaggttacaaaccaagttagcaaacaaaaagaaaagaagaggaagaaaaaaaggaaaaaagtgtag

SEQ ID NO: 125931 - DNA, 1317 bp, Artificial Sequence
  Description of Artificial Sequence: Synthetic coding sequence
atgatgcgggtcaagcagacacaggaccacatttccagcgtgaaatacaaggaagccatcggtcaagggaccccaatccctgatttgccggaggtaaaaagggtgaaggagactcagaaacatatcagctcggtaatgtataaggagaacttgggcacagggattccgaccactgtgacgcccgagatagaaagggtaaagcgaaaccaggaaaacttctctagtgtcctgtataaagaaaacatgggcaaaggtactcccctcgcagtaactcccgaaatggagagggtcaaacataaccaggagaatatctcatcggtgctttacaaggagaacgtgggaaaggcaactgccactcctgtgacaccagagatgcaacgcgtgaagaggaaccaggagaatatcagttctgtcttatacaaagagaacatgcggaaagccacgccaacccctgtaacccctgaaatggagcgtgccaaaaggaaccaggagaatatatcgtccgtcctttactcagactcatttaggaagcagatccaggggaaggcagcttacgttctcgacactccagaaatgagacgggtgcgtgagactcagcgacacatctcaaccgttaagtatcacgaggatttcgagaagcataaagggtgttttaccccagtggtcacagatccaatcaccgagcgcgtcaaaaaaaacatgcaagactttagtgatatcaattatagaggcatccagagaaaggtggtggagatggagcagaagcggaatgaccaggaccaggagactatcacaggactgcgcgtttggaggacgaaccccggcagcgtttttgactacgaccccgctgaggacaatatacagagtcgctccctgcatatgataaacgtgcaagcgcagagacgctcccgcgaacagtctcgctccgccagcgctctcagcatcagcggtggtgaagagaagagtgaacactccgaggcccctgatcaccatctcagcacatactccgacggcggcgtattcgccgtgtcaaccgcttataagcacgctaagactacagaactgccacaacaacggtcatcatcagtggccacacagcagaccacagtaagcagcatcccctctcaccccagcactgctggcaagatatttagggccatgtacgactacatggcagctgatgctgatgaagtctccttcaaggatggcgatgcaatcattaatgtgcaagccattgacgaagggtggatgtacggaactgttcagcgcactggcaggaccggcatgttgcccgctaactacgtcgaagccatttag

SEQ ID NO: 125932 - DNA, 1014 bp, Artificial Sequence
  Description of Artificial Sequence: Synthetic coding sequence
cagaagtacaaagaggattacgaaaacaagataaaggggaaatggtctgagactccttgtttcgaagttgcaaatgctcggatgaacgccgataacataagtacccggaagtatcaggaggacttcgagaacatgaaggatcaaatttacttcatgcagacggagacccccgaatataaaatgaataaaaaggccggggtggctgcgtcaaaagtgaagtataaggaagactacgaaaagaacaaagggaaggctgactataacgtgctacccgccagtgaaaaccctcagctgcgccagctcaaggccgccggggacgcactttccgataaactgtacaaagagaattacgagaagaccaaggccaagagcattaattattgcgagacaccaaaattcaaactcgatactgtgttgcagaacttcagtagtgataaaaagtacaaggactcatatctcaaagacatcctcggacattatgtaggatctttcgaagatccctaccatagtcattgcatgaaagtgactgctcaaaattccgacaaaaactacaaagctgagtacgaagaagacaggggaaaaggtttcttcccccagacaatcacccaagaatatgaagccataaaaaagctggaccaatgcaaagatcatacgtataaagtgcatcccgacaagacaaaattcacccaagtaactgatagccctgtactgctacaggcccaagttaacagcaagcagctgtcagatctgaattataaagccaaacatgaatccgagaagtttaaatgccacataccgcctgacaccccagcgttcatccagcacaaggttaacgcgtataatttgtccgacaatctgtacaaacaagattgggagaaaagtaaggcgaagaaatttgacatcaaagtggacgcaattcctctcttggctgccaaagctaatacaaagaataccagtgatgtgatgtataaaaaagattatgagaagaacaaagtgaaggttcagcaacggtag

SEQ ID NO: 125933 - DNA, 5193 bp, Artificial Sequence
  Description of Artificial Sequence: Synthetic coding sequence
atgaacgttcagccctgctctagatgtggctatggagtgtaccctgcagagaagatcagctgtattgaccaaatctggcacaaggcctgctttcactgcgaggtttgcaaaatgatgctatctgtgaataactttgtgtcccaccagaaaaagccctactgccatgcacacaaccccaaaaacaataccttcacaagcgtgtatcacactcccctgaatttgaacgtcagaactttccctgaagctatcagcgggatccatgaccaagaggatggtgagcaatgcaaatcggtgttccactgggacatgaagtctaaggacaaggaaggagccccaaacagacagcccctggctaacgaaagagcgtattggacaggatatggagaaggcaatgcatggtgtcccggcgccctacccgaccctgaaattgtgcgcatggtagaggcccgtaaatccctcggcgaagagtataccgaggactacgagcagccacgcggcaagggcagctttccagctatgatcacgccagcttaccaacgcgccaagaaagcaaatcagttggcctcacaggtcgagtacaagagaggtcacgatgagagaatctctagatttagcacggtggtcgatacgcctgagctgctgcgttcaaaagccggagcccagctgcagtcagacgtgaggtacacagaagactacgaacagcagcgagggaaaggatcattccccgctatgatcacacctgcttatcagatcgccaaaagagcaaacgaactcgcttcggacgttcggtaccaccagcagtaccagaaagagatgcgcgggatggccggaccagccataggggcagagggtattttgacacgggagtgcgcggaccaatatgggcaggggtatcctgaggagtatgaggagcatcgggggaagggttccttccctgcaatgatcacacccgcataccagaatgctaagaaggcgcatgagctggcgagtgacatcaaataccggcaagacttcaacaagatgaaaggggccgcgcattaccatagtttgccggcccaagacaatctcgtgttgaaacaggcacagagcgttaataaactcgttagtgaggtcgagtataagaaggacttagagtcatctagaggccactctattaattactgtgaaaccccgcaatttcgaaacgtatcgaagatcagtaaattcacttctgacaacaagtacaaggaaaactatcagaatcacatgcgcgggcgatatgagggagtcggaatggacaggagaacactgcacgccatgaaggtgggttctctagcctccaacgtagcctataaggctgactataaacatgacatcgtggactataattatcctgcgactttaactccctcctaccagacagcaatgaagctagttccactcaaggatgcaaattacagacaaagtattgacaagcttaagtattcatcagtgactgacactcctcagatcgtccaggcaaaaattaacgctcaacagctcagccacgtcaactaccgagctgactatgagaaaaacaaactcaactatacgttgccacaagacgtcccccagctggtcaaggccaagactaacgctaagctcttcagtgaagttaaatacaaagagggctgggagaagactaaggggaagggatttgaaatgaagctagacgctatgtcattactagccgccaaggcctcaggagagctagcaagcaatattaagtacaaagaggaatacgagaaaacaaaaggcaaggcgatgggcacagcagactctaggctgctccacagcctgcagatcgcgaaaatgagttccgaggtggaatataaaaaaggctttgaagagtccaaaactagatttcatctaccaatggacatggtgaatattcgtcacgccaaaaaagctcagaccctggcctcagacctcgactatcgcaagaaactacatgaatatactgttctccccgaggacatgaagactcagtgggcaaaaaaagcttacggacttcagagtgaacttcaatataaagcagatctggcctggatgaaaggcgtcgggtggttaacagagggatctctaaatttggaacaggccaagaaagctggccaactggtgtccgagaagaactatcgccagagagttgacgagctgaaattcacaagcgtcacagactccagccagatggagcatgccaagaagtcccaggagcttcagagcggcgtggcctataaggctggcaacgaacagagcgtgcatcaatatacaatcagcaaggacgagcccctcttcctgcaggcacgcgccaatgcagccaatctcagcgagaaactgtataagtcctcttgggagaaccagaaagccaagggatttgagttaagactcgatagcctcaccttcttggcagctaaagctaagcgcgatctggcctccgaagtgaaatacaaggaggactacgagaggagtcgaggaaagctgattggcgccaaagacgtgcaaggtgattcacaaatgtctcactcactgcaaatgtccaagctccagagtgagctagagtataagaaaggtttcgaggatactaaaagtcagtgtcacgtttctctggacatggtgcacctcgtgcatgcaagaaaagctcagcaccttgctacagatgtaggctacaaaactgccgagcatcattttaccgccctcccaactgatatgaaggtggaatgggcgaagaaagcctacggactgcaaagcgataatcagtatagagctgatgtgaaatggatgaaaggcatgggatgggtagctactggctcactcaatgtcgaacaggccaagaaggcaggagaattgatctcagagaagaaatatagacaacatcctgacgccctgaaattcacatcaattaaagacacccccgagatggtgcaagctcgaatatcctatacccaggccgtggatagattgtatagggaacaaggcgaaaacatcaagcaccactataccccgactgctgacctcccagaagtgcttctcgctaagttaaatgccatgaacatctcggagacaaggtataaggaaagctggagcaagttaagagacggggggtataagctgcggttagatgcgctgccttttcaggccgcaaaagcttcgggcgagatcatttctgactacaagtacaaggaggcattcgagaagatgaagggccagatgctgggatcccgtagccttgaagacgacatcagtctggcccatagcgtttacgcaactagtctccagtctgacgtcaattacaaaaagggcttcgagcattcaaaggctcagttccatctgcccttggatatggccgctctcgtccacgccaaaaaagcgcagacactagcctcaaaccaggactataagcacccacttccacagtacacctcccttgcggaagatttgcggttatcctgcgccaagaaggctcacaagctgcagtcagagaacctgtacagatccgatcttaattttatgagaggtgtcgcttgcgttattcccgggactcttgagattgagggtcgcaagaaagcctccgagctcattagcgaatccaagtacaggcaacatcctcattctttcaagtacacagccgtgaccgatacacctaacctgctgcatgctaagttctctaaccagattaccaatgagcggttgtacaaagccgcgggagaagatgccaggcatgaatatacaatgacgctcggcctgccggagttcatcagggcaaagaccaatgcagcgaacttgagcgacgcccgatataaggaatcttggaggaatctgcgcgctcagggctacaagctcacgatcgaggccctgccttttcaagcggcccgggcatccggggacattgcttccgatttcctatatcggcacgattttgtgaaggaacgggggaaactgattgggccacagagcgtcagagacgacccacgtatacagcactgtagaaggatggggcaactgcaatcagaacttcaatatcgtcgtggcgccaccagttcccaagctcagtttcacttgcctatggatatggttcacctggtgcatgcaaagaatgcccaagctcttgctagtgatcatgactatcgcacccagtaccacaagttcaccgcgctgcctgaggacctgaagatggcttgggctaaaaaggctcacgcacttcagagtgagcttaggtataaatccgacctaatcggaatgaaaggaattggttggctggcccttcgctcccctcagatggagtccgcaaaaaaggcgggggaactgatttcagaaacgaaatatcgcaagaaacccgatagcattaagttcactacagtggtggactcacccgatctggtccacgccaaaaatagctacatgcactgtaacgagaggatgtatcgctccggagatgctgagagcctgcatcggtataccctcattcccgaccatccagatttcacacgggcccgtttgaatgctctgcatctgtccgacaaggtttaccgcaactcctgggagcagacacgggctggatcctatgacttcaggctcgacgcgatcccattccagacggcacgggcttccagagaaatcgcgtctgatttccgttacaaggaagcgttcctacgggaccgaggacttcagattgggtatagaagtgtcgatgatgatcccagaatgaagcactttctgaacgtgggtagactgcagtctgacaatgagtacaagaaagatttcgcgaaatcccgttcgcagttccacagttcgactgaccagccagggcttcttcaggccaagcgctcacaacagctcgccagtgatgtgcattaccggcagccattaccgcagccgacctgcgatccagagcagctcggcctccgacacgcgcagaaggcacaccagctgcagtccgacgttaaatataagtccgacttaaaccttacgagaggagtgggatggacaccacctgggtcctacaaagtggagatggctagacgtgccgccgagctcgcaaatgcaaggggcctgggcttgcagggcgcttacaggggggccgaagcagtcgaagctggagaccatcagtcgggcgaagtgaacccagatgccaccgagatcctgcatgttaagaagaagaaagccctgctgctgtag

SEQ ID NO: 125934 - DNA, 5088 bp, Artificial Sequence
  Description of Artificial Sequence: Synthetic coding sequence
atgaatgtccagccatgttctcggtgcggctatggggtgtacccagctgagaaaatctcttgcatcgatcagatttggcataaggcctgctttcactgtgaagtgtgcaagatgatgctcagtgtaaacaactttgtgtcccaccaaaaaaaaccctactgtcacgcccacaatccaaaaaataacacctttaccagcgtctaccacacgccactgaacctcaacgtgcgaaccttcccagaagcgatttccggaattcatgaccaggaagatggcgaacagtgtaaatctgtgttccactgggatatgaagtccaaggacaaagagggagcacctaatcgacagcctcttgccaacgaacgggcttattggaccggatatggcgaggggaatgcctggtgccccggggcactgcctgatccagagatcgtcaggatggttgaggccaggaagtcactgggtgaagagtacacagaagactatgagcagccacgaggcaagggctcatttcccgccatgattacacctgcgtatcagcgcgctaaaaaggccaatcagctggcttctcaggttgaatataaacggggccatgacgagaggatatcacgcttcagtaccgtggtagacaccccagaactgcttcgctcgaaagcgggcgctcaactccagtcagatgttagatacaccgaagactatgaacaacaacgtggcaaaggcagctttcctgcaatgataacacccgcctatcagattgccaagagagccaacgaactggcttccgacgtcaggtatcaccaacagtaccagaaggagatgcgtgggatggccggccccgcgattggagcagaagggatcctgaccagagagtgtgctgaccaatatgggcaaggttatcccgaggagtacgaggaacataggggaaagggcagctttccagccatgatcacccctgcctaccagaacgccaagaaggcccacgagctggccagcgacatcaaatataggcaggattttaataaaatgaagggggcagcacattaccacagtctgcctgctcaagataacttggtgttgaagcaagctcagtctgttaacaagctggtgtctgaaaataaatacaaggagaattaccagaaccatatgcgcggcaggtacgagggagtgggcatggaccgccgtacccttcatgccatgaaggtcggatccttagcctccaatgtagcctacaaagccgattacaaacacgatattgtcgattataactatccagccactctgaccccttcttatcaaacagccatgaaactcgtgccgctcaaagacgccaattatagacagtctatagacaaattgaaatacagttccgtgactgatactcctcagatcgtgcaagccaaaataaatgctcagcagctgagtcacgttaactatcgggctgattatgagaaaaataaactgaattataccttgccgcaggatgttccgcagctggtcaaggctaaaaccaacgcgaaattgttctccgaggttaaatataaggaggggtgggagaaaaccaaagggaaaggattcgagatgaaactcgacgcgatgtccttgttggctgcgaaggcgagtggggagttggctagcaatatcaaatacaaagaagagtacgaaaaaaccaagggcaaggctatgggtacagcagactcccgattactgcacagtctacaaattgccaaaatgagctccgaggtggaatataaaaaaggcttcgaggaaagcaaaacacggtttcaccttccgatggatatggtgaacattaggcacgcaaaaaaagcccaaactctcgcttccgacttggactaccgaaaaaaactccacgagtacaccgtgttgcccgaagatatgaagacacagtgggctaagaaggcatacggactgcagagtgagctacaatacaaggccgacctggcatggatgaaaggagtcggttggctgacagaaggctccctgaatctggaacaggccaaaaaggctggccagctggtcagcgagaagaactaccgccagcgtgttgacgagcttaaatttacgtccgtgacagactcctctcagatggaacacgcgaaaaaatcacaggaactccagtccggtgttgcctataaggctgggaatgagcagtctgtccaccaatacactatcagtaaggacgagcccttattccttcaggctagagctaatgccgccaatctttccgagaaactctataaatctagctgggagaatcaaaaggccaaaggatttgaactgcggctggattcccttacttttctggccgccaaggctaagagggacctcgcaagtgaggttaagtataaagaggactatgaacggagcagggggaagctcatcggggccaaggacgtccagggagatagccagatgtcacactccctccaaatgtccaagcttcagtctgaattggagtacaagaagggtttcgaagacacgaaatcgcagtgtcatgtgagcctggacatggtccacttagtgcacgctcgcaaggcgcaacatctggcgacagacgtcggatataagaccgcagaacatcacttcacagcccttccaaccgatatgaaggtggagtgggcaaaaaaggcttatggactgcagagtgacaaccagtatcgcgctgatgtgaagtggatgaaggggatgggttgggtcgctacagggagtctcaacgtggaacaggcaaagaaggcaggggagctgatcagtgaaaagaagtacagacaacaccccgatgctctcaaatttactagcatcaaggacacccctgaaatggtccaggccagaattagctacacgcaggcagtggataggctgtacagggaacaaggagaaaacatcaaacatcattacactcctacggccgatctcccagaggtgctgctggcgaagctaaacgcaatgaacatttccgaaactcggtataaggagagttggagtaagcttagagacggcgggtataagctgcgtctggacgcactgccattccaggccgcgaaagccagcggagagattatatctgactataagtacaaggaggctttcgagaagatgaagggacagatgctggggagccgctctctggaggacgacataagtctcgcccacagcgtctatgctaccagtttacagtccgatgttaattacaagaaagggttcgaacactccaaagcccaatttcatctgcccttagatatggcagctctcgtccacgccaaaaaagctcagacacttgcctccaaccaggactataagcatccgctaccccagtacacttcactggctgaagatctgcggctgtcttgtgcaaagaaagcgcataagttgcagtccgagaacctctacaggagcgacctcaattttatgcggggggtggcctgtgttattccgggaactttagagattgagggccgaaagaaagctagcgaactgattagtgagagcaagtaccggcagcatcctcacagcttcaaatacacagcggtgacagatacacccaacctgcttcacgccaaattttctaaccagataacgaacgagagactatacaaagcggctggagaagacgctcgacacgaatatactatgactttgggactgcctgagtttatccgagctaagacaaatgctgctaatctttctgatgctcgttataaggaaagttggcgaaacttgcgcgctcaaggttacaagttgactatcgaagccctgcccttccaggccgcccgcgcatctggagacatagcgagcgactttttgtacaggcatgacttcgtgaaggaacggggtaagttgatcggaccacagagtgttcgcgacgacccacgcatccagcactgtcggcgaatgggccaactgcagagcgagctccagtatcgccgcggagccaccagctcacaggctcagttccatcttcctatggacatggtacacctggtgcacgcgaagaatgcccaggctctggcttccgatcacgactaccgcacccagtatcacaaatttaccgcactcccagaggacttgaagatggcttgggcaaaaaaagcccatgctctacagagcgagttgaggtacaagtccgatttgatcgggatgaaaggtattgggtggctcgcgctacgctctccccaaatggagtccgcaaaaaaagccggcgagttaatttctgagactaagtacaggaaaaaacctgatagtatcaaatttaccacagtggtggacagcccagatttagtacatgcgaaaaactcttatatgcactgcaacgagcggatgtatcgttccggcgatgcagaatcattgcatcgatacaccctgataccagaccatcctgatttcacaagggctagactgaacgcactccatctgtcggacaaagtgtatagaaacagctgggagcaaacacgggccgggtcctatgatttccgtctagatgcaatcccgttccagactgctcgagccagtcgagaaatagccagtgacttcagatataaggaggctttcctgagggatagggggctgcaaattggctatagatccgtggacgacgacccacggatgaagcactttctgaatgtgggtcggctgcaatccgacaatgagtacaagaaagatttcgctaagtctcgcagtcagtttcactcttcgaccgaccagccagggctcctacaggcaaaacgcagccagcagctggcctcagatgtccactaccgccagccactaccccaacccacatgtgatcccgaacagctagggctacgacacgcccagaaggcacaccagttgcaaagtgacgtaaaatacaagagcgatctcaatttaacccgtggagtaggatggacaccgcctggatcctacaaggtggaaatggctagaagggccgctgagttggctaatgcgcggggcttagggctccagggggcatatcgcggcgctgaagccgtggaagcaggggaccaccaaagtggggaggttaatccagacgcaaccgaaatcctgcatgtaaagaagaaaaaggcacttctgttatag

SEQ ID NO: 125935 - DNA, 2559 bp, Artificial Sequence
  Description of Artificial Sequence: Synthetic coding sequence
atgcgcggcatggccggtcctgctatcggcgccgaggggatcctgacacgggagtgtgcggatcagtacggacaaggttatccagaggagtacgaggagcaccggggaaagggtagcttcccggctatgattaccccagcctaccagaatgctaaaaaagctcatgagcttgcatcagacataaagtaccgccaggattttaacaaaatgaagggggccgcacactatcactcgctgcctgcgcaggacaaccttgtccttaaacaggcacagagcgtcaacaagctcgttagcgaagtcgagtacaagaaagacttggagtcctcccgcggccactctattaactattgcgagacaccccagttccgcaatgtctccaaaattagtaaattcaccagtgataacaagtacaaagaaaactaccagaatcacatgcgggggaggtatgaaggcgtgggaatggaccggcgcaccttacatgcaatgaaggtgggtagtctggctagtaacgtggcttataaggccgattacaagcatgacatagtcgattataattatccagcaaccctgacaccgtcataccaaactgccatgaagcttgtccctcttaaagatgccaactatagacagagtattgacaagctcaagtattcaagcgtcacagacaccccacaaatcgtgcaggctaaaatcaacgctcaacaactgtctcacgttaactaccgcgcagattacgaaaaaaacaaactgaactacaccttaccgcaggacgtcccccagctcgtgaaagcaaagacaaacgccaagctgttcagtgaagttaagtacaaggaaggctgggagaaaacgaaaggcaaggggtttgaaatgaaactcgatgctatgtcgctcttggccgccaaggcatctggagaattggccagcaacgtgcatctcctgttgagcttaaagattaagtacaaagaagagtacgagaagaccaagggaaaggcaatgggtaccgccgactccaggttgctgcattcccttcaaattgccaagatgtcctcagaggtcgagtacaagaagggatttgaagaatccaagaccaggttccacctccccatggatatgggagtgggatggctcactgaaggctccctgaatctggaacaggctaagaaagcgggtcaactcgtctcagaaaaaaactatagacagcgcgttgatgagctcaaatttacatctgtgacggatagcagtcagatggagcacgccaagaagtcccaggaactgcagtctggagtggcttacaaggctggtaatgagcagtctgtacaccagtacaccatatccaaggatgaacctctcttcctgcaagcacgggcaaacgccgccaacctctcagagttcctgtacaggcacgatttcgttaaggagcgggggaagcttatcggtccgcaaagtgtcagggacgatccccgtatccagcactgcagacggatgggtcaactccaaagtgaacttcagtatcgacgcggcgcgacaagctcccaggctcaatttcatcttcctatggacatggtgcacctggtacacgctaagaacgctcaggcacttgcgtctgatcatgattacaggactcagtaccacaaattcacggcactaccggaggacctgaaaatggcatgggctaaaaaagctcacgcccttcagtccgagctcaggtacaagtccgatctgataggcatgaaaggaatcggctggcttgccctgagatcaccccagatggagagcgctaagaaagcaggcgaactgatttccgagactaaatacaggaaaaaacccgactcaatcaaattcacaacagttgttgactctcccgatttggtgcatgccaagaactcctacatgcactgcaatgagcggatgtaccggtccggtgacgcggagagccttcacagatataccttgatccccgaccatcccgatttcacaagggctcgcctaaatgctcttcatctctccgatttccggtataaggaagcttttcttagagatcgagggttacagattggataccgatccgtggatgatgacccaagaatgaaacatttcctcaatgttggacgacttcagtcagataatgaatacaagaaagattttgccaagagtcgctctcagtttcattcctctaccgaccagccaggactgctgcaggctaaacgctctcagcaactcgcgtccgacgttcactatcgacagcccctgcctcagcctacatgcgacccggaacagctggggttaaggcacgcacagaaggcccatcagcttcaatctgacgtgaagtacaagtccgacctgaacctgactagaggggttgggtggacgccccccggctcatacaaggtggagatggcgaggcgggcagctgagctggccaatgctaggggactcggacttcagggagcttatagaggcgcagaagctgtcgaggcaggagatcaccagagtggagaggtcaatcctgacgcaaccgagatcctgcatgtcaaaaaaaaaaaagccctcctcctgtag

SEQ ID NO: 125936 - DNA, 5217 bp, Artificial Sequence
  Description of Artificial Sequence: Synthetic coding sequence
atgaacgtgcagccatgttcaagatgcgggtacggggtttaccccgctgagaagatatcctgcattgaccaaatttggcataaggcctgttttcattgcgaggtgtgcaagatgatgctgtcagtgaacaatttcgtttcacatcagaaaaagccttactgccacgcccacaatcccaaaaacaatacattcactagtgtttaccacacgccactgaatctgaatgtgaggaccttccctgaggctatctccggcatccacgatcaggaggatggagaacaatgcaagagcgtattccattgggatatgaagagcaaagataaggagggggctccaaatcgccagccactggcaaatgaacgcgcgtactggacaggatatggtgaaggcaacgcgtggtgtccaggagccttgcctgaccccgaaatagtgcggatggtggaggccagaaagtccctgggtgaggaatatacagaagactacgaacaaccacgcggcaagggttccttccctgcaatgattacaccagcctaccagagagccaagaaagcaaaccaactggcttctcaggtggagtacaagcgaggccatgatgagcggatctcacgcttctccaccgtggtcgatacccctgagctgttgagatccaaagctggggcacagctacagtctgatgtcaggtacaccgaagattacgagcagcagaggggtaagggctctttccccgctatgattacccctgcttaccagattgccaagcgcgccaacgaactcgcttcagacgtcagataccaccagcaataccagaaagaaatgaggggtatggcgggtcctgccatcggtgcagagggaatacttacaagagaatgtgcagatcagtacggccagggatatccagaggagtacgaggagcatcgcgggaaggggtcttttccggctatgataacccctgcttatcagaatgccaaaaaagctcacgagttagcctcagatatcaagtaccgccaggacttcaacaagatgaaaggagctgcccactatcactccctcccggctcaggacaacttagtcctaaagcaagcccagagcgtcaacaagttagtcagcgaggtggagtataagaaggatctggagtcctcccgcgggcactccataaactattgtgagacgccgcagttccgcaacgtttccaaaatcagcaaattcaccagtgacaataagtataaggaaaattatcagaatcatatgagagggcggtacgagggggtcggaatggacagaaggacattacatgccatgaaagtcggctctcttgcgagcaatgttgcctacaaggctgactataagcacgatattgtcgattataattaccctgccacactcaccccaagctaccagaccgcgatgaagctcgtacccctcaaggacgccaactacaggcagtccatcgacaaactcaagtattcttctgtgacagacaccccacagatagttcaggctaaaatcaacgcccaacagctgtctcacgtaaactatagggcggattacgaaaaaaataaactgaattatacactcccgcaggacgttccacaattagtcaaagctaaaactaacgccaaactgttttctgaggtgaagtataaggaagggtgggagaaaaccaaagggaaaggatttgaaatgaaacttgatgcaatgtcactgcttgctgccaaagcatcaggggagttagcaagtaatgtacacctgcttcttagcttgaagattaagtacaaagaagagtatgagaaaacaaagggaaaagcaatggggacagccgactctaggcttctgcacagcttacagatagccaaaatgagtagtgaggtggagtacaaaaaaggtttcgaagaaagcaaaacacggttccatctgcccatggacatggtcaatattcgccacgcaaagaaggcgcagaccctcgcctctgacctcgactaccggaagaagcttcatgaatacacggtactccctgaggacatgaaaactcagtgggccaagaaagcttacggtctccagtccgaactgcaatataaggctgacctggcttggatgaaaggcgtagggtggctgacagaaggcagcttgaacttggaacaagctaaaaaggctggccagctggtgtctgagaagaactataggcagcgcgtggacgagttgaagttcacgtctgtcaccgactctagccaaatggaacatgcgaaaaagagccaggaactgcagtccggcgtggcctataaagccggaaatgagcagagcgtccatcaatacactatctccaaagatgaacccctgtttcttcaggcacgggcaaatgccgccaatttgtctgagaaactgtacaagtcttcatgggagaatcagaaggcgaaggggttcgagctgagattagactctttgactttcctggccgctaaggctaagagagacttggcctccgaagtgaagtacaaggaagactatgaacgcagtagggggaagctgatcggtgcaaaagacgtgcagggagacagtcaaatgtctcactcccttcagatgagcaaattacaaagcgagttggaatacaagaagggttttgaggataccaaatctcaatgtcacgtgtccctggacatggtgcatctggtgcatgcgaggaaagcccagcacctggccaccgatgtaggttacaaaactgccgagcatcactttacagcactcccaaccgacatgaaggtcgaatgggccaaaaaggcttacggccttcagtcagacaaccagtacagggcagatgtgaaatggatgaaaggaatgggctgggtcgccaccggatctctcaatgtcgagcaagctaagaaagccggcgagttaatcagcgaaaaaaagtatagacagcaccccgatgcactgaagtttacgagtatcaaagatacaccagagatggttcaagcaagaatctcctatactcaagcggtggatcgcttgtacagggagcagggggagaatattaaacaccattacacccccactgccgatttgccagaagtgttactcgcaaaacttaacgctatgaacatttctgaaactcggtacaaagaatcctggagcaagcttcgcgacggcgggtataaactgcgactcgacgccctcccgttccaggccgccaaggcatccggagaaataatatcagattataagtacaaggaagcattcgagaagatgaaaggtcagatgctgggaagcaggtcattggaggacgatatcagtctcgcccactccgtttacgcaactagtctgcagagtgatgtaaattacaagaagggattcgagcactctaaagcccaattccacctgcctcttgacatggccgcattggtgcatgcgaagaaggcacagaccttggcttccaaccaagattataaacacccactcccccaatatacctcattggcagaggacctaaggttgagctgcgccaagaaagcccacaagttacagagcgagaacctgtaccgatctgatcttaacttcatgcgaggagtggcctgcgtcattcccggcaccctggaaatagagggacgcaaaaaagcctctgaactcatttctgagtcaaaatacagacagcacccacacagcttcaagtatactgccgtcactgatacacccaatctcctgcatgccaagttctccaatcagattaccaacgaacgattgtataaagcagctggggaagacgccagacatgagtataccatgactctcggactgcctgaatttatcagggccaagacaaacgcggccaacttgagcgacgctcgttacaaggagagctggcgaaatcttcgagcccaaggatataaactcacaattgaagccctcccctttcaggcagctcgggcgagcggggacattgcctccgactttctgtataggcatgatttcgtaaaggaaagagggaagttgatcgggccacagagcgtgagagatgacccaagaattcaacactgcagacggatgggacagttgcaatccgaattgcaatacaggcggggcgccacatctagccaggcgcagtttcacttgccaatggacatggtccacctggtgcacgctaagaacgctcaggccctagctagcgatcatgattatagaacccagtaccataaattcacagccttgccagaggatctgaaaatggcgtgggcaaagaaagcccatgcactccagtctgaattgaggtataagtccgacctcatcggaatgaaggggattggctggctcgctcttagatccccccagatggagagcgcaaaaaaggccggggaactgattagcgagaccaaatacaggaaaaagcccgatagtatcaagtttacaacggtggtggatagtcccgatttggttcatgcaaagaatagctatatgcattgcaatgagaggatgtaccgcagcggcgacgctgaaagcctacacagatacacgctaatccctgatcacccagacttcactcgtgctaggttaaatgcccttcatttgtccgacaaggtgtatcgaaatagttgggaacaaacgagagccggctcctacgactttcgattagacgccatccccttccagacagccagggcttcaagggaaatagctagcgattttcggtacaaggaagcgtttctcagggatcgcggattacagattggctataggtccgtagatgatgacccacgcatgaagcattttctgaacgtgggccgtctgcagtcagataatgaatacaagaaggacttcgcgaagtccagaagtcaattccatagctccaccgaccagcccggactgctgcaagccaaacgctcacagcagttagcaagtgatgtgcactaccggcagcctttgccacagccgacgtgtgatcctgaacagctaggattgcgacacgctcagaaagcccatcagttgcagtccgacgtgaaatacaagagcgatctgaacctgacacgcggtgtgggctggacgcccccgggcagttacaaagtggaaatggcccgcagagcagccgaactggctaacgctcgaggacttggacttcagggagcctaccgcggggccgaggccgtggaggctggagaccaccaatccggtgaagtgaacccagatgccactgagattctccatgttaagaagaaaaaggcgctgctcctgtag

SEQ ID NO: 125937 - DNA, 5112 bp, Artificial Sequence
  Description of Artificial Sequence: Synthetic coding sequence
atgaatgttcagccttgttccaggtgtggctacggcgtgtaccctgccgaaaaaatatcatgcatcgaccagatctggcacaaagcctgttttcactgcgaagtgtgcaagatgatgctatcagtgaacaactttgtaagccaccaaaaaaaaccttactgtcacgcccacaatcccaagaataacacgttcacttccgtctaccacacccctctgaatctaaacgtccgcacctttccagaggccatctcaggcatccacgatcaggaggatggtgaacagtgcaaatccgtctttcattgggacatgaagtcaaaagataaggagggtgcccctaacagacagccacttgctaacgagagagcctattggacaggctacggagagggcaacgcttggtgtcccggcgcactgcccgacccagaaatcgtcaggatggtagaagcgcggaagagcttaggagaggaatatactgaggactatgagcaaccaaggggcaaagggtcttttcctgcgatgattacaccagcttatcagcgggccaagaaggctaatcagctcgccagccaggttgagtataagcgcggtcatgacgagcgtatctcacgcttctcaactgtagtggacacgccagagctgttgcggagcaaggcaggtgcgcagctgcagtctgacgtcagatacacggaagactatgaacagcagagaggaaagggttctttccccgcaatgataacacccgcataccaaatagcaaagcgcgcaaatgaactggcctccgacgtgagataccaccagcagtaccaaaaggaaatgcgcgggatggcgggacccgctattggcgctgaaggaatcctaacaagggagtgcgccgaccagtatggccagggatatccagaggaatatgaggaacaccgcgggaagggttcattcccggcgatgattacccctgcatatcagaacgctaaaaaggcccacgagttggcgagtgacattaagtacagacaggacttcaacaagatgaagggcgcggcacactatcattcattacccgctcaagacaatctcgtgctaaagcaggcgcagagcgtcaacaagctcgtttccgaaaataaatacaaggagaactaccagaaccatatgcggggtcgttatgagggggtcggcatggatcggaggacccttcacgcaatgaaggtgggcagcctggcctccaacgtggcctacaaggcagattataaacatgatattgtcgattacaattacccagctaccctgacacctagttaccagactgcgatgaagctcgtgcccctgaaagacgccaactatcgtcagtcgatcgataaattgaagtattcatccgtgacagataccccacagatagtgcaggccaagataaacgcccagcagctcagccatgtgaattaccgggccgactatgagaagaacaagctgaactatacactgccccaggacgtgcctcaactcgtgaaagctaagactaacgctaaactatttagcgaggtcaaatacaaagaaggatgggagaagacaaagggaaaaggcttcgaaatgaagctggatgctatgagtctgctcgccgccaaagccagcggcgagctggctagtaatgtacacttgttattgtcactcaaaatcaaatataaagaggagtatgaaaagaccaaaggcaaagctatggggacagccgatagtaggctgcttcactctctgcagattgcaaaaatgtcatccgaggtggagtacaagaagggatttgaagaatccaagacaagatttcacctgcctatggatatggtgaatattcgccacgccaaaaaggcacagacgctggcctcagacctggattacagaaagaagctccatgagtatacagtcctgcccgaggatatgaaaacacaatgggcaaagaaggcttatgggttgcaatcagagcttcagtacaaggccgatctggcctggatgaagggggtggggtggctgaccgaagggtcacttaatctggagcaggctaaaaaggccggacagctcgtatccgaaaaaaactaccgccaacgcgtggacgaactgaagtttaccagtgtgactgactcatctcaaatggaacacgcaaagaaatcgcaagagttacagtccggtgtggcctataaagctggaaatgaacaaagtgtacatcagtataccattagcaaagacgagccactgtttctgcaggccagagccaacgctgcgaatctctctgagaaactttacaaatcgagttgggagaatcagaaagccaagggatttgagcttcggctcgactcgctaacttttcttgctgctaaggcaaagcgcgacttggcgtcggaggtgaaatataaggaagattacgaacgctcccggggaaaattgattggcgccaaggacgtgcaaggagactctcaaatgtctcactctctgcagatgtctaagttgcaaagcgagctggagtacaagaaaggctttgaggataccaaatcacagtgtcacgtttctttagacatggtgcatctggtacacgcacggaaggcgcagcaccttgccaccgacgtgggatataagactgccgagcaccatttcaccgctctgccaacagacatgaaggtggagtgggctaaaaaggcatacggcctgcagagcgacaaccagtaccgtgccgatgtgaaatggatgaaaggcatgggatgggttgccaccgggagccttaacgtggagcaagccaaaaaggccggtgagcttatcagcgaaaaaaaataccggcaacaccctgacgcgctgaagttcacaagcatcaaagacactccagagatggtgcaagctagaatctcctatactcaggcggtggaccgtctgtaccgggaacagggtgaaaacatcaagcaccattatactcccaccgccgatctgcccgaggttctcctggccaagctgaacgcaatgaatattagcgaaactaggtataaggaatcatggtccaaactacgagacggcgggtacaagctgaggctcgatgcccttccgtttcaagctgcaaaagcctccggggagattatttcagactacaagtacaaggaggccttcgagaagatgaaaggccaaatgttgggctcacgtagtcttgaggacgatatctccttggcccacagtgtgtacgctacatccctacaatcggatgtgaattacaagaaaggctttgaacattcgaaggcccagttccacttgcccctcgacatggctgcgctcgtccatgccaagaaagcccagactctagcgagcaaccaggactataaacaccctctgccgcagtatacctcactggccgaggacctacggctgtcctgcgctaagaaggcccacaagcttcagagtgagaacctgtaccgtagcgacctgaacttcatgcgaggggtcgcatgcgtcattccggggaccctggagatcgagggaaggaagaaggccagcgagttaatctctgagagcaaatacagacagcatcctcactctttcaagtataccgctgtgaccgacacccctaaccttctgcatgctaagttttcgaatcaaataactaacgaaagattgtataaagccgctggagaggacgccaggcatgaatacaccatgacattagggcttccagagtttattcgcgccaagaccaacgcagcaaacttgagtgatgcgcgatataaagaatcgtggcggaacctacgggctcaggggtataagttaactatcgaggcacttcctttccaggctgcaagggcttcaggagacatagcatctgactttctgtaccgccatgatttcgtgaaagaacgcgggaaactcatagggccccaatcagtgagagatgacccaaggatacagcattgtaggagaatgggccaactgcagtctgagttacagtacagacgtggggccacatcatctcaggcccagttccacctgccgatggacatggttcacctggtccacgcaaagaacgctcaggcgctggcaagcgaccacgactaccggactcagtaccacaagttcactgcactgccggaagatctgaaaatggcatgggccaaaaaagcccacgccttacaaagtgagctgcgttacaaaagcgacctcattggcatgaagggaatcggttggttggccttacgatcgccacagatggagagcgccaagaaggctggggaacttattagcgagactaagtaccgaaagaaaccagatagtataaaatttactaccgtcgtcgactcccccgatttggtgcacgctaaaaattcctatatgcattgtaatgagcggatgtataggtccggagacgcagaaagtctacatcgctacacactgatccccgatcacccagattttactagagcacgacttaatgcccttcatttgagcgataaggtctatcggaactcatgggagcaaacgcgggccgggtcttacgacttccggctggacgcaattccttttcagactgccagagcctcaagggaaatcgcaagcgatttccgctacaaggaagccttcttgagggaccgcggcctgcaaattggataccggagtgttgacgacgacccacggatgaagcacttccttaacgttggacgtctgcagtccgacaatgagtacaagaaagattttgccaagagtcgctctcaattccactcctcaacagaccaacccggtctgcttcaggcaaaaaggagccagcagttggcttcagacgtccactacagacagcccttaccgcagcccacctgtgatccggagcaactaggtctacgccatgcacaaaaggctcaccagttgcagtcagacgtcaagtacaaatcagatttaaatcttactcgaggagtaggatggacaccacccggatcgtataaagttgagatggctagaagggcagccgagttggctaacgcacgcggcctgggactacagggggcctataggggcgccgaagcagtggaagctggcgatcaccagagcggagaagtgaatcccgacgcaactgagatccttcacgtgaaaaaaaagaaggcattactgctgtag

SEQ ID NO: 125938 - DNA, 828 bp, Artificial Sequence
  Description of Artificial Sequence: Synthetic coding sequence
atggcgactgaactagaatacgaaagcgtgttatgcgtcaagcccgacgtgagcgtgtatcgtattcctccacgggcgagcaaccgcggatatcgggcctccgattggaagttagaccagcctgattggacaggaaggctgaggatcacaagcaagggaaaaacagcctatataaaactggaagataaagtgagtggagagttattcgcccaggcgccggtagagcagtaccccggcatcgctgtggaaactgtgaccgattcctctcgttacttcgttattcgcatccaggatggcaccggtaggagcgccttcattggaattgggttcaccgataggggcgatgcctttgactttaatgtgtcactgcaagatcacttcaaatgggtgaagcaggaaagtgagattagtaaagaaagccaggagatggatgccaggcccaagctcgaccttggctttaaagaagggcagacaattaaactgtgcatcggtaacatcaccaataagaaaggcggcgccagcaaaccccgtacggcccgcggaggaggtttgtctttactcccacccccaccgggaggcaaagttaccatccctccccctagttcgtccgttgcgatttccaaccacgtcacaccaccccccatccccaaatcaaatcatggggggagtgacgccgatattctgctggatctggactcccctgcgcctgtgactacccccgctccaacaccagtgtcggtttccaatgacctatggggagacttctctactgcctcttccagtgtgcctaatcaggccccgcagccctccaattgggttcaattctag

SEQ ID NO: 125939 - DNA, 402 bp, Artificial Sequence
  Description of Artificial Sequence: Synthetic coding sequence
atggatgcacgcccaaaacttgatctcggctttaaagaaggacagaccattaagctgtgtatcggcaacattactaacaaaaaagggggggcaagcaagcccaggacggccaggggggggggactctcacttttgcctccgccacccggcggtaaagtcacaatcccacctccttcatcttctgtggcaatcagcaaccatgtgaccccaccacctatccccaaatcgaaccatggggggagcgatgctgatatcctgttggacctggacagccccgcacccgtgaccaccccggccccaacaccagtttccgtttccaatgatctgtggggagatttcagtactgcttccagcagcgtgcctaatcaggcaccccagccatcgaactgggtacagttctag

SEQ ID NO: 125940 - DNA, 828 bp, Artificial Sequence
  Description of Artificial Sequence: Synthetic coding sequence
atggccactgagttggaatacgaatcggtgctctgcgtgaaaccggacgtatctgtgtacaggatcccaccccgggccagtaacagaggataccgggccagtgattggaagctagaccagcccgactggacaggacgcctgcgcattacatccaaaggaaagacggcatacatcaaactcgaggacaaagttagtggggagctgttcgcacaagccccggtggaacagtacccaggtatcgccgtggaaaccgtgacagactctagtcgttactttgttattagaatccaagacggaaccggtagaagtgccttcatcggcatcgggttcacggacaggggcgatgccttcgacttcaacgtatccctgcaagaccactttaaatgggtcaaacaagagtcggaaatttccaaagaatctcaagagatggacgcccgaccgaagctggatctcggctttaaagaagggcaaactattaagctgtgcattggaaatatcactaacaagaaaggaggcgcatctaagcccagaacagcacgtggcggcggcctgtcacttctgccacccccgcccggcgggaaagtgaccatcccacccccatcaagttcggtcgccattagtaatcacgtgactcccccaccaatcccgaagtctaaccatgggggaagcgatgccgacatcttattggacctcgattctccagctccagtgacgactcccgcccctacaccagtgtctgtatccaacgatctttggggagacttcagtactgcttcttcctccgtgcccaatcaggcaccacagccaagtaattgggtgcaattctag

SEQ ID NO: 125941 - DNA, 558 bp, Artificial Sequence
  Description of Artificial Sequence: Synthetic coding sequence
atggaggaatcgggctacgagagcgttctgtgtgttaaaccagacgtccatgtctaccgcatacccccccgggcaaccaacagaggctaccgagctgcagagtggcaactggatcaacccagctggagcgggcgattgagaattacagcgaaagggcagatggcttatattaaactggaggaccgtacttccggtgaactttttgcccaggcccccgttgaccagttccccggcactgccgtagagtccgtcacggacagctctcgctacttcgtgattcgcattgaggacggtaatggtagacgggcattcattggtatcggcttcggggatagaggcgacgcttttgactttaatgttgccctgcaagatcacttcaagtgggtgaagcagcagtgtgagtttgcaaaacaggcacagaatccagaccagggacctaagcttgatttgggctttaaagaaggacaaacaatcaagctgaacattgcagttggtctaggaaacattaataggcgctgttcctgtacattagctaccgcccaatcttgccactgctag

SEQ ID NO: 125942 - DNA, 792 bp, Artificial Sequence
  Description of Artificial Sequence: Synthetic coding sequence
atggaagagtctggttacgagtccgtactctgtgtgaaacccgatgttcacgtgtacagaattccccccagggcaactaacagaggctatcgggcggccgagtggcagctcgatcagccatcctggagcgggcgcctcagaattacagccaagggacaaatggcatacatcaaactggaagataggaccagcggggaactgttcgctcaggctccagttgaccagttcccaggaactgcagtagaatctgtcaccgactcctcgaggtactttgtgatccgaatcgaagatggaaatggccgcagggcattcatcggaattggcttcggagaccgcggtgacgcatttgattttaacgtcgcccttcaggaccactttaagtgggtcaaacagcaatgtgaatttgcaaagcaagcacagaacccagatcaaggtcctaagctcgacctggggttcaaagaggggcagaccattaagctaaacatcgcaaacatgaagaaaaaggagggagccgctggcaatccgagagtcaggccagcctccactgggggcctgtctctgcttcctccaccgcctggtggaaaaacctccaccctgattcctccacctggagaacagcttgcggttggagggtccctggtgcaaccagccgtcgcaccttcctccggaggagcaccagtaccttggccccagcccaacccagctaccgcagacatttggggcgactttaccaaaagcaccggttccaccagcagccagacccaacccggtaccggctgggtgcagttctag

SEQ ID NO: 125943 - DNA, 792 bp, Artificial Sequence
  Description of Artificial Sequence: Synthetic coding sequence
atggaagaatccgggtatgagagcgtcttgtgcgttaagcctgatgtgcacgtgtacaggatccctccccgcgcaaccaatagaggttaccgcgctgcggaatggcagctggatcagccaagttggagcgggagactgcgcataactgccaaaggacagatggcctatatcaaactggaggacaggactagtggcgagctttttgcccaggcgcccgtggatcagtttcccggcacggccgtggaaagtgtgaccgatagctctcgttattttgtgattcggatagaggatggcaatggacgcagggcatttataggcatcggatttggcgaccggggcgatgctttcgatttcaatgtggcgctgcaggatcacttcaaatgggtgaagcagcagtgcgagttcgctaagcaagctcaaaatcccgaccagggcccgaagctggaccttgggttcaaagaggggcagactattaaactgaacatcgctaatatgaaaaagaaggagggcgcagcaggtaacccaagagtgcgtcctgcttctaccggcgggttgtccctgctcccacccccaccaggaggcaagacaagtactctcataccaccacccggagagcaactggccgtggggggaagtctggtgcagcccgcggtggcaccaagtagtggcggcgctccagttccatggcctcagcctaatccagcaacagctgatatttggggcgacttcacaaagagtactgggtcaacttcatcccagactcagcctggaaccgggtgggtgcagttttag

SEQ ID NO: 125944 - DNA, 822 bp, Artificial Sequence
  Description of Artificial Sequence: Synthetic coding sequence
atggaggaaagtggatacgagtctgtgctctgcgttaaacccgatgttcatgtctaccgcatcccccctcgggccacgaacaggggctatagagcggctgagtggcaacttgatcagcctagttggtctggtcggctcagaattactgccaaagggcagatggcatacattaaattagaggacaggaccagcggcgaactgtttgctcaggcccctgtggatcagtttccgggcaccgctgtggagagcgtgacagatagtagtagatacttcgtgattcgaatcgaggacggaaatggtagacgggctttcatcgggatcggtttcggcgacaggggcgatgctttcgatttcaatgtagctctgcaggatcattttaagtgggttaagcagcagtgtgaattcgctaagcaggcccaaaacccggatcaagggcctaagctggatcttggatttaaggaaggccaaacaatcaaacttaacattgcaaatatgaaaaagaaggaaggtgccgccggtaacccccgagtgcggcctgcctctaccggggggctcagcttacttccaccaccaccagggggcaagacatcaactcttataccacctcctggggagcaattagccgttggcggcagtctcgtccaacctgccgtcgcaccatcatccgaccagctgcccgcccgaccaagccaggcacaggccggatctagctcggacctctcaacagtcttcccacacgtcacaagcggaaaggccctgccccacctgggccagcgcaaggaggacgaggccctgctgagctggccggtcttcggtgcctag

SEQ ID NO: 125945 - DNA, 714 bp, Artificial Sequence
  Description of Artificial Sequence: Synthetic coding sequence
atggaagagagcggggcggccgagtggcagctggaccagccgagctggagtggtcgcctgcggatcacagcgaaaggtcagatggcttacatcaagctagaagacaggacctccggagagttgtttgcccaagcgccggttgaccagtttccaggaacagccgtggaaagtgtcacggatagttcaaggtatttcgttatccggatcgaggacgggaacggcagacgagcatttattgggattgggttcggtgaccggggagatgctttcgacttcaatgtggcgttacaggaccattttaaatgggtgaaacagcaatgtgaatttgccaaacaagcgcagaatcctgatcagggaccgaagctggatcttggcttcaaagaaggacaaacaattaagctgaacatagccaacatgaagaaaaaggaaggcgcagcaggaaaccctagggttcgtcccgcttccactgggggcctgtctctgctccctccccctccaggaggcaaaacgtctactctcatacccccgccaggcgaacaactcgcggttggaggatctctcgtccagccagccgtagccccctccagcgggggagccccggtgccctggccacagcccaaccctgccaccgccgacatctggggcgattttaccaaatccaccggtagcacctcatcccagacacagcccggcactgggtgggttcaattctag

SEQ ID NO: 125946 - DNA, 792 bp, Artificial Sequence
  Description of Artificial Sequence: Synthetic coding sequence
atggaagagagcgggtatgagagcgttctgtgcgtgaagcccgatgtgcacgtgtataggattccccctagggccaccaacaggggataccgggcagcggagtggcagctggaccagccctcctggtccggtcgcctccggattactgccaaggggcaaatggcatacatcaaattggaagacagaactagcggggagttatttgcccaggcacctgttgaccagtttccagggacagccgtggaatcagtgactgattcctctcgttatttcgtaatcaggattgaggacggcaatggccgtcgagccttcataggaattggcttcggagacaggggtgatgcctttgatttcaacgtggccttacaagatcatttcaagtgggttaagcagcagtgcgaatttgcgaaacaggcccagaaccctgaccagggacccaagctcgaccttggcttcaaggaagggcaaacgatcaaactgaacattgctaacatgaagaagaaagaaggcgccgccgggaatcctcgggtaagaccagccagtacaggaggcctgtcactgttgccgccccctccaggtggtaaaacctcgactctgattcctccaccgggcgaacagctggcagttggcgggtctctcgtgcagccagcagtggctccatcgtcaggtggagcaccagtcccttggccacaaccaaatccagccacggctgatatctggggggactttacaaagtctaccgggtccacatcctctcagacccagcctggcacagggtgggtgcaattctag

SEQ ID NO: 125947 - DNA, 966 bp, Artificial Sequence
  Description of Artificial Sequence: Synthetic coding sequence
atgagcgagcagtctaaagatctctctgatccaaacttcgccgcagaagcacctaatagtgaggtgcatagtagtcccggcgttagcgagggtgttccaccctctgcgacgttagcagaacctcaaagccccccacttggtcctaccgccgctccccaggctgcgcccccaccccaagcacccaacgacgagggagatcctaaggctcttcagcaggctgccgaggagggacgggcccaccaggcccctagcgccgcacagcccggtcccgccccgcctgcccccgcccaattggttcagaaggcgcatgaacttatgtggtatgttctggtgaaggaccagaaaaagatgatcatatggttccccgacatggtaaaggacgtcattggcagttacaaaaagtggtgtcggtctatcttgcggcggaccagcctcatattggccagagtgtttggactgcacttacgcctaaccagcctgcataccatggaattcgctctggtgaaggccctggagcccgaagaacttgacagagtcgctctgtcaaataggatgccaatgacgggcctgctccttatgattctgtctctgatctacgtcaagggcaggggagctcgggaaagcgccgtatggaatgtacttagaattttgggactacgcccttggaaaaagcactctacattcggagatgtcagaaagctcatcacagaggaattcgtgcaaatgaattacctcaagtatcagcgagttccatacgtcgaaccccctgagtacgaatttttttggggcagtcgagcgtcacgcgagattaccaagatgcagattatggaatttcttgctagggtttttaagaaagacccgcaagcatggcccagtcgttatagagaagcacttgaggaagcaagagccctgcgggaggcaaatcccactgcacactatccccgctccagtgtgagcgaggattag

SEQ ID NO: 125948 - DNA, 915 bp, Artificial Sequence
  Description of Artificial Sequence: Synthetic coding sequence
atgcttcaaaagcctcgcaatcgagggcgtagcggcggccaggcagagcgtgaccgggactggagccattctgggaatcctggggcctccagagccggggaagatgcaagagtcctgcgagacggtttcgctgaggaagcaccttccacgagccggggccctggcgggtcccaaggtagccaggggccgtccccccagggcgctagacgggcccaggccgctcctgccgtgggcccgcgctcacaaaaacagctcgagttaaaagtgtcggagctggtgcagtttctactgattaaggaccagaagaagattcctatcaagcgggccgatattctgaaacatgttatcggggactataaggacatcttccccgatctgtttaaacgggctgcagagcgcttgcagtacgttttcggctacaagctcgtcgagcttgagcctaagtccaatacctatatcctgatcaatactctcgagccagtagaagaagatgcggagatgaggggagatcagggcacacctaccaccggtctgctgatgatcgtgctcggattaatcttcatgaaaggcaatacaatcaaggaaacggaggcatgggatttcctacggcgactcggcgtgtacccaacaaagaaacacttgatttttggggacccaaagaaactcatcacagaagatttcgtccgacagcggtatttggagtaccggcgaattccacacacagacccagtagactatgagtttcagtgggggccaaggaccaatttggaaacatcaaagatgaaagtactaaaatttgtcgcaaaggttcacaatcaagatcctaaggattggcctgctcagtattgtgaggccttggccgatgaggaaaacagggctagaccacaacctagtggcccagccccatccagttag

SEQ ID NO: 125949 - DNA, 666 bp, Artificial Sequence
  Description of Artificial Sequence: Synthetic coding sequence
atggctctcgcacttgccgctctggccgccgtagagccagcctgtggcagcaggtaccagcagctgcagaatgaggaagagtcaggcgagcccgaacaagctgccggcgacgctccacctccctactcgagcataagcgctgagtcagctgcatacttcgactataaggatgaaagcggttttccaaagccacccagctacaatgtcgcaactactctgccttcctacgatgaggccgaaaggactaaagccgaggccaccattccattagtcccaggacgggatgaagattttgttgggcgcgatgatttcgatgacgctgaccagctcagaatcgggaacgatggtatcttcatgctgacattcttcatggcattcctgttcaattggattggattcttcctctccttctgcctgacaacttcagccgccgggcgctacggagccattagtggatttggcctgagtctgatcaagtggatactgatcgtgcgctttagcacgtactttccagggtattttgacggtcaatattggctgtggtgggtctttctggtactgggcttcctgctgttcctgcggggcttcataaattatgcaaaggtgcgtaagatgcccgagacattctccaatttacccaggactcgagtgctgtttatatactag

SEQ ID NO: 125950 - DNA, 462 bp, Artificial Sequence
  Description of Artificial Sequence: Synthetic coding sequence
atggcacttgccctcgccgccctggctgcggttgagccagcttgcggctctcggtatcagcagcttcagaatgaagaagaatcaggtgaacctgagcaagcagccggcgacgcccctcctccttacagctctataagcgcagaatcagctgcctactttgattataaagacgagagcggctttcctaagcccccatcatacaacgttgctactacactgccttcttgcttttatgatataagtcacctcatctttttcatcttctatcttcgcaacatgaagaagaaatacacgaagatggtaaagcttttgcacaagtcggcaccagcccagtccgacagttgtaaatgccccttcatttgttgcgtgtgtataagcaggatcagtataggctccagatcgggataccagtatatcatgcatcgctcagtgggctgtctaaaggccaagcaggagaattag

SEQ ID NO: 125951 - DNA, 3138 bp, Artificial Sequence
  Description of Artificial Sequence: Synthetic coding sequence
atgcaccagaaaaccccagagatctattccgtggaactgtctgggactaaagacattgtaaaaacggataaaggggacggaaaggagaaataccgggggcttaagaacaactgcttagagctgaagaagaagaatcataaggaggaatttcaaaaggaattgcacttagatgatcataagctatcaaaccgagaactggaggaaaagtatgggaccgatatcattatgggcctgagcagcacccgggcagcagaattgctggctagggatgggcctaactcactgaccccgcccaagcaaacaccagagatcgtgaaattcctgaagcagatggtggggggatttagcatcctcctgtgggtgggggcctttctgtgttggatcgcctacgggatccagtattccagcgacaaatccgcttccttgaataatgtgtacctgggctgcgtgctcggcttggttgtcatcctgacggggattttcgcctattatcaggaagctaaaagcaccaacatcatgagcagctttaacaagatgataccccaacaggccctggtaatcagggacagtgaaaaaaagaccatcccaagcgagcagctagtggtaggagatatcgtcgaggtgaagggcggtgaccaaatacccgcagacatccgtgttctgtcctcacagggctgtcgggtggataattctagcctgaccggagagagcgagcctcaacctaggtcctctgaattcacacacgaaaaccccctggagacaaagaacatctgtttttatagtaccacctgtctagaagcaagcacctcacctgtgggcactgtgaccgggatggtgatcaatacaggcgatcgcacaattatagggcatattgcctcccttgcatccggggttggaaacgagaagaccccgattgccattgagatagaacacttcgttcatatagttgccggcgtcgccgtctcaatcggcatccttttttttattattgcggtatctctaaagtaccaggtgctggatagtataatattcctcattggaataatcgttgccaacgtgccagagggcctcctggccactgtaactgtgaccttatctctgaccgccaagcggatggctaagaagaactgtttagtgaagaatctggaagctgtggaaaccttaggaagcacctcgatcatttgctcggacaaaacaggcacactgacacagaaccgtatgaccgttgcacacctgtggttcgacaatcagatttttgtggcagatacaagtgaggaccatagcaaccaggtcttcgatcagtccagccgcacctgggctagcttgtcaaaaatcattacgttgtgcaaccgggctgagttcaaaccaggtcaagagaacgtgcctataatgaagaaagcagtaataggagatgcctccgagactgccctcctgaaatttagcgaggtaatactaggagacgtgatggaaattaggaaacggaatcggaaagtagcagagattccctttaattctactaataagtttcagctttcgatccatgaaatggacgaccctcatgggaaaagatttctgatggtgatgaagggggcgcctgaacgaatcctcgaaaagtgttccacgatcatgatcaacggggaggagcaccccctagacaagtccacagcaaagacctttcacactgcctatatggagttgggcgggttgggtgagagggtcttgggcttctgccacctgtaccttccagcagatgagttcccagaaacttactccttcgacattgacgcaatgaatttcccaacttcgaatctatgctttgtcggcctgttaagtatgatcgacccccctaggtcgacggttccagatgccgtcaccaagtgtcggagcgcaggcatcaaagtgatcatggttaccggggaccaccccattacagccaaagctatcgccaaaagcgtcggcatcatttcagcaaacagcgagactgtcgaggatatagcccacaggttgaacattgccgttgaacaggtgaacaaaagagatgccaaggccgcagtcgtgaccggcatggagttgaaagatatgagctctgagcagctggacgaaatactggcgaactatcaggagatcgtgttcgcaaggacctccccccagcaaaagcttatcatcgtggagggatgccagaggcaagatgcagttgtggctgtgacaggcgacggggtcaacgatagccccgcgctgaagaaggcggacattggcattgctatggggatcgccggaagtgatgctgctaaaaacgccgcagatatggtcctgctggacgataacttcgccagtatagtgacaggggtcgaagaaggcagactgatctttgacaaccttaagaaaaccatcgcatattccctgaccaagaacattgctgagttatgccccttcctgatctatattatcgttggtctgccactacccatcgggactattacgatcctttttattgacttgggcacagacatcatccctagtatagccttagcttatgagaaggccgagagtgacatcatgaaccgtaagcccagacataagaacaaagaccgattggtcaaccagccccttgctgtgtactcctaccttcacattggtttaatgcaagccctcggcgcctttctggtgtattttacagtgtacgcacaggaagggtttcttcccagaacactgatcaacctgagagtggagtgggagaaggattacgtgaacgacctcaaggactcttacggccaggaatggactcgataccagagagaatatctggaatggacgggatacacagctttctttgtgggtattctagtgcagcagatcgccgatctgatcatcagaaagacccggcgaaacagtatttttcagcaagggctcttccggaataaagttatatgggtcggaataacgtctcagattattattggactcattctgtcttacgggctgggatccgtgaccgcgctgagcttcactatgcttagagcccagtattggttcgtggccgtgcctcacgccattctgatctgggtgtacgatgaggtacggaagctttttatacggctgtatcccggtagctggtgggataaaaacatgtactactag

SEQ ID NO: 125952 - DNA, 1605 bp, Artificial Sequence
  Description of Artificial Sequence: Synthetic coding sequence
atggcacaacttggcaagctgctcaaggagcagaaatacgaccggcagctgcggctttggggagaccatgggcaagaggccctggagtccgcccacgtgtgcctgattaatgccaccgcgaccgggactgagattctaaagaatctggtacttcccggcatcggaagcttcaccattatagatggcaaccaggtcagtggcgaggacgcaggtaataatttcttcttacagcgctcttctataggcaaaaaccgggctgaagctgccatggagtttctccaggagctcaacagcgacgtgtctggctccttcgtggaggaaagccccgaaaatcttttggacaacgaccctagctttttctgtagattcaccgtggttgtcgctactcagctgccggaatccacgagcctccgcttggcagatgtactgtggaactctcagattcccctgctcatctgccggacctacggcctcgtgggttatatgcgcataattatcaaggaacatcctgtgatcgaatcccaccccgacaatgcactcgaagacctcaggttggacaagcctttcccggagctgagagagcactttcaaagctacgatttagatcatatggagaaaaaagaccatagtcacaccccttggattgtgatcattgccaagtatcttgctcaatggtacagcgagacaaacggacgcattcccaagacgtataaagaaaaagaggatttccgggatctgatccgccagggaattctcaagaacgagaacggggcccccgaagatgaagaaaatttcgaagaggctatcaagaacgtaaatactgctctgaacacgacacaaatacccagctcaatagaggacattttcaatgatgacaggtgtatcaatattactaagcaaacgccctcgttttggattcttgcgcgcgcccttaaagaattcgtggcaaaagagggccagggaaatctgcctgttcgaggcactatcccagatatgatcgccgactctgggaaatacataaagctgcagaatgtgtaccgcgagaaagccaagaaagacgcagctgcggtggggaatcacgtggccaagttgctccagtccattgggcaagcccctgaaagtattagtgaaaaagagctgaagttgctatgttctaatagtgccttcctaagggtagtgcggtgtcgatcactggccgaggagtatggcctcgacacaatcaacaaggacgaaatcatcagtagcatggacaaccctgacaacgaaatcgtgctgtatttaatgttacgcgccgtggatcgcttccacaaacagcaggggagatacccaggcgtgagcaattatcaggtggaggaagatattggtaaactgaagagttgcctgacaggcttcctacaggagtacggcctgagtgtaatggtaaaggatgattatgtccacgagttctgtaggtatggggctgctgagccgcacaccattgccgcttttctggggggagcggcagcacaggaagtcatcaaaattatcaccaagcagttcgtgatatttaacaatacatacatatatagcggtatgtcccagacatctgccacatttcagctgtag

SEQ ID NO: 125953 - DNA, 1587 bp, Artificial Sequence
  Description of Artificial Sequence: Synthetic coding sequence
atggatgctcagcagactaagacaaatgaagcgcggttgtggggagatcacggtcaggaggccctggagtccgcccacgtgtgtcttatcaatgcaacagccactggaacagaaattcttaagaaccttgtgttacccgggattgggtcctttactatcatcgacgggaatcaagtatctggcgaagatgccggtaataacttctttctgcagagatcatcaatcgggaagaatagagcggaggctgccatggagtttcttcaggaactgaattcagacgtgagcgggtccttcgtcgaggagtcccctgagaacctgttggataatgaccctagtttcttctgtaggtttactgtagtcgtcgccactcagctgcccgaatctacaagtcttcggctcgccgacgttctctggaacagccagattcctttactgatatgtagaacttacgggctggtgggctatatgagaatcattatcaaagagcatcccgtgatcgaaagtcatccagacaatgccttagaggacctgcgattagataagccctttccggaacttcgagaacattttcagagctatgacttggatcacatggagaaaaaagatcacagtcataccccatggattgttatcattgccaagtacctggctcagtggtactccgagactaacggcagaattcctaaaacctataaggagaaagaggattttagggatctcatccggcaggggatcctgaaaaacgaaaacggagcgcccgaagatgaggagaatttcgaagaagcaatcaaaaacgtcaatacagctcttaatacgactcagattccatcttcaatcgaagacatattcaacgatgaccgctgtatcaacatcacaaaacagacccctagtttctggatccttgcccgtgcactaaaggagttcgtcgctaaggaggggcagggcaacttacctgtgagagggactataccagacatgatagcagactctggcaagtatatcaagcttcaaaacgtctaccgggagaaggccaagaaggatgccgccgctgttggaaatcacgtcgcaaagcttctccagagcattggacaggcgccagagtctatatctgagaaggaactaaagctattgtgctcaaactctgccttcttacgagtggtcagatgcagaagcttagccgaggaatacggccttgacaccataaataaggatgagataataagctcaatggataaccctgataatgagatcgttctttacttgatgttacgcgctgtggatcggtttcacaagcagcaggggaggtatcccggtgtgtccaactatcaagtcgaggaggacatcgggaaacttaaaagctgcttgactgggtttttgcaggagtatggactcagcgtgatggttaaggacgactatgttcacgagttctgccgctatggcgcagccgagcctcacacaattgccgcattcctcggtggggccgcggctcaagaagtgattaaaatcatcaccaaacagttcgtgatatttaacaatacctacatatattccggtatgtctcagacctctgctaccttccagctttag

SEQ ID NO: 125954 - DNA, 1338 bp, Artificial Sequence
  Description of Artificial Sequence: Synthetic coding sequence
atggagtttcttcaggaacttaatagtgacgttagtggcagttttgtagaagaaagtcccgaaaacctgcttgacaatgatcccagttttttctgcaggtttacggtggttgtggccacccagctccctgaaagcactagtttgaggctggctgacgtgctctggaatagtcaaatcccccttctcatctgcaggacttacggtctggtgggctatatgcgaatcattatcaaggagcaccctgtgatcgaaagccatccggataacgctctggaagatctgcggctggataagcccttccccgaattgagagaacacttccagtcttatgatctcgaccacatggagaaaaaagatcatagccacacaccctggatcgtgatcatcgccaaatacctggcgcaatggtattctgagacaaatggaaggattccaaagacgtataaagagaaagaggactttcgggacttaatccgccaaggtatcctgaagaatgaaaatggggcccctgaggatgaggagaattttgaggaagctatcaaaaacgttaacacagccttgaataccactcagatcccctcttccatagaggacatctttaatgacgaccggtgtattaatatcacaaagcagaccccatctttttggatcttggcaagggctctcaaagaatttgtggccaaggagggccagggcaacctgccagtgcgtgggaccatcccggacatgattgcagatagtggcaagtacatcaaattacagaatgtgtatcgggaaaaagccaagaaggacgctgctgcggtcgggaaccatgtagctaagttgctccagtccattggacaggcgcccgaatctatctctgagaaggagctaaaactcctatgctcaaattccgcgttcctcagagtagtccgctgtcggagtctcgccgaagaatacgggctggatacaatcaacaaagatgagatcattagctctatggataaccctgataacgaaattgttctgtatctgatgctgcgcgcagtggacaggtttcataaacagcaaggcagataccctggagtatccaactatcaggtggaagaagatatagggaagctgaaaagctgtctgaccgggtttctacaggagtatggattaagcgtaatggtaaaggatgattacgtccacgaattctgccgatacggggcggctgagccacatacgatcgccgccttcctcgggggagccgcagcgcaggaagtcatcaagataatcacgaagcagttcgtgatcttcaacaacacttatatttattctgggatgtcccagactagtgcaacctttcaactgtag

SEQ ID NO: 125955 - DNA, 2901 bp, Artificial Sequence
  Description of Artificial Sequence: Synthetic coding sequence
atggagccgcaagtgaccctcaatgtgacattcaaaaacgaaattcagtctttcctggtatccgacccagaaaacactacatgggctgatatcgaagctatggtcaaggtctccttcgatctgaacactatccagataaaatatttggacgaagagaatgaggaggttagtatcaacagccagggagaatacgaggaggctctaaaaatggctgtgaagcaaggaaatcaactgcagatgcaggtgcacgagggacaccacgtcgtagatgaggccccccccccagtcgtgggagccaagcgtttggccgctagggcggggaaaaagccactggcccactatagttctcttgtccgggtactgggctctgatatgaagaccccagaagaccccgctgtccagagcttcccactcgttccttgtgataccgaccagccccaggataagcccccggattggttcacaagttacctggagacatttcgcgaacaagtagtgaatgaaacagtagaaaagctcgagcagaaactgcacgaaaaactcgtgctgcaaaaccccagtttaggatcttgtccatccgaggtgtcgatgccaaccagtgaagagaccctgttcttacctgagaatcagttctcttggcacattgcctgcaacaactgtcagcggcgaattgtcggtgtgcgttaccagtgctctctttgccccagttacaatatatgtgaggactgcgaggctggcccctacggtcacgacactaaccatgttttactgaaactgcggaggcccgtggttggatcctcagaaccgttttgccactctaagtactccacaccacgtttacccgctgccttggaacaagtgcggctccagaaacaagttgacaagaactttctgaaggccgagaaacagagacttcgcgccgaaaagaagcaacggaaagcagaggtgaaagagcttaaaaagcagctgaaactgcatcgtaagatccacctttggaatagcatccatgggttgcaatctcccaaaagtccactaggaagacctgaatccctgttacagtcaaatactctgatgctcccactgcagccctgcacgagcgtgatgcctatgctttccgccgccttcgttgacgaaaacctgccagacgggactcacctgcagccgggaaccaagtttatcaaacattggagaatgaaaaataccggaaacgtgaagtggagtgctgacaccaagcttaaatttatgtggggaaatctgactctagcttccactgagaagaaggacgttctcgtcccatgtttaaaggccggccatgtcggagtggtgagtgtggagttcattgctcccgctcttgaaggaacctacacctctcattggcgcctttcccacaaaggacagcagttcggaccacgcgtgtggtgctctatcattgtagatccttttccgtctgaggaaagtcctgataacattgagaaaggaatgatctccagttcgaagacagacgacctgacctgccagcaggaggaaaccttcctcctggccaaagaggagagacagcttggcgaggtgaccgaacagacggaagggaccgccgcctgcatcccacagaaagccaagaacgttgcctccgagagggaactgtacattcccagcgtcgatctccttactgctcaggatctgctgtcttttgaactgttggatatcaatattgtccaagagctggaacgggtgcctcacaacactcctgtggatgtgaccccatgcatgtcgcctttgccacacgactcgcccctcatcgagaaacccgggttgggtcagatcgaggaagaaaatgaaggtgccggatttaaggccctgcctgattctatggtcagcgtcaaacgcaaagcggagaatatcgcctctgtagaagaggccgaggaggacctgtccggcacgcagttcgtatgtgaaactgtgatcagaagtctgactcttgacgccgcccctgatcataatcccccatgccgccagaagtccctccagatgacattcgcactccccgaagggcctctgggcaacgaaaaagaagaaattattcacatagctgaagaggaggccgtcatggaggaagaggaagatgaggaggacgaggaggaagaagacgaattaaaggacgaagtgcagagtcaatcatccgcctccagtgaggactacattatcatcctgcctgaatgttttgacacaagtcggcctctcggagatagcatgtattcaagcgcgttaagtcaacccggcttggagcggggtgctgagggaaagcctggagtagaagcgggccaggaacctgccgaagctggcgaacgccttccaggaggggagaaccaacctcaggaacacagcatttctgacatactaactacatcccagactttagaaaccgtgcctttgattcccgaagttgtagaactgccccctagcttaccccggtcatccccctgtgtgcatcaccacggaagtcctggtgtggacctaccggtgactatccctgaggtctccagcgtcccagatcagatccggggagagccacgcggtagctctgggctggtcaactccagacagaagtcatacgatcacagccgacaccaccacggttctagtatcgctggggggctagttaagggggccctgtctgtagctgccagcgcatataaggctttatttgccggacctccagtgactgctcagccaattattagcgaggatcagacggccgctctgatggcccacttattcgaaatgggcttttgcgatagacagctcaatctgaggttgttaaagaagcataattataacattctgcaagttgtgactgagctgctgcagttgaataataacgattggtactcccagagatattag

SEQ ID NO: 125956 - DNA, 2814 bp, Artificial Sequence
  Description of Artificial Sequence: Synthetic coding sequence
atggagccccaagttaccttgaatgttactttcaaaaatgagattcaaagtttccttgttagcgaccctgaaaacactacatgggccgatatcgaagccatggtgaaagtgtcctttgacttgaacactatccagatcaaatacctagatgaggagaatgaggaggttaagattgttctgctaggcgaatacgaagaggccttgaagatggcggtaaagcagggaaaccagctgcagatgcaggtacatgaagggcaccatgttgtcgatgaagccccaccccccgtagtcggagccaagcgcctagcagctagagcaggtaaaaaacccctggcccactactcatcccttgtgcgggtgctgggcagcgacatgaaaacgccggaggaccccgccgtgcaaagctttcctctcgtgccatgcgacactgaccagccacaggataaaccccccgattggtttacctcctatctcgaaactttcagggagcaggtggtcaatgagacggttgaaaagctcgagcagaagctgcacgaaaagctagttttgcagaatccttccttgggatcgtgcccttctgaagtgtccatgccgacctccgaggaaactttgtttcttcccgagaaccaattcagctggcatatcgcttgtaacaactgtcagcgacgaatagtcggcgtgaggtaccagtgttcattatgcccttcctataatatatgtgaagactgcgaagcaggcccgtatggacatgacaccaaccatgttcttctgaagctgagacgcccggtggttggctcaagcgagcctttttgtcatagtaagtattctacccctcgcctgccagccgcattggagcaggtgaggctgcaaaagcaggtggacaaaaacttcctgaaggccgagaagcagcgcctaagagccgagaagaaacagagaaaggcagaggtgaaagaactgaagaaacagctgaagctgcaccgtaaaatccatctatggaatagtatccacggactacagtcgccaaaaagccctctgggaaggccggagtcactgctgcagagcaacactcttatgctccctctccagccttgtacttctgtgatgcccatgctgagcgctgcttttgtagacgagaatctcccagatggaacgcacctacagccaggaacaaagttcataaagcattggagaatgaaaaataccggtaacgttaagtggagtgcagatacaaagttgaaattcatgtggggcaaccttactctggcatccacagaaaagaaggatgtcctcgttccatgtttaaaagccggccacgttggtgtggtgagcgttgagttcatcgcaccagccctggaaggcacctatacatcccactggaggctctctcacaaaggacagcagtttggaccccgagtctggtgttctatcatcgtggatcccttccccagcgaggaatcccccgacaatattgagaaaggaatgatctcatcatctaagaccgatgacctcacttgccagcaagaggagaccttcctgttagccaaagaggagcggcaactaggtgaagtaaccgaacagacagaaggcactgcggcgtgcatcccccaaaaagcgaaaaacgtggcctccgagcgtgagctctacataccctcagtggatctgctgacagcccaggacttgctaagctttgaactgctcgacatcaatatcgtgcaagaacttgaacgtgtcccacacaacacgcccgtcgatgtcaccccctgtatgtcacccttaccacatgactcacccttaatcgagaagccggggcttgggcagattgaagaggaaaacgaaggcgcaggattcaaggccttacctgacagcatggtgtctgtgaagcgcaaggctgagaatattgccagcgtcgaggaagccgaggaagatttatctgggacgcagtttgtgtgcgagactgtgatcagatccttgactctggacgccgcgcctgatcataacccaccttgcagacagaagtccctgcagatgacattcgcccttcccgagggcccactcggcaacgagaaggaggagatcattcacatcgccgaagaagaagctgtcatggaagaggaagaagatgaagaggacgaggaagaagaggatgaacttaaagacgaggtgcaatcccagtccagcgccagtagtgaagactacatcatcatactacccgagtgctttgacaccagccgacccctgggcgatagtatgtattcaagcgcgctgtcacagcctggcttggaacgtggcgcggagggcaagcctggagttgaggccggccaggagccagcagaggccggcgagaggctgcctggaggagaaaatcaaccacaggaacattccatctccgatattcttaccacctcacagactctggagaccgtgccactgattcccgaagtcgtggaattacctccaagtcttcctcgcagcagcccttgtgtacaccaccacggctccccaggtgtcgacttaccagtgactatcccagaagtgtcctccgtgcccgaccagattcgaggtgagccgcgaggtagctccgggctcgtgaactcccgccagaagagctatgaccacagcagacatcaccacggctcttcaattgcagggggcctggtgaagggtgctctgtctgtcgctgcatctgcctacaaggcgctgtttgctggccccccagtgactgcccagggactgtgggggttattgtcttttctccacctagctaaaaagtgcttctttttgaaagctccttcggaagccttcagctggttctag

SEQ ID NO: 125957 - DNA, 2901 bp, Artificial Sequence
  Description of Artificial Sequence: Synthetic coding sequence
atggagccccaggtcacccttaatgtcacattcaaaaacgaaatccagagtttcttggtgtccgatccagagaacacaacctgggccgacatcgaggccatggtcaaagtttcatttgatctgaatactattcaaattaaatatttggatgaagaaaatgaggaggtgaagatagtgttgctgggtgaatatgaagaggctctgaagatggccgtcaaacagggcaatcaacttcagatgcaagtgcatgagggacatcacgttgtggacgaagcaccccctcccgtcgtcggcgcaaaacgacttgcagccagggccggcaagaagccgctcgcccactatagctccctggtgcgggtgctgggatcggatatgaagacacccgaagatccggccgtgcagagttttccattggttccatgcgacaccgatcagccacaggataagccccccgattggttcacgtcctatctggagacattccgggaacaggtggtcaatgaaacggttgagaaactggagcagaagctacatgaaaaacttgtgttgcagaatcccagcctgggctcctgtccctctgaagtgtccatgcctacatctgaggaaactctctttttaccagaaaatcagtttagttggcacatcgcctgtaataattgtcagcgtagaatcgtgggcgtgagatatcagtgtagcctgtgtccttcttacaacatctgcgaagactgcgaggctggcccctatgggcacgatacaaaccatgttctgctcaagctgcggaggccagtggtcggttcttctgaaccattttgccatagtaagtatagcaccccacgcctgccagctgctctcgaacaagttcggctacagaagcaggtggacaagaactttttgaaagccgagaaacagcgtttgcgcgcggagaagaaacagcgtaaggcagaagtgaaggagctcaaaaagcagttaaagctgcacaggaaaattcatctgtggaatagcatccacggactccagtctcccaagtctccactgggtcgccctgagtccctgctgcaaagtaatacacttatgttgcccctgcagccctgtacctccgtcatgcctatgctgtccgccgcttttgtggacgaaaatctgcccgacggaactcacttgcagcccggcaccaagtttatcaaacattggcgtatgaagaacactgggaacgtaaaatggagcgcggacaccaaactcaaattcatgtgggggaatctgacattggctagcacagagaaaaaggatgtgttagtgccctgtctgaaagcagggcacgttggggtggtcagtgtggaattcatcgcccccgccttggaaggaacatacacctcccactggcggctttctcacaagggacaacagtttggcccgagggtgtggtgctccattattgtggacccatttccctcggaggaatcgcccgataatatcgagaagggtatgattagttccagcaagactgatgatctcacttgccagcaggaggagacatttttactcgccaaagaagaaaggcagctgggggaggtaactgaacagaccgaaggcacggctgcgtgtattcctcagaaagctaagaatgttgcttctgagcgggagttatacatcccaagcgtagacttgcttacagcccaggatctgttatctttcgagctgctcgacatcaatattgtgcaagagttagagcgggtgcctcacaataccccagtggacgtgaccccgtgtatgtcgccacttccccacgacagccctctgattgaaaaacctggtctgggccaaatcgaagaagagaatgagggggccgggtttaaggcccttcctgactccatggtgtccgttaagcgaaaagcggagaacatagcatccgtggaggaggccgaagaagatctgtcaggtacccagttcgtgtgtgagactgtgatccggtcactgaccctagatgccgcgccagaccacaacccaccctgcaggcagaagtctctgcaaatgactttcgcgctgccggagggccccttgggaaacgaaaaggaagagatcatacacattgccgaggaggaggccgtgatggaggaggaggaggatgaggaagacgaggaggaggaagacgaactgaaggatgaggtgcaaagccagagcagtgccagctctgaggactacatcatcatcctgcctgagtgttttgacacttctcgccccttgggagactccatgtacagctcagcactgtcacagcctggtctggagagaggagctgaggggaaaccaggggtcgaggccggccaggagcccgcggaggcaggggagcggctacctggtggtgagaaccagccgcaggaacactccatttctgacattctaacaacttcccagacgctagagaccgtcccactgatcccagaagtcgtggagctgccacccagtctgccaagatcaagcccctgtgtgcatcaccatggctccccaggggtggatctgccagtcacgatccccgaggtgagctctgtgcctgatcagattaggggcgagcccaggggtagctcaggcctggtgaacagccgacaaaaaagttacgatcacagtcgacaccaccatggatcctcaattgcgggcggcttggtgaaaggggctctgtcggtggccgcctctgcttacaaagctctttttgccggtcctcccgtcactgcccaacccataatcagcgaagatcagacggctgctcttatggcacacctgtttgagatgggattctgcgacaggcagcttaacctgaggctgctgaagaaacacaactataacatcctgcaggttgtcacagagttgctgcaactgaataataacgactggtactcacaacgctactag

SEQ ID NO: 125958 - DNA, 2901 bp, Artificial Sequence
  Description of Artificial Sequence: Synthetic coding sequence
atggaaccacaggtgacactaaatgttacattcaagaacgagatccagtcctttctcgtaagcgaccccgagaacactacttgggccgacattgaagccatggtgaaggtaagctttgatttaaacaccatccagatcaaatatctagacgaagaaaacgaggaagtgtccatcaactcacagggcgagtacgaagaggctttgaagatggctgtcaaacagggtaaccagctgcagatgcaggttcacgaaggccatcatgtcgtggacgaggcacctccaccagttgtcggggccaaaaggttggccgctagggcgggaaaaaagcctctggctcactacagctctctggtgagagtcttaggttccgatatgaaaactcccgaagatccagccgtgcaaagcttccctctagtaccatgtgacacagaccagcctcaggacaaacctcccgattggtttacttcttacttggaaacattcagggagcaggtggtaaatgaaaccgtggaaaagctggagcagaagctgcacgagaagctggttttacagaatccatcgctgggaagctgcccctccgaggtcagcatgcctactagcgaggaaactctgttcctcccagagaaccagtttagttggcacattgcctgtaataattgtcaaagaaggattgtgggggtaagatatcagtgtagcctgtgtccgtcctacaacatatgcgaggactgtgaagccggcccatatggtcacgacactaatcatgtgctgttgaagctcagacgtcccgtggtgggatcctctgagcccttctgccattcaaagtattcgactcccaggcttcccgccgccctggagcaggtgcggttgcagaagcaagtcgacaagaattttctcaaggctgaaaagcagcgcctgcgtgcagagaaaaagcagcgaaaagccgaggtcaaggagctcaagaagcaactcaaattacatagaaagattcatttatggaatagcattcatggtctgcaatccccaaaaagccccctgggtagaccagaatcactgctgcagtcaaacaccttaatgctgccgcttcagccctgtactagcgtcatgcctatgctctcagctgcgttcgtggacgagaacctgcctgacggcacgcacttacagccaggtacgaaatttatcaagcactggaggatgaaaaatacaggaaatgtcaagtggtctgctgacacaaaactaaaatttatgtggggaaacttgaccttagcctccaccgagaagaaggatgtgctggtgccttgtttgaaagccggtcacgtgggggttgtcagtgtggaatttatcgcgcccgcactggagggcacttacaccagtcactggagactgtcccacaagggtcagcagttcgggcctagagtctggtgtagcatcatcgtcgatccttttcccagcgaggaaagcccagataacatagagaagggtatgatatcctcaagcaagacggatgacctgacatgtcaacaagaggagaccttcctgcttgccaaggaagaacgtcagttgggggaggtgaccgaacagacagaggggaccgccgcctgtattcctcagaaagccaagaatgtcgccagcgaacgcgaactgtatattcctagtgtggatctgttaaccgctcaggacctgctgagtttcgagctgctggacattaacatagttcaggaactagaacgggtgcctcacaacactcccgtagacgtgaccccctgcatgagtcccctccctcatgacagccccctgatcgagaaacccggcttggggcagattgaggaagaaaatgagggcgcaggcttcaaagcactgccagattctatggtttctgtcaagaggaaagcagagaacatcgcttccgtagaagaggctgaggaggaccttagcggaacccaattcgtatgcgagacagttataagaagtctcaccctggacgccgcccctgaccacaaccccccctgtcgccaaaaaagtttgcaaatgacattcgcactcccagaggggcccctgggtaatgaaaaggaggaaatcatacatattgctgaggaagaggctgtaatggaggaggaagaggacgaggaggacgaagaggaggaggacgagttaaaggacgaagttcagtcacagagcagcgcctccagcgaggattatataatcatactgccagagtgtttcgatacaagtcgccccctcggcgacagtatgtactcaagtgcgctgtctcagcccggcctcgagcgcggggccgaagggaaaccgggggtcgaggccggccaagaacccgccgaggccggggagcgccttcctggaggagaaaatcaaccacaagagcattcaatctctgacatcctgaccacttcgcaaactctggaaacagtgccactgataccagaagtggtggagctgccccctagtttgccccgctcaagcccttgtgtgcaccaccatgggtctcccggggtggatctgccagtgaccattcccgaagtgtcttcagttccagatcagatccgcggtgagccccgtggcagctctggcctggtgaacagccggcagaagagttacgaccacagtcggcatcaccacgggagttccatagccggtgggctcgtgaagggggctctctccgtggccgctagtgcatataaggcactgttcgccggcccccctgttacagcgcagcccatcatatcagaggaccagacggcggctctcatggcccacctctttgaaatggggttctgcgaccgtcagctaaatctacggcttctcaagaagcataattacaacatcctgcaagtggttaccgaactcctgcagctgaataataacgactggtactcccaaaggtattag

SEQ ID NO: 125959 - DNA, 654 bp, Artificial Sequence
  Description of Artificial Sequence: Synthetic coding sequence
atgtatagctccgccttgtcacagcctggactggaaaggggagccgaggggaaacccggagttgaggcagggcaggagcctgctgaggctggagaacgtctgcctggaggtgagaaccagccacaggagcactccatctcagacatcctgaccacatcgcagacattggaaacagtccccttaatccccgaggtagtggaattgcctccatcactgcctagatcgtcgccatgtgtgcaccatcacggctctcctggggtggatctgcctgtgaccatccctgaagtgtcatcagtgcctgaccagattagaggcgagcctagggggtccagcgggcttgtgaattctcgccagaagagttacgaccattctagacaccatcacggaagttcgattgctgggggcctagttaagggcgctctctcagtggccgcttctgcctacaaagccttattcgccgggccgccagttaccgctcagccaataattagcgaggatcagaccgcagcactgatggcacatttgttcgagatgggtttttgtgatagacagctaaacttgagattactgaaaaagcacaactacaacatcctccaggtggtgacggaacttctacagttgaataataacgactggtactctcagaggtattag

SEQ ID NO: 125960 - DNA, 2514 bp, Artificial Sequence
  Description of Artificial Sequence: Synthetic coding sequence
atggagccacaggtgacccttaatgtcacctttaagaacgagattcagtccttcctggtctctgaccctgagaacaccacatgggcggacatcgaggcaatggtgtccattaatagtcaaggggaatacgaggaggctctgaaaatggctgtgaagcagggcaatcagcttcagatgcaagtgcatgaagggcatcacgttgtggatgaggcccctccacctgtggttggagccaaacggcttgctgcccgcgccggcaagaagcccctggctcactacagctcactggtgagagtgcttggctcagatatgaagacccccgaggatccggccgtgcagtcctttcccctggttccctgtgacactgaccaaccccaggacaaacccccagactggttcacaagctacctagaaaccttcagagagcaggtggttaacgaaaccgtcgagaaattggagcagaaactacatgaaaagctcgtgctgcaaaacccctcactgggcagctgtcccagtgaggtttcgatgcctacctcagaggaaacattgttcctccccgagaaccaattctcgtggcacatagcttgcaataactgtcagcgaaggatagtgggagtcaggtaccagtgcagcctttgcccttcttacaatatatgcgaagactgcgaggctggaccttacggtcacgataccaatcacgtcctgctaaaactccggcggcctgtggtgggtagtagtgagcccttttgccattcgaagtattccacaccgagactgccagccgccctagaacaggttaggctccagaaacaggtggacaagaactttcttaaagccgagaaacagcgactccgcgcagagaaaaaacagcgcaaagccgaggttaaagagctgaaaaagcagcttaaattacaccgcaaaatccatctgtggaattccatccacggcctccagtctcccaaatccccactcggaagaccagaatctctgcttcagagcaacacactaatgctgccactccaaccatgtacaagcgtaatgcccatgttaagcgcggctttcgtcgacgagaacttgcccgatgggacccatttacagccgggcacaaaattcattaagcactggcggatgaagaatactggaaacgtcaaatggtcagccgacacaaaactaaagttcatgtggggtaatctaacactggcatccacagagaaaaaggacgtgttggttccatgcctcaaggcgggtcacgtgggtgtggtgagtgtcgaattcatcgcgcctgcactcgagggtacctatacaagccattggcgcctttcccacaagggccaacagtttggtcctagggtttggtgttcaatcatcgttgacccattccctagcgaggaaagcccggacaacattgaaaagggcatgatctcttcttccaagaccgatgacttgacctgccagcaggaagagacgttcctgttggcgaaagaggagagacaactgggagaagtaacggagcaaaccgaaggaacagcggcctgtatcccccagaaagcaaaaaatgtcgcaagcgagcgggagctctacattccatcggtagatctcctgactgctcaagaccttttaagttttgaactcttagacatcaatatagtccaggaactagagagggtgcctcacaatactcctgtggatgtgactccgtgcatgtcccccctcccgcatgatagccccctaatagagaagccaggtctgggccagattgaggaagagaatgagggggccggcttcaaagctttgcccgatagtatggtgagcgtcaaacgaaaggccgagaacatcgcaagcgtcgaagaggccgaggaggacctgtctggcacccagtttgtctgcgagactgtcattagatccttaacgctggatgcagcccctgatcacaatcctccctgcagacagaaatcgctccaaatgacctttgctctacctgaggggccactgggaaatgagaaagaggagataatccatattgccgaagaggaggccgttatggaagaagaagaagatgaagaggatgaggaagaggaggatgagctgaaggacgaagtacaaagccaatcttcggcttcctcagaggattatatcatcattctgcctgaatgctttgacactagccgccctctcggtgacagcatgtactcctccgcactgtcccagcccggcttagagcgtggagctgagggcaaacctggcgtggaagcagggcaggaacctgcggaagcgggggaaaggctgccaggtggtgaaaatcaacctcaagagcattcgatctctgacattttaactacttcccagaccctagaaactgtgcctctaatccctgaagtggtggaactacctccatcactccctagaagctccccgtgtgtccaccaccacggatctcccggggtggatcttccagttacaattcccgaagtaagcagcgtccctgaccagataaggggtgctaataacttttag

SEQ ID NO: 125961 - DNA, 2262 bp, Artificial Sequence
  Description of Artificial Sequence: Synthetic coding sequence
atgcctatggacctgatactcgtcgtttggttctgtgtctgtaccgcaaggacagtcgttggtttcgggatggaccccgatctccaaatggatatcgtgacagaactggacctggtcaacacgacactgggggtggcccaagtgtccggaatgcacaacgcctctaaagcctttctgtttcaggatatagagagagagatacacgctgcgccgcacgtttccgagaaactgattcagttgtttagaaacaaatcggaattcacaatccttgccacagtccagcagaagccgagtactagcggcgtgatactgagcatcagggagttggaacaccgcatctatgagagggtgattgatcctccagacacgaatctaccaccaggaatcaatctgtggctgggccagaggaaccagaaacacgggctgtttaaagggatcatccaggatggaaagatcatattcatgccaaacgggtacatcacacaatgccctaacctaaatcatacatgtccaacctgttcggactttttaagcttggtgcaggggatcatggacctgcaggagctcctggctaagatgactgccaaattaaattacgctgaaacccgcctatcacagcttgagaattgtcattgcgaaaagacttgccaggtatctgggctgctgtatcgcgatcaggacagctgggtggatggagaccactgccggaactgcacatgcaaatctggcgccgtcgagtgccggcgtatgtcctgtccccccctcaattgctcgcctgatagcctaccggtccacatcgccggacagtgctgtaaagtctgtcgtcccaagtgcatttacggtggcaaagttcttgcagagggacagagaattcttaccaagtcatgtcgcgagtgccggggaggagttctggtgaagatcaccgagatgtgcccacctctaaattgttccgagaaagaccacatcttgcccgagaatcaatgctgccgcgtttgccggggccacaatttttgtgccgagggacctaaatgcggagagaattcagagtgtaagaactggaataccaaggccacctgcgagtgtaagtctgggtacatctccgtgcagggagattcagcctactgcgaagacatcgatgagtgtgcagcgaaaatgcactactgtcatgctaataccgtatgcgttaatttacctggcctctatcgatgcgactgcgttcctggttacatccgagttgacgacttctcttgtaccgagcatgatgaatgcggatccggtcagcacaattgtgatgagaacgcgatttgtacaaacactgtccaaggtcatagttgtacttgcaaaccagggtacgtcggaaatggaaccatctgccgggccttctgcgaggaggggtgccggtatggaggtacctgcgtagcacccaacaagtgcgtgtgtccctccggattcaccggatcacactgcgagaaggatattgatgagtgttctgagggtataattgaatgtcataaccacagtcgttgcgtgaatcttcctggatggtaccattgcgagtgtcgctccggattccatgacgacggtacatattccctgtctggagaaagctgcattgatatagacgagtgtgcattgaggacccacacttgctggaatgacagtgcatgtattaaccttgcggggggtttcgattgcctttgccccagcgggccaagttgttccggcgactgcccccatgagggcgggctgaaacacaacggccaggtgtggacactgaaagaagatcgatgttctgtgtgctcctgtaaggacgggaaaattttttgtagacggaccgcatgcgactgccagaacccctctgccgaccttttttgttgccccgagtgcgatacacgcgtgaccagtcaatgcctggatcagaatgggcacaaactttatcgtagtggagacaactggactcacagttgccagcagtgcaggtgtctggaaggcgaggtggattgttggccactgacatgcccaaacctttcatgcgaatacaccgctatcttggaaggtgaatgttgtccccgctgcgtgagcgatccatgtcttgccgacaacatcacttatgacatcaggaaaacctgcctcgactcgtatggggtatcccggttgtccggaagtgtctggaccatggccggcagcccatgtacgacctgcaaatgcaagaacgggagagtatgttgtagcgtagactttgaatgcctccagaataattag

SEQ ID NO: 125962 - DNA, 2433 bp, Artificial Sequence
  Description of Artificial Sequence: Synthetic coding sequence
atgcctatggaccttattctggtcgtgtggttctgcgtctgcaccgcacgcacagtggtggggttcgggatggacccggatctgcagatggacatcgtgactgaactggatcttgttaatacaactctcggagtagctcaagtcagcggcatgcataatgcttccaaggccttcctcttccaggacatcgaacgcgagatccatgccgccccccatgtgtccgaaaagctaattcaactgtttaggaataaatcggagttcaccatcctggcgacagtgcagcaaaaacccagtacatctggggtgatcctgtcgatccgggagctcgaacattcctactttgaactggagtcttcgggcttacgcgacgaaatcagatatcactatatccacaatggaaaacccagaaccgaagcactgccataccgaatggcggacggtcaatggcacaaggtggccctttccgtctccgcgtcccaccttctgctgcatgttgactgtaacagaatctatgagcgggtaatcgaccccccagacaccaacctccccccaggcataaatttgtggctggggcagagaaatcagaaacacggtctattcaagggtataatacaggacggcaagataatctttatgcctaacggatatataactcaatgcccaaatctgaaccacacatgtccaacttgctcagacttcctttcactggtgcagggaatcatggatctgcaggaactattggcgaagatgaccgccaagctcaactatgccgagactcgtctctctcagctcgagaattgccattgcgagaaaacttgccaggtgtctggactcctctatagggatcaggattcttgggtcgatggcgaccactgcaggaattgcacatgtaaatccggggcagttgaatgcagacgtatgagttgccctccgctcaactgttcccctgactctctgcctgtacatatcgctgggcagtgttgtaaagtttgtaggccgaaatgtatctacgggggaaaggtgttggccgaggggcagaggatcttgaccaagagctgtcgggagtgccgaggcggtgtcttagtcaaaatcacagaaatgtgcccacccctgaactgcagcgagaaggaccacatcttacctgaaaatcagtgctgcagggtttgtaggggacataatttttgcgctgaaggtcctaaatgcggggaaaacagtgaatgtaaaaactggaacacgaaggctacatgcgagtgcaagtcaggttacatcagtgtacagggggatagtgcatactgtgaagatatagatgaatgtgctgccaagatgcattactgtcatgctaataccgtgtgcgtcaatctgcccggcctgtaccgttgtgactgtgtgccaggctatatccgcgttgacgatttcagttgcacggagcacgacgagtgcggtagcggccagcataactgtgatgaaaacgcaatctgtaccaatactgtccaaggacacagctgtacatgtaagcccggatacgttggcaatgggactatttgtagagccttctgcgaagagggctgcaggtacggaggaacgtgcgtcgctcccaataaatgcgtgtgtccctcgggattcacaggttcgcattgtgagaaagacatcgacgagtgcagcgagggcattatagagtgccataatcactcccgttgcgttaacctccctggttggtaccactgcgaatgccgctcaggctttcatgacgatgggacatactctctgagcggtgagtcatgcatcgacattgacgaatgcgccctcaggacccatacctgttggaatgacagcgcatgcatcaatctggcgggaggctttgactgtctgtgcccatctggaccgtcttgtagtggtgattgtccccacgagggaggccttaaacataatggccaggtttggactctgaaggaggaccgctgcagcgtctgtagctgcaaagacgggaagatattctgtcgccggaccgcctgcgattgtcaaaatcctagcgcggacttgttttgctgccctgagtgtgatacccgggtgacctcgcagtgtttagatcagaacgggcacaaactatatcgaagcggagacaactggacccattcatgccagcagtgccggtgcctggaaggagaggtcgattgctggcctctgacgtgccctaatctctcgtgcgagtacaccgcaatactggaaggcgagtgctgtccgcgctgcgtgtccgatccttgtttagcagacaacatcacttatgatatccggaaaacttgtctggactcttacggagtttctagactgagcggatccgtgtggacaatggcaggctctccatgtactacctgtaagtgcaaaaatggacgcgtctgttgctctgttgattttgagtgtctgcagaataattag

SEQ ID NO: 125963 - DNA, 2292 bp, Artificial Sequence
  Description of Artificial Sequence: Synthetic coding sequence
atgcctatggacctgattctcgttgtttggttttgtgtgtgcaccgctagaactgtagtcggatttgggatggatccggatctccaaatggacatcgtaacggagctggaccttgtcaacacaaccttgggtgttgcccaggtgtctggaatgcataacgcctccaaggcatttctgttccaggatatcgaaagggaaatccacgctgcgccacacgtgagtgaaaagctgatccagctttttcggaataagtccgaattcacaattctagcaacagtacagcagaagccttcaacctccggggtgatcctgtctatcagagaacttgaacacagctacttcgagttggagagcagcggactcagggacgaaatcagataccattacatccataacggtaagccgcggaccgaagctctcccataccgaatggcagacgggcagtggcataaagtggctctctcagtgtcagcgtcgcacctgctacttcacgttgactgtaatcgaatctatgagagagtgatcgacccaccagacacgaacttgccaccaggtataaacttgtggctggggcagcgcaatcagaagcacggcctgtttaagggaattattcaggatgggaagatcatctttatgcctaatggttacattactcagtgccccaacctgaatcatacatgtcccacctgctcagactttttgagtttagtccagggtatcatggacttgcaggaactgttagccaagatgaccgccaaattgaattatgctgaaacacgtctctcacagctggaaaactgccattgcgagaaaacatgccaggtgagcggactactttatcgagaccaggattcctgggtggatggggaccattgtcgtaattgcacctgcaagtctggcgccgttgaatgtcggagaatgagctgccccccgttaaactgctcacccgatagcctcccagttcacattgccggccagtgttgcaaggtgtgcaggcctaagtgcatttatggcggcaaggtgctggctgaaggacagcgaattctcactaaatcctgtagggagtgtcggggcggagttttggtcaagataactgagatgtgccctcctttgaattgcagcgaaaaggaccacatcctgcccgaaaaccagtgttgcagggtgtgtcggggacacaatttttgcgcggagggcccgaagtgtggagaaaatagcgaatgcaagaattggaacacaaaagctacttgtgaatgtaaatccggctacatttcagttcagggggatagcgcgtattgcgaggatatcgacgaatgtgccgcaaagatgcactactgccatgccaacacagtatgcgtcaacctgcccgggctgtataggtgtgattgtgtgccaggatacattcgcgtggatgactttagctgcacagaacacgacgaatgtggtagcggacagcataactgcgacgaaaacgctatttgcaccaatacagtgcagggtcacagttgtacatgcaaaccaggctatgtagggaatgggacaatttgtcgggcattctgcgaggaaggctgtagatacggcggtacttgcgtggcccctaacaaatgcgtttgcccctcaggattcaccgggagtcattgtgagaaggatatagacgaatgcgcactgcggacccacacgtgctggaacgactccgcatgtattaatcttgcgggcggatttgactgcctttgtccttcggggccctcctgcagcggcgattgccctcatgaggggggccttaagcataacggacaggtttggaccttaaaggaggaccggtgttccgtttgcagctgcaaggatggaaaaattttttgtcgccgtacagcctgtgactgtcagaatccctctgccgacctcttctgctgcccagagtgcgacacaagagttacctcccagtgtcttgatcagaacggtcataaactctaccgctctggcgacaattggactcattcttgccagcaatgcaggtgtctggagggggaggtggactgttggccattgacatgccccaatttatcatgtgaatacacagccattctggagggtgaatgctgccctaggtgcgtaagtgatccttgcctcgccgacaacatcacgtacgatatccgcaaaacctgcctcgacagttacggtgtgtcacgcttgagtggaagtgtgtggacaatggccggcagtccctgcacaacatgcaaatgtaaaaatggaagggtgtgctgttctgtggatttcgagtgtctgcaaaataattag

SEQ ID NO: 125964 - DNA, 2520 bp, Artificial Sequence
  Description of Artificial Sequence: Synthetic coding sequence
atgtccatcagacgtttgctgatactcattctgaagatcggccggagatggaccgaactaattcgtacaatggagtctagggttctgctccgaactttttgcctgatcttcggcctgggcgccgtttggggactgggggtcgacccctccctgcagatcgacgtcctcacagagctggagcttggagagtctactacgggggtgaggcaagttcccggcctgcataatggcactaaagcattcctattccaggatactccaagaagcataaaagccagcacagcaaccgccgagcagtttttccagaagcttcgcaataaacacgagttcaccatcctcgtgactttgaaacagacacacctgaatagcggggttatacttagcatccatcacttggatcatcgctatctagaactcgaatcctctggacaccggaacgaagtgagactgcactaccggtccggcagtcaccgtccccacacggaagtgtttccatacatcctggccgacgataagtggcataaactgagcctggcaatctccgccagtcacctaatattgcacatcgattgtaacaaaatatacgaaagagtggtggagaaaccatctactgacctgcctctgggaacaacgttttggttagggcagcggaataacgctcatggttattttaaaggcattatgcaggacgtacagttgttggtgatgccccaaggcttcatcgctcaatgtccagacctaaatcgaacctgccctacctgcaacgatttccatggacttgttcagaaaatcatggaacttcaggatatcctcgcaaaaacctcagccaaactgtctcgggccgaacagcggatgaaccggcttgaccagtgctattgtgaacgaacctgcaccatgaaaggtacaacttatcgggaatttgaatcttggatcgacgggtgcaagaactgcacctgtcttaatggaaccattcagtgtgaaacactcatctgcccaaaccctgattgtcctctcaagagcgcgttggcatacgtggacggtaagtgttgcaaggaatgtaaatctatttgtcagttccagggccggacctacttcgaaggggagcgaaacacggtgtattcatcaagtggtgtttgtgtgctgtacgagtgcaaagatcagaccatgaagctggttgaaagcagtggctgtccggccttagactgtccagagagtcatcagatcacactttctcactcttgttgcaaggtgtgcaaaggttatgacttttgtagtgaaagacacaattgcatggagaatagcatctgccggaatctcaacgaccgggccgtgtgtagttgtagagatgggtttcgggcactgcgtgaagacaacgcttactgcgaggatattgatgaatgcgctgaaggaagacactactgccgtgaaaacactatgtgcgtcaacacgccaggcagctttatgtgtatttgcaagactggatacatcaggattgatgattactcctgcactgaacacgatgaatgcattactaatcagcataactgtgacgagaacgctctctgcttcaacactgtgggaggccacaactgtgtgtgtaaacctggatatacaggaaacggcacgacctgtaaagcgttctgtaaagacggatgccggaacgggggcgcatgcatcgctgccaatgtgtgtgcctgtcctcagggctttacagggcccagctgtgaaaccgatatcgacgaatgctccgacggatttgtacagtgtgacagtagagccaactgtattaatctgccaggctggtatcattgtgagtgccgcgatggctaccacgataatggcatgttttctcccagcggagagtcttgtgaggatatcgacgaatgcgggactgggcgtcatagttgcgctaatgataccatttgtttcaaccttgacggcggatatgattgccgatgccctcacggtaagaattgtaccggggattgcatccacgatggaaaggtcaagcataacggtcagatttgggttctggagaacgatagatgttcagtgtgttcatgccagaacggctttgtgatgtgccgccgcatggtctgcgactgtgaaaacccaaccgtagacctcttttgctgtcccgagtgtgatcccaggctgtcgagccaatgtctgcaccagaatggagaaactctgtacaacagcggagacacctgggttcagaactgccagcagtgtagatgcctccaaggtgaagtagactgttggccactcccctgccctgatgtagaatgcgagttctctattctgcctgagaatgaatgttgtccgcggtgcgtgaccgacccatgtcaagccgacacaatccgcaatgacattactaaaacttgcctcgacgagatgaacgttgtccggttcactggatcatcttggattaagcacgggacagaatgcacactgtgccaatgcaagaacggtcacatctgttgtagcgtagaccctcagtgccttcaggaattgtag

SEQ ID NO: 125965 - DNA, 2448 bp, Artificial Sequence
  Description of Artificial Sequence: Synthetic coding sequence
atggaaactgggttgggcgcacccctgttcaaggcgtggctgttaatttcagtctggggcctgggggttgatccctctctgcaaatcgacgtgctcacagaattagaattgggagaaagcaccacaggcgtccgccaggttccggggttacacaacggaacgaaggcatttctgttccaggacacccctcgcagcataaaggcttcgaccgccactgccgaacagttttttcagaaattgagaaacaaacacgagtttaccatactggtcacattgaagcagacgcatctgaactcaggcgtgattctctcaatacaccatcttgatcaccggtatctggaactggaatctagcggacatcggaatgaggtgcggcttcattatcggtccggatcccaccgaccgcacactgaagtgttcccctacatcctcgccgatgacaagtggcacaagttatccctcgcgatctctgccagccaccttattttgcacatcgactgcaacaaaatctatgaacgagttgtggagaagccaagcactgatttgcctctcggcactaccttttggctggggcagagaaataacgcacacggatatttcaaaggtatcatgcaggatgtgcaattgctggttatgccgcagggctttattgcacagtgtcctgacctgaaccgaacttgtccaacttgcaatgacttccacgggctagttcagaaaatcatggagctgcaggatatactggcgaaaacttctgctaaacttagcagggccgaacagaggatgaaccgcctcgaccagtgctattgtgaacgcacctgcaccatgaaagggactacgtacagagaatttgagtcttggattgacggctgcaaaaattgtacttgcctgaatggaaccatccagtgcgagacattgatttgccctaacccagattgtccactaaaatctgcactggcttacgtggacggaaagtgttgcaaggagtgcaaatccatctgtcagttccagggccgtacatatttcgaaggtgagagaaacacggtgtattctagctcaggggtgtgcgtgctgtatgagtgcaaggatcagaccatgaaactagttgagagctccgggtgtcccgcactcgactgtcccgagagtcatcagatcacactatctcatagttgctgtaaagtgtgcaaggggtacgatttttgttctgaacgccataactgcatggagaattcgatttgcagaaatctgaatgatcgggctgtgtgcagctgtagagatggctttagagccctgagagaagataacgcatattgcgaggacattgatgaatgcgccgaaggccggcattactgccgtgagaacactatgtgtgtgaatactccgggtagtttcatgtgcatttgcaagaccgggtacattcgcatagatgattattcctgcaccgagcatgatgagtgtatcaccaaccagcacaattgcgacgaaaatgctctttgttttaacaccgtcggtgggcataactgtgtatgcaagcctggctacaccggaaacggtactacttgtaaggctttttgtaaggacgggtgccggaacggcggggcctgcatagccgctaatgtatgcgcatgtccacagggattcaccgggccttcctgcgagaccgatatcgatgagtgttccgatgggttcgtgcaatgcgattccagggctaattgtataaatttgccaggctggtatcactgcgagtgcagggacggttaccacgataacggaatgtttagccctagcggcgaaagttgtgaggatatcgatgagtgcggaacaggaaggcactcctgcgccaatgacacaatatgtttcaatcttgacggagggtacgattgcagatgtccacacggtaagaattgcaccggagactgtattcacgacggcaaggtgaagcacaacggccagatctgggtcctggagaacgatcggtgcagcgtttgtagctgccagaatgggttcgtaatgtgtcgcagaatggtatgtgactgtgagaacccgaccgttgatctgttttgttgccctgaatgtgaccctagactgagctcccagtgccttcaccagaatggcgagactttgtacaatagcggcgacacctgggtgcagaactgccagcaatgcaggtgtctgcaaggtgaggtggactgttggccgctgccgtgccccgacgttgaatgtgaattctctattctgccagaaaacgagtgctgtcccaggtgtgtaactgatccctgtcaggctgacactattcggaacgacattactaaaacatgcctggacgagatgaatgtggtgagattcacaggaagctcctggatcaaacacggtactgaatgtaccctgtgccaatgcaagaacggtcatatttgttgttctgtcgatccacagtgtcttcaggagctctag

SEQ ID NO: 125966 - DNA, 2451 bp, Artificial Sequence
  Description of Artificial Sequence: Synthetic coding sequence
atggaatcgcgcgtactacttcgcaccttctgtttgatcttcggattaggagctgtatggggcctgggcgtggatcctagcttacaaatcgatgtgttgaccgaacttgagttgggcgagtcaaccaccggtgttcggcaggtgcctggtttgcacaacggcacaaaagcattcctctttcaggatacgcctcggtccatcaaagcttctactgccaccgccgagcagtttttccaaaaactcagaaataagcacgaatttacaatcctagtcacactcaaacagacccaccttaattcaggcgtgatcttgagcatccatcacctggatcataggtacctggaacttgaatcttccgggcaccggaacgaggtcagactgcattacagaagcggctcccatcgcccacacaccgaagtgtttccctacatcttggctgatgataaatggcataaactgagcctcgccatttccgctagccatttaattctacacattgactgcaacaagatatacgaaagagtggtggagaagcctagtacagacctcccccttgggactacattctggctggggcaaaggaacaatgcacacggctacttcaagggcattatgcaggacgtgcagctacttgtgatgccccaggggttcatcgcgcagtgtccggacttaaatcgcacttgccctacctgtaacgacttccatggcctcgtgcaaaagatcatggagctgcaggacatcctggctaagacctcagccaagctttctagagcagaacaacggatgaataggctggaccagtgttactgcgaacgaacatgcacaatgaagggtacaacatatagagagtttgaatcttggatcgatgggtgtaagaattgtacatgcctcaacgggaccattcaatgcgagacactgatttgtccaaatccggattgtcccctcaagtccgccttggcctatgtggacggtaaatgttgcaaggaatgtaagtctatttgccaatttcagggaaggacctactttgagggcgagcggaacactgtatatagtagcagcggcgtgtgtgtgctctacgaatgcaaggaccaaactatgaagttagttgagtcctctggatgtcctgcattggactgccccgaatctcaccagatcaccctgtcgcactcatgttgcaaggtttgcaaggggtacgacttctgctccgaacgacataactgcatggagaacagcatctgtagaaacctgaatgaccgagccgtttgtagctgtagggatggattcagggctctgagggaggataacgcttactgtgaagatatcgatgaatgtgcagaaggacgtcactactgtcgcgagaacaccatgtgcgtcaatacccctggcagcttcatgtgcatctgcaaaacaggatacattaggattgacgattactcctgtacagaacacgacgagtgtatcactaaccaacacaattgcgacgaaaacgctctctgttttaacacagtggggggccacaactgtgtatgtaagccaggctacactggtaacggcacgacgtgcaaggccttttgtaaagacggatgtcggaacgggggcgcatgcattgcagccaatgtttgcgcttgtcctcagggctttaccggtccatcttgcgaaacagacatcgatgagtgctcagacggatttgtacagtgcgattccagggctaactgtattaacctgcctggctggtatcattgtgaatgccgtgatgggtaccacgataacgggatgttcagcccaagcggcgagagctgtgaggatatcgacgagtgcggtaccgggcgtcatagctgtgccaacgacacaatctgcttcaacctggacggcggatacgattgtcgttgcccacatggcaagaactgcacaggagactgcatccacgacggcaaggtgaagcacaacgggcagatatgggttttggagaatgaccgctgctccgtatgctcttgtcagaacggcttcgttatgtgtcgccggatggtttgcgactgtgaaaatccaactgtggatcttttttgttgtcccgagtgtgacccaaggttaagctcccaatgtctccatcagaatggagagacgttatacaactccggcgatacttgggtgcaaaactgtcagcagtgtagatgtctgcagggcgaagttgactgctggcctctcccatgtcctgatgtggaatgcgagttttcaatcctgcccgagaacgagtgttgccctaggtgtgtgaccgacccctgccaggctgataccattcgcaacgatataaccaagacatgtctcgacgagatgaatgtcgtgagatttaccggaagttcatggataaagcatgggactgagtgcaccttatgtcagtgtaagaacgggcacatctgctgctcagtggacccccaatgtctccaagagttatag

SEQ ID NO: 125967 - DNA, 2601 bp, Artificial Sequence
  Description of Artificial Sequence: Synthetic coding sequence
atggggttccctcctttactcaagggacaggcttctgcaacgcgatcttcactggccagttgcagttgggtggttttctttctgtcatgcctatcacggcacgccccagaaatagagggcggtcggagatggaccgagttgatacggaccatggaaagtagggtcctgctgcgtacattttgcctcatatttgggctaggcgctgtgtgggggttgggtgtcgaccccagtttgcagattgacgtcctgacggagctcgaactcggggagtccaccacaggcgttcgacaggttccaggattgcataatggaactaaggcctttctttttcaggataccccccggtcgataaaggcatcaactgcaaccgctgagcaatttttccagaagttaaggaacaagcacgagtttaccattctcgttaccttgaaacagacacaccttaactccggggtgattttgagtattcaccatctagaccaccgatatctagagctcgaatcaagcgggcatcgcaacgaagtaagactacactacagatccggctcccaccgccctcacaccgaagttttcccttacatcctcgccgacgataagtggcataaactctctctggctatttccgcctcccacttgatcttacatattgactgcaacaagatttacgaaagggtggtggagaaaccgtcgaccgacctgccactggggactactttctggctcggtcagagaaacaatgcccatggttattttaaagggatcatgcaggatgtgcagttgctcgttatgccccagggcttcattgcccagtgcccggatctcaaccggacttgccctacctgtaatgacttccacggccttgtgcagaagattatggagctgcaagacatcctcgcaaaaaccagcgccaagctgtcccgtgctgaacagaggatgaataggttggatcagtgctactgcgaacgaacatgtaccatgaagggcaccacgtatcgggagttcgaaagctggatcgacgggtgcaagaattgtacatgtctgaatggtacaatccagtgtgagaccctgatatgccctaaccccgactgccctctgaagtccgcgcttgcatatgtagatgggaaatgttgcaaggaatgcaaaagcatctgtcaatttcagggacggacttacttcgaaggcgagagaaacaccgtttactctagctccggggtgtgtgtgctctatgagtgcaaagatcagaccatgaaactcgtcgaaagcagcggctgcccagctttggattgccctgaaagccaccagattactctcagccactcatgttgtaaagtttgcaaaggctatgacttttgctctgagcggcataattgtatggagaacagcatttgccggaatcttaacgaccgtgcagtgtgcagctgcagggatgggttcagggcattgcgcgaagataacgcttactgcgaggatatcgatgagtgtgctgagggtcggcactattgcagagagaacactatgtgcgttaacaccccaggatcatttatgtgtatctgcaagacaggttatattcgcattgatgactacagctgcacggaacatgatgaatgcataaccaatcagcacaattgtgatgaaaacgccctctgcttcaataccgtcggtggtcacaactgtgtgtgtaaacctggatacacgggcaacggcacaacctgtaaggctttctgtaaggacggatgccgtaacggcggagcatgcattgctgccaacgtatgtgcctgcccacaggggttcaccggtcctagctgcgaaaccgatatcgatgagtgttcggacggatttgtgcaatgtgacagcagagcaaattgtattaacctgcccgggtggtatcactgcgagtgcagagacggataccacgataacggcatgttctcgccgagtggagagtcttgcgaagacatcgatgagtgcggaacaggtcgccactcttgcgcaaacgataccatttgttttaatctggatggaggctatgattgccgatgtccacacggaaaaaactgtaccggggattgcattcacgatgggaaggtcaaacataatggtcagatatgggttttggagaatgataggtgttcggtatgtagctgccagaatggatttgtgatgtgccgaagaatggtttgcgattgtgaaaacccgactgtggatttattctgctgtcccgagtgtgaccccaggctcagcagccagtgcctgcaccaaaatggcgagaccctctacaactccggggacacctgggttcagaactgtcagcaatgtaggtgcctgcagggggaggtggattgttggcccctcccatgtcccgatgtggagtgcgaatttagcatcctgcccgagaatgaatgttgcccccgctgcgtgactgacccttgtcaagcggacacaatccgcaatgatataaccaagacctgtttggacgagatgaacgtggtacgctttaccggctctagttggattaaacacggtacggagtgtacactttgtcagtgtaagaacgggcacatttgctgttccgttgaccctcagtgtctacaggagctttag

SEQ ID NO: 125968 - DNA, 2451 bp, Artificial Sequence
  Description of Artificial Sequence: Synthetic coding sequence
atggagtcaagggtactcttaaggacattctgcttaatattcggactgggggcggtctggggcctcggtgtcgatccaagcctgcagatcgatgttctcacagagctggagctgggcgagtctacaacaggcgtgagacaagtccctggtttacataatgggactaaagcatttctcttccaagatacgcctcggtccattaaggcatcaacagctacagctgaacagttctttcagaagttgcggaacaaacacgaatttactattttggtcactctgaagcagacccatctcaatagcggagtcattctgagcatacaccatctggaccataggtacttggagctcgaatcgtccggccacaggaatgaggttcggctgcattacaggtccgggagccataggcctcatacggaggtcttcccctacatcctggctgacgataagtggcacaagttaagtctggctatttcagcaagtcacctcattctccatattgattgtaataagatctatgagcgagtggttgaaaagccctctaccgacctgccattaggtacaacattctggctgggtcagagaaacaacgctcacggttattttaagggaataatgcaagacgtgcaactgctggtaatgcctcagggctttatcgcacagtgtcctgacttaaatcgtacttgccccacctgcaacgatttccacggactcgtgcaaaagattatggagctgcaggatatactggccaagacaagcgccaagctctcaagagcggaacagagaatgaatcgactggatcaatgttactgtgagagaacatgcactatgaagggcaccacctatcgtgaatttgagtcatggatcgacggctgcaaaaattgtacctgcctcaacggaactatacagtgcgagacattgatatgtcctaatcccgactgccctctgaaatcagctcttgcttatgtggatggtaagtgctgcaaagagtgcaagagtatttgtcagttccaggggcgaacctacttcgagggcgaaagaaacacagtgtactctagctctggcgtatgtgtgctgtatgaatgcaaagaccagaccatgaagctggttgaatccagtggctgccccgcccttgactgtccagaaagccaccagattactttgagccattcctgctgcaaggtctgcaagggctatgacttctgttcagagcgtcataactgcatggaaaattcaatctgtagaaacctgaacgatcgggctgtgtgcagctgcagggatggttttcgcgctctacgggaagacaacgcgtattgcgaagatatcgatgagtgtgccgaaggccgccactattgtagagagaatactatgtgcgtgaatacaccgggaagtttcatgtgcatatgcaaaactggatatatccgaatcgatgattactcttgtacagaacacgatgagtgcataaccaatcagcataattgcgacgagaacgccctctgtttcaacaccgtgggtgggcacaactgtgtgtgcaagcccgggtacacaggcaatgggacaacatgcaaagctttctgcaaggatggttgccggaacggaggagcttgcatagcagccaatgtctgtgcgtgccctcaggggtttactggaccatcctgtgagacagatatcgatgaatgctccgacggctttgtacaatgcgactctcgggcaaattgcattaatctcccaggatggtatcattgcgagtgcagagacggttatcatgacaacggcatgttttcaccttcaggagagtcatgtgaagacattgatgagtgcggcacagggcgccactcttgtgctaacgacactatctgcttcaatctggatggcggttatgattgccgctgcccacacggcaaaaattgtacgggagattgtatccatgatggaaaggtgaaacataacggtcagatttgggtcctcgagaacgatagatgttcagtctgctcttgccagaatggatttgtgatgtgtaggagaatggtatgtgattgcgagaatccgacagtcgacctgttctgctgtcctgagtgcgacccccggctgagctcacagtgtttacaccagaatggcgagactctgtataatagtggggacacgtgggtccagaattgtcaacaatgccgctgtctccaaggtgaggtggactgttggccccttccatgccctgacgtggagtgcgagtttagtatcctgcccgagaacgaatgttgcccccgttgtgtgacggatccctgtcaggccgatacaattaggaacgacataacaaaaacctgcctggacgagatgaatgtggtaagatttacagggagtagctggatcaagcatggaactgaatgtactctgtgtcagtgcaagaacgggcacatatgctgtagcgtcgaccctcaatgtttgcaagagctctag

SEQ ID NO: 125969 - DNA, 1734 bp, Artificial Sequence
  Description of Artificial Sequence: Synthetic coding sequence
atggaaacaggactgggcgctccgttgtttaaggcatggttacttatctctgtgtgggggctgggagtggacccttcactccagattgatgtcctcactgagctggaactaggtgagtccacaactggggtgaggcaggtgcccggactacataacgggactaaagccttcttgtttcaggatacacctagatcgattaaagcctcaaccgccactgctgagcagtttttccaaaaactgcgaaacaagcacgagttcacaatcctggtgacgctaaagcaaacccacctgaacagtggcgtcatcctgagcattcaccacctggaccaccggtacctggaactggagtcctcaggacatcgcaatgaagtgcgcctccactatcggagcgggtcccaccgcccacacactgaggttttcccatatatcctggcagatgataagtggcataagctatcactggctatctccgcctcccacctcatactccatatcgactgtaataaaatttacgagagagtggtcgaaaagcctagtactgatctccctttgggcacaaccttttggttggggcagcgcaacaatgcccacgggtacttcaaagggattatgcaggatgtacagctgctggttatgccccaaggcttcattgcccaatgccccgatcttaaccggacatgcccaacctgtaacgattttcacgggctggtacagaagatcatggagctgcaagacatcctagccaaaacctcagcgaagctgagtagggcggaacagagaatgaacagactggaccagtgctactgtgagcgtacctgcacaatgaaaggcactacgtatagagagttcgagtcatggatagatgggtgtaagaactgcacgtgcctgaatggcacaattcaatgtgaaacactgatctgccctaatccagattgccctctgaaatcggcactggcctacgtggatgggaagtgttgcaaggaatgcaagagtatctgtcagtttcaaggcaggacttatttcgaaggggagcggaacacggtgtattccagtagtggggtctgcgtactatatgagtgcaaggaccagactatgaagctggtagagtcttcgggctgccccgccctcgattgccccgagtcccatcaaatcacactctcacactcatgttgcaaggtgtgcaaagggtatgatttttgtagcgagcgtcacaactgcatggagaatagtatttgtcgaaacctcaacgatcgagccgtctgcagctgccgggatggattccgtgctctcagggaggacaatgcctattgtgaggatattgacgagtgtgcagaaggcagacactattgccgggagaacacaatgtgtgtcaacacccctgggagcttcatgtgtatctgtaaaaccgggtacattcggatcgatgactacagttgcacagaacatgatgagtgtatcactaaccagcataattgcgatgaaaatgccctgtgtttcaataccgtggggggccataattgcgtctgtaagcctggatacacggggaatggcaccacttgcaaagccttttgtaaggacggctgccgtaacggcggcgcctgcatcgcagcaaacgtctgcgcctgcccccagggctttaccggtcccagctgcgaaacagatatcgacgaatgttctgacgggttcgttcaatgcgattctcgagccaactgtatttgtctcgtgccactgtag

SEQ ID NO: 125970 - DNA, 333 bp, Artificial Sequence
  Description of Artificial Sequence: Synthetic coding sequence
atggaaacaggcctaggagcccctctgttcaaggcatggctacttattagcgtttgggggctgggcgtggatccctcgctgcagattgatgtcctgacggaactggaacttggagagtcaactaccggcgtaaggcaagtgccaggcctgcataatggtactaaagcattcctttttcaggataccccaaggagcattaaggcttccaccgcgacagcggagcaattctttcagaaactccgtaataagcacgaatttaccatcctggtcacgttgaaacagacccatttgaattccggagttattctgtcaatccatcacctagaccactag

SEQ ID NO: 125971 - DNA, 2448 bp, Artificial Sequence
  Description of Artificial Sequence: Synthetic coding sequence
atggaaactggactgggcgcgcctctatttaaagcatggttacttatctccgtgtggggcctcggtgtggatccatccctgcaaatcgatgttctgaccgagctggaactgggggagtccaccaccggcgttagacaggtgcctggacttcataatggaaccaaggcgtttctgttccaggatactccacgatccataaaggcgagcactgcaactgcggaacagttcttccagaagctacggaataagcatgagtttacaatcctggtgacactgaaacagactcatttgaatagtggagttatactgtccatccaccacttagaccaccggtatctggagctagagagcagtggacacagaaacgaggtaaggttgcactatcggtcaggttctcatcggccccacaccgaagtgtttccctatattttggccgacgacaagtggcataaattgtcccttgcaatctcagcttcacaccttattctccatattgactgtaataaaatatatgaaagagtagtggagaagccttctactgacttgcccctaggaacgaccttttggcttggccagagaaataatgcgcatggctatttcaagggaattatgcaggatgtgcagctgctggtcatgcctcaagggttcatagcacagtgcccagatctgaaccgtacatgtcctacctgcaatgacttccacggactcgtgcagaagatcatggagctgcaggatatactggctaaaacttctgctaagctgagtcgagccgagcagcggatgaatcgcctcgatcagtgctactgcgaacgcacctgtacaatgaaaggcactacttatagagaatttgaatcctggatcgatggatgcaaaaactgtacttgcctgaatggcacaattcaatgtgaaactctgatttgcccaaatccggattgccctctgaagtctgcactggcttatgttgatggtaaatgctgtaaggagtgtaagtctatttgtcagttccagggtcgcacatacttcgagggggagagaaatactgtttatagcagcagcggagtctgcgtgctttacgaatgcaaagatcagacaatgaaactcgttgaatcaagtggttgcccagccctggattgtcccgagtcccaccagatcacactcagtcatagttgctgtaaggtttgtaaaggatatgacttctgctcagagcggcacaattgcatggaaaactccatctgccggaacctcaacgacagagccgtatgtagctgcagagacggttttagagcgcttcgggaagataacgcatattgtgaagacattgatgagtgcgctgaaggacgacactattgcagggagaataccatgtgcgttaacacacccgggtcatttatgtgcatctgcaagaccggatatattcggatcgacgactacagctgcacagagcacgatgagtgtatcactaatcagcataactgcgatgaaaacgctctgtgctttaataccgtcgggggccacaactgtgtttgcaagcccggatacaccggaaatggaactacttgtaaggcgttttgcaaggatggatgtagaaacggcggtgcttgcatcgcggcaaacgtgtgtgcctgccctcaggggttcacaggaccttcctgtgagaccgacatagacgagtgttctgatggctttgtgcaatgtgactctcgcgctaactgtataaaccttccgggctggtaccactgcgaatgtagagatggttatcacgacaacgggatgtttagcccatcaggtgagtcgtgtgaagacattgatgagtgcggcacgggccgacatagttgtgccaatgatacgatctgctttaacctcgatgggggatatgattgtcggtgtccacacggcaaaaattgcaccggcgattgtatacatgatggaaaggttaaacataacggtcagatttgggtgctggagaacgatcggtgttccgtgtgttcctgtcagaacgggttcgtgatgtgccgacggatggtttgcgactgcgagaatccgactgtcgacctgttttgttgtcccgaatgcgacccgagactgtcatctcagtgcctgcatcagaatggagagacgctgtacaactctggcgatacctgggtgcagaattgtcaacagtgcaggtgtcttcaaggggaggtcgactgttggccactcccatgtcccgacgtggagtgcgaatttagcatcctgccggagaacgagtgctgccccaggtgcgtcaccgacccttgccaggccgatacaatacgcaacgacattaccaaaacctgtcttgatgagatgaacgtggtccggttcactgggtctagctggatcaaacatggcacggagtgcacgctgtgtcagtgtaagaatggtcatatctgttgctctgtcgatccgcaatgtttacaggaactgtag

SEQ ID NO: 125972 - DNA, 69 bp, Artificial Sequence
  Description of Artificial Sequence: Synthetic coding sequence
atggaaagccgggtgctcttaagaacattttgtctcatctttggcctaggagcggtctggggcctctag

SEQ ID NO: 125973 - DNA, 966 bp, Artificial Sequence
  Description of Artificial Sequence: Synthetic coding sequence
atggaaagccgcgtgctccttcgcaccttctgcctcatcttcgggcttggggcggtgtggggtctaggcgttgatccctcacttcagatcgacgtcttaacagagctggagctgggtgaaagcactaccggcgtccggcaagtgccgggcctgcataacgggacgaaagcttttttgttccaggatactccccggtctatcaaagcatctactgcaacggcagagcagttcttccagaaactcagaaacaaacatgagttcaccatacttgtgaccctgaagcagacacacctgaactccggcgtgatactatcaattcaccacttagaccaccgctacctggaactcgagagttctgggcatcgtaacgaggtccgactgcattatcggagcggtagccaccgaccgcatactgaagtctttccttacatcttagctgacgacaagtggcacaaactgagtctggccattagtgcatcccatctgatcctgcacattgattgtaataagatttacgagcgggttgtggagaaaccttctactgacctgccactgggcaccacattctggctgggacagagaaataatgcccacgggtactttaagggcattatgcaagatgttcagctgctcgtcatgccccaaggattcattgcccagtgtcccgacctgaatcggacctgtccgacgtgcaacgactttcacggcctcgttcaaaaaatcatggaattacaggacatcctggccaaaacgagcgccaagttgagcagggccgaacagcgcatgaatcggctggaccagtgctactgtgagaggacctgtacgatgaagggcactacctatagagagttcgaaagttggattgacggatgtaagaactgcacatgtctgaatggaacaatacagtgcgagacgctgatctgccctaatcccgattgcccattaaagtcagctctcgcttactag

SEQ ID NO: 125974 - DNA, 4386 bp, Artificial Sequence
  Description of Artificial Sequence: Synthetic coding sequence
atggccgccgagaggggtgcaagacgattactcagtaccccatcgttctggttgtactgcctcttgctgctcggccggagggcccccggagcagcggcagccaggagcggctcagccccccagtcgccaggtgcctcaatcagaacgtttacacccttctattttttagtggaacccgtagacactctctcagtgaggggaagctcagtgatcctcaactgctctgcctacagcgaaccaagcccaaaaatcgagtggaagaaagacgggaccttcctgaatttagtgtccgatgatagacggcagctgctgcctgatggatcactttttatttcaaatgtggtccattctaagcataacaagcctgacgaaggatactatcagtgtgttgcaaccgtcgaaagcctcgggaccataataagccgaacggccaaacttatagtggccggcttaccacggtttacgtctcagccagaaccctcttctgtatatgccggcaataatgcaatcctgaattgcgaagtcaacgctgatctcgtaccttttgttcggtgggagcagaaccggcagccattgctgctggatgatagggtgataaagctcccaagtggcatgttagtgatttcaaatgctaccgagggcgatggggggctgtaccgttgtgtggtggagtctggaggtcctcccaaatactcagacgaggtcgagctgaaggtgcttccagacccagaggtgattagcgatctggtctttctgaagcaaccttcacccctagtaagggtaatcgggcaggacgtagtcctgccatgcgtggcctctgggttaccaacacctacgatcaagtggatgaagaatgaagaggcactggacaccgaatccagtgaaaggctggtgctcttggcgggcgggtccctggagatttctgatgtgaccgaagatgacgccgggacatacttctgtatagcagacaatgggaacgagaccattgaagctcaggcagaattgactgtgcaggcacagcctgagtttcttaaacagcccactaatatttatgcccacgaatctatggacattgttttcgagtgtgaggtgacaggtaaacccacacctacagtcaaatgggtcaagaatggcgatatggtgatacccagcgactacttcaaaatcgtcaaggagcataatcttcaggtgctggggttagtaaagagtgacgaaggcttttaccagtgtatcgccgagaacgacgtcgggaacgctcaggccggagcacagcttatcatcctcgagcacgcacccgcaaccactgggcccctgccatctgcccctagggacgtggtggcttcacttgtgtcaacgcgcttcatcaaactaacctggcgcacccccgcgagcgatccacacggcgacaacttgacctatagcgtgttttacaccaaggagggcatcgcccgcgaaagggtcgagaacaccagccaccctggtgaaatgcaagtcactatccagaacctcatgccagctaccgtgtacatttttcgggtgatggcgcagaataaacacggcagcggcgagtcaagcgccccccttagggtcgaaacacaaccagaagtccaactgcctggtcctgctcctaacctgcgtgcgtacgccgcttctccgacctccatcactgtgacctgggagacccccgtctctggaaacggagaaattcaaaactataagctgtactacatggaaaagggtacagacaaggaacaggatgtggacgttagtagtcattcctacaccattaatggtttgaagaagtacaccgaatacagctttcgcgtcgttgcctataataaacatggaccaggagtatccacccctgacgttgcagtgagaaccctctctgacgtccccagcgctgctccacagaacctttcactcgaggtgagaaactcaaaatcaattatgatccactggcagccccctgctcctgccacgcagaacggacaaatcacaggttataagatcaggtataggaaagctagtaggaagtccgatgtgacagaaacgttagtatcggggacacagttgtctcagctcattgaaggcctggaccgtggcactgagtataatttccgtgtcgccgctctgaccattaatgggacaggaccggctactgattggttgtctgcagagacctttgaatcagacctcgatgaaacacgcgtgccagaagtgcccagctccctccacgtgagacccttggtcacgtccatcgtggtatcttggacaccaccagagaatcagaacatcgtcgtgcggggttacgcaattggctatggaatcggatccccccatgctcaaacaataaaggtggactacaaacaacggtactacactatcgaaaatctcgatccctctagccattacgtgatcacccttaaggcatttaacaacgtgggggagggaatacctttgtacgaaagcgccgtaactagacctcacacagacacctctgaggtggatctcttcgttatcaacgcgccctacacaccagtgccagacccgactccaatgatgccgcctgtcggagtccaggcaagtatcctgtcccacgataccatccgcatcacttgggcagacaactctctgcccaaacatcagaagatcaccgattcccgctattatactgtgcgctggaaaacaaatattcccgctaacaccaagtataaaaacgcaaatgcaaccacactgagttaccttgtcaccgggttgaagcccaacacgttgtacgagttttccgtgatggttacaaaggggagacgcagctccacttggagcatgactgcccatggtacaacattcgagttagtgcccacttcccccccaaaagatgtcactgttgtgtccaaagaaggcaaacctaaaaccatcatagtgaactggcaaccacccagtgaagcaaacggcaagatcacaggctacataatatactattctactgacgttaacgctgaaatccacgactgggtgattgagccagtggtcggaaatcgcctgactcaccagattcaggagctaacattagataccccctattatttcaagattcaggcacggaacagtaaaggcatgggaccgatgtctgaggccgttcagtttcggaccccgaaggctgattcctccgacaaaatgcccaacgaccaggcatccggcagcggcggaaaagggagccggttaccagatctgggctcggattataagccacctatgagtgggtccaacagtcctcacggatcccccaccagcccgctcgattcaaatatgctgcttgtcatcatagtgtccgtcggcgtgataaccattgtggttgtagtgattatcgccgtgttctgtaccaggagaaccacctcccatcagaagaaaaagagagccgcatgcaagtccgtcaacgggtcccataaatataagggcaattccaaggacgttaaacccccagacttgtggattcaccatgaaaggttggagttgaaacctattgacaaatcgccggatccaaatccaatcatgacagacacaccgatcccacgcaatagccaggacatcacccctgtggacaactccatggatagcaacatccatcaacgtcgaaactcttatcggggccacgagtctgaagattcaatgtcaaccctggctggcaggcggggaatgcgaccgaaaatgatgatgccatttgactctcaaccgccgcagcccgttatctctgcccaccccatccatagcctggataacccccatcatcacttccactccagctccttggcctcccccgctagatctcatttgtaccaccccggctcaccttggccaatcgggacaagcatgtctctcagcgaccgggcaaactcgactgaatccgtgagaaatacaccaagcacagacacaatgccagcctcttcgtcgcagacctgctgtacagaccatcaagaccccgagggtgcaacaagctcttcttacttagcgagctcccaggaggaggatagcggtcagtccctgccgaccgctcatgtgaggccaagccatccgctaaaatcgtttgctgtccccgcaattccccccccagggcctccgacatatgatcctgccctaccatcaacaccacttctctcccagcaggcactgaaccaccacatacactccgtaaaaaccgcttctatagggaccctcggcagatcccggccccctatgccggttgtggtcccttctgctcctgaggtccaggagacaaccagaatgctcgaagactccgagagctcctacgagcctgacgagctgaccaaagaaatggcccacttggagggtctgatgaaggatctgaacgcaattactacggcatag

SEQ ID NO: 125975 - DNA, 4386 bp, Artificial Sequence
  Description of Artificial Sequence: Synthetic coding sequence
atggcagccgagaggggtgcccgccgtttgttgagtactccttccttctggttgtactgtctgcttttgttaggcaggagggcacctggggccgccgccgcaaggtccggcagcgctccacagagtcctggggctagcatcaggacctttacacccttttactttctggtggagcctgtcgatacactgtctgtgagaggtagtagtgtgattctaaactgcagtgcttactccgaaccatcccccaaaatcgaatggaagaaggatggaactttccttaacctcgtgtccgacgacaggcggcagctgctccccgacgggtctttgttcatcagcaatgtggtacatagtaaacataataaaccagatgaaggctattaccagtgtgtggcgaccgtcgaatccctcggaacaattatttccaggaccgctaaactcatcgtcgctggcctgcccaggtttaccagccagccagaaccttcctccgtgtacgcaggaaacaacgccatccttaattgcgaggtgaatgccgatcttgtccctttcgtgagatgggaacaaaatcgacaacctcttctgctggacgaccgcgttattaagctgccttcgggaatgctggtgatttccaatgccacagagggagacggcgggttgtataggtgtgtcgtggagtcgggcggtcccccaaagtattctgatgaggtggaactgaaggtgctgcctgacccggaggtgatatccgacttggtttttttgaagcagccttctccccttgtgcgtgtgataggccaagacgtggtacttccttgcgttgcatcggggctaccaaccccgacaatcaaatggatgaaaaacgaggaggccctcgatactgagagtagcgaaaggcttgtgcttctggccggtggttcacttgagatctctgacgtgactgaggacgacgccgggacttacttttgcatcgccgacaatggtaacgaaaccattgaggcacaggctgagcttactgtgcaggctcagcccgaattcttaaagcaacctacgaacatttatgcacacgagtccatggatatcgtgttcgaatgtgaagtcacgggtaagccaacaccgaccgttaaatgggttaagaatggagacatggtgatcccatccgattactttaaaattgtcaaggaacataacttacaggtcctggggctggtcaagtctgacgagggcttttatcagtgcatcgctgagaacgatgtcggaaatgctcaagccggcgcgcaactgataatcctggagcacgctccagcaacaacaggaccgctgccttccgctccgcgtgacgtagtggcctccctcgtgtcgacccgatttatcaagcttacttggcggactccagctagcgacccacacggggataatctgacatatagcgtcttttataccaaggaaggaatcgctcgcgaaagggtggagaatacctctcaccccggcgagatgcaggtgaccatccaaaatttaatgccggcaaccgtgtatattttccgcgtgatggctcaaaacaagcacggatccggcgagtcatcagcgccactgcgggtggaaactcagccagaggtgcagttacctggccccgctcccaacctgagagcctacgcggcatctcccaccagtatcacagtcacatgggagacgccagtatctggcaatggagaaatccagaactataagctgtattacatggagaaaggcaccgataaggagcaggatgtggatgtctcctcacatagttatacaatcaacggcttgaagaagtataccgaatacagtttccgggtagtggcctataacaaacatggccctggagtgtctactcccgacgttgctgtccgtaccctcagtgatgtaccctcagccgctccccagaacctttctctggaggtccgcaactctaagtccataatgatccactggcagccaccagcgcctgccacacagaatggccaaataactggctataaaattcgttaccgcaaagcttcaaggaaatccgatgtaaccgagacactcgtgtcagggactcagctgtctcagctgattgagggactagaccggggtactgaatataacttccgagtcgcagcgctcacaatcaatggcactgggccggctaccgattggttgtcagccgaaacgttcgaatccgatttggatgagactcgagtccccgaggtgcctagcagcctgcacgtgcgtcctctcgttacctcaattgtagtgtcttggactccacccgaaaaccagaacatcgtggtccgcgggtatgcaattggctatggaataggatccccccacgctcagaccataaaggttgactacaaacagcggtattatactatcgaaaacttggacccctcatcccactacgttatcactctgaaggccttcaacaacgtgggggagggcattcccctctacgagagcgcagtaacacggccgcacaccgacacatctgaagtggatctcttcgtaattaatgcaccatacacacctgtacctgaccccacccccatgatgcctcctgttggcgtgcaagcctcaatcctttctcatgacaccatcagaatcacatgggcggacaacagcctccccaagcatcaaaagatcactgactctaggtactataccgtgagatggaagactaatatccctgcaaacactaaatataaaaatgccaatgcgacaactctctcatatctggtgacaggtctcaagccaaataccctctacgaattctctgtgatggtgaccaaaggtagaaggtcgtccacgtggtctatgacagcccatggcacaacattcgagctggtgcccactagccctcctaaagacgttacagtggtctccaaggagggtaagcccaagactatcattgtgaattggcagcctcccagtgaagcaaacgggaaaattacgggctacataatctattattcaactgacgtgaatgccgagatccatgattgggttatcgagcccgtggtgggaaaccgcctgactcaccagatccaggagttaaccctggataccccgtactatttcaaaatccaggcaaggaacagcaaaggcatggggccaatgagcgaggccgtccagttcaggactcctaaagccgattccagcgacaagatgcctaacgaccaggcctctggtagtggaggcaaggggtcacggcttccagacctcggctccgattataaaccccctatgtccggcagtaacagtccccatggaagtccgacctccccgcttgatagcaacatgctgttagtgattatcgtgtctgtgggtgtaataaccatcgttgtggttgtgatcatagcggtattttgcactcggagaaccacaagtcatcagaaaaaaaaaagagcagcttgtaagagtgtcaacggctctcacaaatacaaggggaactctaaagacgtcaaaccccctgacttatggatacaccacgagaggctggagctgaaaccgatcgataagtccccagaccctaacccaattatgactgacacacccatccctcgcaattcacaagatatcacacccgttgacaactctatggatagcaacatccatcagcggcggaacagctatcgtgggcatgagagcgaggactctatgagtacactagcaggcagacgtgggatgcgccccaagatgatgatgccgtttgattcccagcccccacaaccagtcatctcggcccacccaatccacagcctagacaatccacatcatcacttccacagcagcagtttagcatcgcctgcccggagccatctgtatcaccctgggtccccctggccaatcggcacttcgatgagcttaagcgatcgcgccaacagcaccgagtccgtcaggaataccccctccacagataccatgcccgctagcagcagtcagacttgctgtacagaccaccaggaccctgaaggggcaacttcgtctagctaccttgccagctcccaagaggaggacagcgggcagtccctgccaaccgcacatgtgcgcccctctcatccactcaaatcatttgctgtccctgccattccccctccgggaccccctacctatgacccagcgctacccagcacccctctgttgtcccagcaggcccttaaccatcacattcactctgtgaagaccgcctccatcggcacactcgggcgatctcgacctccaatgcctgtcgtggttccctcagccccagaagtccaggagactaccagaatgctagaggactctgagtccagttatgagccagatgagctgactaaagagatggcacaccttgaaggactgatgaaagacctgaatgctattactaccgcttag

SEQ ID NO: 125976 - DNA, 3519 bp, Artificial Sequence
  Description of Artificial Sequence: Synthetic coding sequence
atgaagaatgaagaagccctcgatactgagtccagtgagagactggttctgcttgccggcggttccctggagatttcagatgtcactgaggacgatgccggcacctatttctgtatcgctgataatggtaacgaaacgatcgaggcacaggccgaactgaccgtgcaggctcagcccgagttcctcaaacagccgactaatatatacgctcatgagagtatggacatagtgttcgagtgtgaagttacgggaaaacctacacctacagtgaagtgggtcaagaacggggacatggtgattccatcagactacttcaagattgttaaggagcacaacttgcaggtgcttggtctggtcaagagtgatgaaggcttttaccagtgcatagccgaaaatgacgtgggaaacgctcaagcaggggcacagcttatcattctggaacatgatgtggctattcccacgctcccgcccacaagcctgacatccgccacaacggaccatctggcccctgctacgactggacctttgccctccgctcctagagacgtggtcgctagcctggtgtccacacggttcatcaagctgacatggcggaccccggctagcgatccgcacggagataatctgacctacagcgtgttttatactaaggagggcattgcccgtgagcgtgtggagaatacctcccatccaggggaaatgcaagtaactatccagaacctgatgcccgctacggtgtatatcttccgcgttatggcccaaaacaagcacgggagcggcgagagcagcgctccactgcgggttgagactcaaccagaagttcagttgccgggccccgcaccaaatctgcgcgcttacgctgcctcgccgacatcaattaccgtcacatgggagactccagtgtccggaaacggtgagattcagaattataagctgtactacatggaaaaaggcaccgataaggaacaagacgtggacgtctcttcccatagttataccattaatgggcttaagaagtatacagaatatagcttcagggttgtcgcatacaacaagcatggccctggcgtaagtacaccagatgtggcagtgcgcacgttaagcgacgttccatcagcagccccgcagaatttatccttggaagttcgcaacagcaagagtatcatgatccactggcagccacctgctcccgctacgcaaaacggccaaataacaggctacaagattagatataggaaggctagccgaaagagtgacgtaaccgaaaccctggtctctgggactcagctgtcacagctgatcgaaggcttggacagagggactgagtacaatttccgcgtcgccgctctgaccattaacggaaccgggcccgctactgactggctcagcgccgagacctttgagagcgatctggatgagacccgcgtgcctgaggtgccatcatcattgcacgtccggcctctagtgactagcattgtagtttcttggacacctccagaaaatcagaatattgtagtacgtggatacgcgatcggttacggtattggaagcccccatgcacaaaccattaaggtcgattacaaacagcgatactataccatcgagaacttggatcccagtagccattacgtgattaccctgaaagcattcaacaatgtgggagaaggtatccccctgtacgaatctgctgtcactcgcccacacacagtgccagatcccactcctatgatgccacctgtgggggtgcaagcctccattttatcacacgacactatacggattacctgggcggataacagcctgcctaaacatcagaaaattacagactcccggtactacacagtaaggtggaaaaccaatatccccgccaatactaagtacaagaatgcaaatgccacaaccctcagttacctggtgaccgggttgaagccaaataccttgtatgaatttagcgtaatggtgacaaaggggcgccgtagctctacatggtcaatgacagcacatggcacaacattcgaattagtgcctacgtccccccccaaggacgtaactgtggtgtccaaggagggcaaacccaagactattatcgtaaattggcagccgcctagcgaggccaatgggaaaatcactggctacatcatttattatagcactgatgtcaatgctgaaatccacgattgggttattgagcccgtcgtgggcaatcggttgacacaccagatccaggagctgactctggatacaccttattacttcaagatacaggcccggaacagtaaaggcatgggccccatgagtgaagctgtgcaatttcgcacccctaaggcctctggcagcggcggtaaaggcagccgtctacccgaccttggcagcgactataaacccccgatgtctggttcaaactccccgcacggatcacccacatcccctttagatagcaacatgttactggtgattatcgtgtccgtcggggtgattacaatcgtggtggtagttataatcgccgtcttttgcacgcgccgtactacaagccatcagaaaaagaaaagagctgcttgcaagagtgtgaacggttctcacaagtacaagggtaattccaaggatgtgaagccacccgacctgtggatccaccatgagagactcgaattgaaaccaatcgataaaagccctgaccctaatcctatcatgactgacaccccaatccccagaaattcccaggacataacacccgttgacaatagtatggacagcaacatccaccagcgccgtaattcatacagagggcatgaaagcgaggacagcatgagcaccctcgccgggcggcgtggtatgaggccgaagatgatgatgccatttgattcacagccaccacagccggtgatcagcgcgcatcccattcactcgctggacaacccccatcaccattttcactctagcagcctggccagtcccgccaggtctcacctctaccatcccggctccccatggccaattggtacttcaatgtccctgagcgaccgagctaactctaccgagagtgtgcgcaacacacctagcaccgacacaatgcctgcctcctcatcccaaacgtgttgtacagatcaccaggatcccgaaggggcaacatcttcaagctacctggcgtcctcccaggaggaggacagcggtcagtctcttcctaccgcacatgtccgccccagccatcccctcaagtcattcgccgtgcctgccatcccacctccaggacctcccacttacgaccctgcgctgccttctacccccctactcagccagcaggcactcaatcaccacattcacagcgtcaaaaccgcctccatcgggacactgggtagatcgaggccacctatgcctgtggtggtgccctcagctccagaggtacaggagaccactcgaatgctagaggactctgagtccagctatgaacccgatgagctgactaaagaaatggctcacttagagggattaatgaaggacctaaatgccattacaaccgcctag

SEQ ID NO: 125977 - DNA, 4353 bp, Artificial Sequence
  Description of Artificial Sequence: Synthetic coding sequence
atggccgccgaacggggagccaggcggttactgtccacacctagcttttggctgtactgtttgctgctgctgggccgccgcgccccgggagccgccgccgccagaagcggctccgcaccccagtctcctggggctagcattcgaactttcacacctttttacttcctggtcgagcccgtagacaccttatccgtccggggttccagcgtcattctgaactgcagcgcttatagcgaaccctccccaaagatcgaatggaagaaggacgggacattcctgaatctggtgtcagatgatcgaagacaactgcttcctgacggcagcctgttcatttctaatgtggtgcactccaaacataacaaacccgatgaaggatactatcagtgcgtggcgaccgtggaaagccttggtaccatcatttcacgcaccgccaagctgatcgttgcgggcttgccaaggttcacctcccagcctgaaccttcgtccgtgtatgccgggaacaatgccatcctgaattgtgaggtaaacgcagacctcgttccattcgtccgctgggaacagaatagacaacccctcctgctggacgaccgcgttatcaagttaccttctggcatgttggttatctcaaatgccaccgaaggcgatgggggtttgtatcgctgtgtagtggaatctggaggacccccaaaatactccgatgaagtggagctgaaagttctgcccgacccagaagtgattagtgacctcgtcttcctgaaacaaccaagtcctctagtccgtgtgatagggcaggatgttgtgctcccttgtgtggcttccggcctgcccacacccactatcaaatggatgaaaaacgaggaagcgcttgataccgagagttccgagcggctggtactactggccggcggaagcttggaaatctccgatgtgacggaggatgacgcggggacttacttttgtatcgccgataacggcaatgagacaatagaggcacaggccgaactgactgtgcaggcacaacccgagttcctgaaacagcccaccaacatatatgcacatgaatccatggatatcgtgttcgagtgtgaagttaccggcaagccgacccccaccgttaagtgggtcaagaatggggacatggttatcccaagtgattactttaagatcgtcaaggaacataatttgcaagtgctgggcctcgtgaagagtgatgaaggcttttatcagtgcatcgcagagaacgacgtggggaacgcacaggctggggcccagctcatcatcctcgagcatgccccggcgactacaggcccgctgccgagcgcccccagagacgtcgtggcctcattggttagcacgcgcttcatcaagctgacatggagaacacctgcctcggacccccacggagataatctgacatacagcgtgttctatacaaaggaaggtatcgcaagggaaagggtggagaatacttcacacccaggtgagatgcaagtaacaattcagaacctgatgcctgcgacggtatatattttccgggtgatggcccagaataagcatggctccggagagagttcggcccccctcagagttgaaacacagccggaagtgcagcttcctggtccggctcctaacctgcgagcgtacgccgctagtcccacaagtataaccgttacctgggaaaccccagtgtccgggaatggggaaatccaaaactataaactctactatatggagaagggcaccgataaggaacaagacgtagacgtgagctctcattcctatacgatcaacgggctaaagaagtacactgaatattctttccgcgtggttgcctacaataagcacggccctggtgtctcaacacccgatgtggcggtgcggactctgtccgatgtgccgtctgcagccccgcaaaacttaagcttggaggtgcggaactctaaatctatcatgatccattggcagccacccgcacccgccacccaaaatgggcagattacagggtataagatccggtataggaaagcaagccgcaagtccgacgtgactgaaacactggtgtctggaacccagcttagtcagctaattgagggactcgacagggggacagaatacaacttcagggtggcggcactcacaattaacggaaccggaccagccacagattggctatcagccgagaccttcgagtcagaccttgatgagacacgcgtacctgaggtgcccagtagcctgcacgtgcgacccctggttaccagtattgtggttagctggactccacctgagaatcagaatattgtcgtgcggggatatgcaatcggatatggtatcggatcaccccatgcacagactatcaaagtggattataagcagcgttattataccatcgaaaacctcgatccaagttcccattatgtgattacactgaaggctttcaacaacgtaggggagggtatccctctatatgaaagcgctgtaaccagaccacatacggatacttctgaagttgacttattcgtgattaatgcaccatataccccagttcccgatcccacgcccatgatgcctcccgtcggggttcaggcctctatcctttcccatgataccattcgcattacatgggccgacaattcactacctaagcaccagaaaattaccgattctcgttactacacggtaaggtggaagacgaacatcccagcaaacacgaaatataagaacgctaatgctactacgctctcatacctcgtcactggtcttaagccaaataccttgtatgaattctcagtgatggttactaaggggcggcgatcttctacatggtccatgaccgcccacggaacaacattcgagttggtacccacgagcccccccaaagacgtaacagttgtgagcaaagagggtaagcccaaaactatcattgtcaactggcagccaccttccgaagcaaacggtaaaatcacaggctacatcatctactattctaccgacgtcaatgcggagatacatgattgggtcattgagcctgtggttggcaatcgcctgacccatcagatccaagaacttaccctcgatacaccctactattttaaaatccaggcccgaaattctaagggtatggggcccatgagtgaggcagtacagtttagaacgccaaaggccagcgggagtggaggaaagggctcccgcttgcctgacctgggtagcgactacaagcctcctatgagtggatccaattctccccacggctcacctacctcgccccttgattctaacatgctgttggtgattattgtgtcagtgggagtgattaccattgtagttgtggtcattatcgcagtgttctgtacacggagaaccaccagccaccagaagaagaaaagggccgcatgtaaatccgtgaacggtagtcataaatacaaggggaacagcaaggatgtcaagccccccgacctgtggatacaccacgaaagattggagctgaagcccatcgataagtccccggatcccaacccaattatgaccgataccccgattcccagaaacagccaagatattacccctgtggataacagtatggattcaaacatccatcagaggcgaaactcctatagaggacacgagagcgaggacagcatgagcaccctggctggccgtcgggggatgaggcctaagatgatgatgccctttgacagccagcctcctcagcccgtgatatcagcccatcctatacactccctagacaatccacaccaccacttccattcttcctccctggccagcccagctagatcgcacctctaccaccctggtagcccttggcctatcgggacgagcatgtcactgtcagaccgagccaattccaccgaatctgttcgcaatacgccaagcacagacactatgcccgcaagctcttctcaaacatgctgtacggatcatcaagatcccgaaggcgccacttcatcctcctatctggcgtccagccaggaggaagactccggccagagtctgcccacagctcatgtgagaccgtcacacccgttaaagtcattcgcagtcccagcaatcccacctcctggcccccctacgtatgacccagcccttccatctacaccccttttaagtcagcaggcgctgaaccaccatatccactccgtaaagacagcttccatcggcacactcggaagaagccgtcctcctatgccagtagttgtgccttctgcccccgaagtacaagaaactacccgcatgctcgaagacagtgagagtagctatgagccagatgagctgaccaaggagatggcccacttggaaggactcatgaaagacttaaacgccattaccacagcctag

SEQ ID NO: 125978 - DNA, 4227 bp, Artificial Sequence
  Description of Artificial Sequence: Synthetic coding sequence
atggcggctgagagaggggcccgtcgtctgttatccacgccctctttttggctgtattgcctgttgttactgggccgtagggccccaggcgctgccgcggcaagaagcgggtctgctcctcagtcccccggtgcctccattcgtacctttaccccattttatttcctggtcgagcctgttgacaccctcagcgtcagaggctcaagcgtgatcctgaattgtagcgcctactccgagccctctcccaaaatcgagtggaagaaagacggcacttttctcaatttggtgagcgacgaccggcggcagctcctacctgatgggtctttgttcatctccaatgtcgtgcattccaagcacaacaaacctgacgaagggtactatcagtgcgtggctaccgttgagagtttaggtacgattattagtagaaccgcaaagctgatagtcgccgggttgccacggttcacaagtcagccggaaccctcgagcgtgtacgctgggaacaatgccatcttgaactgtgaagtaaacgccgatttggttccttttgtgcggtgggaacaaaataggcaaccgctcctgctggatgaccgcgtgattaaactgccgagtggaatgctggttattagtaacgcaacagagggtgacggcggtttgtatcgttgtgtagtcgaatccggtgggcccccaaaatattcagatgaggtcgagttgaaggtcctgcccgaccccgaggtgatctcagacctggtcttcctgaagcaacctagccctttggtgcgcgttatcggacaggatgtggtgctcccctgtgttgcttccggtcttccaactcctacgatcaaatggatgaagaacgaagaagcgctcgacactgaaagctccgaacgcctggtattactcgccggcgggtccttagagatctctgatgtgacagaagatgatgctggtacttacttttgcatagccgataacggcaatgagacaatcgaagcccaggcagagctgaccgtccaggcccagcctgagttcctcaagcagccaaccaacatctacgcgcacgaatctatggatatagtttttgaatgtgaggttacaggcaagcccactcccactgttaagtgggtgaaaaatggggatatggtaattccctccgattatttcaagatcgtgaaggagcacaacttacaagtgctgggtttggttaagagcgacgaaggtttttatcagtgcatagcggagaacgacgtcggtaatgcccaggccggcgctcagctcattatcctggagcatgctccagctaccacgggccccttgcctagcgcaccccgggatgtggttgcatccctcgtcagcacccgctttattaagttgacttggcgcactccagcttctgatcctcacggcgataacctcacttactccgtcttctatacaaaggagggaattgcccgcgaacgggtcgaaaatacttcccatcccggcgaaatgcaagtgacaattcagaacctgatgcccgcaactgtctacatttttcgggtaatggcccagaataagcacggatccggcgagtcaagcgctcccttacgagtggagacccagccggaggtgcagctgcccggccccgccccgaatctccgcgcttatgctgccagccctacttctattacggttacctgggagactccagtttcaggaaacggcgagattcagaattataaactctactacatggagaaaggaacagataaggagcaggatgtcgacgtcagctcccactcctacaccattaacgggttaaagaaatacacagaatatagctttagagtggtcgcctacaacaagcacggtccaggagtgagtacaccagatgtggcagtgaggaccctatctgatgtgccttcagccgccccacagaacctgtcattggaggtgagaaacagcaaaagtattatgattcactggcagccccccgcccccgccactcagaacggccagatcaccggctataagatacgatacaggaaagcctccaggaagtcagacgtaacagagacattggttagtggtacgcagctgagtcaactaatcgaaggattagatagggggacggagtacaatttccgggttgctgccctgacgataaatggaacagggcctgcaactgactggctctctgccgagacattcgagtcagatctggacgagactcgagtccctgaagtaccctctagccttcacgtgcgccccttggtcactagcatcgttgtatcctggacaccacccgaaaaccagaacatcgtcgttcgcggttatgccatcggttacggaattggctccccccacgctcagacaatcaaggtcgactacaaacagcgctactacacaatcgaaaatctggacccttcctcccattacgtgattactctgaaggcatttaacaatgttggcgaaggaatccccctctacgaatccgctgtaactcggccgcatactgacacaagtgaggtcgatctgtttgtgataaacgccccatatacaccggtccctgaccctacaccgatgatgcctcctgtgggtgtgcaggcttccatcttgagccacgacaccatcaggataacctgggcagataattctttgcctaagcaccagaaaattacagattcccgctactacaccgtgcgttggaagacaaatattcccgcaaatactaagtataaaaatgccaatgcgactactctgtcttacctcgtgacagggttgaaaccaaatacactatacgagttctctgtgatggtgacaaaaggaagaaggagttctacatggtctatgactgcccatggcacaacatttgaactcgtgcccactagtcccccaaaggacgtaactgtggtcagcaaggagggcaaaccaaaaacaatcatcgtcaactggcagccaccatctgaagcaaacggaaaaatcaccggctacatcatctattactccacagacgtgaacgcggagattcacgattgggttatcgaaccagtagtcggaaatagacttactcaccagatacaagaattaacgctcgataccccatattacttcaagatccaggccagaaacagcaagggcatgggccccatgtcagaggctgtacagttccgcacccccaaagccgacagcagcgataagatgccaaacgatcaggcctccgggtctggcggtaagggtagcaggctgccagatctgggctcagactacaagcctcccatgtccgggagcaactccccccatggaagccctacttctccacttgattccaatatgttgctagtaattattgtgtctgtgggcgtgattacaattgtggttgtggttattattgctgtgttctgtacgcggcggacaacatcccatcaaaagaagaaacgggccgcctgtaaatcggtgaacggttctcacaaatacaagggtaacagtaaggacgtaaagccacccgatctgtggatccaccatgaaagactggagcttaagccgatcgacaaatcacccgacccgaatcccattatgaccgatacacccataccccggaatagtcaggatattactcccgttgataactcaatggacagcaacattcaccagcgccgcaattcttacaggggacacgagagtgaggacagcatgagtaccctcgctggaaggcgtgggatgaggccgaaaatgatgatgccttttgacagccaaccaccacagcaaagcgtgaggaacacgcctagcaccgacacaatgcccgccagctctagccagacctgttgcacggatcatcaggatcctgagggcgcgactagctctagctaccttgcatcaagtcaggaagaagacagcggtcaatctctcccaactgcacacgttcgacctagccacccgcttaagagcttcgcggtccccgcaatacctcctccaggtcctccgacatatgacccagccctcccatccactcccctcctgagtcagcaagcgctaaaccatcatatacacagcgtgaagaccgcttccataggcaccctgggtagatccagacccccaatgccagtggttgtcccctctgccccggaggtccaggagaccacccggatgctggaggattcagagtcctcttatgagcccgacgagttgacaaaggagatggctcacctggagggtttgatgaaggatctgaatgccatcacaaccgcatag

SEQ ID NO: 125979 - DNA, 1074 bp, Artificial Sequence
  Description of Artificial Sequence: Synthetic coding sequence
atgcagtccgttcagtccacatccttctgcctcagaaaacagtgtctgtgtcttacctttctgctcctccacttactcggccaggtggcagccacgcaaagatgtcccccacagtgtcctggtagatgcccggccacccctcccacctgcgcacccggtgtgcgagcagtcttagacggttgcagctgttgtcttgtttgtgcacgtcagcgtggcgaaagctgcagtgaccttgaaccctgcgatgagagttctgggctgtactgtgaccgcagtgccgacccctcaaaccagacaggcatttgtactgccgtggagggtgacaattgcgtatttgatggggtgatttacaggtcaggggagaagtttcagccctcttgtaagttccagtgcacatgcagagatggacagataggatgtgttcctcgatgtcaattagatgtcctgctgcccgaacccaattgtccagccccccggaaggtggaagttccaggggagtgttgtgagaaatggatttgcggtcccgacgaggaggactccctgggcgggttaacattggctgcctatcgcccggaggcgacattgggcgtggaggtgagtgactcctccgttaactgtattgaacaaacgaccgaatggaccgcctgcagcaagagttgtgggatggggttttccactcgcgtgacaaaccgcaaccgtcagtgtgagatgctgaagcagaccagactgtgtatggtcagaccttgcgaacaggagcccgaacagcctacagataagaaaggcaaaaagtgtctaaggaccaagaagagcctaaaggccattcatctgcagttcaaaaactgtacatctcttcatacctataaacctcgcttttgcggcgtctgctccgacggtaggtgttgtactccgcacaacactaaaaccatccaggccgaattccagtgctcccctgggcagatcgtgaagaaacctgttatggtgatcggcacttgcacatgtcatactaattgtccaaagaataatgaggctttcctgcaagagttggagcttaagacaacccgaggcaagatgtag

SEQ ID NO: 125980 - DNA, 2202 bp, Artificial Sequence
  Description of Artificial Sequence: Synthetic coding sequence
atgcttgccagacgccagagagaccccctccaggcactcagaagacgaaaccaggagctgaagcagcaggtggatagcctgctgagcgagtcccaattgaaggaggctctagaaccaaataagagacagcatatttaccagcggtgcatccagctgaagcaagcaatagacgaaaataaaaatgcccttcagaaactgagtaaagcggacgaatcggcgcctgttgcaaactataaccaaagaaaggaggaagaacatacactgctggataaactcacccaacagctccagggccttgctgtgacaatatcaagggagaatatcactgaggttggagctcccacagaagaagaggaagaatcagagagtgaagattctgaggatagcgggggagaagaggaggatgctgaggaggaagaagaagagaaggaggaaaatgaaagtcataagtggtctaccggggaggagtacatagctgttggggacttcactgcccagcaggtgggtgacctgacttttaagaaaggggagatcctgctcgtgatagaaaaaaaaccggacgggtggtggatagctaaagacgctaaagggaatgaagggctggtgccaagaacttatctggagccctacagtgaggaagaagagggccaagaatccagtgaagagggctctgaggaggacgtcgaggctgtggacgagactgcagacggggcggaggtcaaacagcgcaccgatccacattggtctgctgtgcaaaaagcaatcagcgaagctggtatattttgtctggtgaaccacgtcagtttctgttatctgatcgtgctgatgcgcaacagaatggagaccgtggaagacaccaatggctctgaaaccgggttccgcgcttggaatgtccaaagccgcggaagaattttccttgtgtccaaacccgtactacaacagatcaacacagtcgatgtactgaccactatgggtgccattcctgcgggttttcgcccaagcactttgtcacagctgctggaagaggggaatcagtttcgggcgaattattttctgcagccagaactgatgccaagtcagctcgcctttcgggacctgatgtgggacgcaaccgaaggaaccattagatcccgcccctctcgtatctctctaattttaactttgtggagttgcaagatgattccactccccggaatgtccatccaggtcctgtcccgacacgttcgcctgtgcctttttgatggcaacaaagtcctctccaatattcacactgtgcgagccacatggcaaccgaagaagcccaaaacttggactttttctccccaggtgacccgtattctgccctgtctgttggacggcgattgctttatccggtccaattccgcaagccctgacctcgggatattattcgagctcggaatttcatatataaggaactcaaccggcgaacggggagagctgtcctgcggctgggtgttcttgaagctatttgacgcaagtggtgtgccaattcccgccaagacttatgagttattcttaaacgggggaaccccttacgaaaaagggattgaggtagatcccagcatctcaagaagggcgcacggcagcgtcttttatcagatcatgactatgcgcaggcaaccacagttactagtaaaactgagatccctcaacaggcggtccagaaatgtgctgtcacttcttccagagaccctcatcggaaacatgtgtagcatccacttacttatcttttacagacagatcctaggagacgtccttctgaaggacagaatgagcctccagagcactgacctgattagccatcccatgctcgcaaccttccccatgcttctggaacagccagacgtcatggacgccttgcggtcctcatgggccgggaaagagagcacgctgaagagatcagagaaacgggacaaggagttcttgaaaagcactttcctcttggtttatcacgactgtgtgctgcccctcctacactctacgagactgccaccattcaggtgggccgaggaagaaaccgaaactgcgcggtggaaagtcattacagatttcttgaagcaaaaccaggagaaccaaggcgccctccaggccctgctgtctcccgatggcgtccatgagccttttgacctcagtgagcagacgtacgatttcctaggcgagatgcggaagaacgccgtctag

SEQ ID NO: 125981 - DNA, 1845 bp, Artificial Sequence
  Description of Artificial Sequence: Synthetic coding sequence
atgctggcacggagacagagggatcctctccaagcacttcggagaaggaaccaggagcttaagcagcaggtggacagcctactaagtgaatcacagctcaaggaggccctggagcctaacaaacgacagcatatctatcagcgtgtaggggctcccactgaggaagaggaggaatctgagagtgaggactctgaggacagcggcggggaggaggaggacgcggaagaggaggaggaagaaaaagaggagaatgagtcccataagtggtcaaccggggaagagtatatcgccgtgggggacttcaccgcacaacaagtcggagatttaacattcaagaaaggggaaatactgctcgtgatcgagaaaaagccagacggttggtggattgccaaggatgctaagggaaacgaaggtctggtgccccggacctaccttgaaccctacagcgaggaggaggagggccaggagtcaagtgaggaaggctccgaagaggacgtcgaggccgtggacgagactgctgatggagcagaggtaaagcagcgtaccgatccgcactggagcgccgtccagaaggccataagcgagattaacaccgttgacgtccttacaactatgggggcaatccccgccggttttcgcccatcgactttatcacagttactcgaggaaggcaaccaatttcgcgcaaattacttcctgcagcctgagttgatgccatcccagctcgccttcagagatctcatgtgggatgccactgaaggaaccatccggtctcgaccaagtcgaatatccctcatcctgactctctggagctgcaagatgattcctctgcccggaatgtccatccaagttctcagccggcatgtgcgtctctgtctgttcgacggaaataaagttctgtctaacattcacacggtcagagccacgtggcaacctaagaagcccaagacctggacgttttcacctcaggtgactcgcatattaccgtgcctgctggatggagactgctttatccgatctaacagtgcaagcccggatctgggaatcctctttgagctgggaatttcctacatccgcaactcaaccggcgagcgcggcgagctatcctgcggctgggtattcctgaagctcttcgatgccagcggggtacctatccctgccaaaacatatgagttgtttttgaatggggggaccccgtatgagaaaggcatcgaggttgaccccagcatttccaggcgggctcatgggagcgtgttctatcaaatcatgaccatgcgcagacagcctcagctgttggtgaagttacgcagcctcaaccggcgcagccgcaacgtgttgagcctgctgccggagaccctcattggcaatatgtgcagcattcatctcctgatcttctatcgccagattctgggcgatgtgctccttaaagaccgcatgagcctgcagtctacagaccttatctctcatcctatgctggcaaccttcccaatgctgctggaacagcccgatgtgatggatgcgctgagatcctcttgggctggcaaagagtcgaccttaaaaagaagcgagaaacgcgacaaagagtttctgaagtctacatttctgctggtgtatcacgattgtgttcttcccctgctgcacagcactagactgccgccattccggtgggcagaagaggagacagagaccgcgcgttggaaggtaataaccgactttctgaaacagaaccaagaaaatcagggcgcattacaggccttattgagccccgatggggtgcacgagcctttcgacctgtctgaacaaacctacgatttccttggcgagatgcgcaagaatgcggtctag

SEQ ID NO: 125982 - DNA, 2199 bp, Artificial Sequence
  Description of Artificial Sequence: Synthetic coding sequence
atgctggctcggcggcagcgcgacccacttcaggctctgcgccgcagaaaccaagagctgaagcagcaggttgatagtttgctcagcgaatcccagcttaaggaggccctcgagcccaataagagacaacacatttaccaaaggtgcatccaattaaaacaggcgatcgacgagaataagaatgccctgcagaaattatctaaggccgacgagtcggcgccggtggctaactacaatcaacggaaggaagaggagcacaccctgcttgataaactgacacaacagctccaaggcttggccgtgacgatcagtcgcgagaacatcactgaggtaggcgctccaacggaagaggaagaagaatctgagtctgaagacagtgaagattcagggggcgaagaggaagacgccgaagaggaagaagaggagaaagaggagaatgaaagccacaagtggagcactggggaggagtatatcgccgtcggagatttcaccgctcagcaggtaggggaccttacctttaagaagggcgagatcctgttagtcatagagaaaaaaccagatggctggtggatcgccaaggatgccaaagggaatgagggcctggtccctcgcacataccttgaaccgtactctgaagaagaagaaggacaggaaagttctgaggaaggatctgaggaggacgtggaggcggtggacgagactgctgacggcgctgaggtcaagcagagaactgatccacattggagcgctgtccagaaggctatcagtgaagctggtattttctgcttagtgaaccatgtcagcttctgctatcttatcgtactcatgcgcaataggatggagactgtcgaagacacgaacgggtccgagactggatttcgagcttggaacgtccagtcacgcggtagaatcttcctggttagtaagcccgtgttgcagataaataccgtggatgttttgacaactatgggtgctatcccggcagggttcagaccatctacactttcccagctcttggaagaaggcaaccagttcagagccaattacttcctgcagcccgaactgatgccttcacagttagcttttagagatttaatgtgggatgctactgaaggaacgatcagatcccgcccctcccggatttctctgattttgaccctgtggagctgcaagatgatccccctccccgggatgtctatccaagtcttatctcgccatgtgaggctgtgcctatttgatgggaacaaggtgctgagtaatatacacacagttagagcaacttggcaacccaagaagccaaaaacttggacctttagtccccaggtgacacgcattctgccgtgcctacttgacggagactgttttatccgcagcaattctgcctcccccgatctgggaatcttgtttgaactgggaattagctacatcagaaatagcaccggagagcggggagaattatcctgcggatgggtattcctgaagctgtttgatgcgagtggcgtgccgattccagccaagacatatgagctgtttcttaatggggggaccccttacgagaaaggcattgaagtagaccctagcatctccaggcgcgcccatggatcagtcttctaccagatcatgaccatgagacgccaaccccagctcctagtgaagctgcgctctcttaataggaggagccgcaatgtactgagtcttctgccagagacgctcatcgggaacatgtgtagtatccatctacttatattctaccgacaaattttgggagatgttctcctcaaggataggatgtctctccagtcaactgacctgatttcacatcccatgcttgcgacttttccaatgcttttagagcagccagacgtaatggacgcccttcgcagctcttgggcgggtaaggagtctactctcaaaaggagcgagaaacgcgataaagagttcctcaagagcacatttctgctggtgtaccacgattgtgtgcttcctctcttgcacagcactagactgccaccgttcaggtgggccgaggaagaaactgaaacagctcgctggaaggttatcaccgacttccttaagcagaatcaggaaaaccagggcgccctgcaggcactgctgtcccccgacggagtgcatgaacccttcgatctgtccgaacaaacttacgatttcctgggggaaatgagaaagaacgcggtgtag

SEQ ID NO: 125983 - DNA, 2034 bp, Artificial Sequence
  Description of Artificial Sequence: Synthetic coding sequence
atgctcgcccgaaggcagagagatcctctgcaggctctgcggcgtcggaaccaagaactgaagcagcaggtggattctttgctctcggagagtcaactgaaggaagcccttgaacccaataagcggcagcacatctaccaacggtgcatccagctaaagcaggcaatcgacgagaacaagaatgctctgcaaaaactgagcaaggctgacgaaagtgcacctgtggccaattataaccagagaaaagaggaggaacacaccttattggacaagttgacacagcagctgcaaggactggctgtgaccatcagtagagaaaatataaccgaagtgggggcccctaccgaagaggaggaggaaagtgaaagcgaagatagtgaagactctgggggggaagaggaagacgcagaggaagaggaggaggaaaaagaggagaacgaaagccataaatggtccactggtgaggaatatatcgccgtgggggatttcaccgcgcagcaagtgggggatctgaccttcaaaaagggcgaaattctgcttgtgattgaaaaaaaaccagatggctggtggatcgccaaggacgcaaaaggtaacgaagggttagtaccacgcacctatttggaaccttactcagaggaggaggaaggacaggaaagctccgaagaggggtcagaagaggacgtagaagcggttgatgaaaccgcagatggcgccgaggtgaaacagagaacagatccccattggagcgccgtgcaaaaggctatatctgaacaaatcaatacagtagacgtcctaactaccatgggcgcaattcctgcgggattcaggccatcaactctcagtcaactactagaggaaggtaatcagttccgcgccaattatttcctccaaccagaactcatgccgagccagctagcctttagagacttgatgtgggatgcaactgagggcaccattcggtcgcggccatcccggatcagcctcattctgacgctatggagctgcaaaatgatcccactacctgggatgtccattcaagtactatcgcggcacgtgaggctgtgcctgtttgatggtaacaaagtattaagtaatattcacacagtgagggctacgtggcagccaaaaaagcctaagacttggaccttctcccctcaggtgacccgtatattaccttgcctccttgacggcgattgctttatcaggagtaactcagccagccctgacctgggcatactgtttgaacttggcatttcgtatatccggaactctacaggcgaacggggtgagctcagttgcggctgggtgttcttaaagttatttgacgccagcggggtcccaatcccagctaaaacctatgagctgttcttgaatggcggcaccccatatgagaaggggatcgaggtcgatccctctatctcacggcgagcccacggttccgttttctaccagataatgacaatgaggcggcagccgcagttgctcgtcaagctgaggtccctcaatcggcgctcacggaacgtcctgagtttactccctgagactctgataggcaatatgtgttctatacatctgctgatcttctacagacagattctgggtgacgtgcttctcaaagaccgcatgtctcttcagtccaccgacttaatttcccatccaatgctggccactttccccatgctgttggagcagccagatgttatggatgccttacgctcaagttgggccggcaaagagtcgactctgaaaaggtcggagaaacgggataaagagttcttaaagagtacatttttgctggtctaccacgattgcgttttgccactgttgcacagcactagattaccaccattccggtgggctgaggaagaaactgaaactgctcgttggaaagtgatcaccgatttcctaaagcagaatcaggaaaatcagggagcactccaagctcttctgagccctgatggagtgcacgagccttttgatctcagcgagcagacatacgatttcttgggagagatgcgcaagaacgccgtgtag

SEQ ID NO: 125984 - DNA, 2115 bp, Artificial Sequence
  Description of Artificial Sequence: Synthetic coding sequence
atgggtacagcatcctcccttgtgtcccctgctggcggggaggtgattgaagacacttacggtgcaggaggtggggaggcatgcgaaatcccagtagaagtgaagcccaaagcacgcttacttagaaactccttccgcaggggagcaggagctgcggccggtgccgggcctggctctctgccgcggggggtcggcgctggtggcctgttaggagcatcattcaagtcgactggttcctcagtccctgagctggaatacgccgccgccgaatacgaacgcttacgcaaagaatacgaaatcttccgagtgtccaaaaatcaagaacttctttccatggggcgtcgagaagctaagctcgataccgaaaataagagactccgcgccgaactgcaggcccttcagaaaacatatcagaagattctgagagaaaaggaatctgccttagaggcaaagtatcaagcgatggaacgtgctgcaaccttcgagcatgatagagataaagtgaaacgccagtttaaaatcttcagggaaacaaaggagaacgagattcaggatctgctgcgagccaaacgagagctggagagtaagctgcagcgtctgcaggcgcaggggatccaagtgttcgaccctggggagtcagatagtgacgataattgtaccgacgtaactgcagccgggacccagtgcgagtattggaccgggggagcattaggttctgagccctctattggttctatgatccagctccagcagagctttcggggaccagaattcgcccatagcagtattgatgtggaaggtccatttgcaaacgtgaaccgcgacgactgggacatcgctgtggctagtcttctccaggtgacccccctcttttctcacagtctttggagcaatactgtgagatgctatctcatatatactgatgagacgcaacccgagatggacctgttcctaaaggattactctccgaagctgaagaggatgtgcgaaaccatggggtacttcttccacgcggtttacttcccaatcgatgttgagaaccaatacctgaccgtgagaaagtgggaaatagagaagtcttccctcgtaatcctctttatacatctgactctcccatccctacttctggaagactgcgaggaagctttcctcaagaaccccgaaggtaaaccccgtctgatcttccacaggctcgaggatggcaaagtgtccagtgatagcgtgcaacagctcatagaccaagtgtccaacttaaataagacttcaaaggccaagattattgaccactcgggtgaccctgccgaaggtgtctacaaaacctatatttgtgtggaaaaaatcataaaacaggatatcttgggattcgagaacacagatctggagacaaaagatttaggttcagaagatagcatcccggaggaggacgatttcggggatgtgctttgggatatacacgacgaacaggagcagatggaaacgttccaacaagcctctaacagtgcacacgaactcgggtttgagaagtattatcagagactgaatgacttagtggccgcccccgcacctatcccaccgctgctagtgtcaggtggcccaggaagcggaaagagcctgctgctgagcaagtggatacagctccaacaaaagaacagcccaaatacccttattctcagtcacttcgtcggccgtccgatgagcacgagctccgagtcttcactcattataaaacggctgaccctgaaattaatgcagcactcttggtcagttagcgccctgacattggatcccgcaaaactgttggaggagttccccagatggctagagaagttgagtgcccggcaccagggaagtatcatcatcgtgatagacagtatcgatcaggtgcaacaagtcgaaaagcatatgaaatggctcattgaccctctgccagtgaacgtgagggtcattgtctcagttaatgtggagacctgtccccctgcctggcgactgtggccaactctgcatttggatcctcttagcccaaaagatgctaagtccatcatcattgccgaatgccactcagtggatataaagctgagcaaggaacagtgctgggaaagcaggcagttccggtag

SEQ ID NO: 125985 - DNA, 3993 bp, Artificial Sequence
  Description of Artificial Sequence: Synthetic coding sequence
atggggacagcgagttcgctggtgtcacccgcgggtggggaagtgatcgaggacacatacggagctggtggtggcgaggcttgtgaaattcctgtggaagtcaagccaaaagcacggcttctgagaaactcattcaggagaggtgctggcgccgctgccggggcaggtccaggaagcttacccaggggagtgggcgcgggcggcctcctgggagcctccttcaaatcaaccggctcatccgtcccagagctggaatacgccgcggcagagtacgaacgcctgcgcaaggagtacgagatatttcgggtctccaagaatcaggagctgctgtctatgggcagacgggaggccaagttagacacagaaaataaaaggttaagagccgagctgcaggccttgcaaaagacatatcagaagattctgcgagaaaaggagagtgccctggaagccaaataccaggcgatggagagggccgccacgttcgaacatgaccgcgacaaagtcaagcgccagtttaagatctttcgtgaaaccaaggagaatgagatacaggacctgttgcgagcgaagagagaactggagtctaaactccagcgactacaggcccaggggatccaagtgttcgatccaggggagtctgattccgacgacaattgtactgacgttacagctgccggaactcaatgtgaatactggacaggaggtgctttgggctccgagccttctatcggtagcatgattcagcttcaacagtcattcagaggacccgagtttgcccacagcagtatcgacgtggaaggcccatttgccaatgtgaaccgagatgattgggatatcgccgtagccagtctcctgcaggtgaccccattatttagtcactcactgtggtccaacaccgtacgctgttatctgatctacacggatgagacacaaccagagatggatttgttcctgaaggactattctcccaaattaaagcgcatgtgcgagactatggggtacttctttcacgctgtctatttcccaatcgatgtcgaaaaccagtatttgactgtgaggaagtgggaaatagaaaaaagttccctcgtgatcctctttatccatcttaccctccccagcctactgcttgaagactgtgaggaagcatttttgaagaaccccgagggaaagccacgactgatttttcaccggctggaggatggcaaggtgtcatccgactccgtgcagcaactgatcgatcaggtttctaacttaaacaagactagcaaggccaagattattgatcattctggagacccggctgagggtgtctacaagacttacatatgtgttgaaaagattatcaagcaggacatcttgggctttgaaaacaccgatctcgaaactaaggaccttggaagtgaggacagtattcctgaggaggatgacttcggagatgtcctgtgggacattcacgatgaacaagagcagatggaaacatttcagcaggcttcgaattctgcccatgaacttgggttcgaaaagtactatcagaggctgaacgacttagtagccgcccctgctccgatcccccctctactggtttccggcggtccagggtctgggaagtctctgctgctgtccaaatggattcagctgcagcaaaagaacagtcctaacacactgatactgagccactttgtgggaagaccgatgtcaactagtagcgagtcctctcttattatcaaaagacttacactgaagctaatgcaacacagctggtccgtgtcggcactcaccttagaccccgcgaaactgctggaggagtttccacgctggcttgagaagttatctgccaggcaccaggggtcaatcatcatagtaattgactctatcgaccaggtgcagcaggtcgagaaacacatgaagtggctgattgacccactgcctgtcaacgtgagggtcatcgtctccgttaacgtggagacatgccccccagcatggcgcctgtggcccactctgcatctagaccctctctccccaaaggacgcaaagtccattattattgcggagtgtcattccgtcgacatcaagctgagcaaagagcaggaaaagaaactggagcgccattgtcgctctgccacaacatgtaacgctctgtacgtgaccttgtttggcaaaatgatcgcccgcgcggggcgtgctggcaacctagataagatcctgcatcaatgtttccagtgtcaggacactctttcactctaccgacttgtgttgcatagcatacgcgaatccatggcgaatgacgttgacaaagagctcatgaaacagatactgtgtctcgtgaatgtctctcataatggggtcagcgagtctgagctgatggagttgtatccggaaatgagctggaccttcctcacatccctcatacattctctctataagatgtgtctcctcacatatggatgcggcctcctgcggtttcagcacctgcaggcatgggagacagtccggttggaatacctcgagggcccaactgtaactagcagctaccggcagaaattaatcaattacttcacactacagcttagccaagaccgagtgacctggaggtcagccgacgaactcccatggctgttccagcaacagggatccaaacagaaactgcacgactgccttttgaatctcttcgtgtctcaaaacctttacaagagaggacactttgcagagcttctctcgtactggcagtttgtgggcaaggataaatctgccatggccactgagtacttcgattctcttaaacagtacgaaaagaattgcgaaggagaagataatatgtcttgcttagctgatctatatgagacgctcggtaggtttttgaaggatctaggactgctctcccaggctatagttccccttcaacgatctttggaaattagggagacagctctggaccccgaccatcctcgggtggcccagtctctgcatcagctggcctcagtgtatgttcagtggaagaagttcggtaacgcagagcaactgtataaacaggccctggagatcagcgagaacgcttacggggccgatcatccctacaccgcccgagagctggaagccctagccaccctctaccagaaacaaaacaagtatgagcaggccgaacatttccggaagaaatcattcaagattcaccaaaaggccataaaaaaaaagggcaatctctacggattcgccctgttgcggcggagagctctgcaactcgaggaacttactctcggcaaggacactcccgataacgctcgcacactaaacgagctcggggtgctgtactatctccaaaataacctggagaccgccgaccagtttctgaagcgttctctggaaatgcgggagagagtacttggaccagatcatccagattgcgctcagtcattaaataatctcgccgccctttgtaacgagaagaaacaatatgacaaggccgaggaactttacgagcgagctcttgacatccgaaggagagcgctcgctcctgatcacccttccctggcatacaccgtcaaacacttggccatcctgtacaagaaaatgggcaagctggataaggccgtgcccctttatgagttggctgtggaaattaggcagaaatcattcggtcctaagcacccatctgtggcaaccgcactggtgaaccttgccgtgctctactcacagatgaagaagcatgtggaggcactgcctctgtatgagagggccctcaaaatctacgaagatagtttgggccgcatgcatccgagggtgggtgaaaccctcaaaaacctggccgtgctgagttacgaaggaggtgacttcgaaaaggccgctgaactgtacaaacgggccatggagatcaaagaggccgagacttctctgcttggaggaaaggccccatcaagacactcgagcagtggcgacacctttagtctaaagaccgcgcatagcccaaatgtgtttctccaacagggacagaggtag

SEQ ID NO: 125986 - DNA, 720 bp, Artificial Sequence
  Description of Artificial Sequence: Synthetic coding sequence
atggggactgctagcagcctcgttagtccagctggaggcgaggtgatcgaggacacctacggggcaggaggcggcgaggcttgcgaaattccagtagaggtcaagcccaaggctagacttctgcggaactcgttcaggagaggagccggtgcagctgcgggtgctgggcctggctcattgcctcggggcgtaggcgctggggggctgctgggtgcatcttttaagtcaaccggctcctctgtgccagaactagaatatgcagctgccgagtacgaacggctccggaaggagtacgagatcttccgagtgtcaaaaaaccaggagcttttaagcatggggaggcgtgaagccaagcttgacacagagaacaagagattacgcgccgagctccaggccttgcagaagacttaccagaagatcctgcgcgagaaggagtcagcgctcgaggccaaataccaggccatggagcgggctgccacttttgaacacgatagagacaaggtcaagcgccagttcaagatatttcgagagacgaaggaaaacgagatccaagatttgttgagagcaaagcgcgagctggagagcaaactccagaggctgcaggcccaaggcattcaggtgtttgaccccggtgaatcagactccgacgacaattgtacagacgtaactgtgagtctggaaagcgatcagcaccccgggatttttatagcaaatttctag

SEQ ID NO: 125987 - DNA, 453 bp, Artificial Sequence
  Description of Artificial Sequence: Synthetic coding sequence
atgggcacagcctctagcctggtgagcccagcgggtggcgaggtgattgaagacacctatggcgcgggaggtggcgaggcatgcgagataccagtcgaggtcaagcctaaggccaggctcttgcggaactccttccggcgcggcgccggtgccgcagccggagcagggccgggctctctgccccgcggcgtcggagcaggggggttgttgggcgcctcctttaaaagtactggaagtagtgtgccggaattagagtacgctgccgcggaatatgagaggctgagaaaggagtatgaaatcttccgggtgtcaaagaatcaggaactgctctctatgggtaggagagaagccaaactggacactgagaacaaacgtctgagggccgaactgcaaggcctggcagctgtggccaggtccagactcacagccacctggaacagctgggcccagtag

SEQ ID NO: 125988 - DNA, 1914 bp, Artificial Sequence
  Description of Artificial Sequence: Synthetic coding sequence
ataattgctaatgccgggcgcgccggtaacctcgacaaaatcctccaccaatgctttcagtgtcaagacacactgagcctctatcgcctggtactgcacagcatccgagagtctatggccaatgatgtggataaagaattgatgaagcaaatcctctgtctggtgaacgtcagccacaatggagtgtcagaatccgagctaatggagttgtaccccgaaatgagctggaccttccttacaagtttaatacattctctctacaaaatgtgccttctcacatacggatgcggactcttgaggttccagcacctccaggcctgggagaccgtgagactggaatacctggaggggccaaccgtgacctcaagctaccgccagaagttgataaattattttaccctgcagctctcacaggatcgagtcacatggagatccgctgatgagttaccatggctgttccagcagcaagggtctaaacaaaaactgcacgactgcctgctgaacttgtttgtgtcccagaatctttacaagagaggacacttcgccgagctattgagctactggcagttcgttggcaaggacaagtctgccatggccaccgaatatttcgacagcctcaaacaatacgaaaagaactgcgaaggggaggacaacatgagctgcttagcggacctgtacgagactctgggccgctttctcaaagacctgggccttctgagtcaggcgatagtgcctctgcaacgatccctcgagatccgagagacagccttggaccccgaccatccacgggtagcccagagcttgcaccagttagcttccgtgtacgtgcaatggaaaaaattcggaaatgctgagcagttgtacaagcaggccctggaaatctctgaaaacgcttacggagcagaccatccgtacacggcgcgggaactggaagccttagccaccttgtatcagaaacaaaataagtacgaacaggcagaacactttagaaagaaatctttcaagatccaccaaaaggcaataaagaagaaggggaatttatacgggtttgcccttttaagacgccgcgccctacaattagaagagctcactctgggtaaagatacgcccgataacgcacgcaccctgaatgagctaggagtgctgtattacctgcagaacaacttggaaactgccgaccaattcttaaaacgaagtctcgaaatgcgtgaaagagtgctgggccctgaccaccctgattgcgcgcagagcttaaacaacctggctgctttatgcaacgaaaagaaacaatatgacaaggccgaggaattgtatgagagagcattggacataagacgtagggcactggctcccgatcaccccagcctcgcttatacagtcaagcatctggccatactgtacaaaaagatggggaaactggacaaggctgtgccgctgtacgaactcgccgttgaaattcgacaaaagtcgttcggcccaaaacaccctagcgtcgccacggccttggtaaatttggctgtattatactcgcagatgaaaaagcacgtggaagcgcttcctctgtatgaaagggcattaaaaatttacgaggactccctgggtagaatgcacccacgggtgggggagaccctgaaaaacttagcagtgctgtcctatgaaggcggtgattttgagaaagctgcagaactttataaacgggctatggagataaaagaagctgaaacaagcctgctgggaggcaaagccccaagtcggcacagctcaagtggagacacattcagcctaaaaacagcacattcccctaatgtgttcctgcagcagggccagaggaaggtccagagcaacctactctcaccagaggggctctctaacatctgcgcccaggagaaaactacaagattcaccagcagctag

SEQ ID NO: 125989 - DNA, 1236 bp, Artificial Sequence
  Description of Artificial Sequence: Synthetic coding sequence
atgtcctgtcttgccgatctttacgagactctgggccgcttcctaaaggatctgggcctcctttctcaggccatcgtccctctgcagcgctctctcgagattcgtgagaccgctctcgaccccgatcatcctcgggtggctcaatcgttgcaccagctggcttctgtgtacgtgcaatggaagaagttcgggaatgccgagcagctgtataagcaggcactcgagatttcagaaaatgcatatggagcagatcacccatacacagcccgtgagctcgaggccctggctaccctttaccagaaacagaacaaatacgagcaagccgaacacttcaggaaaaagtcatttaagatccaccagaaggccatcaagaaaaagggtaatctgtacggattcgcgttgctgcggagaagggccctccagctagaagagctgactcttgggaaggacacaccagataacgctcgcacgctaaacgagctgggcgtgctgtactatttgcaaaataacctggagactgcagaccagttcctcaaacggtcacttgaaatgagagagcgtgtgctggggcccgaccaccctgattgtgctcagtctcttaataatttggcagcactctgcaatgaaaaaaaacagtacgacaaagctgaagaactctacgaaagagcattggacatcagacgccgggccctcgccccagatcacccctctttagcttataccgtgaagcatttggctatcctgtacaagaagatggggaaactggataaggccgtacctttatatgagttggccgtggagattcgacaaaagagtttcgggcccaaacacccctccgtggcaactgctctcgttaacctggcggtgttgtatagccaaatgaagaagcacgtggaagctctgcccctgtacgaacgggctttgaagatatacgaggatagcttgggccgtatgcacccgcgcgtaggcgaaacccttaagaatctcgctgtgctgtcgtacgaagggggcgactttgagaaggccgcagaactatacaaacgcgctatggagattaaggaggctgagaccagtctcctgggaggcaaagcgccctcacgccactcatcaagcggcgatacgttctctctgaagaccgctcacagccctaacgttttcctgcaacagggtcagcgcgcgggtaagagtaatccgacgttctacttacaaaagggatttcagacttacgttctatag

SEQ ID NO: 125990 - DNA, 4281 bp, Artificial Sequence
  Description of Artificial Sequence: Synthetic coding sequence
atgaacgactggcatcgtatcttcacacagaacgtcctcgtgccgccccatccacaacgagcacgacagccctggaaagaatcaacagcctttcaatgcgttctgaagtggctggacggacccgtcatccgacagggcgtgctcgaggtgttgtccgaagttgaatgtcaccttcgcgtgtcctttttcgatgtgacataccgccacttttttggacgtacctggaagaccactgtcaagccaactaagcgacctccatcaagaattgtgtttaatgagccactctatttccacactagtctgaatcacccacacatagtcgccgtggtcgaggtagtggcggagggaaagaaaagggacgggtccctgcaaactcttagctgtggctttggaatactgaggattttttcaaatcagcccgattctccgatttctgcttcccaagataagagactgcggttgtaccacgggacgcccagggccctcctgcatccactactgcaggaccccgctgaacaaaatcgacatatgacattgatcgaaaactgttcactgcagtatacgttgaagccgcacccagccctcgagcctgcgtttcatctgctgccagagaaccttcttgtgagtggacttcaacaaatccctggacttcttcccgcacatggagaatcgggtgatgcactcagaaaaccgcgacttcagaaacctatcaccggccacctggatgatctcttctttaccctgtatccgagcctggagaaatttgaggaggagttacttgaactccacgtccaagatcattttcaagaggggtgtgggcccctggatggtggcgcgctggagattctggagcgaagacttcgggtgggtgtccacaatgggctgggatttgtgcagcgaccccaggttgtcgtcctggtcccagagatggatgtcgcactcacacgttccgcttccttctcaaggaaggtggtgtctagtagcaagacgagcagcggcagccaggcattggtactgcgttcccggctccgattacccgagatggtgggacaccctgcctttgccgtcatcttccagctggagtacgtgttctctagtcctgcaggagtggatggcaatgccgccagcgttacctccctgagcaacctggcgtgcatgcacatggttaggtgggccgtctggaacccactgctggaggctgatagcggcagagtgactcttccactgcagggtggaatccagccaaatccatcccattgccttgtgtataaagtacccagcgccagcatgtcaagcgaagaggtcaagcaggtcgaatctggcacgttgaggttccagttctccctgggtagcgaggagcatctggatgcccccaccgagcctgtgtctggccccaaggtcgagagaaggccctcacgcaaacctccaaccagtccttcttctcccccggcccccgtccctcgcgttctagctgccccacagaactcaccagttggcccagggttgtccattagtcagttggctgcatcgccccgctctcccacccagcactgcctggccaggcctactagccagctaccacacggaagccaggcttcccccgcacaggcccaggagtttccgctcgaagctggtatctcccacctggaagccgacctctctcaaacatctctggtgcttgagacctcaattgccgaacagctgcaagagctgccgtttaccccccttcacgctccaatcgtggtcgggacccagactaggtcgtctgcaggacagccaagcagagcctccatggtcctccttcaatcaagcgggtttccagagatcctcgatgccaataaacagcccgctgaagctgtttccgcaacagagccagtaacctttaatccccaaaaagaggagagtgactgtctgcaatcaaatgaaatggttctgcagttcttggcgttttcgagagtggcacaggactgccggggaacgtcctggcccaaaactgtgtactttacttttcagttttacaggttccccccggcgacaaccccaagactacagttggtgcaattggatgaggccggtcagccatctagcggagcgctgactcatatcctagtgcctgtaagccgtgatggcaccttcgatgccggcagcccaggttttcagctccggtacatggttggaccgggtttcttgaaacccggcgagaggaggtgctttgcgcgatacctagccgtgcagactctgcagattgatgtctgggatggcgactctctgcttctgatagggtcagccgccgttcagatgaaacacctgctccgccagggacgccccgcagtgcaagcctcccacgagcttgaggtggttgccactgaatacgagcaggataatatggtggtcagtggggatatgctcggctttggacgcgtgaaaccaatcggtgtccactcagtggtcaaaggacgtctgcatttgacactcgccaatgtagggcatccctgcgagcagaaagtacgagggtgctccactctgcccccaagtcggtccagagtcatctccaacgatggagcctcacgcttctctggtggatctctgctgactactgggtcttcaagaagaaaacacgtggtgcaagcgcagaaactcgctgatgttgacagtgaactcgccgcaatgctattgacccacgctcgacagggcaaggggccacaggacgtgtcacgagaatccgatgcaaccaggcggagaaaactggaaaggatgcggtctgtcagactccaggaggccggcggtgacttggggaggcgaggcacttccgtgctcgctcagcagagcgtaaggactcagcatctgcgcgatctgcaggtcatcgctgcttacagagagcgaacgaaagcagaaagcattgccagtctcctgtcgctggctataaccaccgagcacaccctgcatgccacactaggagtggccgaatttttcgaatttgtcctgaaaaacccacataatacccagcacaccgtgacagttgaaatagataaccctgaactgagtgtgattgtggacagtcaggagtggagggattttaagggcgcagccggcctccacacccctgttgaagaggatatgttccatctgcgaggctctctcgcaccccagttgtatcttagacctcacgagacagcacatgtgccgttcaaattccagagcttcagtgctggccagctagcgatggtgcaggcctctcctggactgagtaatgaaaaaggaatggacgcagttagcccatggaagtcatcagccgtgcctacaaagcatgctaaagttctctttcgcgcatccggagggaagcctatagcagtgctgtgtctaacagtagaacttcagccgcacgtggtggatcaggtctttagattctaccaccctgagctttcattcctgaagaaagcaatacgtttaccgccatggcacacatttcctggggcccccgttggaatgctgggcgaagatccaccagtgcacgtccgctgcagtgatcccaacgtcatatgtgagacccaaaacgtgggtccaggcgagccacgagacatcttcttgaaggtggcctctggaccctcccctgaaatcaaagacttcttcgttatcatatattccgatcgctggctcgcaactccaacacagacttggcaggtgtatcttcatagcttacagcgggtggacgtgtcctgcgtggcaggccagctgactagattatccctggtgttacggggtacacaaacagtgcgaaaagtgcgggcattcactagccatcctcaggaactgaagaccgatccaaaaggcgtatttgtattaccacctaggggagtccaggatttgcacgtcggtgtgcgaccccttcgggcgggctcacgatttgttcatctgaatcttgttgacgtagattgtcaccagctggttgcgtcgtggctggtgtgcttatgttgtaggcaaccgctgatctcaaaggcttttgaaataatgctcgccgccggggagggcaaaggtgtgaacaaaaggattacttatacaaacccttacccgtcacgacggacatttcacctccactccgatcatccagagcttctgcgtttcagagaagatagtttccaagtcggcggcggggagacctatacaatcggtttgcaattcgctccttcacagcgcgtgggcgaggaagagattctaatctacatcaacgatcatgaagataagaacgaagaggcattttgtgtcaaggtcatatatcagtag

SEQ ID NO: 125991 - DNA, 546 bp, Artificial Sequence
  Description of Artificial Sequence: Synthetic coding sequence
atggtgctacttcaatcttcaggctttccagagatactggatgccaataagcagcctgcggaagctgtttccgctaccgaaccggtaacatttaatcctcagaaggaggagtccgactgtttgcagtctaatgaaatggtcttgcagttcctggccttctcaagggtcgcccaggattgcaggggcacatcgtggcccaagaccgtttatttcacctttcagttctaccggttccccccggccaccacaccccggctccagctcgtacagctcgatgaggctggccagccgtcgtcaggcgctctgacccacatactcgttccggtgtcacgtgatggcaccttcgatgcaggctcaccgggttttcagctaaggtacatggtcggcccaggctttctgaagcctggggagcgccgctgctttgctcgatacttagctgtgcagaccctgcagatcgacgtgtgggatggcgatagtctgcttctgatcggatcagcagccgttcagatgaaggaaacctcccatattttctccgtttcacaatag

SEQ ID NO: 125992 - DNA, 3606 bp, Artificial Sequence
  Description of Artificial Sequence: Synthetic coding sequence
atggcactgggcacaaccctgcgcgcaagcctgttattactgggtttgttaacggagggcctcgcccagcttgctatccccgcctcggtgccacggggattctgggcactgccagagaacctgaccgtggtggaaggcgcgagcgttgagttgcggtgcggggtgtctacccccggatctgccgttcagtgggccaaggacggtctgctgctcggaccggatccgcgcataccaggattcccccgctaccggctcgaaggcgacccagctcgaggagagtttcatctccacatcgaagcatgtgatttgagcgatgacgctgaatatgagtgtcaggtggggcggagcgagatgggccccgagctggtcagtcctagggtcattctgtccattctggtaccacccaagctactgctgttgacgcccgaggcagggaccatggtgacctgggtggcagggcaggaatatgttgtgaattgcgtgtccggagatgctaagccagcccccgacatcacaattctgctgtccggtcaaaccatttcagacatctcagccaatgtgaatgaaggtagtcagcagaagctgttcactgtcgaagctaccgctcgagtgacccctcggagctcggataatagacagctgctggtttgcgaagcatcaagccctgccttggaggcacctatcaaagcttcgttcaccgttaatgtattgttcccaccggggcccccagtgattgagtggccagggctggatgagggacacgttcgcgccggccagtctctagaattgccttgtgtggcacggggcggcaatccacttgctacactccagtggttgaaaaacggacagccggtgtccaccgcgtggggcacagagcacacccaggccgtggctcgatcagtgctcgtgatgacggttagaccagaggatcatggggcccaactgtcttgtgaagcacacaactcagtgtctgccgggacccaggagcatggaattactttacaggtaacttttcctccctcggctatcattatcctgggctcggcgagccagacagagaacaagaacgtaacactgagctgcgtgtcaaagtccagtagaccaagggtgctgctgaggtggtggctgggttggcgccagctgctgccaatggaggagactgtgatggatgggctccacggcggccatatttcgatgagtaatttaacattccttgcacgacgggaagataatggactgacactaacttgcgaagcgttctcggaggccttcacaaaagaaacatttaagaagagcctcatcctgaacgtgaaatacccggcacaaaaactctggatcgagggaccaccagaagggcaaaaactccgagctggaaccagagtcaggttagtttgtttggcaattgggggcaatcccgaaccctctctgatgtggtacaaagactcacggactgttaccgagtccagacttccgcaggaaagccgaagagttcacctgggtagtgtggagaagtctgggagcacctttagtcgagagctggtgctggttacagggcctagtgacaaccaagctaagtttacctgtaaagctggtcagctgtctgcgtcgacccagctcgccgtgcagttccccccaactaacgtcacaattttggcaaacgccagcgcattgaggccaggcgacgccctgaatctgacgtgtgttagcgtgtctagtaacccgcccgtgaacctctcctgggataaagagggcgagagactggagggggttgcagccccacccaggagggccccctttaagggtagcgctgccgcccggtctgtccttctgcaggtatcctcacgagatcatgggcagagagttacatgccgggcacattctgcagaattgagagagacagtcagctctttttatcgcctcaacgtgctgtaccggccggagtttctgggtgaacaggtcctggtggtgacagcagttgaacagggcgaggctcttctccccgttagtgtctccgccaaccctgcccccgaggcattcaactggacatttcgaggctacagactgagccccgctggcgggccacggcatcgtattctgtcgtcaggagcattgcatctatggaacgttacacgcgctgatgacggcctgtatcagttacattgtcagaactcagagggaacagctgaggcaaggctaagactcgacgtgcattatgcgccaacgattcgcgcacttcaggatcccactgaggtcaacgtaggcgggtctgtggatattgtatgtaccgtggacgcgaaccccattttacccggaatgtttaactgggagcgcctcggcgaggacgaagaggatcaatcattggacgatatggagaagatttcccgggggcccactgggaggttgcgaattcatcatgcgaaactcgcgcaggctggcgcttatcagtgcattgtggataatggtgttgcccctcctgctagacggctcttgcgccttgtggttcgctttgcaccccaggtcgaacatccaacccccctcactaaagtggccgcagcaggcgatagcacaagcagcgccactctccattgtcgcgcccgaggcgtgcctaatatcgtgttcacatggacaaagaatggcgtgcctctcgaccttcaggatccgcgctacactgagcatacttatcatcaaggaggggtgcactcctctttactgactattgcaaacgtctcagccgcccaggactacgccctttttacttgcactgcgacgaatgcactagggagtgatcaaacgaatattcaactggtttcaatctcaagaccggaccccccatctggacttaaggtggtatctcttacgccacactcggtgggactcgagtggaaacccggtttcgatggcggcctgcctcagaggttctgtatccgctacgaggcgctcggtactccagggttccattatgtcgacgtggtgcctcctcaggctacaacctttaccctgaccggcctgcagccaagcactaggtaccgcgtgtggctgctggcgtccaatgcactgggtgacagcggtcttgctgataagggcacacagttaccaattactacccccgggctccaccaaccctctggagaaccagaagaccagcttcctacagagcccccctcaggcattagtgagaaaaccgaggccggaagtgaggaggatcgcgttaggaacgaatacgaggagtcccaatggacaggggagagggacacccagagcagtaccgtctctacaacagaggccgagccttattacaggagtttgagagacttcagtccacagctcccgcccacgcaggaggaggtttcttattcccgagggttcacgggagaggacgaagacatggccttcccaggccatctatacgacgaggttgaacgcacgtaccctccttccggcgcctgggggcctttgtatgacgaagtccagatgggcccctgggacctgcattggccggaagatacttatcaggaccccagggggatttacgatcaagtcgcgggcgacttagatacactagaacctgacagcctgccttttgaattgcggggccatctggtgtag

SEQ ID NO: 125993 - DNA, 3726 bp, Artificial Sequence
  Description of Artificial Sequence: Synthetic coding sequence
atggcactcgggacgactttgagggccagtctgctgctcttgggactacttaccgagggactggcgcagctggcaatacctgcttccgtgcctcggggattctgggccctacccgaaaatctgactgtagtcgagggcgcctctgtggagcttcgttgtggggtgtctacaccaggatccgccgtccagtgggcgaaagatggcttattgctgggtcccgaccccagaatacccgggttcccaaggtatagactcgaaggggatcctgcacgcggtgagtttcaccttcacatagaggcctgtgatttatccgatgatgcagagtacgaatgtcaggtcggccggagtgaaatgggccctgaacttgttagcccaagggtgatcttatcgattctggttcctcccaaactgctgttacttactccggaggccgggacgatggtgacttgggtggctgggcaagagtatgtggtgaactgtgtgagcggagacgctaagcccgcacccgatattaccatcctcctcagcggccagaccatctcagacatcagcgccaatgtgaacgaaggaagccagcagaagttattcactgttgaggcgacagccagagtcacaccacgttccagtgacaataggcagctcctggtgtgcgaagcttctagtccggcccttgaggctcccattaaggccagttttaccgtcaatgtgctttttccgcctggaccgccagttatcgaatggccagggctggacgagggacacgtgagggccggccagtcgctggagctcccttgtgtagcacgtgggggaaatcccctggccacactccaatggcttaagaatggacagccagtgtccactgcgtggggcactgagcacacccaagccgtcgcgcgctccgtactcgtcatgacagtgagaccggaagatcatggggcacagctttcttgcgaagcccacaactccgtgagcgcagggacacaagagcacggcatcacccttcaggtcacttttccaccaagcgccataattatactcggcagcgcctctcagacggagaacaagaatgtaacactgagttgtgtttcaaaatcatctcggccacgggtgttgcttagatggtggctgggatggcggcaattgcttcccatggaggagactgtgatggatggactacacggagggcacataagcatgtcaaacttaacctttctggcccgtagagaggataacggccttacccttacatgtgaggccttctccgaggcgttcaccaaagagacctttaagaagtccctgatcctgaacgtgaaataccccgcgcaaaagctttggatcgaaggaccccctgaggggcagaaattaagagcaggaaccagagttcgtttggtgtgcttggcaattggcggcaacccagagccatcattaatgtggtataaggactctcgcaccgttactgagagcagacttccacaagagtcaagaagggttcatctcggatcagtggaaaagtccggtagtaccttttcacgtgagcttgtcctcgtcaccggccctagcgataatcaggccaaattcacctgtaaagctggtcagctgtccgctagcactcagctggctgtacagttcccccccacaaatgtgaccattcttgccaacgccagcgcgcttcggcctggagacgccctgaaccttacatgtgtgtcggtttcctctaatccccctgtgaacctttcctgggacaaggagggtgagcgcctcgaaggagtcgctgctcccccaaggagagctccatttaaagggtcagcagcagcacgaagcgtcctgttacaggtgtcgagtcgggatcacgggcagagggtgacatgtcgcgctcactctgccgaattgagagagaccgtgtcatcattttaccgactgaatgtcctttatcggcccgagttcttgggagagcaagtacttgtcgtgacggccgttgaacaaggggaggcactgctgccagtcagcgtgtcagcgaacccggccccagaagcttttaactggactttcagaggttatcgactgtcccccgctggagggcctaggcacaggattctgtcatcaggtgccctgcatctctggaacgtgacgagagctgatgacggcttgtaccagttacattgccagaacagtgagggcactgctgaagctaggttacgcctcgatgtgcattatgcccccaccatccgggcactccaagatcccaccgaagtaaatgtggggggctctgtggacatcgtttgcaccgtagacgctaaccccatactgcccgggatgttcaactgggagcgcctcggggaagatgaggaagaccagagtttagacgatatggaaaagatttctagagggcccacaggtaggttgaggattcaccacgcgaaactggctcaggccggcgcctaccagtgtatcgtggataacggtgtggcaccgcccgcacgcagactcctgcgcctggtggtaagattcgctcctcaagttgagcatcctactcccctcaccaaggtcgccgctgcaggggattccacgtcatctgcaactttgcattgtcgagctcgaggtgtccccaatatcgtattcacctggaccaagaatggcgtgccgctggacctgcaggacccacggtacacagagcatacgtatcatcagggcggggtgcactcgtctttacttactattgccaacgtaagtgcggcccaggattacgcgttattcacatgtaccgctaccaacgcgctcggctccgaccagaccaatattcagcttgtgtccatttcccgccccgatcctccatccgggctgaaggtggtgtctctcaccccccatagtgtgggcctggaatggaaacccggctttgacggggggctaccccagagattctgcatccgttacgaagcgctgggaactccagggtttcactatgtggatgtggtcccaccccaggccaccacttttaccctcaccggcctgcagccatctaccaggtatagggtgtggctcctggccagtaatgcgctcggcgactctggcctggcagacaagggtactcagctgccgatcactactcctggacttcaccaaccttctggagaaccagaagatcagcttccgaccgaacctccaagcgggccctccggcctgccactccttcccgttctcttcgcgttaggcggactgctgctcttatctaatgcatcctgtgtggggggtgtgctctggcagagaaggctaagaaggcttgctgaagggatttctgagaaaacggaggcaggaagcgaggaggatagagtgcgaaatgaatacgaagagtcccagtggacaggcgaaagagatactcaatctagtaccgtgtctaccactgaagcagagccttactatagatcccttcgcgatttctcaccacagttacctccaacgcaggaggaggttagctactctcgcggctttacgggtgaggatgaggatatggctttccccgggcatctttacgacgaggtggagagaacttatccgcctagcggcgcttggggaccgttgtacgatgaggtccagatgggtccttgggatctccactggccagaagatacatatcaggatcccagaggaatttatgaccaggtggctggagatctggacactttggaacctgattcgctgcccttcgagctgaggggtcaccttgtctag

SEQ ID NO: 125994 - DNA, 1152 bp, Artificial Sequence
  Description of Artificial Sequence: Synthetic coding sequence
atggagcgccgggcccgctcgtcatcccgggaatctcgcgggaggggaggacgaacaccccacaaagagaataaaagggccaaagctgagagatccggaggtggacgaggcaggcaggaagccgggcccgaaccttcaggttcaggtagagccggcacacccggcgaacctcgcgcaccggctgcaacagtggtggatgtggatgaggtccggggatctggagaggagggaacagaagtcgtggctctgctggagtccgagaggcccgaagaaggaaccaagtcctcaggtctgggggcttgcgagtggctgctcgtgctcattagccttctcttcattatcatgacattccccttctcaatctggttttgtgtaaaggtggttcaagagtatgaaagggtgatcatattcaggctgggtcacctgctccctggacgcgctaaagggcctggcctattttttttcttaccatgtttagatacataccacaaggtagatctgcgcctgcaaacgctggagatcccctttcacgaaatcgtgaccaaggacatgtttattatggaaattgacgcaatttgttactacagaatggaaaatgcaagcctgctgctgagctccttggctcacgtgagtaaagctgtccagttcctagtccagactactatgaagcggctactcgctcacagatccttaacagaaatactgctcgagcgcaaatcaatagctcaggatgccaaagtggccttggacagtgtgacatgcatctgggggattaaggtggagcgcattgagataaaggacgtccgtctgcccgcgggcctccagcactcattggcagtcgaggccgaggctcagaggcaagccaaggtaaggatgattgcagccgaagcagagaaagcagccagcgaatctctgaggatggccgctgaaattctctcaggtactcccgcagccgtgcaacttcgctacctgcatacactgcagagcctatcaacagaaaagccatcaactgtggtcttgcctctccccttcgacttactgaattgcctttcgagcccctccaacaggactcagggcagtctgccattcccctcccccagtaagccggtggagccccttaatccgaagaagaaagatagccccatgctgtag

SEQ ID NO: 125995 - DNA, 948 bp, Artificial Sequence
  Description of Artificial Sequence: Synthetic coding sequence
atggagcgccgggcccggtctagtagcagggagagtcgcgggagaggcggtcgcacacctcataaagagaacaaacgcgcaaaggccgagcggagtgggggaggcagaggacgccaggaggctggccctgaacctagtggcagcgggagggctggcacacccggagagcctcgggcccccgcggccaccgttgttgatgttgacgaagttcgagggtccggcgaagagggtaccgaagttgtagctttgttggagtctgaacgcccagaagaggggacaaaatcaagtggcctaggcgcatgcgagtggctcctcgttctgatcagtctgttgttcattatcatgaccttccccttcagtatctggttttgcgtgaaggtggtgcaagaatacgagcgagtgattatttttagactgggacatctgcttcctggaagggcaaagggtccaggcctcttcttcttcctgccatgcttagacacataccataaagtggatctcaggctgcagaccctggagattccattccatgaggtggcactggattccgtgacttgcatctgggggattaaagtggagagaatcgagatcaaggatgttcgtctccctgccggacttcagcacagcttggcagtggaagccgaggctcagcgccaggccaaagttcgtatgatcgctgctgaggccgagaaggctgccagcgagtccctgcgtatggcagccgagatcctgtccggcactccagctgctgtgcagctgcggtacctccatacattgcaatcgttgtctacagagaagcctagcactgttgtgctccccttacctttcgatctcctaaactgtctcagctcacccagcaaccgaacccaaggtagcctgcctttcccttcccctagtaagcccgtggaaccactgaaccccaaaaaaaaggacagcccaatgctgtag

SEQ ID NO: 125996 - DNA, 1284 bp, Artificial Sequence
  Description of Artificial Sequence: Synthetic coding sequence
atgggagccggggctaccggccgagcgatggacgggccccgactactcctgctcctcttactgggggtgagcttaggaggagccaaggaggcctgccccaccggcctctacacccacagtggagagtgttgcaaagcctgtaacctcggggagggtgtggcacagccctgtggcgccaatcagaccgtttgcgagccttgccttgactccgtcactttcagcgacgtagtgtccgctactgagccatgcaagccgtgtactgaatgtgtgggcctacagtcaatgagcgcaccttgtgttgaggccgatgacgcagtctgtcgctgcgcctatggctattaccaggatgaaacaactggacgatgcgaagcgtgccgcgtgtgcgaggccggatcagggctcgtgttttcatgccaggacaaacaaaatacagtctgcgaggagtgtcctgacgggacgtacagcgatgaggccaatcatgtggacccttgcctgccatgcacagtctgcgaagacacggagcgccaattgagagagtgtaccaggtgggccgacgctgagtgtgaggaaattccggggcgctggatcaccaggtctaccccaccagaaggcagcgattcgacagctccgtctactcaggagcccgaggccccgcccgaacaggatcttattgccagcacagtcgccggggtggtgacaaccgtgatgggcagcagccagcccgtggttaccagaggcaccacagataatctgattccagtgtattgctcgattctggctgcggtggttgtagggttagtggcctatatcgcctttaagcgctggaatagttgtaagcagaacaaacagggtgccaacagccgtcctgtcaatcagacacctcctcctgagggcgaaaagctgcacagcgactcaggcatcagcgtggattctcagtccctacatgaccaacagcctcacacacagaccgcctcaggccaggctctcaaaggagatggtggcctgtattcttctctcccaccagctaagagagaggaggtggagaaactgctgaacggatcagcgggagacacctggcgccatctcgctggtgaattggggtaccagcccgagcatatcgacagtttcacacacgaggcatgcccagtgcgagctctcctggcttcctgggccacgcaggattcagctaccctggatgccctgttggcagccttgaggagaattcagagagccgacttagttgagagcttgtgttccgaatcaactgcgacaagtcccgtatag

SEQ ID NO: 125997 - DNA, 1002 bp, Artificial Sequence
  Description of Artificial Sequence: Synthetic coding sequence
atgtccgcaccctgcgtcgaggcagatgacgctgtttgcaggtgtgcatacggatattaccaggacgagactaccggacgctgcgaggcttgccgagtctgcgaggcagggtcaggcctggtgttctcatgccaagataaacagaacaccgtatgcgaagagtgtcctgatggcacctattctgatgaggccaatcatgtcgacccgtgcttgccgtgcaccgtttgtgaagacaccgaaaggcagttgcgagagtgcacgagatgggccgacgccgaatgcgaagaaatacccggcagatggatcaccaggagcacacctcccgaaggatcagactcaacagctccttcaacccaggaacctgaggccccacctgaacaggacctaatcgcttcaacagtggcgggagtggtgacgactgtgatgggctcctcacagccggtggtcaccaggggaacaaccgacaacctgatcccagtctattgctcaatcttggctgcggtggtcgtaggtctggtagcctatattgctttcaaaagatggaattcgtgtaagcagaacaaacagggggccaactccaggcccgtcaatcagacccctcccccagaaggagagaaattgcactctgacagcggaatctccgtggacagtcaatctctgcacgaccagcaacctcatacccaaacagccagcggccaggccctcaagggtgatgggggcctgtacagttccctgccgcctgccaaacgagaagaagtagagaagttgctgaatggatctgccggtgacacctggagacatcttgccggagagcttggctatcagccagaacatatcgacagtttcactcatgaagcgtgtcccgtccgtgcgctgctggcttcatgggccacacaggatagcgcgaccctggatgccctacttgccgctctgagaagaatccagcgagctgatttggtggagagtctttgttccgaatcaactgccacgagccccgtatag

SEQ ID NO: 125998 - DNA, 336 bp, Artificial Sequence
  Description of Artificial Sequence: Synthetic coding sequence
atggccaacatacaccaggagaacgaggaaatggagcaaccgatgcaaaatggtgaggaggatcgcccgttgggaggaggcgaaggccatcagccggccggaaaccgtaggggacaggcgcgacgcctggcacccaattttaggtgggcgatacctaaccgccagattaacgatggcatggggggggacggggatgacatggaaattttcatggaggagatgagggagatcaggcgtaagttgagggaactccaattgaggaattgtctgcggatccttatgggcgaactgtcaaaccatcacgaccatcacgacgaattctgcctcatgccttag

SEQ ID NO: 125999 - DNA, 306 bp, Artificial Sequence
  Description of Artificial Sequence: Synthetic coding sequence
atggaacagccaatgcagaacggggaggaagaccggccgctagggggaggcgaggggcaccagccagcagggaatcgcaggggacaggcacggcgcctggcacccaattttcgctgggctatcccaaaccgtcaaatcaatgacgggatgggcggagatggcgacgatatggagatcttcatggaggagatgcgtgaaattaggcgcaagcttcgcgagctgcagctacggaactgcttgagaatcctaatgggcgaactgtcgaatcatcacgatcatcacgatgagttctgcctgatgccttag

SEQ ID NO: 126000 - DNA, 306 bp, Artificial Sequence
  Description of Artificial Sequence: Synthetic coding sequence
atggagcaacccatgcagaatggtgaggaggatcggcctctgggcggcggtgaagggcaccagccagcgggtaataggagagggcaggcaaggaggttggcccctaattttaggtgggctatcccaaacagacagatcaatgatggaatgggaggcgatggagatgacatggaaatcttcatggaagaaatgcgcgaaattcggaggaagttgcgagaactccagcttcgtaactgtctgcggatcctcatgggagaattatctaaccaccatgatcaccacgacgagttctgtcttatgccctag

SEQ ID NO: 126001 - DNA, 336 bp, Artificial Sequence
  Description of Artificial Sequence: Synthetic coding sequence
atggccaacattcaccaggaaaatgaggagatggagcagcctatgcagaatggggaagaggacaggccccttgggggtggcgaagggcaccaacccgccggcaatcgaagggggcaggcccgtaggttggcccctaattttagatgggcaatccccaaccgccagataaacgatggaatggggggagacggagatgatatggagatctttatggaggagatgcgagaaatccgaaggaagctccgtgagctgcagctgagaaattgcttgagaatacttatgggtgaactgagcaatcatcatgaccaccacgacgaattctgcctgatgccttag

SEQ ID NO: 126002 - DNA, 336 bp, Artificial Sequence
  Description of Artificial Sequence: Synthetic coding sequence
atggcaaacattcaccaagaaaatgaagaaatggaacaacctatgcagaacggagaggaagatcgtcctctgggcgggggtgaaggccatcagcctgctggcaatcggcgggggcaagcgagaagacttgctccaaacttccgctgggcaatccccaaccgtcagatcaacgacggtatgggtggcgacggggatgacatggaaatcttcatggaagaaatgcgcgaaattcgccggaagttgagagaactgcagctgagaaactgtttacgcatcttgatgggtgaattgtcgaaccatcacgaccatcacgacgaattttgcttaatgccctag

SEQ ID NO: 126003 - DNA, 402 bp, Artificial Sequence
  Description of Artificial Sequence: Synthetic coding sequence
atgatgctcaattcggacacaatggaactcgacttgcctccaactcactcggagaccgaatctggcttctctgactgtggtgggggggccggacctgatggcgccggccctggcgggcccggaggcgggcaggcccggggtcctgaaccgggcgagccagggagaaaggacctgcagcacttgtcccgcgaggagcggagaaggagaagaagggctaccgctaagtaccgcacggcccacgccactagggaacggattcgtgttgaggctttcaatttagccttcgccgagcttaggaagctactgcctacattgcctcctgataagaaactgagcaagatcgagattctgcgactggctatctgctatatttcataccttaatcatgtgcttgatgtttag

SEQ ID NO: 126004 - DNA, 408 bp, Artificial Sequence
  Description of Artificial Sequence: Synthetic coding sequence
atgatgctgtcccccgatcaggccgcggacagcgatcatccaagtagcgcgcactccgacccagagagcctcggaggcaccgacactaaagtgttggggtccgtgtccgacctggagccagtcgaagaagcagagggcgacggtaaaggcgggagccgtgcagccctctacccacatccacaacagcttagtcgcgaggagaaacggaggcgtagaagagctaccgctaaatatagaagcgcccatgcgacacgcgagaggatcagagtggaggcattcaatctcgccttcgcggaactgaggaagctgcttcctaccttaccgccggataagaagctctcgaaaatagagatcctgagactggccatttgttacattagttacctcaaccatgtcctggacgtttag

SEQ ID NO: 126005 - DNA, 408 bp, Artificial Sequence
  Description of Artificial Sequence: Synthetic coding sequence
atgatgttatctcctgaccaggctgctgactcagatcaccccagttctgcacactcggatcccgagagcctggggggtacagataccaaagtcctgggttcagtgtccgatctggagcccgtcgaggaggctgagggagacggtaaaggaggctcgagagctgctttatacccacaccctcagcagctcagtcgcgaagagaagcggcgtaggcgcagagctacggccaagtaccgttcagcccacgccacccgggagcgaattcgggttgaggctttcaatcttgcatttgccgagttacgcaagctgctccccacactaccaccggataaaaagttgtccaagatcgaaatcttgagattggccatatgttacatttcttacctcaaccacgtactggacgtatag

SEQ ID NO: 126006 - DNA, 324 bp, Artificial Sequence
  Description of Artificial Sequence: Synthetic coding sequence
atgatgttgtccccggatcaggccgcagattcagatcacccgtcctcggctcacagtgaccctgaatccctgggggggacagatactaaggtcctagggagcgtcagcgatctggagcctgtggaagaagcagagggggacggcaaaggcggatcccgagccgccctctatccacatccccagcagctttcgagagaggaaaaacggcggagacgccgggccacagcgaagtatagaagtgcccatgctacgcgcgaaagaatccgggtcgaagcgtttaatcttgcatttgcagaactgcggaagttactacctacgctgtag

SEQ ID NO: 126007 - DNA, 1125 bp, Artificial Sequence
  Description of Artificial Sequence: Synthetic coding sequence
atgggcctgccccggggctccttcttctggttgctcttactgctgaccgccgcttgttcgggactgctgtttgcgctgtattttagcgccgtccagagataccccggacccgctgcaggggcaagagacactacatctttcgaggccttcttccagtctaaggcctctaacagctggaccggaaagggccaagcttgccgccatcttttgcacttagcaattcagcgacaccctcactttcgtggcctattcaatctgagtattcccgtacttctgtggggagatctgtttacacctgcactctgggatcggttaagtcaacataaggctccctacggatggcgtgggctatcccatcaggtgatcgcctccacattgtcactgctgaatggctctgaatcagcaaaactgttcgcccccccccgcgacaccccacccaaatgcattagatgtgccgtggtcggcaatggcggtatcctgaacggcagtcgccagggaccgaacattgacgcgcacgactatgtgttcaggctgaatggagcagtaatcaaaggatttgaacgggatgtaggaacgaaaacctccttttatggctttaccgtgaacactatgaagaattccttagtcagttattggaatctagggtttacttcggttccccagggtcaggacctccaatacattttcatcccatctgacattcgtgactatgtaatgctgagatctgcaatcctgggcgtgccagtgccagagggtctggataagggggataggccccatgcctattttggaccagaggcctccgcctccaaatttaaacttctccaccccgattttatctcctatttaactgaaaggttcttaaaatctaagctcataaacacacatttcggtgatctgtatatgccttccaccggcgctcttatgctgctgaccgccctgcacacttgcgaccaagtcagcgcttacgggtttattacgtcaaattactggaaattctcagaccattatttcgaaagaaaaatgaagccccttattttctacgcgaatcatgatctctccctcgaggctgccctttggagagatctccataaggcagggatcctgcagctctatcagcgctag

SEQ ID NO: 126008 - DNA, 2235 bp, Artificial Sequence
  Description of Artificial Sequence: Synthetic coding sequence
atggccgggagatcaatgcaagccgcccggtgtccaaccgacgaactcagtcttaccaactgcgccgtcgtcaacgagaaagactttcaatcaggtcagcatgtgatcgtcaggacttcccctaatcatcgatatacctttactctgaaaacccaccccagcgtggttccaggctcaatcgctttcagtctgcctcagcgaaaatgggccggactttccatcggacaggagatagaagtaagtctgtacacattcgacaaggctaaacagtgcatcggcactatgaccatcgagatcgattttctacagaaaaagagcatcgattctaacccctacgatacggacaaaatggccgcagagttcatacagcaatttaacaaccaggctttctccgtaggacagcagcttgtatttagcttcaacgagaagctcttcgggctcctcgttaaagacatagaagccatggacccgtccattctgaaaggtgaaccagctaccggcaagcgccagaagatagaggtcgggttagtggtcggaaattcacaagttgcctttgaaaaagcggaaaacagttcattgaaccttatcggcaaggctaaaacgaaggaaaatagacaatctataatcaatcccgactggaatttcgaaaagatgggaatcgggggtttggataaggaattctcagacatcttccgcagagcattcgcatcacgggtgtttcctcccgaaattgtggagcagatgggttgcaagcatgtgaaaggaattctgctgtacggcccacccggctgcggcaagaccctcctggctcgccaaatcggcaagatgctaaatgctagggaacccaaggtggtcaacggacctgagattctgaataagtacgtgggagagagcgaagctaacatcagaaagctgtttgccgacgcagaagaagagcaaagacggctcggtgcaaactctggcttgcacattattatctttgatgagattgacgcaatatgcaaacagagggggtccatggctggcagtactggtgtacacgacaccgttgtgaaccagcttctctccaagatagacggcgtcgagcaactaaacaatattctcgtcatcggcatgacgaatcgacctgacctcattgatgaagccctgctgcgtccagggaggctagaggtgaagatggaaatcggcctccctgacgagaaagggcggctgcaaattctgcacattcacaccgcgcggatgaggggacaccaattgctgtctgccgacgtcgatattaaggagctcgcagtcgagacgaagaattttagtggcgctgaattggaggggctggtccgcgctgcccaaagtaccgcaatgaatcgccacataaaagcctctaccaaagtggaggtcgacatggaaaaggcagaatctctccaagtcactagaggtgacttcctggcatccctcgagaatgatattaaacccgcttttggcactaatcaggaagactatgcctcttatatcatgaacggcatcatcaagtggggggatccggtcacccgcgtgctggatgacggtgagctgctagtccagcagacaaagaatagtgaccgtacgccgctcgtttcagtgctgctggaaggacctccccactctggcaagaccgctttggctgcgaagattgccgaggagtccaattttccttttatcaaaatttgcagccccgacaagatgatcggtttttccgagaccgccaagtgtcaagccatgaagaaaatcttcgacgatgcctacaagagccagttgagttgtgtggtggtggatgacatcgaaagactgttggattatgtccctataggtccgaggttcagcaatctggtgttgcaagccctgctcgtgctgctcaagaaggctccgcctcagggacgcaagctcctgattatagggaccaccagcagaaaagacgtccttcaggagatggagatgctgaatgctttctcaacaaccattcacgttcccaacatcgccacgggcgagcagctcctcgaagcactcgaactcttgggcaattttaaggacaaagagagaactaccattgcccaacaggttaaaggcaaaaaagtctggatcggcatcaagaaactgctgatgctcatcgaaatgtctttacagatggaccccgagtatcgggtgaggaaattcctagccctgctgcgagaagagggtgcctccccattagacttcgattag

SEQ ID NO: 126009 - DNA, 888 bp, Artificial Sequence
  Description of Artificial Sequence: Synthetic coding sequence
atggacaattcaggaaaggaagctgaggccatggcactgttggccgaggctgagagaaaggtgaaaaattctcagagctttttcagtgggctgttcggagggagcagcaaaatagaggaagcttgcgagatatatgcccgggccgcgaacatgtttaaaatggccaagaattggagcgctgcaggtaacgcattctgccaggcagctcagttgcacctacaattacaatcaaaacacgacgctgccacctgtttcgtcgatgccggcaacgctttcaagaaagctgatccgcaggaggccatcaactgtctgatgcgggcaatcgagatctacactgacatgggacggttcaccatcgccgcaaaacaccacatatccattgccgaaatatacgaaacagagctggttgacattgagaaagccatcgcgcactacgaacagagtgcagattattacaagggcgaagagagcaattcatccgccaataagtgtctcctcaaggtcgccggctacgctgccctgctagagcagtaccagaaagcaattgatatctacgaacaggtgggtacgaacgcgatggactctccgctgttaaaatatagtgctaaggactatttctttaaggctgccctctgccacttctgtatcgatatgctcaacgctaagttggctgtccagaaatacgaagagctctttcctgcgttttctgatagtagggagtgtaaactgatgaaaaaacttctggaggcccacgaggagcagaatgtggacagttacacagagtcagtgaaggaatacgactccatatcccgcctagatcaatggttaaccacaatgctccttcgcatcaagaagaccatccagggagatgaggaagatctgagatag

SEQ ID NO: 126010 - DNA, 897 bp, Artificial Sequence
  Description of Artificial Sequence: Synthetic coding sequence
atggacaacgctggcaaggaaagagaagccgtgcagctcatggctgaagctgaaaaacgtgtgaaagcctcacattcctttctccgaggactgtttggtggcaataccaggattgaagaggcatgtgaaatgtatacccgagccgctaacatgtttaagatggctaagaactggtccgctgcaggcaacgcattttgccaagctgccaagttacacatgcagctccagtctaaacacgacagtgctacctctttcgttgacgccggaaacgcatataagaaggctgaccctcaggaggccatcaactgccttaatgccgccatcgatatttatactgacatgggtcgcttcacaatagccgctaaacaccacattaccatcgctgagatctacgaaacggagctagtcgatatcgagaaggcgatcgcgcattacgagcaaagcgctgactactataagggcgaagagtctaactcttccgctaataagtgcctcctgaaggtcgccgcctacgccgctcagctggagcaataccagaaggccatcgaaatatacgagcaagttggtgcaaataccatggataatccacttctgaagtactccgcaaaggattatttctttaaagccgctctttgtcacttcattgtggacgagttaaacgcaaagcttgcactggaaaagtacgaggaaatgttccccgcctttacagactctcgagagtgtaaactcttgaaaaaattgctagaagctcatgaagagcagaattctgaggcgtacacagaagccgtgaaggagttcgatagtattagtcgcctagaccaatggctcactacaatgcttctgcgtattaagaagtcaatacagggcgacggtgagggcgatggtgatctaaagtag

SEQ ID NO: 126011 - DNA, 615 bp, Artificial Sequence
  Description of Artificial Sequence: Synthetic coding sequence
atgacgctcctccccgccctctggatgctggaaatgctaaccaagagacaaataccaaagggtcgcttcaccattgctgccaagcaccatatcaccattgcagagatctacgagactgagctggtggacattgagaaagcgatcgcccactacgagcagtctgctgactactacaagggagaggagagcaacagctccgccaataaatgtcttctgaaggtggctgcctatgccgctcagcttgaacagtatcaaaaagcaatagagatctacgaacaggttggggccaacacgatggataatcccctgttgaaatattcagccaaagactacttctttaaggctgccttatgccacttcatagtggatgagttgaacgctaaactcgcgctggagaagtacgaggagatgttccctgctttcacagactcaagggagtgtaagctgctgaaaaaactacttgaggcccatgaagagcagaacagcgaggcatacaccgaagctgttaaggaattcgattcgataagtcggttagaccagtggctgactaccatgctactgcggattaaaaagagtatccagggtgacggggagggggacggcgacctgaaatag

SEQ ID NO: 126012 - DNA, 768 bp, Artificial Sequence
  Description of Artificial Sequence: Synthetic coding sequence
atgtacactcgggctgcgaatatgttcaaaatggcaaagaattggagcgcagctggcaacgccttttgccaggctgcaaagcttcatatgcaactgcagtctaagcacgacagtgctacctccttcgtcgatgcgggtaacgcgtacaaaaaggccgatcctcaagaggcgatcaactgtctgaacgccgctattgacatttacaccgacatgggcaggttcaccattgctgctaaacaccatattactattgcggagatatatgaaacggaactagtggatatagagaaagccattgcacactacgagcagagcgctgactactacaaaggagaggagtctaacagcagtgcgaacaagtgcctccttaaagtcgccgcatacgccgctcagctggagcagtatcagaaggctattgaaatctacgagcaggttggagcaaacactatggacaacccactgctgaaatattcagccaaggactatttttttaaagcagccctgtgtcacttcattgtcgacgagctgaatgccaaactcgcccttgagaagtatgaagagatgttccctgctttcaccgattcaagagaatgcaaattgcttaagaagctgctggaagctcacgaagagcagaactctgaggcctataccgaagccgtcaaggaattcgatagtatctcacgattagatcagtggctgactacgatgctcctgcgtattaagaagtcaatccagggggacggggagggcgatggggatttgaagtag

SEQ ID NO: 126013 - DNA, 780 bp, Artificial Sequence
  Description of Artificial Sequence: Synthetic coding sequence
atggataacgccggaaaggaacgcgaagccgtacagctgatggctgaagccgaaaaacgagtcaaggcatctcacagcttcttacgcggtttgttcgggggcaacacacgcattgaggaggcctgtgagatgtacaccagagctgctaacatgtttaaaatggctaagaactggagtgaggccataaactgtctgaacgcagccatagacatctacacagacatgggcaggttcaccattgccgcgaaacatcatataaccatagcagaaatttacgagacggaattagttgacattgagaaggcaattgcccattacgagcagagtgctgactactacaaaggagaagagtctaattcctcagctaacaagtgtctgctgaaggtggcggcctacgccgcacagctcgagcaatatcagaaggcaattgagatctacgagcaggtgggcgctaacaccatggacaaccccttgctgaaatatagcgccaaggactattttttcaaggcagctctgtgccactttatcgtggatgaactgaacgcaaagctcgcactcgaaaagtatgaggagatgtttccagctttcaccgacagtagagagtgtaagctgctgaaaaaactgctcgaagcccacgaggaacagaactctgaagcatataccgaagccgtgaaggagttcgactctatcagcagattggaccagtggctcactactatgcttctgaggatcaaaaagagcatccaaggggatggcgaaggcgatggggacctgaagtag

SEQ ID NO: 126014 - DNA, 1887 bp, Artificial Sequence
  Description of Artificial Sequence: Synthetic coding sequence
atggggtcctgcgcgcgtctcctgttgctctggggttgtactgtcgttgccgccgggctctccggcgtggccggagtttcaagcaggtgtgaaaaagcttgcaatcctcggatggggaacttagcgcttggcaggaagctttgggctgatacgacgtgtgggcagaacgccactgagctttattgtttttatagcgaaaacaccgatttgacctgcaggcagcctaaatgtgataagtgtaatgcggcatacccacaccttgcccacctgccttcagccatggctgattcttcctttcgatttccaagaacctggtggcaaagcgcagaggatgttcacagagaaaagatccagctggacctagaggccgaattttactttactcatctgatagtcatgtttaaatctccacggcccgctgctatggttttagaccggagtcaggacttcgggaagacatggaagccatacaaatacttcgcaacaaattgctctgcaacgtttggattagaggacgacgttgtgaagaaaggtgcgatctgcacttctaagtactcttcgccattcccttgcaccggaggggaggtcatcttcaaggccctgagcccaccgtacgatacagagaatccctactccgcaaaggttcaggaacagctgaaaattacaaacttgagggtgcagctactgaagcgacagagctgcccgtgccagagaaacgacctgaatgaggaaccacagcacttcactcactacgccatctacgatttcattgtgaaagggagctgcttctgtaacggccatgccgaccagtgtattccagtgcacggattcagacccgtgaaggctcctggaacgtttcatatggtacacggaaagtgtatgtgcaaacataataccgctggaagccactgtcagcattgcgctcccctttacaacgaccgcccatgggaggcagcagacggcaaaacaggggcaccgaacgagtgtcgcacatgcaagtgtaacggccacgcggacacgtgccacttcgacgtgaatgtctgggaggcgtctggtaacaggagcggaggagtgtgcgatgattgtcagcataacacagagggacagtattgtcagcggtgcaagcccggcttttatcgcgacctacggaggcccttcagtgcccctgatgcttgcaagccttgctcttgccaccccgtcggatctgccgtccttccagcaaactcagtgacattctgtgacccttcgaatggagattgtccgtgcaaacccggagtcgcggggcggcgatgcgaccgctgcatggtaggttattggggcttcggagactatggttgccggccctgcgactgcgcaggcagctgcgaccctattaccggcgactgcatctcctcccataccgacatcgactggtatcatgaagtgccagactttaggcctgtgcacaataaaagcgaacccgcatgggagtgggaagatgctcagggcttttctgcattacttcatagcggcaagtgcgagtgcaaggagcagaccctgggtaatgcaaaagctttctgtggtatgaaatatagctacgtcctcaagattaaaatactgtcggcccacgacaagggcacccacgtggaggtgaacgtaaagattaaaaaagttctgaagagtacgaagttgaaaatcttccgggggaagcgaactctgtatcctgagtcctggactgaccggggttgcacttgtcccatactgaaccctgggctggaatacctggtggccggtcacgaagacatccgcacagggaaattaattgtgaatatgaaatctttcgtccagcattggaagcctagcctaggtagaaaagtgatggatattctcaaacgagagtgcaaatag

SEQ ID NO: 126015 - DNA, 1776 bp, Artificial Sequence
  Description of Artificial Sequence: Synthetic coding sequence
atgggtaacctggccttgggccgaaagctgtgggccgatacaacgtgtggacagaatgcaacagagctttattgtttctattctgagaataccgatctgacttgcagacaaccgaagtgcgacaaatgtaacgcggcctaccctcaccttgctcacctgcctagcgcgatggcagatagctcttttcgctttcccaggacttggtggcagtccgccgaagatgtacatcgggagaaaattcaattagatcttgaggcagagttctattttacccacctgatcgtgatgttcaagtctccgcgcccagcggctatggttctggacaggagtcaggattttggtaagacctggaaaccatacaaatactttgccaccaactgttctgcaacttttggattagaggacgacgtcgtaaagaagggtgcaatatgtacctccaagtacagttccccatttccctgcaccgggggtgaagtgatctttaaggccttgtcacctccttatgatacagagaacccatactctgcaaaagtgcaggagcagttaaagattactaatctgagagttcagctcctaaagaggcagtcatgcccttgtcagcggaacgatcttaatgaggaacctcagcattttactcattacgcaatctacgattttattgtcaaagggagttgtttctgcaacggacacgcagatcagtgcattcctgtgcatgggttccgccctgtgaaggcccctggcacctttcatatggtgcacggcaaatgtatgtgcaagcataacacagctggttcccattgtcagcactgcgctccgttatacaatgatcgaccatgggaggcagcggacggtaagaccggcgctccgaacgagtgccgcacctgcaaatgcaatgggcacgccgacacatgtcatttcgatgtcaacgtctgggaggcgagcggcaaccgttcgggaggggtttgtgacgactgccagcacaatacagaggggcagtattgccagcgctgtaagccaggcttctatagggatctccggcgccctttctctgctccagacgcatgcaagccatgtagttgccacccagtgggtagcgcggtgctgcctgcaaactctgtcactttctgtgacccttcaaatggcgattgcccatgcaagcctggggtcgcaggaagacggtgcgacagatgtatggtcggatattggggcttcggagattacgggtgtcggccttgtgattgtgcagggtcttgcgatcccatcacgggggattgtatctcttcccatacagatattgactggtatcatgaggtacccgattttagacctgtgcacaacaaatccgagccggcgtgggaatgggaagatgcacaaggcttttctgcactgctgcactccgggaagtgtgagtgcaaagaacagactctcggtaatgcaaaagcattctgtggaatgaagtactcttatgtgctcaagataaaaatccttagcgcccacgacaagggaacccatgtcgaagtgaatgtcaaaataaaaaaggtgcttaagtcgaccaagctcaagatttttcggggaaagaggactctgtaccccgagtcttggaccgataggggatgtacctgcccaatcctgaatcctggccttgagtatctcgtggcaggtcatgaagacatccggaccggcaagttgatcgtgaatatgaagtcctttgtacaacactggaaaccaagcttgggccgtaaggtgatggatatcttgaagcgcgagtgcaagtag

SEQ ID NO: 126016 - DNA, 1818 bp, Artificial Sequence
  Description of Artificial Sequence: Synthetic coding sequence
atgggatcctgcgctaggctgctgctgctgtggggctgcacagttgtcgcagctggcctgagcggagtggccggggtgagctccaggtgtgaaaaggcctgcaaccctagaatgggcaacctcgctctcggcaggaagctgtgggccgacacaacttgcgggcagaatgctacagagctctactgcttctattcagaaaacacagatcttacatgcaggcagccgaaatgcgataaatgcaacgcggcctacccccacttggcacacttaccatctgctatggctgattcatcgtttagattcccacggacatggtggcagtccgcggaagatgtgcatagagagaaaatccagctggatcttgaggccgaattttactttacccatctgatcgtcatgttcaaaagtcccagacctgcagctatggtgctggatagaagccaggacttcggtaagacttggaagccctataagtacttcgcaacaaactgttccgctacctttggattggaagacgacgttgtcaagaaaggagcgatctgcacatctaaatacagttccccttttccgtgtactggaggcgaggtgatctttaaagcgctgtctcctccgtatgataccgaaaatccatacagcgctaaggtgcaggagcagctgaagatcactaatctgcgggtccaactcctgaaacggcagtcatgcccctgtcagcggaacgatctgaatgaagaacctcaacactttactcactacgctatttatgacttcatcgtgaagggatcttgcttctgcaatggtcatgctgatcaatgtatccccgtccacgggtttcgtcccgtgaaagcccccgggaccttccacatggtgcatggcaaatgcatgtgcaagcacaatacggctggatctcactgtcagcattgtgcaccactgtacaatgatagaccctgggaggccgctgatggtaaaacaggggcccctaacgagtgccgcacatgcaaatgcaatgggcacgcggatacttgtcacttcgatgtcaatgtctgggaagcatccggcaatcgatcgggcggcgtttgtgatgattgtcagcacaataccgagggccagtactgccagagatgtaaacctgggttctatcgggacctccggcgcccgttctcggcccccgatgcttgtaagccctgttcgtgccaccccgtcgggagtgctgtactccctgcaaacagtgtgacattctgcgatccgagcaacggcgactgcccctgcaagcccggggtagcaggccggcgctgtgatcgctgtatggttggttattgggggttcggggactatggatgccggccctgtgattgtgcagggtcctgtgatcctataacaggtgactgcattagctctcatacagacatcgactggtatcatgaggtacccgattttcgtcctgtccataacaaaagcgaacccgcgtgggaatgggaggatgcccagggcttttccgctctgctgcattccgttttaaagatcaagatcctgtcagcacacgataaggggacgcacgtggaggtgaacgtgaagatcaaaaaagttcttaaatccactaagctgaaaatcttccgcgggaaaagaactctgtaccccgaatcatggacagatcggggctgcacatgtccaattctgaacccaggactggaatatctggtcgccgggcacgaggacattcgcaccggcaagcttattgtgaacatgaagtcatttgtgcaacattggaaaccctccctcggaagaaaagtgatggacatcctgaagcgcgagtgcaaatag

SEQ ID NO: 126017 - DNA, 1095 bp, Artificial Sequence
  Description of Artificial Sequence: Synthetic coding sequence
atgtatttgtcccgatttttaagcattcacgctctttgggttaccgtgagttcagttatgcagccttaccccttggtgtggggtcactacgatttatgtaaaacccagatttataccgaggagggcaaggtgtgggactacatggcgtgccaaccagagagcacggacatgactaaatatctgaaggtgaaattagatccccccgatataacatgtggtgacccaccggagactttttgcgccatgggaaacccctatatgtgcaataatgaatgcgacgcttcaacgcccgagttagctcatccccccgaactcatgtttgactttgaaggcagacatccaagcactttttggcagagtgcgacatggaaagaataccccaaacccctgcaagtgaacataacgctgtcctggagcaagaccatcgagttgacagacaatattgtgatcacatttgagtccggacgtccagaccaaatgattctcgagaaatctttggattacggcaggacatggcagccttaccagtattatgccacggactgtctggatgccttccacatggaccccaagtcagtgaaagatctaagccaacacacagtcctggagattatttgtaccgaggagtacagcaccgggtataccaccaacagtaaaatcatacacttcgaaatcaaggaccgctttgcttttttcgctggccctagactgcgtaacatggcctctctatacggtcaactagataccaccaaaaagctacgggatttcttcacagtgacggacttacggatcaggttactccgccctgcagtgggggaaattttcgtcgacgagttgcatctggccagatacttctacgctatctccgatataaaggtccgtggacgctgtaagtgcaatctgcacgcaaccgtatgtgtgtatgacaacagtaagctgacttgcgaatgtgagcacaatacgacaggtcccgactgcgggaaatgcaaaaaaaattaccagggacggccctggagcccaggatcatatctcccgatacccaagggaactgctaatacctgcataccatcgatctcctcaattggctctaaatag

SEQ ID NO: 126018 - DNA, 1518 bp, Artificial Sequence
  Description of Artificial Sequence: Synthetic coding sequence
atgtatctttcgcgattcctctccatccacgcactctgggtgacggtaagtagcgtgatgcagccctacccccttgtttggggtcactacgatttgtgtaagactcagatctataccgaggagggcaaggtgtgggactatatggcctgccagcctgagtccacggacatgacgaagtatttgaaagttaagttggacccacccgacattacatgcggtgaccctccagagacattttgtgcaatgggaaacccttatatgtgtaataacgaatgtgacgctagcactcctgagctggcccaccctcctgagctgatgtttgatttcgaaggaaggcatccatcaactttttggcagtccgcgacatggaaggaatatccaaaaccattgcaggtcaacatcactttgagctggtcgaagacaattgaacttaccgacaatattgtgatcacatttgaaagtggtcggcccgaccaaatgattcttgagaaatccctcgactacggacgaacctggcagccttaccagtactacgccaccgactgtctggacgctttccacatggatccaaagtccgtgaaggacctgtcccagcacaccgtgcttgagatcatatgcacagaagagtatagcacaggatatacaacaaattcaaaaataattcatttcgagattaaggaccgcttcgctttctttgctggccctagactgcgaaatatggcatcgctttatggacagctggatactaccaaaaagctgagagatttctttacagtgactgacttacgcattagactgctacgtccagcggtgggggagatttttgttgacgaattgcacctggcccgctacttctacgccattagtgatattaaggtgagaggtcgctgcaagtgcaacctccacgctaccgtgtgcgtgtacgacaattcaaagctcacttgtgaatgtgaacacaataccactggccctgactgcggcaagtgcaagaaaaattaccaaggtcggccctggagtcccgggtcctacctcccgataccgaaggggacagctaacacatgcatcccttctattagctctatcgggaaccctcccaagttcaatagaatttggcctaacattagcagcctggaggtttctaatcctaaacaggagtgttactgcaaccctttaggctccatccacgatcgctgtaatggctctggtttttgtgagtgcaagaccggtactacaggccctaagtgcgatgagtgcctgcccgggaattcgtggcactatggctgccagcccaatgtctgcgacaatgaactgctgcactgccaaaacggaggcacatgccacaacaatgttcggtgtctgtgtcctgccgcctacaccggtatactgtgcgagaagctacggtgtgaggaggccggcagctgcgggtcagactcaggtcagggagcccccccgcacggaagcccagcgttgctattactcactaccctgcttgggaccgcttccccgctcgtgttttag

SEQ ID NO: 126019 - DNA, 861 bp, Artificial Sequence
  Description of Artificial Sequence: Synthetic coding sequence
atggcctccttgtacggacagcttgacactactaagaaattgagggacttttttacggtgaccgatctgcgaatacgactcctgcggcctgcagtcggcgaaatcttcgtggacgagctgcacctggctcgctatttctacgctatcagcgatatcaaggtcagggggaggtgcaaatgtaacttgcatgccaccgtgtgcgtgtatgacaactcaaagcttacttgcgagtgtgaacataatactacagggcccgactgtgggaaatgtaagaagaattaccagggccgcccttggtctcctgggagctacctccccatccctaaaggtacggccaatacttgcattccaagcattagcagcataggtaaccctcccaagtttaaccggatatggccaaacataagcagcctggaagtttcaaatccaaaacaggtggctcccaagctggccctctccactgtcagttctgtgcaagtagcaaatcacaagcgggaatgttattgtaacccgctgggcagtatccatgaccggtgcaacgggagcggattctgcgagtgtaagaccggtacgaccggccccaaatgcgacgaatgtctacccggcaacagttggcattatgggtgccagcctaatgtgtgtgacaacgagttgctgcactgccagaatggcgggacctgccacaacaatgtcaggtgtttatgtcctgcagcttatacaggaatcctctgcgagaaactcagatgcgaggaagccggcagttgtgggtccgacagcggacagggggctcccccacacggcagcccagcattgctgttactgacaactctgcttggaaccgcttccccactagtgttttag

SEQ ID NO: 126020 - DNA, 1029 bp, Artificial Sequence
  Description of Artificial Sequence: Synthetic coding sequence
atggcgtctctctatggccagttagatacgacgaaaaaacttcgggacttctttaccgtgaccgacctccgcattcgcttgctccgcccagcagtcggggaaatttttgtcgatgagttacatctggcacggtatttctatgccatctccgacattaaggtgaggggacgctgtaaatgtaacttgcacgccaccgtttgcgtgtatgacaacagtaaactgacttgtgaatgtgaacacaacactacgggccccgattgcggtaaatgcaagaagaactaccagggtcgaccctggtcccccggctcttatttgcctatcccaaagggcacggcaaatacctgcatccccagcatctccagcatcgggaatccacctaaatttaacagaatctggcccaatatctcctcactggaagtcagcaatcctaaacaggtagcccctaagctggcacttagcaccgtctcttcggtgcaggttgcgaatcataaacgggactgtgaatgttttggacattctaaccgatgctcctacattgacttactcaatactgtcatatgcgtttcctgcaaacacaacaccagagggcagcactgcgaactgtgtcggttagggtacttcagaaacgcaagcgcccagctggatgacgaaaacgtgtgcatcgagtgttactgtaatcctttaggcagcatccacgaccgctgcaacggatccggattctgtgaatgcaaaaccggcaccactggtccgaaatgcgatgagtgtctgcctggcaatagttggcactatggctgtcagcctaatgtgtgcgacaatgaactgctgcactgtcaaaacggcggtacttgccacaacaatgttcggtgcctctgtcctgccgcttacactgggatcctgtgtgagaagctgcgttgtgaggaagccggctcgtgtggaagtgacagtggacagggggctccgccccacggcagtccagctctcctgttgcttaccacgctgttaggcacagcctcccccctggtcttttag

SEQ ID NO: 126021 - DNA, 1485 bp, Artificial Sequence
  Description of Artificial Sequence: Synthetic coding sequence
atgtacctgagccgatttctctctatccatgccttatgggtcacggtaagcagcgtgatgcagccataccccctggtttggggtcactatgatctctgtaagactcagatctatactgaggaagggaaggtatgggattacatggcttgccaaccagagagcactgacatgactaaatacttgaaggtgaaactagacccgccggacattacatgcggagatccacctgagactttctgtgctatgggcaatccatatatgtgcaataacgaatgcgatgcgtccacgccggaactggcccatcctccggaacttatgttcgactttgagggccgacacccttccacgttctggcagtctgccacttggaaggagtatccaaaacccctgcaggtcaacatcaccttgtcgtggtctaaaactattgagctgactgacaatattgtgattacattcgagtctgggagacccgaccagatgatcttagagaaatctctggactacgggcgcacctggcagccctatcaatattacgcaaccgattgtctggacgcttttcatatggaccctaagtccgtgaaggatttgtcacagcataccgtgctggaaataatttgcacagaggaatattccaccggctatacgaccaactcaaagattatccacttcgagattaaggacaggttcgccttcttcgccggcccacgactccgcaatatggccagtctctatggacaactggataccacgaagaagctgcgtgatttcttcacggttaccgatctaaggatcagattgctacgaccagcggtcggcgagatatttgttgatgaattacacctggctagatacttctacgccataagcgatatcaaggtgcgagggcgttgtaaatgcaaccttcacgccactgtgtgcgtgtacgacaacagtaagttgacctgtgagtgtgagcacaacaccacgggcccagactgcgggaagtgcaaaaagaactatcagggccgtccctggagcccaggcagttacctgcccatccctaaagggacagctaatacatgcatcccatccatctcaagcattgggaactgtgagtgttttgggcattcaaataggtgctcttatatcgacctacttaatacagtcatctgtgtcagctgcaaacataacacacgcggccaacattgtgaactgtgccggttaggatactttaggaatgccagcgcccagctggatgatgaaaacgtgtgcatagccaacgtgtgtgacaacgagctgttacattgtcagaacggcggcacctgccacaacaatgtgcggtgtctgtgccccgcggcttacaccgggatcctctgcgaaaagctgagatgtgaggaggccgggagctgcgggtccgattcaggccagggcgccccccctcatgggagtcctgccctcttgctgctgacaactttgttaggcaccgccagcccattggtgttctag

SEQ ID NO: 126022 - DNA, 1443 bp, Artificial Sequence
  Description of Artificial Sequence: Synthetic coding sequence
atgtacctctcgcgcttcctcagcatccatgcactttgggttaccgtgtcttcagtcatgcagccatacccactggtgtggggacactacgatctgtgcaagacacagatctataccgaagagggaaaagtctgggattacatggcctgccagcccgagagtacggacatgactaagtatctcaaggtgaagctggacccacccgatattacatgcggtgatccccctgagacattctgcgctatggggaacccatacatgtgcaataacgaatgtgatgctagcacgccagagctagcccatcccccagagctgatgtttgactttgaggggcggcacccatctacgttctggcagagcgctacttggaaagaataccccaaacctctccaggtgaatataactctctcttggtcaaagactatcgagctaacggacaacattgtcatcaccttcgagagcgggagacctgaccagatgatcttagaaaagtccctggactacggacgaacatggcagccttaccaatactatgcgactgactgtctggatgctttccacatggatccaaagtccgtgaaagacctgagccagcacacagtacttgagatcatctgtactgaagagtatagtaccgggtacactaccaatagcaagatcatccatttcgagatcaaggataggttcgccttcttcgctggaccaaggttacgcaacatggcttctctctatggtcagcttgatactactaagaagctcagggacttttttactgtgaccgacctcagaataaggctccttagacctgcagtcggtgagatatttgttgatgaacttcatctcgcccgctatttctatgccatctcagacattaaggtacgcggcagatgcaagtgcaacctgcacgccacagtgtgcgtctacgacaactctaagcttacttgtgagtgtgagcataatacaacgggacccgattgcggcaaatgtaagaagaactatcaagggcgaccatggtccccaggatcttatctccccattcccaaggggaccgctaacacctgcattccttccatttcttccataggaaacccacccaagtttaacagaatctggcctaacatatcctctttggaagtatctaatccaaaacaggtggcccctaaacttgccctcagcaccgtatcttccgtgcaagttgcaaatcacaagagggccaacgtctgcgacaacgaattgctccactgccagaacggcggtacgtgtcataacaatgtcaggtgcctctgtcctgccgcatacacaggaatcctgtgcgagaagttgcgatgcgaggaggcaggaagctgcggcagtgactctggtcagggggctcccccacacggtagcccggcgttgcttctgctgaccaccctgcttggcaccgccagccccctcgtcttttag

SEQ ID NO: 126023 - DNA, 1383 bp, Artificial Sequence
  Description of Artificial Sequence: Synthetic coding sequence
atgtacctttccagatttttaagtattcacgctctgtgggtcacggtaagttctgtgatgcagccttatccgctggtatggggccattacgatttgtgcaaaacccagatttacaccgaagagggcaaagtctgggactacatggcctgccagccagaatccaccgatatgacgaagtacctgaaggtgaagctcgaccctcctgatattacctgtggcgatccgccggaaaccttttgcgccatgggcaacccctacatgtgcaacaatgaatgcgatgcatccacccctgagctggcccaccctccggaactaatgttcgacttcgagggcagacacccctccacattctggcagtccgcaacttggaaggagtatccaaaacccctccaagttaacatcaccctgtcgtggtccaaaacgatcgaactcacggacaatatcgtgattacgtttgaatccgggaggcctgatcagatgatcctcgaaaagtcactggactacgggcgcacatggcaaccttaccagtactacgctaccgactgcttagatgccttccacatggacccgaagtccgttaaggatctgagccagcatacggttctcgagattatctgcaccgaggaatactctactggatacaccactaacagtaagattatccactttgaaattaaagatagatttgctttctttgctggaccgcgacttaggaatatggcctctctatatggccaactcgataccacgaaaaagcttcgcgacttctttacggtgaccgacctgcggatccgcctcctccggcctgcggtcggggaaatatttgtggatgagctgcacttagccagatatttttatgcaataagcgatataaaggtacgcggccgctgtaagtgtaacctccacgctactgtctgtgtgtacgataatagcaaactgacatgtgagtgcgaacataatactaccggaccagattgcggcaaatgtaagaagaactatcaggggagaccgtggtctcctggttcgtacttaccgatcccgaaggggactgcaaacacttgtataccatccatcagttcaattggaaatcccccaaaatttaatcggatttggcctaacattagtagcttagaggtcagtaatccaaagcaagcgaacgtttgtgacaacgagctactgcattgtcaaaacgggggcacctgtcacaataacgtgagatgtctttgccccgccgcctacacagggatactttgcgagaaactacggtgtgaagaggccggcagctgcgggtctgattcaggccaaggggcccccccccacggttcaccagcattgctgctgctgacgactctgctcgggacagcgtcaccgctggtgttttag

SEQ ID NO: 126024 - DNA, 1620 bp, Artificial Sequence
  Description of Artificial Sequence: Synthetic coding sequence
atgtatttatcacggtttttgtccattcatgctctctgggtgactgtgtcaagcgtgatgcagccttacccgttagtgtggggacactatgatctgtgtaaaacacagatctatacagaagaggggaaagtctgggattatatggcgtgccagccagagtcaacagatatgacaaagtacctgaaagttaaactggatccccctgacattacatgcggcgaccctcccgaaacattctgcgctatgggaaatccatacatgtgtaataatgagtgtgacgcatcaacccccgaattagcacatcccccggagctgatgttcgacttcgaagggcggcatccatcaacattttggcagagtgccacttggaaggagtatcccaagccgctgcaggtgaacataacgctttcatggtccaagaccattgagttgaccgacaacatcgtgatcacgtttgagtcggggaggcccgaccagatgattcttgaaaagtcccttgattacggccgtacttggcagccttaccagtattacgccactgattgtctggacgccttccacatggaccccaaaagtgtcaaggacctcagtcagcataccgtactggaaattatctgtacggaagagtacagcacaggatataccaccaattcaaaaatcatacactttgagatcaaggataggttcgcctttttcgccgggccacgacttcgcaatatggcttccctgtatggccagttggacactacaaagaagctccgagacttcttcaccgttaccgacctcaggatcagacttctacggcctgcagtcggtgagattttcgttgatgaactgcacctggctagatacttctacgcgatctccgacattaaggttaggggaagatgtaaatgtaacttacacgcaactgtatgcgtgtacgacaactccaaacttacctgtgagtgtgagcacaacacaaccggccctgattgcggcaaatgtaaaaagaattaccagggccggccctggtcaccaggcagctatcttccaatcccgaaaggcactgccaatacctgcatcccaagtatttcaagtatcggcaactgtgaatgctttggacactctaacaggtgcagttacatcgatcttctgaacaccgtgatctgtgtctcatgcaaacacaatactcgaggtcagcattgcgagctgtgcaggctggggtatttccgtaacgcatccgcgcagctggacgacgaaaacgtgtgtatcgaatgttattgtaacccgctcggatcaatccatgatcgctgcaatggtagcggtttctgtgaatgtaagaccggaacaacgggacctaagtgcgatgaatgtctccccggcaatagttggcactacggctgtcaaccaaacgtgtgcgataatgaactcctccactgtcagaacggtggcacctgtcataataatgtaaggtgcctgtgtccggctgcctatacagggatactgtgtgaaaaacttcggtgcgaagaggctgggagttgcggtagtgactctggccaaggggctccaccacacgggtctcccgccctgctgctcctgactacccttctcggcaccgcgtctcccctggtgttctag

SEQ ID NO: 126025 - DNA, 1383 bp, Artificial Sequence
  Description of Artificial Sequence: Synthetic coding sequence
atgtacttgtctcgctttctgagtatacacgccctctgggtgaccgtgtcctccgtcatgcagccctaccctctagtatggggtcactatgacttgtgcaagactcaaatttacacagaggaaggaaaggtatgggactacatggcctgccaacctgagtctacggacatgaccaaatacctgaaagtgaaattggatccccctgacattacatgtggagatccacccgagactttttgcgctatggggaacccttatatgtgtaataacgagtgcgacgcatctacccccgagctggcgcatccaccagagcttatgtttgatttcgagggacggcaccctagtacgttctggcagtccgccacctggaaagaatacccaaagcccctccaggtaaatatcaccctctcctggagtaaaaccattgagctgactgacaacattgtgatcacattcgagtcaggacgacccgatcagatgatcttagagaagtcactggactacggccgcacctggcagccataccagtactacgcaactgactgcctcgacgccttccatatggacccaaagagcgttaaggacctgtctcagcacaccgtgttggaaatcatatgtaccgaagaatacagcaccggatacactacaaattccaaaatcatccactttgaaatcaaggacagatttgccttcttcgctggaccacggctaagaaacatggccagcctttacggccagctggacacgactaaaaaactccgcgatttcttcacagtcaccgatttgcgaatccgacttctgcgccctgccgtcggagagatcttcgtggacgaactccacctggctcgctatttttatgcaatctccgatatcaaggtgagggggaggtgcaaatgcaatctgcatgccaccgtgtgcgtgtacgacaacagcaagctgacctgcgagtgtgaacataacaccacggggcctgattgcggcaaatgtaagaagaattatcagggaagaccatggtctcccggtagttacctaccaattcccaaagggacagctaatacatgtgatccctacttaacatcttgtggggatcccccaaaattcaaccgcatttggcccaacatctctagtttggaggtgtcaaaccccaagcaggccaatgtctgtgacaatgagctcctgcactgccagaacggagggacatgccataataatgttagatgtctctgccccgcggcttacactggcatcctgtgcgagaaactccgttgcgaggaagcaggctcgtgtggctccgattcgggtcaaggagctcctccacacggaagtcccgcattgctgttactcacaaccttattaggtacagctagtcccctggttttttag

SEQ ID NO: 126026 - DNA, 1443 bp, Artificial Sequence
  Description of Artificial Sequence: Synthetic coding sequence
atgtacctgtctcggtttttgtcaattcacgccttgtgggtgaccgtaagtagcgtgatgcagccgtacccgttggtatggggacattacgacctttgtaagacacaaatctacacagaagagggtaaggtctgggattatatggcctgtcagccggagagtacggatatgaccaagtatttgaaggtcaagctcgacccccctgatattacttgcggagacccccccgaaacgttttgtgcgatggggaacccttacatgtgcaataatgaatgcgacgctagcacccctgagctcgcgcatccccctgaacttatgtttgattttgaaggacggcacccctccactttttggcagtctgcaacttggaaagagtacccaaaacctcttcaagttaatattactctcagttggtctaaaactatcgaactcacagataacattgtgataacctttgagtcaggcagacctgatcagatgatcttagagaagagcctggattatggacgcacctggcagccataccagtactacgccaccgattgcctggacgcattccacatggaccccaagtctgttaaggacctgtcccagcacacagtcctggagattatctgcactgaagaatattcaaccggatacacaactaattcaaagatcatccattttgagattaaagatcgctttgcattttttgcaggacctcgcttgcggaacatggcctcattatacgggcagctggataccacgaaaaaacttcgcgattttttcacagtgacagatctacgaatcagattactacgaccagcagtgggagaaatctttgtggatgagctccatctcgcgaggtacttctatgcgatcagcgacatcaaggtcaggggcaggtgcaagtgcaatttacatgctaccgtctgcgtgtacgacaactcgaaactgacctgcgaatgcgagcacaatactactgggcccgattgtggaaagtgtaagaagaactaccagggcaggccatggtcccctggatcttatttacctatccctaaggggaccgccaacacctgcatcccctccattagttctattggtaatccgccgaagttcaatcggatctggccaaacatttcaagcttagaggtgtctaatccaaaacaggtggctcccaaacttgcattgtccacagtttcaagcgtccaggtggctaatcacaagagagctaatgtgtgtgacaatgagctgctgcattgtcagaacggtgggacatgtcataacaatgttagatgcctgtgccctgctgcgtatactggcatcctctgtgagaaactgagatgtgaggaggccggaagttgcggttcagacagtggccaaggtgcgccaccccacggaagcccagccttgcttctgttaactacattactagggaccgcatcccccttagtgttctag

SEQ ID NO: 126027 - DNA, 1485 bp, Artificial Sequence
  Description of Artificial Sequence: Synthetic coding sequence
atgtacttaagcaggtttctgtccattcatgccctgtgggtcactgtgtcctctgtgatgcagccttacccactggtctggggccattacgatctgtgcaaaactcagatttatacagaggaaggcaaggtgtgggattatatggcctgtcagcctgagagcactgatatgacaaagtacctgaaggtcaaactggatccaccagatattacctgtggagatcccccagagaccttctgtgctatgggcaatccatacatgtgtaacaacgaatgcgacgcttctacccccgagcttgctcaccctcctgaactgatgttcgattttgagggacgccatcccagcacattctggcagagcgccacttggaaggaataccccaagcctttgcaagttaacatcacgttgagttggtctaagaccatagagctcacagataacatcgtgatcaccttcgagtccggtagacccgaccagatgatcctcgaaaagtccctggactatggaaggacatggcagccttaccaatattatgctacagactgccttgacgcatttcatatggaccccaagtccgttaaggatctgagtcagcacactgtgctcgagataatctgtacggaggaatactccacgggatacactaccaactctaaaatcatccacttcgaaatcaaggaccggtttgctttctttgcagggccacgcctgcggaacatggcttccctctatggacagttagacacaacaaagaagctgcgcgatttctttacagtgacagatttgcggattcgcctgttgcgaccggccgtcggagaaatttttgtggatgaactgcacctggcccggtatttctatgctatttccgacatcaaagttagaggccggtgtaagtgcaacctacatgctacagtatgcgtttacgacaattcaaagctcacatgcgaatgcgaacataacaccaccggccctgactgtgggaagtgtaagaagaattaccagggacgaccgtggtccccaggatcctatctgcctatcccgaagggcactgctaatacgtgtgacccgtatttaactagctgtggagattgtgagtgcttcggacattccaacaggtgttcctacatcgacctcctgaacacggtaatctgtgtgtcctgcaaacataatacacggggacagcattgtgaactctgccggctcggatatttccggaacgccagcgcccagctggatgatgagaatgtttgcattgccaatgtgtgcgataatgaactcctgcactgccagaacgggggtacatgtcataacaacgtccgatgcctatgccccgcagcgtacaccgggatactgtgcgagaagctacgctgtgaggaagctggctcctgcggcagcgacagcggccaaggcgcaccgccacacggatcccccgccctgctcctgctgacaactcttctgggaacggcgagcccgttagtgttctag

SEQ ID NO: 126028 - DNA, 1620 bp, Artificial Sequence
  Description of Artificial Sequence: Synthetic coding sequence
atgtacctgtcgcggtttctgagcatacatgctctgtgggtcacagtgagctctgtgatgcagccatatccactggtgtggggacattatgatctgtgtaaaacacagatttatacagaggaaggtaaggtttgggactatatggcgtgccaacctgagagtacggacatgaccaagtatctgaaagtgaagctcgatccgccagatatcacatgcggagaccccccggagaccttttgtgccatgggcaacccttatatgtgcaataacgaatgtgacgcaagcactccggagctggctcaccctcccgaactgatgtttgatttcgagggacgccacccatccactttctggcagtcagccacgtggaaagagtacccgaaacccttgcaggtaaatattaccttaagctggtccaaaacgatcgagctgaccgataatattgtcatcacttttgagagcggacgccctgaccagatgattctggaaaaatccttagattacgggcgaacatggcagccctaccagtattatgccacggactgcttagatgcatttcacatggaccctaagagtgtcaaagatctgagccagcacaccgtgctggaaataatctgtaccgaggaatatagtactggatatacaactaattccaagatcatccactttgaaatcaaggatcgattcgctttttttgcaggccctcgcctgcgcaacatggcctctctatacggccagctcgatacgacaaagaaactcagagatttctttacggtgacagacttgcggattcgcttgcttcggccagccgtgggcgagattttcgtggacgaattgcatcttgctagatacttctacgctatctctgatataaaagtgagaggccgctgtaaatgcaaccttcatgcgacagtttgcgtgtatgataactcaaaacttacatgtgagtgcgagcataacaccactgggcctgactgtggcaagtgtaagaagaactatcagggacgaccttggagccccggatcatacctgccaattcccaaaggaaccgctaatacctgtattccatctatctctagcatcgggaattgcgaatgctttggacattccaatcgctgtagttacatcgacttgttgaacaccgttatctgtgtaagctgcaagcataatacacgtggccaacactgcgagttatgcagactggggtacttccgaaatgcttcagcccagctcgatgatgagaacgtctgtatcgaatgttattgtaacccactggggtccattcacgacaggtgtaacggttcagggttttgtgagtgtaagacgggaactacagggcctaagtgcgatgaatgtttaccaggcaactcctggcactacggatgtcaaccgaatgtatgcgataacgaattactgcattgccagaatgggggcacgtgccataataacgtgcgatgcctctgccccgccgcgtacaccgggatcctctgtgaaaaacttaggtgcgaagaggcaggtagctgcggtagcgactcaggccaaggcgccccaccacacgggtcacccgcgctgctgctgctcaccacactgttagggaccgcatctcccctggttttctag

SEQ ID NO: 126029 - DNA, 1317 bp, Artificial Sequence
  Description of Artificial Sequence: Synthetic coding sequence
atgtatctctcgaggtttctgagcatccatgcactgtgggttaccgtgtcctccgtaatgcaaccttatcccctggtttggggccactatgacctgtgcaagactcaaatctacactgaagagggcaaagtttgggattacatggcttgccagcccgagtccactgatatgaccaaatacttaaaggtgaaacttgaccccccggatatcacctgtggagaccctcccgaaaccttctgtgctatgggtaatccttacatgtgcaacaatgaatgtgacgcttctactccggaactggcacatccccccgaattgatgtttgatttcgaaggacggcatccgagtaccttttggcagtctgctacttggaaagaatatccgaaacccttgcaagtaaacataacactcagttggtccaagaccatcgaactgaccgataacattgtcattacatttgagtcagggcgcccggaccagatgattctggagaagagtctggattacgggagaacctggcaaccataccagtactacgctacagactgtctcgacgccttccatatggatcctaaatcagtgaaggacttaagtcagcacaccgttctcgagatcatatgcacagaggaatattccacgggttatacaacaaactccaagataatccattttgaaatcaaggacagatttgccttcttcgctgggccgaggctgaggaatatggcctctttgtatggccagctcgacactactaagaaattgagagacttttttaccgtgaccgacctgaggattcggctgctccggcccgccgtcggcgagatctttgtcgatgagctgcacttggccagatacttctacgccatctctgatattaaagtgagaggtcgctgcaagtgcaatctgcatgctacggtgtgcgtgtacgataatagcaaacttacctgtgaatgcgaacacaacacaacagggcctgattgcggaaagtgcaaaaaaaactaccaaggacgcccctggtcaccgggcagttacttaccaattcctaagggcactgcgaacacatgtataccatccatcagtagtataggaaccaacgtgtgcgacaatgaattactgcactgtcaaaatggtggtacatgccataataacgtgcggtgtctttgccctgcagcctatacaggcatcttatgtgaaaagctgagatgcgaggaagcgggatcctgcggctcagatagcggtcagggagccccaccacacggatcccctgccctgcttctattaacgacattactgggaacggcgagccctcttgtgttttag

SEQ ID NO: 126030 - DNA, 1095 bp, Artificial Sequence
  Description of Artificial Sequence: Synthetic coding sequence
atgtacctgtcacgctttctgtcaatccatgccttgtgggttaccgtcagctctgtgatgcaaccctaccccctggtgtggggccattacgatctgtgcaagacacagatatacactgaggagggcaaggtgtgggactatatggcatgccagcctgagtctaccgatatgaccaagtacttaaaggtgaagctggaccctcccgatattacatgcggcgacccgcctgaaacattctgcgctatggggaatccatacatgtgtaataacgaatgcgatgctagcactcccgaactggcgcacccacctgagctgatgttcgactttgaaggtagacacccctccaccttttggcagtcagccacttggaaagagtaccccaagccactgcaggttaacatcactctatcctggagcaagactatcgagttaactgataacatagtcatcacattcgaaagtggcaggccagaccagatgatcctggagaagagcctagactacggaagaacctggcagccataccagtactatgccactgattgcctggatgcttttcacatggatccaaaatccgtgaaagatctctcacagcacactgtcttggagattatatgcacagaggagtattcaaccggttatactacaaattccaaaattatccactttgaaataaaagaccggttcgcattctttgccgggccacggctgagaaacatggcctccctgtatggccaacttgacacaacgaagaagctgcgcgatttctttacagtcaccgaccttaggattcgtctccttcggcccgccgtcggggagatcttcgtggacgaactccatctcgcccgatatttttacgcaattagcgacattaaggttcgcggccgatgtaaatgcaaccttcacgccacagtatgcgtttacgataacagtaagcttacatgcgaatgcgagcacaacactacaggcccagactgcgggaagtgcaaaaagaactaccaaggtagaccatggtccccagggtcttaccttccgattcctaaagggactgccaacacttgcattcctagcatctccagcatcgggtccaaatag

SEQ ID NO: 126031 - DNA, 1317 bp, Artificial Sequence
  Description of Artificial Sequence: Synthetic coding sequence
atgtacctgtcacgcttcttgtccattcatgccctatgggtgaccgtctccagcgtgatgcagccttaccccctggtttggggccattacgatctgtgtaagactcagatttacactgaggagggcaaagtttgggactacatggcctgccaaccagagagcacagacatgactaaatacttgaaggttaagctcgaccctcccgacataacgtgcggcgatccccccgagaccttctgcgccatgggcaacccttatatgtgtaacaacgagtgtgacgcaagcacccccgagctggcccacccacctgaactgatgttcgacttcgaaggaaggcacccaagcactttttggcagagcgcgacgtggaaagaatatcccaaacccctgcaggtcaacataactctgagctggagtaagacaatagaattaaccgacaacatcgtgatcaccttcgagagcggccgcccagatcagatgattctagagaaatccctggactatggtcgtacatggcagccctatcagtattacgctaccgactgcttggacgcattccacatggatcccaaatccgtgaaagacctcagccagcacacagtcttggaaatcatctgcaccgaggagtatagtacggggtatacaactaatagcaagatcatccacttcgaaatcaaggatagattcgcattctttgccgggccgaggctgaggaatatggcaagcctctacggacagctggataccaccaaaaaactcagagatttcttcaccgtgaccgatctccgcatccgtttactcagacccgccgtcggagaaattttcgtggacgaattacatttagcacgatacttctacgctatcagtgatattaaagttagaggtcgctgtaagtgtaatctccatgccactgtgtgtgtgtatgacaattctaaattgacctgcgaatgcgaacataatacaacaggtccagattgcgggaagtgcaaaaagaactaccaaggccggccgtggtctccgggatcatacttgcccatccccaaaggaactgccaatacttacttgcctagcatgtactcagtcgcagccaacgtgtgtgacaatgaactcctgcattgccagaacggcggtacttgtcacaacaacgtgaggtgcttgtgcccagcagcctacaccgggatcttgtgcgagaagcttcgctgtgaagaggcaggttcatgtggcagcgattcaggtcagggcgctccacctcatggatcccctgcccttctcctcctgactactctgcttggtacagcttctcctctggtcttctag

SEQ ID NO: 126032 - DNA, 1620 bp, Artificial Sequence
  Description of Artificial Sequence: Synthetic coding sequence
atgtacctcagcaggttcttgtcaattcacgctttgtgggtgaccgttagctcagtgatgcagccttatcccctcgtatgggggcattacgacttatgcaagacacagatctatacagaagagggaaaagtctgggattatatggcatgtcagcccgagtctaccgacatgacaaagtacctgaaggtgaaattggatccgcccgacataacctgcggagacccaccggagactttctgcgctatgggtaacccctatatgtgtaataacgagtgcgatgcctcaaccccagaactggcccaccctccagagctgatgtttgactttgaggggcgacacccctccacattctggcaatctgctacatggaaggaataccccaaaccccttcaggtgaacataacactttcgtggtctaagactatcgaactgacagacaacatagtcatcactttcgaaagcggtaggcctgatcagatgatcttggagaaatcactcgattatgggcgtacttggcagccgtatcagtactacgccacagactgcctcgacgccttccatatggatcccaagagcgtgaaggaccttagccagcacaccgtgttggaaattatctgtactgaagaatactctacgggttatacgaccaatagtaagattatccatttcgaaataaaagataggtttgcctttttcgccggcccaaggctgagaaatatggcatctctctacggccagctggatactaccaagaagctaagagatttttttacagtcacggatcttaggatccgtctgcttcgaccagcagtcggtgagatctttgtcgacgaattacatctggcacggtacttctacgctatatccgatatcaaagtcaggggacgatgtaaatgcaacctacatgccaccgtgtgcgtatacgacaactctaaacttacctgcgaatgtgagcataataccacagggcccgactgtggaaagtgtaagaagaactatcagggaagaccttggagtccaggttcgtatttacccatcccgaaggggaccgctaacacctgcgatccttacctgacttcctgtggcgactgtgagtgcttcgggcactcaaacaggtgctcctatatcgacctcctcaacaccgtgatttgcgtgagttgcaagcataatacccgcggacagcattgcgagctttgcagactgggctactttcgcaatgcttctgcacaattagacgacgagaacgtatgtatcgagtgttattgcaatcctcttggctcaatccacgatcgctgtaacggatccggattttgcgagtgcaagacaggcactaccggcccaaaatgtgatgagtgcttacccggcaatagctggcactatggatgtcagcctaatgtgtgtgacaatgaactgctccactgccaaaacggcggtacctgccataacaacgttcgctgtctgtgcccggccgcctatacaggaatactttgtgaaaagctcagatgcgaagaggcgggcagctgtgggagtgattctggccagggcgctccacctcatggcagcccagctcttttgttgctgacaacgctgttaggtaccgcttctcccttagtattctag

SEQ ID NO: 126033 - DNA, 519 bp, Artificial Sequence
  Description of Artificial Sequence: Synthetic coding sequence
atggttgggcccgctcctcggaggcgcctgcgccccctggccgctctggctctcgtgttggccttagcaccaggcctgcctaccgcgagagccggccagacacctaggcccgcagaaagaggaccgccggtgcgcctattcacagaggaggagttggccaggtacggtggcgaggaagaagaccagcctatctatcttgccgtgaaaggagtggtcttcgatgtcacgtctggtaaggaattctatggccggggtgccccctacaatgcccttacaggcaaggactcaacgagaggcgtggctaaaatgtcgttagaccctgctgacttaacacacgacacgacaggcctgaccgccaaggaacttgaggctctggacgaagtattcaccaaggtctacaaagctaagtacccgatcgttggctatactgcgcgcagaatcctaaatgaggacggcagtcccaacctggactttaagcccgaagatcagccacatttcgacattaaggacgaattttag

SEQ ID NO: 126034 - DNA, 2088 bp, Artificial Sequence
  Description of Artificial Sequence: Synthetic coding sequence
atgagcttacttctgagcttttacttactggggctcctcgtatcctccggccaggaccggttcgctatgttagctaataacaatctccaaatattaaacatcaataagagcgatgaaggcatatatcgctgcgagggccgagtggaggctcgaggagaaatcgatttccgcgacatcatcgtgatcgttaacgttccacccgcgatctctatgcctcagaagtcatttaacgcaactgcagagagaggtgaagaaatgactttcagctgtcgtgcttccggcagcccagagcctgctatatcttggtttcgaaatggtaaactcattgaagaaaatgaaaagtacatcttgaagggctccaatactgaactgacagtgaggaatattattaattccgacggcggcccttacgtgtgccgggccaccaacaaagccggagaagacgaaaagcaggcgtttcttcaggtgttcgtgcagccacacatcatccagctgaagaatgagaccacatatgaaaacggccaggtgacacttgtctgcgacgcagagggggagcctattccagagattacgtggaaaagggcagtcgatggcttcacctttaccgaaggtgataagtcgctcgacggccggatagaggtgaagggccagcatggcagttcctccttacatatcaaggatgtgaagctcagcgattccgggcggtacgattgcgaagccgcatccagaataggcggtcaccagaagagcatgtatttagacatcgaatacgcaccaaagttcatctccaatcaaaccatctattacagctgggagggaaaccctataaatatcagttgcgacgtcaagtctaaccccccagcatctattcattggagaagagacaagttggtcctccccgcaaaaaacaccacaaatctcaaaacatactctaccggcaggaagatgatcctggagatagctcccacatccgacaacgatttcgggcgctacaattgcacagcaaccaaccacattggaactcggtttcaagagtacattctggctctcgctgacgttcctagcagcccttatggagttaaaattatcgagctttcccagaccacagctaaggtgagttttaacaagccagattcacatggtggcgtgcccattcaccattaccaggtcgatgtcaaagaagtggcctctgaaatctggaagatcgttaggagccacggagtgcagactatggttgtgctgaataatttggagccaaatactacttacgaaataagggtcgcagcagtgaatgggaaaggacagggcgattactcgaagattgaaatatttcagaccctgccagttcgggagccctccccccccagtatacacggccagcccagcagcgggaagtcattcaagttatccatcactaaacaagacgatggtggagcacctatcctggagtacatcgtgaaatatcgttctaaagataaggaagaccagtggctggagaagaaggtccaggggaacaaggatcatataattctcgagcacctccagtggactatgggctacgaagtccaaataactgctgcaaatagactcggctactccgagcctacggtatatgagttcagcatgccccctaagcccaatatcattaaagacacgctgttcaacgggcttggcctgggcgctgttattggcctcggcgtagccgctctactgctgattctggtagtgacagacgttagttgtttcttcataaggcagtgcggactgctcatgtgcatcactaggaggatgtgcggcaaaaagtctgggtctagcggcaagtccaaagagctggaagaagggaaagctgcgtatctcaaggacggcagcaaagaacccatcgtggaaatgagaacggaggacgagagggtgaccaaccacgaagatggaagtccagttaacgagcccaacgagaccactcctttgactgaaccagagaagcttcctttgaaagaggaggacgggaaggaagctttgaacccggaaacaatcgaaattaaggtcagcaatgacattatccagagcaaagaggatgatagtaaggcctag

SEQ ID NO: 126035 - DNA, 2514 bp, Artificial Sequence
  Description of Artificial Sequence: Synthetic coding sequence
atgagtttgctactctcattttatttgctggggctgctcgtgtcttctggccaggctttgctgcaagtgaccatctcccttagcaaggtggagctgagcgttggtgaaagcaagttctttacctgcacagcaatcggtgagccagaatctattgactggtataacccccaaggggagaagatcatatcaacccagcgagtcgtcgtgcagaaagaaggagttagatcaaggttgaccatttataacgctaatatagaggacgctgggatctatcgctgccaggcaaccgacgctaaaggacagactcaagaggcaaccgttgtgttggaaatttaccagaagctcacattccgggaggtggtgtcacctcaggaatttaagcagggagaggacgctgaggtagtctgtagagtgtccagtagtccagcgcctgccgtgagttggttgtaccataatgaagaggtcacgacaatttccgataatagatttgccatgctggcaaacaacaacttgcaaattcttaatattaacaagtcggacgaagggatctacagatgtgagggtcgggtggaagccagaggagaaatcgatttcagggatattatcgtgattgtcaatgtgccacccgcaatttcaatgccccagaagagcttcaacgcaactgcggagagaggggaagagatgactttctcctgccgagccagtggttcaccggaacctgcgattagttggttccggaacggcaagctcatcgaagagaatgagaagtacatcctcaaggggtccaacaccgagctgacagtcaggaatataatcaattcagatgggggcccctatgtctgtagggccaccaacaaggcaggcgaagatgaaaagcaggcgttccttcaagtgtttgtccagccgcacattatccagctgaaaaacgagacaacttacgaaaatgggcaagtgacgttggtctgtgacgctgaaggcgagccaatccctgagatcacttggaaaagagcggtggacgggtttacattcaccgaaggcgataagtcactggacggccgcattgaggttaaaggacagcacggctctagctcgctgcacataaaagacgtgaaactgtccgattcaggacgctacgattgcgaggcagcctcaagaatagggggacaccagaagtctatgtatctggacattgagtacgccccaaaattcattagcaaccaaactatttactacagctgggagggtaatcctatcaacatctcctgcgacgtgaagtctaatccccctgcctcgattcattggcgccgagataagctggtgcttcccgccaagaataccacaaatcttaaaacttattccaccggccggaaaatgatcctcgagatcgctccgacatcagacaacgacttcggtcggtataactgtactgctactaatcatattgggactcggttccaggagtatatactcgcgctcgctgatgtacctagcagcccttatggggtgaagatcatcgagctctcccagactacagcgaaggtttctttcaataaacctgactcccatggcggggttcccatccatcactatcaggtggatgttaaggaggtggcttccgaaatctggaaaatcgttcgaagtcatggtgtgcagaccatggttgttctgaacaatctggaacccaacacaacatacgagatccgagtcgcagccgtgaatggcaaagggcagggggattattccaagatcgaaatttttcagacattacccgttcgcgagccttctcctcccagtatacatggccagccctcaagtgggaaaagctttaaactctcaattactaagcaggatgacggaggggctccgattttagaatacatcgtgaaatacagaagcaaggacaaggaagatcaatggcttgaaaagaaggtgcagggcaataaagaccatatcattttggagcacctgcaatggaccatggggtatgaagttcaaattactgctgccaatcgcctgggctactccgaaccaactgtctacgaattcagtatgcctccaaagcctaatatcatcaaggacactctttttaacggactgggtctgggagctgttattggattgggcgtggccgcactgcttttgatcctggtggtgacagatgtgagctgtttcttcattagacagtgcggactcctgatgtgcatcacccgccggatgtgcggcaaaaaaagcggctctagtggaaaatccaaggaactcgaagaaggcaaagccgcttacttgaaggatgggtctaaagaacccattgtagaaatgcgcacagaagacgagcgggttaccaaccacgaggacggtagccccgtgaacgaacctaatgaaaccactcctctcaccgagcccgaaaaacttccactgaaggaggaagatggcaaagaggcactcaacccagagactattgaaatcaaggtctcaaatgatatcatccaatcaaaagaggacgactcaaaagcctag

SEQ ID NO: 126036 - DNA, 1275 bp, Artificial Sequence
  Description of Artificial Sequence: Synthetic coding sequence
atggtccggagcgacagtggtggacaagtctatctcgattatcacaataggcaggggttgtttgtcgattggaaatacaacgaagctctgtaccttgaagagggacagcctgagacctattacaggacggccctgctgcaggtaactatcagcctctccaaggtcgaactttccgtgggagaatccaagttcttcacatgtaccgcgataggggagccagagagcatcgattggtataacccccaaggtgaaaaaatcatttcaacacagcgagtggtggtgcagaaagagggtgttcgaagtcgactgaccatatataacgcaaatatcgaggacgcaggaatataccgctgtcaggctaccgacgcgaagggccagacccaggaggccaccgtggtactggaaatttaccagaagctaacgtttcgcgaggtagtgagtccccaagagtttaaacagggcgaggatgccgaggttgtctgtagagtctccagctcacctgccccagccgtgtcatggctctaccacaacgaggaagtcactaccatctctgacaatagattcgctatgctcgcgaataacaaccttcagattctaaacattaacaaatcagacgagggcatttaccgctgcgagggacgggtagaagcacgcggcgagattgatttccgggatattattgtgattgtcaacgtccccccagctattagcatgccccaaaaatctttcaacgccacagccgagcggggcgaagagatgacattcagctgccgagccagcggctctcccgagccagcgatctcttggttcaggaatgggaagctcattgaggaaaatgagaagtatatcctgaagggtagcaatactgagctaaccgtacgcaacatcattaactcggatgggggcccgtatgtgtgtcgcgccaccaataaagctggcgaagacgagaaacaggcgttccttcaggttttcgtccagccccatatcattcaactaaagaacgagactacctacgagaatggacaggtgacactggtgtgcgatgctgagggtgaacccatccctgagatcacttggaagcgggccgtggacgggttcacttttacagagggcgataagtcccttgacggtagaatcgaagtgaagggccagcatgggtcttccagcctgcatatcaaagatgtgaagctgagcgacagcggccgctatgattgtgaggcagccagtagaataggaggtcatcagaagtcaatgtacctcgatatagaaagctag

SEQ ID NO: 126037 - DNA, 1983 bp, Artificial Sequence
  Description of Artificial Sequence: Synthetic coding sequence
atgcaggaaaatctgaggttcgccagcagcggcgacgatataaagatctgggacgccagttctatgactctggtggataaatttaatccccatactagtccgcatggcataagctccatctgctggtcctcgaataataatttccttgtaacagcttctagcagcggggacaagatcgtggtgtcaagttgtaaatgcaaaccagttcccctcctggagctggcagagggacaaaaacagacctgcgtgaatctgaattctaccagtatgtatttggtgtccggcggacttaacaatactgttaatatctgggatctgaagtctaaacgcgtacatcggtccctcaaggaccacaaggaccaggtgacctgcgtcacttataattggaacgattgttacattgcctccggttcattatccggggaaatcatcctgcattcagtaaccacaaacctgagttcgacaccttttggccacggctctaatcagagcgtccggcacctgaaatattctctgttcaagaagtcccttctgggaagcgttagcgacaacgggatcgtgaccctctgggacgttaactctcagagtccctatcataactttgactccgtgcacaaggctcctgcgtccggaatttgcttcagcccagtgaatgagctcttattcgtgaccatcggcctcgacaaacgcattatactgtacgacacatcttctaagaagttagtgaagacgctggtggctgatacaccccttacagcagtggatttcatgccagacggagcaacactggctatagggtcgagtcgagggaagatttaccaatatgacctgcgaatgctgaagtctccagtcaagaccatctcagcacacaaaactagtgtgcagtgcatcgcattccagtatagcaccgtgctgaccaaatcctcacttaataagggctgtagcaacaaacctacaaccgtgaacaagcgaagcgtgaacgttaacgcagcgagcggcggtgttcagaactccgggatcgtgcgcgaagcacccgctaccagcatcgctacagtgctgccccagccgatgacctctgcgatggggaaagggactgtggcagttcaggagaaggctgggcttcctcgcagcattaacaccgataccctctctaaggagaccgactctggaaagaatcaagacttcagcagctttgatgatacggggaagtcttccctcggtgatatgttttcacctataagagatgatgccgtggtcaacaaggggagcgatgaatcgatcggaaaaggcgatgggttcgatttcctcccacaactgaattcggtgtttcccccgagaaagaaccctgtgacaagctcgacatcggttttacattcaagtccacttaacgttttcatggggagtcccggaaaagaggaaaacgagaaccgtgacctgactgccgagtccaaaaagatatatatgggaaagcaagagtcaaaagactcgttcaagcagttggctaagctcgtgactagtggcgccgagagtggaaatctcaataccagcccctcatctaaccagaccagaaactccgagaagttcgagaagccagagaatgagattgaggctcagctgatttgcgagccacctataaacgggtccagtactccgaatcccaaaatcgcctctagcgtaacagccggggttgcttcttctttaagcgagaaaattgcggattcaatcggtaataaccgccagaacgcccccctaacctccatacagatcaggtttatccagaatatgatacaggagactctcgacgattttagagaagcatgtcaccgcgatatcgtgaatctccaggtggaaatgattaagcaatttcatatgcagttgaatgagatgcactcacttctcgagagatacagcgtgaatgagggtctggtcgccgagatcgaaaggttgcgcgaggagaataagaggctccgggcgcacttttag

SEQ ID NO: 126038 - DNA, 1716 bp, Artificial Sequence
  Description of Artificial Sequence: Synthetic coding sequence
atgtatcttgtgtcaggaggactgaataatactgtgaatatctgggatctgaaaagcaaacgagtccatagaagccttaaggatcataaagatcaggtgacatgcgtaacatacaactggaatgattgctacatcgcctccggatctctatctggcgagatcatcctgcattcagttactaccaacctgagttcaaccccttttggccatggctctaatcaatccgttagacaccttaaatactctttattcaaaaagtccttgctgggaagcgtgtctgacaacggcatagtcacactgtgggacgtgaattcacagtccccctaccacaactttgatagcgtccacaaagcccctgcaagcggcatctgttttagtcctgttaatgagctgctgtttgtgaccattggcctggacaaacgcattattctgtacgacacttcctctaagaaacttgtcaaaacgctggtggctgacacaccattgacggctgtggatttcatgccggacggagctacgcttgcaatcggttcatctcgaggaaagatttaccagtacgatctacgtatgctgaagagtcctgttaagacaatttcggcacataagaccagcgtgcagtgtattgcgttccagtactctacagtccttactaagagcagcctgaataaaggctgcagcaataaacccaccactgttaataagcgatctgtaaacgtcaatgcagccagtggaggggttcagaacagcggcatcgtgcgcgaggcccccgccacaagtattgctactgtactgcctcagccaatgacatcagccatgggaaaaggaacagtggcagtgcaagagaaagctggactcccaaggtcaatcaacaccgacaccctctccaaagagactgactcaggcaaaaaccaggacttcagttcttttgatgacaccggaaaatcctccctaggtgacatgttcagcccaatcagggacgacgccgtcgtcaacaagggttcagatgagagcattggaaagggcgacggatttgatttcctcccccagcttaactccgtgtttccccccaggaagaaccctgtgacatcctccaccagcgttctgcattcctcccctctgaatgtctttatggggtccccgggaaaagaggagaatgagaatagggatttgaccgctgagtccaaaaaaatttatatgggaaagcaggaatcaaaggatagcttcaagcagctcgccaagctcgtgactagtggtgcagaatcggggaaccttaatacgtcaccctcctcaaaccagactcggaattccgaaaagtttgaaaagcctgaaaacgaaatagaggcccaacttatctgcgagcctcctattaatggcagcagcacgcccaatcccaaaatcgcaagtagcgtgacggccggagtcgcgtcatctctgagtgagaaaattgccgactcaatcggaaacaatagacagaacgcaccgctgacatcaattcagataagatttatacagaatatgatacaagagacactggatgatttccgggaggcatgccaccgcgacatcgtgaatctgcaggtggagatgattaagcaattccatatgcagttgaatgagatgcattcacttttagaacggtattccgtgaacgagggcctggtggccgagatagagcgcctaagagaggagaataaacggctgcgggcccacttctag

SEQ ID NO: 126039 - DNA, 1983 bp, Artificial Sequence
  Description of Artificial Sequence: Synthetic coding sequence
atgcaagagaacctccgcttcgcaagttctggagacgacatcaagatctgggacgcttcatctatgactctcgtagataaattcaatccccatactagcccccatggtatttcttccatttgctggtcctcaaacaataatttcctcgtgacggcaagttctagcggggataagatcgtcgtgagctcctgtaagtgtaagccagtgcccctgctggagctggctgaaggccagaaacaaacgtgcgtgaatctgaacagtacctctatgtacctagtaagcgggggcctaaataatacagtgaacatctgggacctcaagagtaagagggtccaccggtcactgaaggaccataaagaccaggtgacgtgcgtgacctacaattggaatgactgctatatagcctccggctcccttagtggggagattattttacacagcgttactactaacctatcatcaaccccatttggccatggttctaatcaatcagtccggcatttgaaatatagcctgttcaagaaatcactcctgggttcggtgtccgacaacggtatcgttaccctgtgggatgtcaatagccagagcccgtaccacaacttcgattctgttcacaaggcaccagctagtgggatatgcttctccccggtgaatgagctactttttgtcactatcgggttagacaaacgcataattctgtatgacacatcatcaaaaaaacttgtcaagacactggtcgccgatacgccccttactgccgtcgacttcatgcctgacggggcaactttggccatcggcagcagccggggaaagatctaccaatacgatctgagaatgctgaaatccccagtcaaaacaataagcgctcataaaacgtccgtccagtgtatcgcatttcagtactcaaccgtgctgacaaagagctccctgaataagggatgctccaacaaacctaccaccgtgaataaaaggagcgttaacgtgaacgccgctagcggaggagttcagaattctgggattgtgagagaggctcctgcaacaagcatcgcaacggtgctaccacagcccatgactagcgcgatgggcaagggcacagtcgccgtgcaggaaaaagccgggctgcctaggtcgataaatacagatactctcagtaaggaaacagatagtggtaagaatcaggatttctcgagttttgacgacactgggaaatcatccctgggtgacatgttctcacctatcagagacgacgcagtggttaacaaggggagcgacgagtctattgggaaaggagacgggtttgacttcctcccgcaactcaactctgtctttcctcctaggaagaaccccgttacaagttccacctctgtgcttcatagtagcccactgaatgtgttcatgggtagtcctggcaaggaagaaaacgaaaatcgcgatctcaccgccgagagcaagaagatttacatggggaagcaggagagtaaggattctttcaaacagctggccaagctcgtgacctcgggcgccgaatctggcaatctgaacacaagccccagctctaaccaaacacggaattccgaaaagttcgaaaagcccgaaaacgagatagaggctcagttgatatgcgaaccgcccatcaacggttcttccactcccaatcctaaaatcgcttcatctgtaaccgctggggtggcgagtagtttatccgaaaagatcgccgacagtataggaaataataggcaaaacgccccgcttactagcatacagatcagattcattcagaacatgattcaggagaccttggatgactttcgtgaggcttgtcaccgagatatcgtgaatctccaggttgaaatgatcaagcagttccacatgcaactgaacgaaatgcactctctcttggaacgctattcggtaaacgaaggcctggttgccgagattgaaaggcttagggaagagaataaacgcctgcgcgctcacttttag

SEQ ID NO: 126040 - DNA, 1716 bp, Artificial Sequence
  Description of Artificial Sequence: Synthetic coding sequence
atgtatttagtttccggcggacttaacaacacagtgaatatctgggatctgaagtccaaaagagtgcatcggagtttaaaagatcacaaggatcaggttacttgcgtaacctacaactggaatgattgttacattgctagcgggtctctgtctggagagattatcctgcatagtgtaacgacgaacctcagtagtacgcccttcggacacgggtctaaccagagtgtgcgtcatcttaaatattcactgtttaaaaaatcccttctgggtagcgtgagcgacaacggaatcgttaccctgtgggacgttaactctcaatctccttatcataacttcgattcggttcacaaagctcccgcctctggcatctgctttagtccagtaaacgagcttctctttgtgaccatcggactcgacaagcgcattattctttatgacacatcctcaaagaagttagttaaaacactggtcgccgatactccattgacggctgtagattttatgcccgatggagcgacactggctattggctcttcaagggggaagatttaccagtatgacctgcggatgctaaagagcccagtgaaaaccatttccgctcacaagacaagcgtccaatgcatcgcatttcagtactctactgtgctgacaaagagctctctgaataaagggtgcagcaacaagcctacaacagttaacaaaaggagcgtgaatgtgaatgcagcaagtggaggcgtgcaaaactccggaatagttagagaggcacccgccacaagtattgccacagtgcttccgcaacctatgacctcagccatgggtaaaggcactgtcgccgtccaggaaaaagctggactgccaagaagcatcaacaccgacacactgtcaaaggagaccgactctggaaaaaatcaggacttttcatcattcgatgataccggaaaatcaagcctgggggacatgttttcccccatcagggacgatgcagtcgttaataagggaagcgacgagtccattggtaagggcgatggcttcgactttcttccacagctgaatagcgtgtttcctccgcgtaagaatccagtgacttcttcaaccagcgtgttgcatagctcaccactgaacgtgttcatggggtctcccgggaaagaggaaaacgagaatagagatcttaccgcggagtccaaaaagatctatatgggcaaacaggaatcaaaggactccttcaaacagttggccaaattagtgaccagcggcgcggaatccggcaacctcaatacttctcctagctcaaaccagacgcgaaattcagaaaaatttgagaaaccagagaatgagatagaggcacagctgatttgcgagcccccgattaacgggagttctacccccaacccgaagattgccagttcggtcacggccggggtcgctagtagtttgagtgagaaaatcgccgattcgatcgggaataatcgccagaacgcccccctaacctcaattcagatccgctttatacaaaatatgatccaggaaaccctggacgacttcagggaagcgtgccatagggacatcgttaacctgcaggtagagatgattaagcagttccatatgcaactgaatgagatgcactccctgttggagcgctacagcgtcaacgaagggctagtggctgaaatagaaagactgagggaagaaaacaaaaggctccgcgctcacttctag

SEQ ID NO: 126041 - DNA, 483 bp, Artificial Sequence
  Description of Artificial Sequence: Synthetic coding sequence
atgtatttagtcagtggtggccttaataacacagtgaacatctgggatttgaagtcgaagcgcgttcaccggagcctgaaggatcacaaggaccaggtgacatgcgtgacttataattggaacgattgctacatcgcctcagggtcgctgtccggggaaatcatcctgcatagcgttaccactaatctatcctcaactccttttggccacggttcaaaccagagtgtgaggcacctaaagtattctctctttaaaaagagcctcttagggtcagtgagcgataacggtattgtgactctttgggatgttaacagtcagagcccctatcataactttgactctgttcacaaagcacccgcgagcggaatctgtttcagtcccgtcaacgagttgctgttcgttaccatcggactggacaaacgcataatactgtatgatacctcaagcaaaaagctggtcaaaacactcgtggccgacacgtag

SEQ ID NO: 126042 - DNA, 504 bp, Artificial Sequence
  Description of Artificial Sequence: Synthetic coding sequence
atgcacttcacgggggctgtcatgcaggagaatctccggttcgcatctagcggagatgacattaagatctgggacgccagtagcatgaccttggtggacaaatttaacccacatacatccccacacggcattagcagtatatgctggtcctcgaacaacaacttcctggtgaccgcgagctcctccggcgacaagattgtggtctcatcttgcaagtgcaagccagtaccactcctggagttggccgagggtcaaaagcagacatgcgttaatctgaattctacgtcaatgtacctcgtgtccggcgggctgaacaataccgtgaacatctgggatctcaagtccaaacgagttcataggtcattgaaagaccacaaggatcaggtgacgtgcgttacctacaactggaacgactgctatattgcctctggatccttgtccggagagataatcctgcatagcgtgaccactaatctgtcatccaccccttttgggcatggctag

SEQ ID NO: 126043 - DNA, 306 bp, Artificial Sequence
  Description of Artificial Sequence: Synthetic coding sequence
atgcaggagaacctcaggttcgcttcctccggcgatgacatcaagatctgggatgcaagctctatgacactagtcgataagttcaatccacacacctccccacacggaatcagttccatatgttggtcttctaataataatttcctggttacagcctcgtcaagtggagacaaaatcgtggtttccagctgtaagtgcaagcccgtcccccttttggagctcgcagaaggacaaaaacagacttgtgtgaatttaaatagcacatccatgtacctggtttctggagggctgaacaataccgtgtag

SEQ ID NO: 126044 - DNA, 498 bp, Artificial Sequence
  Description of Artificial Sequence: Synthetic coding sequence
atgcaagaaaatctgcggttcgccagtagtggagatgacatcaaaatctgggatgcgtcttctatgacccttgtggataaatttaaccctcatactagcccccatgggatctcctctatctgctggtcatccaacaacaactttctcgtaactgcctcatctagcggagataaaatcgtcgtttcgtcctgcaagtgtaagcccgttccactgctggagttggccgaggggcagaagcagacttgcgtgaaccttaactccacatccatgtatctagtgagcggcggcttaaacaacaccgtgaacatatgggacctgaaatccaagagagtacacaggtcactcaaggatcacaaagaccaggtgacatgtgtgacttacaactggaacgactgttatatcgcatcaggctccttgagcggagagatcattctgcattcagtgaccaccaacctgagctcaacaccctttggacacgggagcaaccaaagtgtctag

SEQ ID NO: 126045 - DNA, 2004 bp, Artificial Sequence
  Description of Artificial Sequence: Synthetic coding sequence
atgcattttacaggagccgttatgcaggagaatctgagatttgcgtcctccggggacgacatcaagatttgggacgccagctcaatgaccttagtggacaagtttaacccacatacctctccccatggcattagctctatctgctggtccagtaataacaactttttggtgactgctagctctagcggcgataagattgtagtctccagctgtaagtgcaaacccgtgcccctcctagagctggctgagggccagaagcagacttgcgtcaacctaaactcgacatctatgtatctcgtgtctggaggactaaataacaccgtgaatatttgggacttaaagagtaagcgggtccaccggtctttgaaggaccataaagaccaggtcacctgcgtgacatacaactggaacgattgctacattgcctcaggatcactaagcggtgaaataatcctgcattccgttaccactaatctctcttccacgcctttcggacatggcagcaaccaatccgtgcgccaccttaaatactctctgtttaagaaatccctgctcggctcggtgagtgacaacggtatcgtgaccctttgggacgtcaatagtcaaagcccctatcataacttcgactccgttcacaaagcacccgccagtggcatctgtttcagtccagtgaacgagctgctgtttgttactataggactggataaacgcataattctgtatgacactagcagcaagaagttagttaaaacattggtcgccgacactccactcaccgctgtggactttatgcccgatggcgccactttggcaattggctcttcgagaggtaagatctatcagtatgatctccgtatgcttaagtctccagtcaagacaatcagtgctcacaaaacctcagtccaatgcatagcctttcagtatagtacagtgttaaccaagagctctctgaacaagggatgctcaaataaacctaccactgtcaataaaaggtcagtcaacgtcaacgctgcctctggcggcgtgcagaatagtggcatagtgagggaagccccggcaacctccattgctaccgtgctcccccagcctatgacgagcgcgatgggcaaaggaacagtagccgtccaagaaaaggccggcctgccccggtcgatcaatacagatacactgtccaaagagaccgacagcggaaagaaccaggacttttcttccttcgacgatacaggcaagagctctctgggagacatgttttctccaattcgggacgatgctgtagtaaacaagggtagtgacgagagtatcggaaagggcgatggttttgactttctgccccagctaaatagcgttttcccacctaggaagaaccctgtgacatctagtacctccgtgctgcacagtagccccttgaatgtgttcatgggctcccccggtaaggaggaaaatgaaaatcgggatctgacagcggagagtaagaaaatttatatggggaaacaggagagcaaggactcctttaaacaacttgccaagctggtcacctcaggggctgagtcgggaaacttaaataccagcccttcttccaaccaaactcgcaacagcgagaagttcgaaaagccagaaaacgagatcgaggcccagcttatctgcgagcccccgatcaatgggagtagtacaccgaaccctaaaatcgcaagcagcgtgaccgcaggagtggctagctcactgtctgagaaaattgccgatagcattggcaacaaccggcagaatgcaccccttacatcaatacaaatccggtttatacaaaatatgatccaggagacccttgacgactttcgagaagcatgccaccgggacattgtgaatctgcaagtagagatgattaagcaattccatatgcagctgaatgagatgcacagtctgttagaacggtacagcgtaaacgagggccttgtagccgagattgaaagattgcgagaagagaataagagactgcgcgcccacttctag

SEQ ID NO: 126046 - DNA, 3744 bp, Artificial Sequence
  Description of Artificial Sequence: Synthetic coding sequence
atggcacagtctttacgactgcattttgccgccagaaggtctaatacttatcccctgtcggaaacttccggggacgatctagattctcatgtgcacatgtgtttcaagagacctacccggatatccacaagcaacgtcgtacagatgaaactgacccctaggcagactgcactggcgcccctaattaaggaaaacgtacagagccaggaacgctctagcgtgcctagctcagagaatgtcaataagaaaagcagctgtctgcagatctctcttcaacccacccgttatagtggctacctgcaatcctccaacgtgctggctgatagtgatgatgcgagcttcacatgtattttgaaggatggcatatatagctccgccgtcgtcgataacgagttgaatgcggtcaacgatggacatctcgtgtcgtctcccgccatctgctcagggagcttgagtaatttttccacatctgacaacggatcctacagcagcaatggttctgatttcggatcatgcgcttcaattacctctgggggcagctatacaaattcagtgatttccgactcctcatcttatactttcccacccagtgatgatacattcctgggcggcaatctgccttcggactcgacctctaatcggtctgtgcccaacagaaatactaccccctgtgagattttttcgaggtctactagcacagacccattcgtccaagatgatctggaacacgggctcgagattatgaagctccctgtaagtcggaacaccaagattcccttgaagcgttactcatccttggtcatttttcccaggtccccatcgactacacggcccacgagtcccacctccctctgtacccttctgtctaaaggtagctatcaaaccagccaccaattcattatctctccatcagaaatcgcccacaacgaagatggaacctccgctaaaggcttcctgagcacggctgttaacggtctgagactgtcgaaaactatctgcacccccggcgaggtgcgggatatccgtccattacatcgaaaaggtagtctccaaaagaaaatcgtgttgtctaataataccccacggcaaactgtctgcgagaagtcttctgagggctattcctgcgttagcgtgcatttcacccagagaaaagccgcaacactagattgcgagactactaacggtgattgcaaacctgagatgagcgaaatcaagctaaatagcgacagtgagtacattaaactgatgcaccgcacaagtgcctgtctgccaagttcacagaacgtcgattgccagatcaacatcaatggcgagctcgaaagaccacacagccagatgaataaaaaccatggcatcctgcggcggtctattagtctgggcggagcctaccctaatatctcctgcttaagctctctgaaacacaattgcagtaagggcggcccatctcaactgctcatcaagtttgcctccggaaacgagggaaaagtggataatcttagcagagattccaaccgggattgcacgaacgagctgtcaaattcctgcaaacccggatgggttgtcttggatcagccagatgctgcctgtcaccttcagcagcagcaggaacccagtccactgccccccgggtgggaagagcggcaggatattctgggcagaacatactacgtcaaccacgagagtagaagaactcagtggaaacgacccacaccccaagataacctgactgatgccgagaatggcaatattcagctgcaggcgcagagagccttcactaccagacgtcagataagtgaagagacagagtcagtggacaatcgcgagagtagcgaaaactgggaaatcattcgagaggatgaggctacaatgtactcaaaccaggccttccccagtccaccgccatctagtaatctggatgtccccactcatctcgccgaagaactgaatgcaaggttgactatcttcggcaattctgctgtgtctcagcccgcatcgagttctaatcattcaagccgtaggggatctcttcaagcgtatacgtttgaagaacagcccaccctgcctgtgctgttgcctactagttccggtttgcccccaggctgggaagaaaaacaagacgaaagggggaggtcatattatgtggaccacaatagcagaacgaccacctggacgaagcctaccgttcaggcgaccgttgagactagtcagttaacaagcagccagagctccgctggtccccaatctcaggcctctaccagtgactcaggacagcaagtcacacaacccagtgagattgaacagggtttcctgcccaagggctgggaagtgcgccacgcccctaacgggcgacctttcttcatcgatcacaacacaaagacaacgacgtgggaggacccacggctgaagatcccagcgcatttgagaggtaagacctcgctcgacacatctaacgatctggggcctctacctccaggctgggaagagcggacccacaccgatggccggatcttttatatcaatcataacatcaaacggactcagtgggaagatccccgtctagagaatgttgcaattactgggcctgctgtgccatattccagggattataagaggaaatatgaattcttcaggcggaaattgaaaaagcagaacgatatcccaaataagttcgagatgaaacttcgcagagcgaccgtgctcgaagactcctataggagaatcatgggggtcaagcgggccgacttcctgaaagcacgactgtggattgagtttgatggtgaaaagggccttgattacgggggcgtcgctagggagtggtttttcctgatctcaaaagaaatgtttaatccctattacggcttgttcgaatactctgctaccgacaattacactcttcagatcaacccgaacagcgggttatgcaacgaagatcacctatcctattttaaattcatcggaagggtcgcggggatggctgtgtaccacgggaagctcttggacggcttctttatcagaccgttctacaagatgatgcttcataagccaattacgcttcacgatatggagtcagtcgatagtgaatattacaattctctcaggtggatactggagaatgatcctaccgaactcgaccttcggttcatcatagacgaagaactgttcggccagacccaccaacacgagctaaaaaacggcggctcagagatagtggtcaccaataaaaataaaaaagagtatatatatctggtcatccaatggagatttgtgaatcgaatacagaagcagatggcagcttttaaggaggggttttttgagcttataccacaggacttgattaaaatcttcgatgagaatgagctcgaactgcttatgtgcggacttggagacgtggatgtcaacgactggagggagcacaccaagtacaagaatggctattccgcaaaccatcaggtcatccagtggttctggaaggcagtgctgatgatggatagcgagaaaagaatccggctgctgcagttcgtgaccggaacaagccgcgtgcctatgaacgggtttgctgaactgtacgggtccaatggaccgcaaagctttaccgtggaacaatggggcacacccgagaagctgccgcgagcgcatacctgctttaaccggcttgatctgcctccttacgagtcctttgaagaattgtgggacaaacttcaaatggccatcgagaatactcagggcttcgacggggtggactag

SEQ ID NO: 126047 - DNA, 2703 bp, Artificial Sequence
  Description of Artificial Sequence: Synthetic coding sequence
atggctacttgcgccgtcgaggtgttcggtctcctcgaagacgaggaaaattcccgcattgtgagagtcagagttattgccggcatcggcctcgccaaaaaagacattctcggtgcctcagatccttacgtcagagttactctgtacgacccgatgaacggcgtgctgacttcagtgcagacgaagaccataaaaaagtccctgaatccaaagtggaacgaagagatcctgttcagagtgcaccctcaacagcacaggctactgttcgaggtcttcgatgagaaccgactgacacgggatgacttcttaggtcaggtggacgtgcccctatacccgctgcccactgagaacccgcggctcgaacgtccttacacttttaaagactttgtacttcatccacgtagccacaaaagccgggtgaaaggataccttagactgaaaatgacgtatcttcctaagacctctggcagcgaagacgacaatgcggaacaagcagaggaactggagccaggatgggtcgtgctcgaccagcccgacgccgcgtgccatttgcagcagcaacaggagccttcccctctgcctcctggatgggaagagagacaggatatactgggccgcacctattacgttaaccatgaaagccgccgtacccaatggaagaggcccacaccacaggacaacttaacagatgctgaaaatgggaacatccagctccaggcccaacgggcttttaccactaggcggcagattagcgaggagacagaaagcgtcgacaatcgcgagagctccgagaactgggaaattatcagagaggacgaggctacaatgtacagcaatcaggctttccccagtccccctccctcctcaaacttggatgtacccacccatctggctgaagagttaaacgctcgactgaccatattcgggaattccgccgtcagccaaccggcatcaagttcaaatcatagttcacgtagaggaagcttgcaggcctacaccttcgaggaacagcctacactgcccgtcctgctacccacctctagcggcctaccgcccgggtgggaggagaagcaggacgagaggggaagatcctactatgtcgatcataattccaggactactacatggacaaagccaaccgtgcaggccacagtggagactagccagttgacaagttcgcagtcaagcgcaggaccccagtctcaggcctctacatctgatagcgggcaacaagtgacccagccctcagagatcgagcaagggttcctgcccaaagggtgggaggttcgtcacgcccctaatggtagaccatttttcattgaccacaataccaagactacaacatgggaagatcctcggctgaagatccccgcccaccttcggggaaaaacatcactggacactagcaacgacttgggcccactgcctcccggctgggaggaacggactcacacagatggtagaatcttctacatcaaccacaacattaagcgcacccagtgggaagaccctcgcctcgaaaacgtagccattactgggccagcggtgccctactcccgggattacaaacggaaatacgaattctttaggcgtaaactgaagaaacagaatgacattcccaataagtttgagatgaagcttagaagggcaactgttctagaagactcgtataggagaattatgggtgttaagagagcggatttcctgaaagctagactctggattgagttcgatggtgaaaagggtctggattacgggggcgtagcaagagaatggttttttctcatatccaaagagatgtttaatccatattatggcctcttcgagtattccgctactgacaactatacacttcagataaatcccaacagcggtctctgtaatgaagaccatctgagttactttaagttcatcgggagggttgcgggcatggcagtgtaccatgggaagttgctcgatggattcttcattagacccttctacaagatgatgttacacaagcctatcacactacatgatatggagtcagtagatagcgagtattacaactccctgcgctggatcctggaaaacgaccctaccgaacttgaccttcgcttcataattgatgaggaactgtttggacagacgcatcagcacgaactgaagaatggcggttccgagattgtcgttacaaataagaacaagaaggagtacatttacctagtgatccagtggcgattcgttaatcggatacaaaagcagatggctgcctttaaggaaggctttttcgaattgatacctcaagatctgataaagatttttgacgaaaatgagctggaactgttgatgtgtggcctcggcgatgtggatgtcaacgactggcgcgagcacactaaatataaaaacgggtactccgccaatcaccaggtaattcagtggttttggaaagccgtgcttatgatggatagcgaaaaaaggatccggctcttacagtttgtgacaggtacgtctcgggtgcctatgaatggctttgcagagctctatggttctaacgggcctcaatcttttacggttgaacagtggggaacaccggagaaactccccagagcacatacatgcttcaataggctagatttacccccctacgagtcctttgaagagttgtgggataagctgcagatggctatagagaatacacaaggtttcgacggagtggactag

SEQ ID NO: 126048 - DNA, 3912 bp, Artificial Sequence
  Description of Artificial Sequence: Synthetic coding sequence
atggcccaatctctccgactgcatttcgctgcaaggaggtctaatacctatcccctttccgagacatctggtgatgacttggatagtcatgtgcacatgtgcttcaaacggccaacacggatatcgacatcaaatgtggtgcagatgaaactgacgcctagacaaactgccctggctcctctgattaaggagaacgttcaatcacaggaaagatcgtcggtgcctagctccgagaatgtaaataaaaaatcttcgtgtctgcagattagcctccaaccaactcgctacagcgggtacttgcaaagctcaaatgttctcgccgacagcgacgacgcttctttcacctgcatcctgaaggatggcatttacagctctgctgtcgtggacaacgaactcaatgccgtaaacgacgggcacttagtaagctctcccgccatatgcagcggcagcctgtctaactttagcacaagcgataatgggtcctatagcagtaatggaagtgacttcggctcttgtgcctcgatcacatccggtggctcctacacgaacagtgtgatatcggattcctcatcctacacttttccaccttccgatgacacctttttaggggggaatctccccagtgacagcacgtccaatagatcggtgcctaatcgtaatactaccccttgtgagatcttctccaggtccacctcaaccgatccgtttgtccaggatgatttggagcatggcttagagatcatgaagctgccggtgtctaggaacaccaagatcccactgaagcgatacagctcactcgtgatttttccaaggtccccctctaccactaggcccacctctccaactagcttgtgtacactactatctaaggggtcatatcagacaagtcatcaatttataattagtccttctgaaatcgcacacaacgaagatggcactagcgccaaaggttttctatccaccgcagtaaatggtctgcgcctgtcaaaaacaatctgcacgcccggtgaagtgagagacattcgcccgttacaccggaaggggtcactgcagaagaagatcgtgctctccaataatacgccacggcagactgtgtgtgagaaaagctctgagggttactcatgtgttagtgtccattttactcagagaaaggccgcgactctggattgtgaaaccacaaatggggactgtaagcccgaaatgagcgaaattaaactcaattcggattctgagtatatcaagctaatgcaccgcacatccgcatgtctaccatcgtctcagaacgtggattgtcagattaatattaacggcgagttagagcggccacactcgcagatgaataaaaaccatggaatactgagaaggagcatcagtcttggaggggcatatccaaatatctcctgtctctccagtttgaaacacaactgttctaagggcggtcccagccagctgctcataaaatttgccagtggaaacgagggcaaggttgacaaccttagtcgggactctaacagagactgcaccaatgagttgtctaactcatgcaagacacgagatgattttctggggcaagtggacgttcccctgtatcctctccctacagaaaaccctcggttagaacgcccatatacatttaaggactttgtcctccacccacggtcgcataaaagccgcgttaaaggttatcttcgactaaaaatgacttatttgcccaagacctccggttctgaagacgacaatgccgagcaggcagaggagctggaacagcaacaggagccatctccactcccacccgggtgggaagagcgccaggatatcctgggaaggacatactacgtgaatcacgaaagtcgcagaacacagtggaagcgacccacccctcaggacaatctgaccgatgcagaaaacgggaatattcagcttcaggctcagcgtgcctttaccacaagacgacagatctccgaagagactgaatcggtggacaatagagaatcctctgaaaattgggagatcatccgagaggatgaggccaccatgtattcaaatcaagcctttccaagtcctcccccttccagtaatttggacgtgccaacacatctggcagaggagttaaacgctcgacttaccattttcggcaactcagcagtgagtcagccagcatcttcttctaaccactcctctaggcggggcagtctgcaggcgtacacatttgaagagcagccaactctgcccgttctgctcccaaccagtagcggcctccccccaggctgggaggagaagcaggacgagcggggcagatcctactatgtggaccataactcccgcacaaccacttggaccaaaccaaccgtgcaggccactgttgagacctctcaattgaccagctcgcagtcctcggccggccctcagtcccaggcatcgacctctgatagtggccaacaggtgacacaacccagtgagatcgagcaggggttcctaccaaagggctgggaggtaagacatgcacccaacggacggcccttctttatagaccacaacaccaaaacgacaacgtgggaagatccgcgattgaaaatacccgcgcatctgagaggcaaaacctctttagatacttccaacgatctagggccactcccacctgggtgggaggagcgtacacacacagacggacgtattttttacattaatcacaacattaagcgaacccagtgggaggatcccagactcgaaaacgtggctatcaccggccccgcggtaccctacagcagagactacaagagaaagtacgaatttttccgacgcaagctcaaaaagcagaacgatattcccaacaaattcgaaatgaagcttcggcgggcaaccgtcctcgaagacagttacaggcgaatcatgggagttaagcgcgctgatttcttgaaggctaggctgtggatcgaatttgacggcgaaaagggtttggactacgggggagtggctagagagtggtttttcctgatatctaaagagatgttcaatccctattacgggctcttcgaatattcagctacagacaattatactctgcagatcaaccctaactcaggcctgtgcaacgaggaccacttatcttacttcaagtttatcggacgggtcgcagggatggctgtatatcacggtaagttgttagacgggtttttcatcaggccattttataagatgatgctgcacaagcccatcacactgcacgacatggaatctgttgattcagaatactataactcactccgctggatactggagaacgaccctactgaattagacttacggttcatcatcgatgaagaactcttcggccagacccatcagcatgagctgaaaaacgggggctccgagatagtagttactaataagaacaaaaaggagtacatctatttggttattcagtggaggttcgttaacagaatccaaaaacagatggccgctttcaaagagggttttttcgagttaattcctcaggaccttatcaagatcttcgatgagaatgagctggaactgctaatgtgtggcctgggcgacgtggacgtgaacgattggcgggaacacactaaatacaagaacggatacagtgctaatcatcaggtaatccagtggttctggaaggccgtcctgatgatggactctgagaagaggatcagactcttgcagtttgtgactggaacctctcgcgtccctatgaatggatttgctgagctgtatggatccaacggtccacagagcttcactgttgaacaatggggcacacccgaaaaactccctcgggcccatacttgtttcaatagactggatctaccaccttatgagagctttgaagaattgtgggacaaactacagatggcaattgaaaacactcagggtttcgacggggtagattag

SEQ ID NO: 126049 - DNA, 3960 bp, Artificial Sequence
  Description of Artificial Sequence: Synthetic coding sequence
atggctcagtctctccggttgcatttcgcggcccgcaggtcaaacacctaccctttatctgaaacaagcggcgacgatttagatagccacgttcacatgtgcttcaaacgcccaacccgcatctccacctccaacgtcgtgcaaatgaagctcactccaaggcagactgcgctggcccctctcatcaaggagaatgtgcaatctcaagaacgttcgtctgtgcccagcagcgaaaacgtgaacaagaagtcgtcctgcctccagattagcctgcagccaacacgatattctggctatctccagtctagtaacgtgctcgcggacagcgacgacgcttccttcacttgcatcttaaaagacgggatttactcctcagccgttgttgataatgaactgaacgccgtcaatgacgggcacctggtatctagccctgccatatgcagtggatctttgagcaacttcagcacttctgacaacgggagttactctagcaacggctccgatttcggctcctgcgctagcattacgagtggcggaagctatacgaattcagtcatcagcgattcctccagctacacgttccctcctagtgacgacacattccttggaggaaaccttccctctgattccacgagtaacaggtcagttccaaacaggaatacgaccccgtgtgagatctttagccgctctacttcaaccgaccccttcgtgcaagatgacttggagcacgggttggagatcatgaaactgccggtctcaagaaacacaaagattcctctgaagcgttactcaagcttagtgatctttcccagatcaccttccacgactcggcctacatcaccaactagcctttgcacgctgctcagcaagggaagctaccagacatctcaccagttcattatttctccttccgaaattgctcacaacgaggatgggacatccgctaaggggtttctaagcacagcggtaaatggcctgaggctttccaaaacgatctgcacccctggggaggtgcgggacattcgtccgctgcacagaaagggatctctccagaaaaagattgttcttagtaacaatactcctcgccagacagtgtgcgaaaagagttcagagggctacagttgtgttagcgtgcacttcacccagcgcaaggcagctaccttggactgcgaaactaccaacggggactgtaagcctgaaatgagcgaaataaaactaaatagcgatagcgagtatattaagcttatgcatcgaactagtgcctgtctacccagtagccagaatgtcgattgtcaaattaacatcaacggggaactcgaaagacctcactcacaaatgaacaaaaaccacggcatattgcgccggagcattagcttggggggggcctaccccaatatatcttgtctgtcctctcttaaacacaattgttctaagggcgggccatcccagctgttgattaaatttgctagtggcaacgagggaaaagttgataacctatccagggatagcaacagggattgtaccaatgaacttagcaattcttgcaagacgagagacgatttcctcgggcaggttgacgtgccgctgtaccctctccccacagagaatccccggctcgagcgtccttatacattcaaggactttgtgcttcatcctagatctcacaaaagccgcgtgaagggttacctgcgcttgaaaatgacctatctgcccaaaacgagcgggagtgaggacgataacgcagagcaggcagaggaactcgaaccaggttgggtggtcctcgaccagcctgatgcggcctgccacctacaacagcaacaagagccctcacccttgcctcccggatgggaggagcggcaggatatcctcgggaggacttactacgtgaatcatgaatcaagaaggacccagtggaaacgacccactcctcaggataatctcactgacgcagaaaatggaaatatacaattacaggcacagcgggccttcaccacccgtcggcagattagcgaagaaaccgaatccgttgacaaccgcgaatctagtgaaaactgggaaataatcagggaagacgaggccacaatgtattccaatcaggcctttccatcacctcctcccagttcaaacctggacgtccctacccaccttgccgaggaactgaacgccagactcaccatatttggtaactcagccgtaagtcagcctgcgagttcttctaatcacagctccagaaggggtagcttgcaggcatataccttcgaagagcagcctactttacccgtgctccttcccacttcttcaggcttaccaccaggctgggaagaaaaacaggacgaaaggggtcgctcttattacgtggaccacaattctcggacaactacatggaccaagccaacagttcaagccaccgttgagacttcccagctcactagtagccagagttctgccggccctcagtcccaggcttccaccagtgattccggacagcaggttactcagccaagcgaaattgagcaggggttcttgcccaagggctgggaagtgaggcacgctcccaacgggcgccccttttttatcgaccacaatacaaagaccacaacctgggaagaccctcgtttaaaaattcccgcccacctgcgcggcaaaacttcattagacacctctaacgacctgggtccactgccaccaggatgggaggaaagaacacatacagacgggaggatcttctatattaaccacaatatcaaacgaactcagtgggaagaccctaggttggaaaatgttgcaatcacaggcccagccgttccctattcgcgagattacaaacgcaagtacgagttcttcagacggaagctcaaaaaacagaacgatattcctaacaaattcgagatgaagctgaggcgggctacagtgcttgaagactcctatcggaggatcatgggggtgaaaagagcagactttctcaaggcccgattgtggattgagttcgacggggagaaaggcctggattacggcggcgtcgcacgggaatggttctttctcatctctaaggagatgtttaacccgtattacggcctttttgagtactctgcgactgataattatacacttcagatcaatccaaatagcggcctctgcaacgaagatcacctttcttacttcaagtttataggaagggtggcgggaatggccgtgtaccacggcaaactgctagacggctttttcataagacccttctacaaaatgatgctccacaagcccattactcttcatgacatggaatcagtcgatagtgaatactataacagtctgcgttggatcctcgagaacgaccctactgaacttgacttacgctttatcattgatgaggagctatttggccagactcatcagcatgagctcaagaacggaggttccgagatcgtggtcactaacaaaaacaaaaaggaatatatttacctcgtgatccagtggcgctttgtgaataggatccaaaaacagatggccgcatttaaggaaggcttttttgagttaatcccccaggacctcattaagatcttcgacgagaacgaactggagttgctcatgtgtggtctgggtgatgtggacgtgaatgactggagggaacacacaaagtacaaaaacggatacagtgcaaaccaccaagtaattcagtggttttggaaggccgtcctcatgatggactctgaaaagagaatcaggctattgcaatttgtgacagggacgtcgcgggtgcctatgaacggtttcgccgagctgtatggaagtaacggaccccaatcattcactgttgagcaatgggggactccagaaaagttgcctagggctcacacatgcttcaacaggctcgatctcccgccttatgagtcctttgaagagctttgggacaagctgcagatggcaattgagaatactcaggggttcgatggagtggattag

SEQ ID NO: 126050 - DNA, 2616 bp, Artificial Sequence
  Description of Artificial Sequence: Synthetic coding sequence
atggccactggcctgggcgagcccgtttatggcctctctgaagatgagggggagtcgaggatcctgagagtcaaagttgtttccggaatagatctggcaaagaaagatattttcggcgcctccgacccgtacgtgaaactatctctttatgttgccgacgagaacagggagctggctcttgtgcagaccaagaccattaagaaaactctaaatccaaaatggaatgaggaattctactttcgtgttaatccctctaaccatcgactgctcttcgaggtgttcgatgagaatcgcctgaccagagatgactttctcggccaggtcgacgttccactgtcacatctgcctacagaagatcctaccatggagcgaccttatacgtttaaggattttctgctgcggcctaggtctcacaaaagccgggttaagggatttctcagacttaaaatggcttatatgcctaagaacggcggccaggatgaggagaacagcgaccagagagacgacatggaacatggatgggaagttgtggattcaaatgatagcgcctctcagcaccaggaggagttgcccccaccccccctgcccccaggctgggaggagaaggttgacaacttgggaagaacctactacgtgaaccacaataatagaacaacgcagtggcacaggccaagtctcatggacgtgtccagtgagtctgacaacaacattagacagattaaccaggaggcggcgcatcgacggttcaggtccaggcggcacatcagcgaagaccttgagccagaaccaagtgaaggtggagacgtccctgagccctgggagaccatcagcgaagaggtcaatattgccggcgattcgctgggattggctcttccacctccaccagcgtctcccggtagtcgcacctctcctcaggaactgtcagaggagctatccaggagacttcagataactcccgatagcaacggtgagcaattttcctcccttatccagagggagccttcttcccgattgcgcagctgttctgtgactgatgcagttgccgaacaggggcatctccccccgggtgctaaggacagtccagtgcgacgggccgtgaaggatactctgtctaacccacagagccctcaaccctccccttacaattcccccaaacctcaacataaggtaactcagtcctttctgccaccagggtgggaaatgagaatcgctcccaacgggaggccctttttcatcgatcacaatacaaagacgactacgtgggaggatcctagactcaagttcccagtgcacatgcggagcaaaaccagtttaaatcccaatgatctcgggccattgccaccaggatgggaagagcgtatacacttggatggtcgcacgttctacattgaccacaatagcaagatcacccaatgggaggacccacggcttcagaatccagctattacaggccccgccgtgccatattcccgcgagtttaaacagaagtatgattattttagaaagaaactgaagaaacctgcagatatccctaatcgattcgagatgaagctccacagaaataacatctttgaggagagctacagacgtattatgtccgtcaagagacccgatgtgctgaaagcaaggttatggatcgagtttgaaagtgagaaaggccttgactacgggggcgtcgctcgggaatggttcttcctgctaagtaaagagatgtttaatccatattacgggcttttcgagtattctgctaccgacaactatactcttcaaataaatccaaatagcggcctatgcaacgaggatcacctgtcgtactttacatttatcggtcgggtggcaggcttagctgtgttccacggtaagcttttagatggctttttcattagacccttctacaaaatgatgctcgggaagcagatcaccctcaatgatatggagagtgttgactctgagtattataattccctaaaatggattctggaaaatgacccaaccgaactggatttgatgttctgcatagatgaagagaactttggacaaacctaccaggttgacttgaagcccaacgggagtgaaataatggtcaccaacgaaaacaaaagggagtacatcgacctcgtgatacaatggaggttcgtaaatcgtgtacaaaagcagatgaacgccttcctggaagggttcactgagctcttacccatcgatctcataaagattttcgatgagaacgaactcgaattactgatgtgcggactcggggatgtcgacgttaatgactggaggcagcactcgatctataaaaatggctactgccccaatcacccagtgattcagtggttctggaaggcagtactcctgatggacgcggagaagagaatccggttattgcagttcgtgaccggcacctcccgtgtccccatgaacggctttgccgagctgtacggtagcaatggccctcagctctttaccatcgagcaatggggttccccagaaaagctcccaagggcccatacttgtttcaaccgtcttgatctcccaccttacgagacgtttgaggatcttcgtgagaagctgctaatggcggtggagaacgcacaaggttttgagggcgtggattag

SEQ ID NO: 126051 - DNA, 2508 bp, Artificial Sequence
  Description of Artificial Sequence: Synthetic coding sequence
atggagcggccctatacgtttaaggacttcttgctcagacctcgctctcataagtcccgagttaagggcttcctcagactaaagatggcttacatgccgaagaatggcggccaggacgaagaaaattccgatcagcgcgacgacatggagcacggctgggaggtggtggattcgaacgattccgcttctcagcaccaggaagaactgccacctcctccattgcccccaggatgggaggagaaagtggacaatcttggtcggacttattatgtcaatcataacaatcgtaccactcagtggcaccgcccttccctgatggacgtgagttcagagtcagacaataacataaggcagattaaccaggaagcagctcatagacgatttcggagccgcagacatatctcagaggacttggagcccgaacccagcgagggcggcgacgtacctgaaccttgggagacaatatcagaggaggtgaacatcgctggtgactctttgggactcgcactgccaccgccccccgcttcccccggcagtcgaacatctccccaggaactatccgaagaactgtcgcgtcgcctccaaattacccctgattccaacggtgagcagttctcgtcgctgatccaacgggagccaagctctagacttcgaagctgctccgtgaccgatgctgtcgctgagcaggggcacttgccacctcccagcgttgcctacgtgcatactactcctggcctgccctcaggctgggaagagcgcaaagacgctaaaggtcgcacttactatgtgaatcacaacaatcgtactacgacctggacacgacctattatgcagctggccgaagacggggcctcaggtagcgcaacaaattcgaacaatcacctgatagagccacagatccgacggcctagatcactcagctcccctacggttaccttgtccgctcccttggagggcgccaaagatagtccagtgagaagagcagtcaaagatacactgtcaaatccacagtcacctcagccctctccctacaacagtcccaagccacagcataaagttacacaatcatttctgccacctgggtgggaaatgagaattgccccaaacggcagaccttttttcattgaccacaacactaaaaccacaacatgggaggatccaagactcaagtttcctgtgcatatgcgaagtaaaacatccctcaacccaaacgatttgggacccctgcctcctgggtgggaagagcggattcacctagatggacgcacgttctacatcgaccacaactccaagatcacacagtgggaggacccccggcttcagaaccccgctatcacaggacctaaagcggtgccgtactctcgggaattcaagcaaaagtacgactatttccggaaaaagctcaaaaaaccagccgatattccaaataggttcgagatgaaactccacagaaataacatatttgaagaatcctacaggcgcattatgtcggtgaaacgtcctgacgttctgaaggctcgcctttggattgaattcgaatccgagaaagggcttgattatggtggagtggctagagaatggttttttctgctatccaaggagatgtttaacccgtactatggactcttcgagtacagtgccaccgataactatactctgcaaataaatcccaatagtggattgtgcaatgaggatcacctgtcttacttcacgttcatcgggcgggtagcaggcctcgctgtctttcatggcaaacttctcgacgggttctttattcgacctttctataaaatgatgctgggaaagcaaatcactctgaatgacatggaaagtgtggacagcgagtattacaattccctaaagtggatcctcgaaaacgatccaactgagctagatttgatgttctgcattgatgaagagaactttggccagacctaccaggtggacctaaagcccaatggatcggagatcatggtgaccaatgaaaataaacgggagtatatcgacctcgttatccagtggcgcttcgtcaacagagttcaaaagcagatgaacgccttcctagagggctttaccgagcttcttcccatcgatctgattaaaatctttgatgaaaatgaactggagttgctcatgtgcggcctgggcgacgtggatgtgaatgactggcggcagcactctatttataagaatgggtactgccctaaccaccctgttatacagtggttttggaaggctgtgctgttaatggatgccgaaaagaggattcgactgttgcaatttgttacagggacatcccgtgttcctatgaacgggtttgccgaactgtacggctccaacgggcctcagctgttcaccatcgagcagtgggggtctcccgagaagctacccagagcccacacttgtttcaatcgccttgacttgccgccttatgaaacgtttgaggatctgcgggagaagctactgatggccgtggagaacgcccaggggtttgaaggtgtcgactag

SEQ ID NO: 126052 - DNA, 2736 bp, Artificial Sequence
  Description of Artificial Sequence: Synthetic coding sequence
atggccaccggtctgggagagcccgtctatggcctgtctgaagacgaaggcgaatctaggatattgagagtcaaagtggtgtctgggattgatttggctaagaaggatatattcggcgcctcggacccctacgtcaagctcagcctttatgtagctgacgagaatcgggagctggccctggtgcaaaccaaaaccataaagaagacactgaatcccaagtggaacgaggaattttactttagagttaatccctctaaccataggctcttgttcgaagtgtttgacgaaaaccgcttgacccgggatgactttctgggacaggtggacgttcctcttagtcatttgccgacggaagaccccaccatggaacgaccctacacctttaaggattttctccttcgccctcgcagtcacaagagtcgggttaagggttttctgcgactgaagatggcttacatgcctaagaatggcggacaggatgaagagaacagcgatcagcgagatgatatggagcatggatgggaagtggtggattccaacgacagcgcgtcgcaacatcaggaggagttgcctcctcccccacttccaccaggttgggaagagaaggtggacaacctggggagaacttactatgtgaatcataacaaccgaaccacccaatggcaccgcccgagtctcatggacgtttcatccgagagtgacaataatatcaggcagattaaccaggaggctgcccaccgaagatttaggtcccgtcgccatatttccgaagacctcgaacccgaaccatctgaggggggtgatgtccctgaaccatgggaaacaatctcagaagaggtgaatatcgccggcgattccctcggtctggcactacctccccccccagcgtcccccggcagcagaactagtcctcaggagctgagtgaggagctatcccgccggctccagataactcccgattctaacggggaacagttttcctccctcatccaacgcgagccttcctctcgcttgcgctcttgcagcgtcacagatgcagtggctgagcaggggcaccttcctccactggccgaggacggcgcttcaggatcagccacaaatagcaacaaccatcttatcgagccacagattagacggcctcggagcctttcttcgcccaccgttaccttatccgcacccttggagggcgcaaaggattctccagtgcgacgggcggtgaaggacactctctctaatcctcaatctccccagcctagtccttacaactcccctaaaccccagcataaagtgactcaatctttccttcccccaggctgggagatgcgaatcgccccaaatggccgccccttctttattgaccacaatactaagacaaccacatgggaagatcccagactcaagttccccgttcacatgaggtcaaagacttccctgaaccccaatgatctgggacccttgcctcccggttgggaggaaagaattcatctggatggccgaactttttacattgatcacaactctaagatcacacaatgggaggaccccagactacagaaccccgctataacaggccccgccgttccttatagtagagagttcaagcagaaatacgattactttcggaaaaaactgaagaagccggcagatatccctaatcgcttcgaaatgaagcttcatcgcaataacatcttcgaagaatcatataggagaattatgagtgtcaaacgtcccgacgtccttaaggctaggctttggatcgagttcgagagcgagaaagggttggattacggcggagtcgccagagagtggttttttcttctgagcaaggagatgttcaacccctattacggcctgttcgaatatagcgcaactgataactataccctgcagatcaatccgaactctggactgtgcaatgaggatcacctttcgtactttacctttattggacgtgttgcggggctggctgttttccacggcaaactactggatggctttttcattcgtcccttttataagatgatgcttgggaaacagattacattgaacgatatggagtcagtggactccgagtactacaattccctaaagtggatccttgaaaatgacccaacagagctcgaccttatgttctgtatagatgaagagaactttggccaaacctaccaagtggacctaaaacctaacgggagcgaaatcatggtcaccaacgaaaataagagagagtacattgatcttgtcatccagtggaggtttgtaaacagagtgcagaagcaaatgaacgctttcctggagggattcacagaactgctccctatcgacctgattaagattttcgatgagaacgagttagaactgttaatgtgtgggctgggcgatgtcgacgttaatgattggcgccagcactccatttacaaaaatggctactgtcctaatcacccagtgattcaatggttctggaaggcagtgctgcttatggatgccgaaaaacgtatcaggttgctgcagtttgttaccggaacttctcgtgtcccgatgaatggtttcgcagaattgtatggcagcaatggaccccagctgttcactatcgagcaatggggcagccctgaaaaactcccgcgcgctcatacctgcttcaacagactcgatctaccgccctatgaaaccttcgaagatctacgcgaaaagctccttatggcagtagaaaacgcccagggattcgagggggtggattag

SEQ ID NO: 126053 - DNA, 2904 bp, Artificial Sequence
  Description of Artificial Sequence: Synthetic coding sequence
atgaggcgactggcattcgaacagggggaaagccgcatactgcgcgtcaaggtggtgtccggcattgatctggccaagaaagacatcttcggagccagtgatccctacgtgaagctgtcactatatgtggccgatgagaatcgcgagcttgctttagtgcagaccaaaacaattaagaaaaccctgaatcctaagtggaacgaggagttttactttcgcgtgaatccttcaaaccatcggctcctattcgaggtttttgacgagaacaggctgacacgcgacgacttccttgggcaggtcgacgtcccactttctcatcttccaacagaggacccaacgatggagagaccctacacattcaaggactttctcctgagaccacggagtcataagtctagggtcaagggcttcctgaggctgaaaatggcttatatgccaaagaatggaggccaggacgaggagaactctgatcaacgcgacgacatggagcacggctgggaggtagtcgacagtaatgattccgcctcccagcaccaggaggagctgcccccgccacccttaccccccgggtgggaagaaaaagtcgataacttaggcaggacgtattacgtcaatcacaataatcggaccacccaatggcaccgaccatccttgatggacgtgtctagcgagtctgataacaatataagacagattaaccaggaagccgcccatcgccggttcaggtccaggagacacatttccgaggatcttgagccagagccgtcagaaggcggagatgttccagagccctgggaaaccatttcggaggaggtgaacatcgccggagacagtctcggacttgccctgcctcctccacctgcctcccctggctctagaacctccccccaggagctgtcagaggaattatcccggcgcctccagattactcccgacagcaatggtgagcagtttagctccttgatccaaagggaacccagctcacggctgagatcctgcagcgtgactgacgccgtggccgaacaagggcaccttccaccaccctccgcccccgccgggcgggcccgctccagcactgtgaccggcggcgaggagccaacgccaagcgtcgcctatgtacacacaaccccaggactccccagcggctgggaggaacgaaaggatgctaaaggtcgaacctattatgttaatcacaataatagaacaacgacgtggacaaggcccattatgcagctggccgaagatggtgcctccggttcagcaactaacagtaataatcacctcatcgaacctcaaatacgcaggccgagaagccttagctctcccaccgtgactctgagtgccccccttgaaggcgcgaaggactccccggtcagaagggccgtgaaagataccttatcaaatcctcagtcacctcagccctcaccctacaatagtcctaagccccaacacaaggtgacacagtcatttttgccgcccggatgggagatgagaatagctccaaatgggcgtccctttttcatagatcacaacaccaagaccaccacctgggaggacccgcgattaaagttccccgttcatatgcggagcaaaactagcttaaatcccaacgatttggggccgctgcccccaggatgggaggagagaatccacttggacggaaggaccttctatatcgaccataactctaagatcacccagtgggaggatccaagactgcagaaccctgcgattaccggacccgccgttccttattccagagagtttaagcagaagtatgattacttccggaagaagttgaagaagccagcagacattcccaatcgtttcgaaatgaagctgcacaggaataatatcttcgaggagagctaccggcgcatcatgtctgtgaagaggcccgacgtgctgaaagcccgactatggatagagtttgagtctgagaagggactggactacggaggtgttgcccgggagtggttttttctgttaagtaaggagatgtttaacccttactacggattgtttgagtacagcgccactgataactatacgctgcagatcaatccaaattcagggttgtgtaatgaagaccaccttagctatttcaccttcatcggacgagttgccggcttagccgtgttccacggcaaactcctggatggattcttcatacgcccgttctataaaatgatgctcggtaaacagatcacgttaaacgacatggagagcgtcgactcagaatactataattctttgaaatggatcctggagaacgaccctacagagctggacctgatgttctgcatagacgaagaaaacttcggccagacctaccaggtcgacttgaagccaaatggaagcgagattatggtcaccaatgagaataagcgagagtatatcgatttggtcattcaatggcgcttcgtgaatagagtgcagaagcagatgaatgcatttttagaaggcttcacggaacttcttcctatagacttgattaaaatcttcgacgaaaatgaactggagcttctgatgtgcggcctgggagacgtggacgtgaatgactggaggcagcacagtatttataagaatgggtactgcccaaatcatcctgtgatacagtggttctggaaagcagtgttgctaatggacgctgagaaaaggattcgactccttcagtttgtgaccggcacctcgagagtccccatgaatgggttcgctgagctatatggtagtaatgggccccaactgttcactatcgagcagtgggggagtccggaaaagctgccgagggctcacacttgcttcaatagactcgacctgcctccctatgagacgtttgaggacttgagggaaaaactgttaatggccgtagaaaacgcccaggggtttgaaggcgttgattag

SEQ ID NO: 126054 - DNA, 2868 bp, Artificial Sequence
  Description of Artificial Sequence: Synthetic coding sequence
atggccacagggctgggagagccggtgtacggactctccgaagacgaaggcgagagcaggatcctcagagtgaaagtggtcagcggcatcgaccttgctaagaaggacatcttcggggcaagcgatccctacgtcaagttgagcctgtacgtggcagatgaaaaccgggagcttgctctggtgcaaaccaagaccatcaagaaaactctcaacccaaaatggaatgaggaattttactttagagttaatccctccaaccatcgtctgctgtttgaggtgttcgacgagaatcggcttactcgggacgattttctgggccaggtggatgtgccgctgtcgcacctccccacagaagatcctactatggaacggccgtatactttcaaagatttccttcttaggcccagaagtcacaaaagtagggtgaagggcttcttgcggttgaagatggcctacatgcctaaaaacggtggacaggatgaggagaatagcgaccagcgggacgacatggaacacggatgggaagtggtggattctaatgactcagcaagccagcaccaagaggagctgccccccccaccactgcccccaggttgggaggagaaggtggacaatctgggtaggacatactatgtaaatcacaataacaggaccacccaatggcatcggccgagtctgatggatgtgtcttcagaatccgacaataacatccggcagattaaccaggaggctgcgcacagaaggtttaggtctcggaggcacatcagcgaggatctggagcctgagcccagcgagggcggtgatgtacctgaaccgtgggaaaccattagtgaggaggtgaacatcgccggcgatagccttggtcttgcactcccgccccctcctgcgtcaccagggtcacgtacaagccctcaggaactttctgaagaactgtcaaggaggttgcagattacccccgacagtaacggagagcagttttcatccttgatccagagagagccttcaagccggctccgctcttgtagtgtgactgacgcagtcgctgagcagggccacttgccgcctcccagtgtagcatatgtgcatacaacacccgggctaccttcaggatgggaagagaggaaggatgccaagggaaggacctattacgtcaatcacaacaacagaacgactacctggacccggccaattatgcaactggctgaggatggcgcatctggctcagcgactaattcaaacaaccatctcatcgaaccacagataaggcggccgcgctcactcagttctcccacggtaaccctgagcgcgccattggagggggctaaagattctcctgtgcggcgggcggtgaaagacactctcagcaatcctcaaagtccacagccatctccttacaactctccaaagccccagcacaaagtgacacagtcctttctgcccccggggtgggaaatgcgaatcgcccccaacggtcgtccgtttttcatcgatcacaacactaaaaccaccacctgggaggacccacggctgaaattccctgttcatatgaggtcaaagacctcactcaatccaaacgacctgggaccgctaccccctggctgggaggaaagaatacatctggacgggcgaaccttttacattgaccacaacagcaaaatcacacagtgggaagacccccggttgcagaacccggccatcaccggaccagccgtgccatactctagggagttcaagcaaaaatatgactattttcgtaagaaattgaagaaaccggccgacatacctaacaggtttgaaatgaaactgcatcgtaacaacattttcgaagagagttacagaagaataatgtctgtgaaacggcccgacgttctgaaagcgcggctgtggattgaattcgaatccgaaaagggactggactacgggggagtggctcgcgaatggtttttccttctatctaaagagatgttcaatccatactacggcctgttcgagtattctgccaccgataactacacactgcagattaatcccaattccggcctgtgtaatgaagatcacctgagttattttactttcattggcagggttgcgggattggccgtgttccatgggaagttgcttgacggctttttcattcgcccattctacaaaatgatgctcggtaaacagattacccttaacgacatggagtccgtcgattcagaatattacaactctctcaagtggatcctcgaaaatgatccaaccgagctggacctcatgttttgtatcgacgaagaaaatttcggccagacctatcaggtagaccttaaaccaaatggaagtgagattatggttaccaatgagaacaaacgcgaatatatcgatctggtcatccaatggagatttgtgaatcgggtacagaagcagatgaacgccttcctggagggcttcacagagcttttgccgatagatttgattaagatatttgatgaaaatgaactcgaattgctcatgtgtggcctgggtgacgtggatgtcaatgactggcgccagcactccatttacaagaatggatactgtcccaaccatcctgtaattcaatggttttggaaggctgtactgcttatggatgctgaaaagagaataagactgctgcagttcgtgacggggacatctcgcgtccccatgaacggctttgccgagctctatggcagcaacgggccacagctgttcaccatcgaacaatggggctctccagaaaagcttcctcgtgctcacacgtgttttaataggctggatctcccaccttatgagacattcgaggatctccgggaaaagctgttgatggcagttgagaatgctcagggcttcgagggtgtggattag

SEQ ID NO: 126055 - DNA, 2928 bp, Artificial Sequence
  Description of Artificial Sequence: Synthetic coding sequence
atggccacaggattaggcgagcctgtgtatggactgtcagaggatgagggagaatcacggatccttagggtcaaggtggtttctggtatcgacttggcaaagaaggacatctttggcgcaagcgatccatatgttaaactgtccctgtatgtcgcagacgaaaatcgagaattagcgttggttcagacaaagaccatcaaaaaaactctcaaccctaagtggaacgaagagttctatttcagagttaatcccagcaaccatagactgctgtttgaggtgtttgatgagaatcgcctgacacgtgacgatttcctcggacaggttgatgtccctctgtcccacctcccaaccgaagatcccacaatggagcgaccatacacctttaaggatttcctgctccgtccgcgctcgcataagagccgagtgaaaggcttcctaaggcttaagatggcgtacatgccaaaaaatggcggacaggatgaggaaaattccgatcagagggacgatatggagcacggttgggaagtggttgactccaatgacagtgcctctcagcaccaggaggaacttccccccccgccgctcccgccaggctgggaagaaaaagtcgataatttaggacgcacttattatgttaaccacaacaaccgaacaactcaatggcacaggccatctcttatggacgttagttccgagagtgacaacaatattcggcagatcaatcaggaggctgcccatcgtaggtttagatctcggagacatatcagcgaggacttagagcctgagccaagtgaggggggcgacgtgcccgagccctgggagaccatcagcgaagaagtgaacattgcgggcgactctttgggcctggctctgccaccaccgcctgcatctccggggagtcgcacaagtccccaggaactgtcagaggaattgtctcgaagacttcagattacaccagattctaatggagagcaatttagcagtctgattcaacgtgagcccagcagcaggctaaggagttgttccgtcacagacgctgtcgccgagcagggccaccttcctccaccaagcgcgcctgctggcagagccagatcatctacagttactgggggggaggaaccaactcccagtgtggcctacgtacataccacacctggtctgccatccggatgggaggagcgaaaggacgccaaaggaaggacatattatgtaaaccacaacaaccgcacgaccacgtggacccgaccaattatgcagctcgcagaggacggcgcctcaggatctgctaccaatagcaataaccatttgatagagccccagatccgacgtcccagaagcttgtcttcccccaccgtgacactgtctgcccctttggaaggcgccaaagactcaccagtacggcgggctgtgaaggatacactatctaaccctcaatccccccagccctctccttacaactctcccaagcctcaacacaaggtgacccagtctttcctgccaccagggtgggagatgagaatagcaccaaacggaagaccattctttatcgaccacaacaccaagacaaccacctgggaggatccaagactcaagttccctgtgcatatgcgctctaaaacgtcacttaaccccaatgatctcggccctctccccccagggtgggaagaacgcattcatttggatgggagaaccttttacattgatcataacagcaaaataacgcagtgggaggacccacgcctacagaatccagccattactggacccgcagtgccttacagccgagagtttaaacagaaatacgactacttccggaagaagctaaaaaaacccgctgatattcccaatcggttcgagatgaagctacaccgaaataatatctttgaagagtcctatcggaggatcatgagcgtgaagaggcccgacgtgctgaaggccagactttggatcgagttcgaatccgaaaaagggcttgactacggaggggtggcacgcgagtggttctttctactatccaaggagatgttcaatccgtattacgggttgttcgaatactcagccactgataactacaccttgcagattaaccccaactctggtttgtgtaatgaagatcatctttcctatttcacattcatcggtagagtagcagggctggctgtctttcatggaaagcttctggatggtttcttcataaggccattctacaagatgatgttgggcaagcaaatcacgctgaatgatatggagagcgtggactccgagtactataacagtctgaaatggatcctggagaatgatcccacagagctggacctcatgttttgcatcgacgaggaaaatttcgggcagacctatcaggtcgatttgaaacctaacggcagtgagattatggtcaccaacgaaaataagcgggaatacatcgatctggttattcaatggcggtttgtgaacagagtgcagaagcagatgaacgcctttctggagggatttacagaattgctgcctattgatctcataaagatcttcgacgagaacgagcttgagcttctcatgtgtggactgggggatgtcgatgttaatgactggaggcagcattccatttataagaacggatattgtccaaaccaccccgtgattcagtggttttggaaggctgttctgttgatggatgctgaaaagaggatcagactgctgcagtttgtcacaggcacaagcagggtgcccatgaacgggttcgccgagctttatgggtccaatgggccacaactctttactatcgagcagtgggggtctcctgaaaaactgcctcgggcccatacgtgttttaaccggcttgacctccccccctatgaaacattcgaggacttacgggagaaattgctaatggcggtggagaatgcccagggattcgaaggcgtagattag

SEQ ID NO: 126056 - DNA, 2565 bp, Artificial Sequence
  Description of Artificial Sequence: Synthetic coding sequence
atggagcgaccctacaccttcaaggactttctgctgcggcctcgatcacataagtcacgcgtgaaaggctttctccgcctcaaaatggcttatatgcccaagaatgggggccaagacgaggagaatagcgaccaacgagacgacatggaacacggctgggaggtcgtggattctaacgattcagctagccagcaccaggaggaacttccacctcctcctctgcctcctggatgggaagagaaagtagacaacctgggacgaacctattacgtaaaccacaacaacaggaccacacagtggcacagaccgagcttgatggatgtgtcatccgaaagtgacaacaatatccgccagatcaaccaggaggcagctcacaggcgcttccggtccaggcgtcatatttctgaggaccttgagcctgaaccttctgaggggggcgacgtccctgaaccttgggagaccataagtgaggaagttaatatagctggagattctctcggactggcactgcctccgccaccagcatctcccgggtcgcggacgtctccacaggagctgagcgaggagctgtcgcggcggcttcagattacacctgattctaacggcgaacaattttcaagcctgattcaaagagagccatcctcacggctgcggtcatgcagcgttactgacgccgtcgccgaacaggggcacctgcctccccctagtgcccctgctggccgggcgcggtcctctactgtaaccggcggcgaagagccaactccgtcagtggcctacgtccacacaaccccgggacttccctcaggctgggaagaaagaaaggatgcgaagggccgaacatactacgttaaccataataatcgaaccacaacatggaccagacccatcatgcaactggctgaggatggggcatccggttccgccacgaactccaacaaccatctgatcgagccacagatcagacggccccggagtctaagctccccaaccgtgactttgagcgctccactggagggggctaaagacagcccagtccgcagagcagtaaaagacacattgtcaaatccccagtctcctcagccatccccatacaatagccctaagcctcagcataaagtgacccagagcttcctgcctcccgggtgggagatgcgcatcgcgcccaacgggcgcccattttttatagaccataatactaagactaccacttgggaagacccccgtctcaagtttccagttcacatgcgatccaagacctctctgaaccctaatgatcttggcccactgccccctgggtgggaagagcggatccacctggacggcagaaccttctacattgaccataactccaaaattacccagtgggaagaccctaggctccagaatccagccatcaccggtccagctgttccatattcccgcgagtttaaacagaaatacgactacttcagaaagaagttgaaaaaaccagcggacattccaaatagatttgaaatgaaactccacagaaacaatatctttgaagagtcatacagacggataatgagcgtcaagcgccctgatgtgctgaaggctaggctgtggatagaatttgagagtgagaaaggactggattacggcggtgtggcccgagagtggttttttctactctccaaggagatgtttaatccttactacggcctgtttgagtactcagccaccgacaactataccctgcagatcaaccctaattcaggactgtgtaatgaagaccacctgagctatttcacctttataggaagagtcgccggcctggcggtcttccacggcaaattattagatggattctttatccggcccttctataaaatgatgcttgggaaacagataactttgaacgacatggaatccgtggattcagaatactacaattccctgaagtggattcttgagaatgaccctacagaactggatcttatgttttgtatcgacgaagaaaatttcggccagacctatcaggtggacttaaaacctaatggtagcgagattatggtgacaaatgagaataaacgtgagtatatagacttagtcatccagtggcggttcgtaaaccgggtccagaagcagatgaatgccttcttggagggcttcactgagctgctgcctattgatctgatcaaaatcttcgacgagaacgaactcgagctcctgatgtgcggcttaggcgacgtggacgtcaatgactggcgccagcattctatatataaaaacggatattgccctaatcaccctgtgattcaatggttctggaaggctgtactgctgatggacgcagaaaaacggatccgactgctgcagtttgtaacaggaacctcccgcgtgcctatgaacggctttgctgagttgtacggatccaatgggcctcagttatttaccatcgagcaatggggctcacctgagaagttgccgcgggcacatacgtgttttaataggttagaccttccgccgtatgagacattcgaggaccttcgggagaagctgctcatggctgtagaaaatgcccaaggatttgagggtgtggactag

SEQ ID NO: 126057 - DNA, 2505 bp, Artificial Sequence
  Description of Artificial Sequence: Synthetic coding sequence
atggaaaggccttacaccttcaaggattttttactacggccgaggtcacacaagtctagagtcaagggcttcttgaggctgaagatggcttatatgcccaaaaatggcggacaggacgaggagaattctgatcagcgcgatgatatggagcatggttgggaggtcgtggacagcaacgactcagcatcgcagcaccaagaggaactgcccccaccccccctgcctcccgggtgggaagagaaagtggacaatttaggccggacttactatgttaaccataataatcgaactacccagtggcaccgaccaagtctgatggatgtgagctccgagagtgacaataatatccgacagattaaccaagaagccgcccaccgccgtttcaggtcacgacgccacatttcagaagacctcgaacctgaaccctccgaaggcggggatgtccccgagccttgggagactattagcgaagaagtgaatattgctggcgatagtctaggactggcattgccacctcctcccgcatcaccaggctccaggacatctccgcaagaactctcagaagagctgtctaggagactgcaaattactccagattccaatggcgagcagttctcttccttgatccaaagagagcccagtagccgcctgaggtcttgttcggttaccgatgctgtagctgaacaagggcatctcccacccccgtccgtggcttatgttcatacgacaccggggcttccgagtggttgggaggagagaaaagacgcgaagggtagaacatattacgttaaccataataatcgcacaactacctggacccggccgatcatgcagctcgcggaggatggggcctccggaagtgccaccaacagtaacaaccatcttatcgagccccagatacgaagaccccggtctctgtccagcccgacagtgacgctatccgcccccctcgagggcgccaaggattcccctgtgcgtagggctgtgaaggacactctaagcaatcctcagtcgccccaacctagcccttacaattctcctaaaccacagcataaggtgacccaatcttttcttcccccggggtgggaaatgcgaatagctcctaacggacgacctttcttcatcgatcataatacaaagactaccacctgggaggacccacggctaaaattcccagtacatatgagatccaagaccagtcttaaccccaatgacctgggccctctgcctccaggttgggaggaaaggatccatttggacggacggacattctacatagaccacaactctaagatcacacagtgggaggaccccaggctgcagaatccagccattactgggcccgccgtcccctattcacgtgaattcaagcagaagtatgactatttccgtaagaagctgaagaaacccgctgatatccccaatcgattcgaaatgaagctgcaccggaacaacatcttcgaagaaagctaccgccggatcatgtcagttaaaagacctgatgtactgaaggccagactgtggattgaattcgagagcgagaagggactcgattacgggggggtcgctcgcgagtggtttttccttctgtctaaggaaatgtttaacccttattatggtctgttcgaatacagtgcaacagacaattacactctgcaaattaatccaaacagtggcctttgcaatgaggatcatctgtcgtattttactttcataggacgcgtcgcaggacttgcggtgttccacggaaaactgctcgatggcttcttcatcaggcctttctataaaatgatgctggggaaacagattaccctcaacgacatggagtcggtcgattccgaatattacaattctctgaagtggattcttgaaaatgatcccaccgagctcgacctcatgttttgtatcgatgaagagaatttcggtcaaacttaccaagttgatctgaagccaaacgggtccgagatcatggtgacaaacgagaataagagggagtacatcgatctagtgatccaatggagattcgtaaatcgggtgcagaagcagatgaacgccttcctggaaggatttaccgagttgctccctatcgatcttatcaagattttcgatgaaaatgagcttgaacttctaatgtgcgggctgggagatgtcgacgtcaatgattggcgacagcacagcatctacaagaacggctactgccctaaccatccagtaatccaatggttctggaaggctgttctcttgatggatgccgagaagcgcatacggctgcttcagtttgttacaggcaccagcagagtgccaatgaacgggttcgccgaattgtacgggtccaacggtcctcagttgttcacaattgagcagtgggggagccccgagaagctcccaagggcccatacctgctttaaccggctcgaccttccgccctacgagaccttcgaggatctgcgagaaaagttgctcatggcggttgagaacgctcagggctttgaaggtgtggactag

SEQ ID NO: 126058 - DNA, 2505 bp, Artificial Sequence
  Description of Artificial Sequence: Synthetic coding sequence
atggagaggccttataccttcaaggacttcctgctgcggcctcgtagccacaagtccagagtcaaaggattcctgaggctcaagatggcatatatgccaaaaaatgggggccaagatgaggaaaatagtgaccaaagggacgacatggagcacggctgggaggtggtagattcaaatgatagcgcctctcaacaccaggaggagctgccacccccacccctgccccccggctgggaagagaaagtcgataatctgggccgtacatattatgttaaccacaataataggacaacgcagtggcacaggccctcacttatggatgtttcttcggagtccgataataacattcgacagatcaaccaggaggctgcacaccgaagattcaggagccgaagacacatcagtgaagatctggaacccgagcctagcgagggcggcgacgtgccagagccatgggaaaccatctccgaggaggtcaacatcgcgggggactcccttgggctggcccttccaccccctccggccagcccggggagtcgaacttcaccccaggagcttagcgaggaattaagcagacggctccagataactcccgacagtaatggcgagcagttcagcagcctgatccagagggaaccctcaagccggctgcggagctgttccgtgactgatgccgtggctgaacaaggtcatctgcctcccccatcagttgcctatgttcacaccactcccggattgccgtcgggttgggaggagcggaaggacgctaagggcagaacttattacgtgaaccataataataggactacaacctggaccaggcccatcatgcaattggccgaggatggggcttccggcagcgctacaaattccaataatcacctgatcgaacctcagatccgcaggcctcgcagtctttctagccccacagtgacactgagcgctcctctggaaggcgccaaggacagtcccgtgcggcgagctgtaaaagacactctaagcaatccacagagccctcagccatcgccctacaactcccctaagccccagcacaaagttacacagagttttctgcccccaggctgggaaatgcgcatagcacctaatggccggccctttttcattgatcacaacactaagactacaacatgggaagatccacgcctcaagtttcccgtgcatatgcggagtaagacctcccttaaccctaatgacttgggtccactcccccctggctgggaagagcgtattcatcttgatggaaggacattctacatagaccacaacagcaaaattacccaatgggaggatccacggctccagaatcccgctatcacgggacccgccgttccttactccagggaattcaaacagaagtatgattatttcaggaaaaaattaaaaaaaccagcagatatccccaataggtttgaaatgaagctgcaccgaaataatatttttgaagagtcatatcgacgaattatgtctgtcaagcggccagacgtgctgaaggcccggctatggattgagttcgagtcagaaaagggcttggactacggtggtgtagctagggaatggttctttctgctcagcaaggagatgtttaacccttattacggcttgttcgaatactctgccactgacaattatactctgcaaataaaccctaactctggtctgtgcaacgaggatcatctctcctacttcacatttatcggaagagttgctggcctggccgtgtttcacggcaagctcctggacgggttctttataagaccgttttataaaatgatgttggggaagcagatcactctcaacgatatggaatcagtcgatagcgagtattacaatagtctgaaatggattttggaaaatgatccaaccgaactcgatctgatgttctgcattgacgaggagaactttggccagacctaccaggtggacctgaaacccaacgggagcgagataatggtgacgaatgagaataagcgagaatacatcgaccttgtcattcagtggcgttttgtgaacagagtgcagaaacaaatgaatgcgtttctggaagggtttaccgagctgctgccaatcgacctgatcaagatttttgacgagaacgaattggagctcttgatgtgtgggctgggtgatgttgatgtaaacgattggcggcaacactctatatataagaacggatattgcccaaaccatcctgtgatacagtggttttggaaagcggtgctgttgatggatgcagagaagaggataaggttacttcagtttgtgactggcacatctcgcgttcccatgaatggatttgctgaactgtacggtagcaacggaccccaattgtttacaatcgagcagtggggttccccagagaaactgccccgagcacacacctgcttcaacagattggacctaccaccttacgagacatttgaggaccttagagagaagctcctaatggccgtcgagaacgcccaggggtttgagggcgtggattag

SEQ ID NO: 126059 - DNA, 2565 bp, Artificial Sequence
  Description of Artificial Sequence: Synthetic coding sequence
atggaaaggccttatacttttaaagactttctgctgaggccccgaagccacaaaagcagagtgaaaggtttcctgcgacttaagatggcctatatgcccaaaaacggtgggcaggacgaggaaaactctgaccaaagagatgatatggaacatggctgggaagttgtagattccaacgattccgcttctcaacaccaagaagaacttccgcctcctccgctgccaccagggtgggaagagaaggtagataacctcggtcggacctactacgttaaccacaataaccgaaccacacagtggcaccggcccagcctgatggatgtgtcatccgaaagtgataataatatcagacaaattaaccaagaggccgcccaccggagatttaggagtcgcagacacatcagcgaagaccttgagcccgaaccttcagagggaggtgacgtgcccgagccttgggagaccatctccgaggaggtgaatatagctggagacagtctcgggctcgcactaccccctccgccagcatcacctggcagtagaacctctccccaggagctgagtgaagagttgagccggcggttgcagattacgcccgattcaaacggtgaacaattctctagcctgatccagcgggagcctagtagtcggttgagatcttgcagcgtcactgatgcagtggcagagcaagggcacctgccaccaccatctgcgccggccggaagggcgagaagttccaccgtgacaggaggcgaagaaccaacccccagcgtcgcatatgtgcataccaccccaggcctccctagcggctgggaggagaggaaggacgccaaggggcgcacctactacgtgaatcataataaccggactacaacatggacccgacccataatgcaactggccgaagatggagcgagtggaagcgcaactaactcaaacaaccaccttatcgagccccaaatacgacgacctcgttcactttcatctcctaccgtgacgttatccgcccctttggagggggccaaggacagcccagtgcgcagggctgtgaaggacactttatccaacccacagtcccctcagccctccccctataatagcccaaagccacagcacaaagtgacacagtcatttttgcccccagggtgggaaatgcgcattgccccaaacggccggccctttttcatcgatcacaacaccaaaactactacctgggaagatccgcgcctgaaatttccggtgcatatgaggtcaaaaacttcactgaacccaaatgatcttggaccactccccccggggtgggaggaaaggatccacctggacggtcgtacattttacatagatcataattctaaaattacgcagtgggaggatcccaggctgcagaatcccgctatcacaggacccgctgtaccatattcaagggagttcaagcagaaatacgactacttccggaagaaacttaaaaaacctgccgatatccccaacaggttcgagatgaagctacatcggaacaacatattcgaggaatcttatcgcaggattatgtccgttaagcgaccagacgtgctgaaagcacggctgtggatcgaattcgagtccgagaagggcctggattatgggggggttgcccgcgaatggttttttttgctatcaaaggaaatgttcaatccctattatggcctcttcgagtacagcgctacagacaactacacactgcagatcaatcccaattccgggctctgtaatgaggatcacttgtcttacttcacttttattggtagggtggccggccttgccgtcttccatggcaaacttctcgacggcttcttcatccggccattttacaagatgatgcttggcaagcaaatcaccctgaacgacatggagtctgttgactccgaatactataacagcctgaagtggatactggaaaatgatccaaccgaattggacctgatgttctgcatcgacgaagagaacttcggccaaacatatcaggtggatttgaaacctaatggctcagagattatggttactaacgagaacaagcgtgagtatatagacctcgtgatccagtggcgttttgtaaatcgcgtacaaaagcagatgaatgcctttttagagggcttcaccgaactcctgcccatcgatctaatcaagattttcgacgaaaacgaattggaattgctgatgtgtggcctgggtgatgtagacgtcaatgactggaggcagcactccatttacaagaacggctactgtcccaatcatcccgttattcagtggttctggaaagctgtgttgttgatggacgccgagaagcgaatcaggcttctccagtttgtcacgggcacctccagagtgcctatgaacgggttcgccgagctgtatggttcaaatgggcctcagctgtttaccattgaacaatgggggtcgcccgagaagctgccgagggctcacacctgctttaatcgacttgaccttccaccatatgaaacatttgaagacctgcgagagaagttgttgatggccgtcgagaatgcacaaggattcgaaggagtggattag

SEQ ID NO: 126060 - DNA, 525 bp, Artificial Sequence
  Description of Artificial Sequence: Synthetic coding sequence
atgaagtataagaacctgatggcacgggccctctatgataatgtaccggagtgtgctgaagagctcgcattccgcaagggtgatatattaacagtaatcgaacagaacaccggtgggctggaggggtggtggctctgcagcctccatggtagacaaggaattgtgccaggcaacagggtgaaacttctgatcggtcccatgcaggagaccgccagctctcacgaacagccagcctcaggcttgatgcagcagacgttcggtcaacagaaactttatcaggtccctaatccacaggcggcacctcgtgatactatctaccaggtgccacctagttaccagaaccagggaatctaccaggtcccgactgggcacggcacccaagagcaggaagtgtatcaagtcccacccagcgttcaacggagcatcgggggcacgtccggtccacatgtgggaaagaaggtgtttcagagagatgggcaggtgtcctattttctggtgcgggcctcaaagcaaactagcctgtag

SEQ ID NO: 126061 - DNA, 2505 bp, Artificial Sequence
  Description of Artificial Sequence: Synthetic coding sequence
atgaagtacaagaacctgatggctagggccttgtatgacaatgtgcccgagtgtgctgaggaactggccttccgcaagggagatatcttgaccgtaattgaacaaaacaccgggggcctggaaggatggtggctgtgttctctccatggccgtcagggcattgtgccggggaaccgagtgaaactgctgatcggtccaatgcaggaaaccgcatcttcacacgaacaaccagctagcggtctgatgcagcaaactttcggacagcagaagctgtaccaagtgccaaaccctcaggcggcccccagagataccatctatcaggtgcctccgagctatcagaatcaaggcatttatcaggtgccaactgggcacggaactcaggagcaggaggtttaccaggtgcctccttcggtacagaggtccatcggcggtacaagtgggcctcacgttggcaaaaaagtcatcacaccggtgaggaccgggcacgggtacgtttatgaatatccaagtagatatcagaaggacgtgtacgacatacctcctagccataccactcagggagtgtacgacattccaccatcgtcagccaagggtcctgttttttctgtgcccgtgggcgagatcaaacctcagggagtttacgacatacctcccacaaagggcgtctacgctattcctcccagtgcctgtagggacgaggccggcctccgtgaaaaggactacgattttccacccccaatgcgccaggccgggcggccagatcttagacccgagggcgtttacgacattcccccaacatgtaccaaacccgccggaaaggacctgcacgtgaagtataactgcgatatccctggcgcggctgagccagtcgccaggcggcatcagagtctctctccgaaccatccgccacctcagttagggcagtctgtaggcagtcagaatgatgcctacgacgtcccaaggggtgtgcagttcctcgagccacccgcagagacgagtgagaaagccaatccacaagaaagagatggcgtatacgacgtacctcttcataaccccccagatgctaaggggtccagagatctagtggatggcattaatagattgagcttttcgagcaccggcagcactcgcagtaacatgtccactagctctacttccagcaaagaaagctcactctcagcatctcccgcccaggataaaaggttgttcctggatcccgataccgctatagagcgcctacaacgcctgcagcaagcgctagagatgggcgtcagctcacttatggcgctggtgaccacagattggaggtgttatggatatatggagagacacatcaacgagattagaacagcggtggacaaggtagagttgttcttaaaagagtacctccactttgtgaaaggtgcagtagctaacgctgcttgtttgccagaactgattttacacaataagatgaagcgggaactgcagcgcgtagaggatagccatcagatcctgagccagacatcccatgacctgaatgagtgttcatggagtttaaacattcttgctattaacaagcctcaaaataagtgcgatgacctcgatcgctttgtgatggtcgctaagactgtgccggacgatgcgaaacaactgacaactactattaatacgaatgcagaggccttgttcagacctgggcccgggtcattgcacctgaaaaatggacctgagtcaattatgaacagtactgaatacccccacggagggtcccaaggccagctgctgcaccctggagatcataaagcgcaggcccacaataaggcattaccccccggcctaagcaaagagcaggctcctgactgtagctccagcgacgggtccgagcggtcttggatggacgattacgattacgttcatctgcagggtaaggaagaatttgagcgccagcagaaagaactcttggaaaaggaaaacattatgaagcagaataagatgcagctcgagcatcaccagctaagccagtttcagctgctggagcaggaaatcaccaagccagttgaaaacgatatttctaagtggaagccatctcagagtctccccacaactaattctggagtctccgcccaagatcggcaactattatgtttctattacgatcagtgtgaaacccacttcatttcgctcctaaatgccatcgatgctctgtttagttgtgtgtcttccgcacagcctcctagaatcttcgtggctcacagcaaatttgtgattctcagcgctcacaagctcgtgttcataggggatactcttacccgacaggtcaccgcccaggacatcagaaacaaagtgatgaattcatcgaaccagctgtgcgagcagctcaagacaatcgttatggcgacaaaaatggctgctttgcattatccatctaccaccgcactgcaggaaatggtccaccaggtgactgacctgtctaggaacgcacaactgtttaagaggagtcttctcgaaatggccacgttctag

SEQ ID NO: 126062 - DNA, 99 bp, Artificial Sequence
  Description of Artificial Sequence: Synthetic coding sequence
atgtggacaaggaacctgatggcccgcgcactgtatgataacgtcccggagtgcgcagaagaattggctttccgaaagggagatatccttactgtatag

SEQ ID NO: 126063 - DNA, 2505 bp, Artificial Sequence
  Description of Artificial Sequence: Synthetic coding sequence
atgtggacacgcaatttgatggccagagcactctacgacaacgtgcccgagtgcgcagaagagctagcgtttaggaaaggggacatcctgaccgttattgaacagaacaccgggggactggagggatggtggctgtgctctctgcatggtagacagggtattgtgccgggcaatagggtcaaactgttaataggccctatgcaggaaactgcttcatcgcacgaacagccagcctccggtctcatgcagcagacattcggtcaacaaaagctgtaccaggtgcctaatccccaagctgcgccacgggacaccatctaccaagtgcctccctcgtaccagaatcagggaatctatcaggtgcctacgggtcatgggacccaggagcaggaagtctatcaggtgccaccctcagtgcagaggtcaatcgggggcacaagcgggcctcacgtaggaaagaaagtgatcactccagtgcggactggacacgggtatgtatacgagtatccctcgaggtatcagaaggatgtgtatgacatcccaccctcgcacaccacacagggagtttacgatattcctccatcatcagcgaaaggacccgtttttagcgtgccggttggcgagattaagccccagggcgtgtacgatatccctcctacgaagggcgtgtacgctatccctccctcagcctgtcgggatgaggccgggctgcgggagaaagattatgattttcccccgccaatgaggcaagcaggtagacctgatctacgacccgagggagtgtatgacataccacccacatgtactaagcctgctggcaaagatttgcacgtaaaatacaactgtgacattcccggggctgctgagcccgtagcccggcgtcaccaatccctgtcacctaaccatccacctccgcagctcggacagtccgtgggctctcaaaatgacgcttacgatgttcctagaggagtacagtttctcgaaccgcctgccgagacatcagaaaaggctaatccccaggaacgggacggcgtgtatgacgtgcccttgcacaacccccccgacgctaagggtagtcgcgacctagttgacggaataaatcgcttgagcttttcgagcacgggaagcacccgcagcaacatgtccacctcgtctactagcagtaaggaaagtagcctttctgcctcacccgcccaggacaaacgactattcctagaccctgacacggctatcgagcgactccaacgtctgcagcaagcactggagatgggagttagttcgctgatggctctggtgaccactgactggcggtgttacggctacatggaacggcacatcaacgaaatccgaacggccgtggacaaggttgagttgttcctgaaggagtacctgcactttgtaaaaggcgctgtggccaatgccgcttgcctccctgagctcattctgcataataagatgaaacgagagctgcaacgcgtggaggacagtcatcagatccttagtcagacaagccacgatctgaacgagtgttcatggtcccttaatatactcgcaattaacaaaccacagaataaatgtgacgacctcgataggttcgttatggtggccaagactgttcctgatgacgccaagcagctcaccacaacgatcaataccaacgccgaagccctgttccgccccggacctgggtccctgcatctcaaaaacggaccagagagtatcatgaacagcacagagtatccccacggcggttcccagggacagcttctgcatccaggcgaccacaaggcccaagcccataataaggcgcttccgcccggattaagcaaagagcaagctcctgattgtagcagctctgatgggtccgagcgcagttggatggacgactacgattacgtgcatcttcagggcaaagaggagttcgagcgccagcagaaggagctcctggagaaagagaacataatgaaacaaaataaaatgcagctggagcatcaccaactgtctcaattccaacttctagagcaggagattaccaagccagttgagaacgacatctccaaatggaaacctagtcagtccctgccaacaactaactctggagtctctgcccaggataggcagctgctttgtttttattatgatcaatgcgagacacactttatatcccttttgaatgccatcgacgcactatttagctgcgtttcaagcgcccaaccaccccgcatctttgtggctcactccaagtttgtgatactgtccgctcataagctagtttttataggcgataccttaacgaggcaggtcaccgcacaggatatcaggaataaggtgatgaattcctccaaccagctatgtgagcaactgaagactattgtaatggccaccaaaatggccgcactgcattacccatcaaccacggctctccaggagatggtacaccaggtgacagatctcagtagaaatgctcaattatttaaaaggagtttactagaaatggccaccttttag

SEQ ID NO: 126064 - DNA, 1212 bp, Artificial Sequence
  Description of Artificial Sequence: Synthetic coding sequence
atgctccgaccagaagctgggctggtcggcctgcatggtcctgcccaggagaattctgcactgccaggacgtcgagacagtgcctccgaactgcgagctctgagtggcctggaagtcgacccgggcgagggctggggccgggtagtcctgatcagccccagaacagttcgcttccgagttctgtctccaggcgtgagggaagaaggacatgtgcaaaacaacggccagaatcaggcccggcccgcgaggggggttaccggtgcaggcgggtggggcagcgccgctgtgtgccgtgggagggctctccgggggagggaacccgccctgccctccgccagtttccccgacgtggcagcgtgcccggggtcactggactgtgctctcaagaggagagcacggtgtcctcctggcgcccatgcttgtggaccgtgccttcagcccttccaggaagaccagcaaggcctatgtgttcctaggatgagacgccctcccgggggcggccgcccccagcccaggctagaggacgaaatcgacttcctagctcaggaattagcacgaaaggaatctggacattccaccccacctctcccaaaggatcgccagcgcttgcctgagccagctacgctggggttcagtgcccggggccagggtctcgagttagggctcccctctacacccggaacacctacccctacgccccacacaagcttaggaagccctgtcagtagcgaccccgtgcacatgtccccccttgagccccgcggtggtcagggcgacgggctagctctggtgctgatcctggccttctgcgtggcaggggccgccgctctgtcggtggcatccctgtgctggtgccgattgcaaagggagattcgcctcacacaaaaagcagattatgccacggccaaagcgcctgggagcccagctgcgcctagaatatcaccaggtgaccagagactggcccagtctgctgagatgtatcattaccaacaccagcgccagcagatgttgtgtctcgagaggcataaggagcctccaaaggagcttgacacggcgagctcagatgaagaaaatgaggatggagatttcaccgtgtatgagtgccctggcctggcccccaccggcgaaatggaagtccggaacccactgttcgatcacgcggccctaagtgcacccttgccagcgcctagttctcccccagctctgccatag

SEQ ID NO: 126065 - DNA, 978 bp, Artificial Sequence
  Description of Artificial Sequence: Synthetic coding sequence
atggctacccccttgccccccccaagtccccgccacctgagactgcttcggctgttgctgtccggtctggtgctgggtgctgctttgcgtggcgcagcagcaggacacccagacgttgcagcctgccccggcagccttgactgcgcacttaaacgtcgagctagatgccccccgggcgctcacgcttgtgggccttgtttgcaaccgtttcaggaagaccagcaaggcctatgtgttcccagaatgcgccgaccacctggcgggggaagaccccagcccagactcgaagatgaaatagacttcctagcccaggagctggcacgtaaggagagtggacattcaacgcctcccttacccaaagatcgacagcggctgcccgaacctgctaccctcggattctccgctaggggacaggggctcgagcttggattgccttctactcccggcactccaacgcctaccccccacacttccctggggagccctgttagctccgatcccgtgcatatgagcccgcttgagcctcgcggcggacagggagatggcctagcacttgtgttgatcctggccttctgcgtggcaggcgccgctgcattgagcgtggcgtcgctgtgttggtgtcgccttcagcgcgaaatacggcttacccagaaagcagattacgccacagccaaagcccccggttccccagcggcaccaagaatctctccaggggaccagcgtctggctcagtctgcagagatgtatcactaccagcatcaaagacaacagatgctctgtctcgaacgccacaaggaacccccaaaggaactcgacacagccagtagtgacgaggaaaacgaagatggagactttactgtgtacgagtgcccaggcctcgcccctaccggcgaaatggaggtcagaaacccgctgttcgaccacgccgctctgtcggcaccgctccctgcaccatctagcccccctgcactgccttag

SEQ ID NO: 126066 - DNA, 297 bp, Artificial Sequence
  Description of Artificial Sequence: Synthetic coding sequence
atgtccgtaagagaactcaaccggcagctcagagggtgcggcagggatgaggccctgcggcttaaacaacgccgccggacactgaagaaccgagggtacgcgcaggcctgcagaagcaagaggttgcagcagcgccgtgggctcgaggcagagagagcccgccttgccgcacaattggatgctctcagggcagaagtggctagactggccagagaaagggacctctacaaggcccgctgcgatcggttaacatcatcaggtcccggctctggagatcccagtcacctcttcttgtag

SEQ ID NO: 126067 - DNA, 714 bp, Artificial Sequence
  Description of Artificial Sequence: Synthetic coding sequence
atggctctgccacccagcccactggctatggaatatgttaatgatttcgacctgatgaaattcgaggtcaagagagagccatccgaaggccgtccgggtccccccacagcttccctgggatccacaccatatagttcggtgccaccttctcctacattcagcgagcctggaatggtgggtgccaccgagggtacgcgtcccggcctggaagagctttattggctcgccaccctccagcaacagttaggggccggcgaagctctaggcctgtcacctgaggaagctatggagctcctgcaagggcaggggcccgttcctgtggacggcccacacggatattaccccggctccccagaggagacaggagcccagcatgtgcagttagccgagcgtttctctgatgcggctctggtgagcatgtcagttcgcgagctgaaccggcagcttcgggggtgcggtagggacgaggctctgcgattgaagcagcgacgccggacacttaagaatcggggatatgcacaggcttgtagatctaaacgtctccagcaaaggcggggcttagaggccgagcgagctaggctcgctgcccagctggacgcactgcgggcagaggtcgcccggctggcccgagagcgcgacctctataaagcacggtgtgacagactcacttcctccggacctggttccggcgatccctcacacctgtttctatag

SEQ ID NO: 126068 - DNA, 714 bp, Artificial Sequence
  Description of Artificial Sequence: Synthetic coding sequence
atggccctacctccatctccactcgctatggaatacgtgaatgattttgacctgatgaagttcgaggtcaaaagagaaccatcagagggtcggccgggaccccccacagccagcctcggctcaaccccgtacagtagtgtccctccgtccccgacgttttccgaaccgggtatggtgggagcaaccgaaggaaccagaccagggctagaggagctctattggctggccacactgcagcagcagctgggggcaggggaagcactaggcttgagtccggaagaagccatggagctgcttcagggacagggccccgttccggtggatgggccccacgggtactatccaggaagtccagaagagacgggagcccaacacgtgcagctggccgagaggtttagcgatgccgctctggtcagtatgtctgtccgggagctgaaccgccaactgcgggggtgcggacgcgatgaggctttacggctgaaacaacgtcgcagaacactgaagaatcggggttacgcacaggcttgccggtcgaaaagactccagcagcggcgcgggcttgaggccgaacgcgcaagattggcagcccagctggacgcacttagagccgaagttgccagactggctcgggagcgggatctatataaggcccgctgcgacaggctcacgtcgtctgggcccggttccggcgacccgtcacacttgtttctatag

SEQ ID NO: 126069 - DNA, 198 bp, Artificial Sequence
  Description of Artificial Sequence: Synthetic coding sequence
atggcccttcctccttcccccctggctatggaatacgtgaatgacttcgatctgatgaagttcgaagttaaacgagagcctagtgagggaaggccggggccaccgacggcttctttgggcagcactccttattcttccgtgcctccgtctcctacctttagtgagcctgggatggtgggggcaacagaaggaacgtag

SEQ ID NO: 126070 - DNA, 297 bp, Artificial Sequence
  Description of Artificial Sequence: Synthetic coding sequence
atgtcggtccgagagctgaatcgccagctgcgtggatgcggaagagacgaggctcttaggctgaaacagcgacgaagaactctgaaaaatagaggatacgcgcaggcttgccgtagcaagcgccttcagcaacggcggggtctcgaagcagagagggcgcgactggccgcccagctggatgccctccgagcagaagtggcaagactggcccgagagagagacctgtacaaggctagatgcgaccggctgacctctagcggtcccgggagtggcgacccgtcccacctttttttatag

SEQ ID NO: 126071 - DNA, 714 bp, Artificial Sequence
  Description of Artificial Sequence: Synthetic coding sequence
atggcactgccccccagccctttggccatggagtacgtcaatgattttgacttgatgaaattcgaggtgaagcgggaaccgagtgaagggcggcctggccctcccacagcttcactcggcagcactccatatagctctgtccctccgtcccctaccttctcagaacccggtatggtaggggccaccgagggcacgagacctgggcttgaagaactgtactggctcgccaccctacagcagcaactgggggcaggggaagccttagggctcagtcccgaggaagcaatggaactgctgcaaggtcagggtcctgtgcctgttgacgggccacacggctattacccgggctcaccggaagaaactggtgctcaacacgtacaacttgctgagaggttttccgacgctgccttggtgtcaatgagcgtgcgcgagctgaaccgacagctgcggggctgtggtcgtgatgaagctctccgactgaaacagagaaggcgcacgctgaagaatcgcgggtatgctcaagcctgtagatcaaaaaggctgcagcagcggcgcggactggaggcagagcgggcgaggcttgccgctcagctggatgctcttcgcgccgaagtggcccgcttggcccgcgaacgggatctgtacaaagcccgttgtgacaggcttacaagtagtggacctgggtccggtgatccctctcatcttttcttgtag

SEQ ID NO: 126072 - DNA, 1674 bp, Artificial Sequence
  Description of Artificial Sequence: Synthetic coding sequence
atgggtggtcagatcacccgcagtaccctgcatgattctattggaggcccctttcctgtcacttcgcacagatgccatcacaaacagaaacactgtcccgccgtgctgccatctggtggcctgcctgccactccgctgctctttcacccacacaccaaaggtagccagatacttatggacctgagccacaaagccgtgaaaaggcaggcctctttttgcaacgcaatcactttctctaatcgtccagttttaatctatgagcaggttcggttaaagattacgaagaagcaatgttgttggagtggcgcattgagactgggtttcacgagcaaggatccaagtcgcattcatcccgattctcttcctaagtacgcttgcccggatctcgtgtcacagtccgggttctgggctaaagccctccccgaggaatttgcgaatgaaggaaatatcatagctttttgggtggacaaaaagggtagagttttccacagaatcaatgactctgcagtaatgcttttttttagtggcgtgaggaccgctgaccctttatgggccctggtggacgtctatgggttaacgcgcggggtccagctgctggattcagaactcgtgctgccggattgtctccgaccaaggtcttttaccgcactcagaagacctagcttacgccgcgaggcagacgatgctcggctttccgtaagtctgtgcgacctcaatgtacccggggccgacggagatgaagctgctccagccgccgggtgtcccatcccgcagaattccttaaactcacagcactcccgggccctgcccgctcagctggatggcgatctcagatttcacgctctgcgcgccggcgctcacgtgagaattctggacgaacaaactgttgcacgcgtagaacatggcagagacgaacgggccttggtgtttacttccaggcctgttcgtgtagctgaaaccatttttgtgaaagttactcgttctggcggtgctcgccctggcgctttgtcatttggagtgaccacatgtgatcccggaacgcttcgtcccgctgatctgcccttcagcccggaggctctagtggaccgtaaggagttctgggctgtgtgtagggtccccggtcctctccactctggtgacatactgggactggtggtcaatgcagatggggaattgcacctaagccacaatggggctgcagctggaatgcaactttgtgtagatgcaagtcaaccgctgtggatgttatttgggctccacgggaccatcactcagatccgcatcctcggctctaccattctcgccgaaagaggtattccatcactgccatgcagccctgcaagcactcctacgtctcccagcgcgttaggatcccgactgtcagatccactcctcagcacctgctcctccggccctcttggctcctctgccggaggtactgcaccgaactctccagtaagcctgcccgagagcccagttacaccgggcctcggacagtggagcgacgaatgcactatctgctacgagcacgccgtcgatacggtgatctacacatgtggtcatatgtgtctgtgttatgcctgtgggctgaggctgaaaaaagctctccacgcctgttgtcccatctgccggcgacctatcaaggacatcatcaagacttaccggtcgtcctag

SEQ ID NO: 126073 - DNA, 1725 bp, Artificial Sequence
  Description of Artificial Sequence: Synthetic coding sequence
atgggcaataatttctctagcattccaagcctgccgcgggggaacccctcccgggccccaagagggcacccccagaacctgaaggactcgatagggggacccttcccagtgaccagccatagatgtcaccacaagcagaaacactgcccggcagtgctgcctagtggaggcctgccagcaacccccctcttgttccatccccacacaaaaggctctcaaatcttaatggatctgtcacacaaggctgttaagaggcaggcttcgttttgtaacgcgattactttctcgaacagacctgttctgatctatgaacaggtccgattgaaaattacaaagaagcagtgctgctggagcggcgcactcaggctaggattcacgagtaaggacccctcacggatccacccggacagcttgccgaaatatgcttgccccgacctggtctcacaatccggcttctgggcaaaggccctccctgaggaatttgcaaacgaggggaacattatcgctttctgggtggacaagaaaggcagagtctttcatcgcatcaacgattcagccgtgatgctttttttttccggagtgagaacagctgatcctctgtgggccctggttgatgtttacgggctgacgcggggcgtccaacttctagactcggagttagtgttaccagactgtctccggcccagatcatttactgcattgaggcggcccagtttgcggcgggaggcagatgacgcgcggctgagcgttagtctgtgtgaccttaatgttcccggggcggacggtgatgaagccgcaccagcagcgggctgccccatccctcaaaacagcttgaattcccaacactcccgagccctgcctgcacagctcgacggcgaccttcgattccacgctctgagggccggcgctcacgtgaggatccttgacgagcagactgtggctagggtggagcacggccgcgatgagagagccctcgttttcacgagcagacctgtcagggtggcagagacgattttcgtaaaagttactcggtcaggaggcgctagacccggtgccctgtccttcggcgtgacaacctgtgatccaggcaccctccgtccagctgacctgccctttagtcctgaggccctggtggaccgaaaagaattctgggctgtctgtcgcgttcccggcccactgcattccggagacatcctcggcctggttgtgaatgccgatggggagctccatctcagtcataacggagctgctgccggcatgcaactctgcgtcgacgcaagtcagcccctttggatgctcttcggattgcacggcaccataactcaaattagaatcctggggtcaacaatcctagccgaacgtggcatcccctcccttccttgctcacccgcgtcaactccaacttctccttcggcacttgggtccagattgagtgatcctctgctgtctacatgctcttccgggcctcttggttcatctgccggaggcaccgctcctaactcccccgtctctttgcccgaaagtcccgtcacccccgggttaggtcaatggagcgacgagtgcaccatctgctatgaacacgctgtcgataccgtcatttacacgtgcggccacatgtgcctctgttacgcttgtggcctgcggctgaagaaggcactgcacgcctgctgcccaatttgcagacggccgataaaagacatcattaaaacgtatagatcatcctag

SEQ ID NO: 126074 - DNA, 600 bp, Artificial Sequence
  Description of Artificial Sequence: Synthetic coding sequence
atgggagggcagatcacccggagtacgctgcacgattctatcggaggcccattccccgtgacgtctcaccgctgccaccacaagcagaagcactgtcccgccgttcttcccagtggcgggcttcctgcaactccactcttattccatccacacacgaaagggagccagattctgatggacctttcccataaagctgtgaagcgccaggcatcattctgcaatgccataactttcagcaaccgccccgtgttaatctatgagcaggtgagactgaaaatcacaaaaaagcagtgttgctggagcggggcactacgcttaggttttacgagcaaggatccctctaggatccatcctgacagcttgccaaaatacgcttgtccggacctcgtgtcccagtctggtttttgggcaaaagcactgcccgaagagttcgctaatgaaggcaatataattgcattttgggtcgacaagaagggaagggtttttcacaggatcaatgacagtgccgtgatgctgttttttagtggagtccgcacagctgatcctctgtgggccctcgtcgatgtttatggccttacgcgaggagtgcagctgctgtag

SEQ ID NO: 126075 - DNA, 327 bp, Artificial Sequence
  Description of Artificial Sequence: Synthetic coding sequence
atggatctctctcacaaggccgtaaaacgccaggccagcttctgcaatgcaattacctttagcaaccggcccgttcttatctatgaacaggtcaggctgaaaataacgaagaagcaatgctgctggtcgggcgctctgaggctcgggtttaccagtaaggacccctctagaattcacccggactctctacccaaatatgcctgccccgacctggtcagccaatcaggattctgggccaaggccctgcccgaggaattcgctaacgaaggaaatatcatcgccttctgggtggacaaaaaaggacgcgttttccacaggatcaattag

SEQ ID NO: 126076 - DNA, 2553 bp, Artificial Sequence
  Description of Artificial Sequence: Synthetic coding sequence
atgcgtcaggtgtgttgtagtgccttgcccccgccccctttggagaaggggcgctgctctagctactcagatagctcctcttcttctagtgagaggagttcttccagctcttcatctagcagtgaatcaggcagctctagcaggtcttcctccaataacagctccattagccgaccagccgcccctcccgagcccaggcctcaacagcagcctcaaccaagatcccctgcagcacggcgggctgcggcaaggtcgcgcgccgccgcagctggcggtatgcggcgggatcccgcccccggcttctcaatgctcctgttcggtgtgtccctcgcatgctattccccgagtttgaagagcgtccaagaccaggcatataaggctcccgttgtcgtggagggcaaggtccaaggtttagtccctgccggaggttcttctagcaattccacaagggaaccccctgctagtggccgcgttgcgctggtaaaggtgctggacaagtggccactccgtagtggtgggcttcaacgtgaacaagtgatttcagtaggtagttgcgtgccccttgagcgtaaccagcgttacatctttttcctggaacccaccgaacagcccctggtattcaagacggcctttgcacctcttgacactaacggtaaaaatttaaagaaggaggtggggaagatattatgtactgattgcgccaccaggccaaaactgaagaagatgaagagtcagaccggtcaggtaggcgagaagcagtcactgaagtgtgaagctgccgcaggaaatccccaaccttcctatcgctggttcaaggacgggaaggaattgaatcgatctagggacatacgtatcaaatatgggaacggacggaagaatagtcgtctacagttcaataaagtgaaggtggaagatgctggggaatacgtatgcgaggctgaaaacatcctggggaaagacacggtacgcggaagactctacgtaaatagtgtatcgacgaccttgagctcctggtcaggccacgcaagaaaatgcaatgaaaccgcaaagagttactgtgtaaatggaggcgtgtgctattatattgagggaattaatcaattgagttgtaaatgccctaatgggttctttggccagaggtgcttggagaaacttccattgagactctatatgccagatcccaagcagaaggccgaggagttataccagaagcgcgtgctgacgatcacgggtatttgcgtagctctgttggtggtgggcattgtgtgcgtcgtggcgtactgtaagaccaagaagcagagaaaacagatgcataatcacttgagacagaatatgtgcccagctcaccagaatcggtccctggctaacggaccatctcatccaagactagaccctgaagaaattcagatggctgactacatctcaaaaaacgtgccggcaaccgaccatgtgatccgccgggaaacggagacaaccttctctggctcccactcttgtagtccttcacatcattgctctactgccacaccgacatcctctcataggcatgagtcacacacatggagtcttgagagaagtgagtccctgacctccgacagtcaatctgggatcatgctttccagcgtcgggacaagcaaatgcaacagtcctgcttgcgttgaagctcgagctagacgcgctgctgcatacaacttagaagagcgtcggagagccacagctcctccttaccatgactctgtggacagcctgagagactctccccactctgagaggtatgtgtcggcactgacaacacccgccagactctcaccagtcgatttccactatagcctggccacccaggtcccgaccttcgagatcacctctcctaactctgcccatgccgtaagcctgccaccagctgcacccattagttataggctcgctgagcagcagcccctactgcggcatccagcccctcctgggcccggtccaggccctggacctgggccagggcctggagccgacatgcaacgctcttatgattcttactactatcccgctgccggacctggccccagacgcggcacatgtgctctaggtggctccctgggcagcctgccagcaagcccttttaggatcccagaggacgatgaatacgaaaccactcaggagtgcgccccacctcccccgccgcggccccgcgcacgcggagcctccaggcgcacctccgctggccccaggcggtggagaagaagcaggctgaacggattagctgcccagcgcgctagagctgcaagagattctctttctctgtcatctggttccggcgggggcagtgcaagcgccagcgatgacgacgccgatgatgccgacggcgccctggccgccgagtctactccattcctaggactcaggggagcccacgacgcactccggagcgatagtccaccgctgtgcccagcggctgatagtcgcacttattattctctcgattcacactccacacgtgcttcatctcgccactccaggggcccacccccccgcgctaagcaggattccgccccgctctag

SEQ ID NO: 126077 - DNA, 1281 bp, Artificial Sequence
  Description of Artificial Sequence: Synthetic coding sequence
atgagacaggtgtgctgcagcgccttgcccccacctccccttgagaagggtagatgttcaagttacagcgattcaagctcctcctccagcgagaggagcagctcttcatccagctcttcatctgaatctggaagctccagcaggtcttcctctaataactcttccattagtaggccagcagcccctcctgagcccagaccccagcagcaaccacagccaagatctcctgccgcaagaagggccgctgctaggagccgggcagccgccgcgggagggatgcgaagggatcccgcccctggattctccatgttattgttcggcgtctcacttgcttgctactcaccttcgctgaaatccgtacaggaccaagcctacaaagccccagtggtggtcgaaggcaaggtgcaggggctagtccctgcaggtggctcttcttctaattcgacgagagagcctcccgcctccggaagagtggccttggtaaaagtgcttgataaatggccgctgcggtccggcggactacaaagggaacaggtgatcagcgtaggctcctgcgtccccctcgaacgcaaccagcgctatatcttttttctcgagcccaccgagcagcctttggtattcaagaccgcatttgctcctctagacactaacggcaaaaaccttaaaaaagaagtgggcaaaatcctctgcaccgactgtgcaaccaggccgaagctgaagaagatgaaatcccaaacaggccaagtaggagaaaagcagagccttaagtgtgaggctgctgctggcaacccccagccttcctataggtggtttaaggatggtaaggagctgaacaggagccgcgacatccggattaagtatggcaatgggcggaaaaatagcagacttcaatttaataaggttaaagtcgaagacgctggggaatatgtgtgcgaagctgaaaacatcctgggaaaggatacagtcagaggtcgcctgtatgttaattccgtgtcaacgaccttatcatcatggtctggacacgcccgcaagtgcaatgaaacagcgaaaagttactgcgtaaacggaggagtctgctattatatcgagggcataaaccagttgtcttgcaagtgcccgaatggattctttggccagcgttgtttggagaagctgccgcttcgtctgtatatgccagaccccaagcaatctgtgctttgggacacgccgggtaccggcgtgagtagttcacagtggagcaccagtccaaagcctcgctcctgtacgcggcgcgggtcatag

SEQ ID NO: 126078 - DNA, 2577 bp, Artificial Sequence
  Description of Artificial Sequence: Synthetic coding sequence
atgcgccaagtctgttgtagtgcactgcccccacccccactcgaaaagggaagatgttcaagctactctgatagttcgagctcgtcctctgaacggagctcctcatcttcatcttctagtagtgagtccggctcaagcagcagaagttcttctaacaactcctcgatctcccgccccgctgctccacctgagccccgcccccagcagcaaccccagccaaggtccccagctgctcgacgggctgctgctagaagccgggcagctgcagccgggggcatgcgcagggatcccgcccctggattctcaatgctgctgtttggagtgagcctcgcttgttatagcccctcccttaagtctgtgcaggaccaggcatacaaggccccagtagttgtagaggggaaggtccaggggctcgtccctgctggcggctcctcgtctaactctacaagggagcctccagccagtggtcgagttgcacttgttaaggtactggacaaatggcctctgagatctggtggcctgcagcgagaacaggttataagcgtcggttcctgcgtgccgctggagcggaatcagcggtacatttttttcctggaaccgactgaacaaccgctggtattcaagacagcatttgcacctctggacacaaatggaaaaaacctgaagaaggaggttggcaagatcctctgtaccgattgcgcaacacgcccaaaactgaaaaagatgaagagtcagacagggcaggtaggagagaaacagtcgcttaaatgtgaggcagctgccggaaaccctcagccttcatatagatggttcaaggatggtaaggaactgaacagaagccgcgacatcagaataaagtacggcaacgggcgtaagaacagtcggcttcaatttaataaagttaaagtggaagacgccggcgagtatgtgtgtgaagcagagaacattcttggaaaagatactgttcgcggccgcctttatgtgaactcagtgtcaacaaccctgtcttcctggagtggacatgctcgcaaatgtaatgagaccgcgaaatcctattgcgtcaatggcggggtgtgttattacattgagggcattaaccaactctcctgcaagtgccccaacggattctttggccaacgctgcctggaaaaattgccgctgaggctgtacatgccagacccaaagcagtcctttctctcttttgagctgtcaaaggccgaggagctgtaccagaaacgcgtgctcactataaccggaatttgtgtagccctgttggtggttggaatcgtctgcgtggtggcatactgcaagacaaagaaacaacgtaagcagatgcataaccatctccgtcagaatatgtgtcccgcacaccagaacagatcgcttgcaaacggcccatcccacccacggttggaccctgaggagattcagatggccgattacatctccaaaaatgttcccgctactgatcacgtgatccgacgcgaaactgagaccacgttcagcgggtcccacagttgttcaccatcccaccactgctccaccgccacacctacatccagccaccggcacgagtctcacacctggagtctcgaaaggagcgagagtctcacctctgattcccagtcaggaatcatgctctcttctgtcggaacctcaaagtgcaattcgccagcctgtgtggaggcaagagcgagaagggccgccgcctataatctggaagagcggagaagagccacagcccccccttatcacgacagcgtcgatagcttgagagacagtccacactcagagaggtatgttagtgcactgacaactcctgcccgcctgagccccgtggatttccactatagtctggctacacaggtgcccacattcgagatcacaagccctaattccgcgcacgccgtgagcctacccccagcagccccgatctcatataggctcgcagaacagcagccactactgagacatccggccccacccggcccaggaccaggtcccggccccgggcccggcccaggcgccgacatgcaaaggtcatatgattcctactactaccccgcagcaggccccggcccccgccgagggacctgcgccctgggcggatctctggggtcgctccccgcctccccctttcgcatcccagaggacgatgagtatgaaactactcaagaatgtgcaccaccccccccaccccgccccagagcgcgcggtgcaagtcggcgcacctctgcgggcccgaggcggtggaggagatcccgcctcaacggcctcgctgcccaaagggcgagggcagctagggacagcctctcgctgagctcggggagcggggggggaagcgctagcgccagcgacgatgacgccgatgatgccgacggggctctcgctgccgagtctactccttttttaggcctgcgtggagcccatgatgccttaagaagcgactcccctcctctctgtccagcggctgattcgagaacatattactcactcgactcacattctactcgagcatcaagcaggcactcccgaggacccccaccgcgggccaaacaagatagcgctcctttatag

SEQ ID NO: 126079 - DNA, 2355 bp, Artificial Sequence
  Description of Artificial Sequence: Synthetic coding sequence
atgcggcaggtgtgctgctcagccctgccacctcctccactggagaaaggtaggtgttccagctattccgatagtagcagtagcagctcagaacgaagttcctcctcgagttccagctccagcgaaagcgggagctcttcgagatcttcgagtaataactcttcgattagccggccagcagcccctcccgagccgcgtccccagcagcaacctcaaccgcgctcgcctgcagcccggcgcgcagccgcgcgaagtagagctgccgccgccgggggcatgagaagagaccctgctcctggcttctcgatgctcctgttcggcgtgtccctagcttgttatagtccaagtctgaaatccgtgcaggatcaggcatacaaggcccctgtggttgtggaggggaaagtgcaagggctagtgcccgccggagggagtagttccaattctacaagagagccccccgccagcggccgcgtggcattggtcaaggtgttggataagtggcccctgcgaagtggcggtctgcagcgagagcaggtcatctcggttggctcctgtgtgcctttagagaggaaccagagatacattttcttcttggaacctactgagcagcccttggtatttaagactgcttttgccccccttgataccaatggcaagaatttaaagaaggaggtaggaaagatcctttgcacagattgtgcaacccggcctaagttaaagaaaatgaagtcacagacaggacaggttggcgagaagcagagcctcaagtgtgaggccgctgccggaaatccccagccaagctataggtggtttaaagatggtaaagagctaaatcgtagtcgcgatatacggatcaaatacggaaacggcagaaagaattcgcgcctgcagtttaataaggtcaaggttgaggatgccggtgagtacgtgtgcgaagctgaaaatatcctcgggaaggacacagtgcgcggccggttgtatgttaactccgaagctgaggagctgtaccagaagagggtcttgaccatcacaggcatctgtgtagccttgctcgtcgttggcatagtgtgcgtggtggcctattgtaagactaagaaacagcggaaacagatgcacaatcatctgcgccaaaatatgtgtccggcgcaccagaatcgctcgctcgccaacggcccaagccaccccagactggacccagaagagatccaaatggccgattacatcagcaagaatgtccctgctactgatcatgtgattagacgagaaacggagaccacctttagtggctcacactcatgtagccctagccatcattgctcaaccgctacacccacctcttcacatagacacgagtcacatacctggtccttggaacgcagcgaatcactgacttccgatagccagtcaggaatcatgttatcttctgtgggaacctcgaagtgcaatagccctgcatgtgtcgaggcacgtgcacgccgggcagctgcttacaatttggaggagaggagaagagccaccgcccccccctatcatgatagtgtcgactcacttagagatagccctcattctgaacgttatgtttctgccctgacaacgccagccaggctctcacctgtggattttcactactccctggctacccaggtacctacgtttgagattaccagtccgaatagcgcccacgctgtttcgttacccccagccgcgcctatttcctatcggctcgcagagcaacagccacttctgcggcaccccgctcccccaggtcccggcccagggccaggacctgggccgggaccgggagcagatatgcagcggtcatatgactcctattactacccggcagccggccccgggcccagacgcggcacttgcgccctggggggaagcttgggatctctgccggcttctcccttccggattcctgaggacgacgagtatgaaaccacacaggagtgcgccccaccaccccctccacggcccagagcgagaggcgcaagtcgacgcacttctgcgggaccccggagatggcgtcggtcaaggttgaacggccttgccgctcaacgggcgagagccgcacgagatagcttgtcgttgtcttcagggagtggtggagggtccgcctcggcctcagatgatgatgccgacgacgcagatggtgcactcgcagctgagtccactccgtttctgggtctaagaggcgcacatgatgctctgagatctgacagcccgccgctctgtccagcagcagacagtcggacatactactcccttgacagccattcaactagggcctcttcgcgccatagccggggccctccaccgcgtgccaaacaggatagtgcccctctgtag

SEQ ID NO: 126080 - DNA, 993 bp, Artificial Sequence
  Description of Artificial Sequence: Synthetic coding sequence
atgaggcgggatcccgcccccggcttcagtatgctcctgtttggcgtttccttagcatgttattcccccagtctgaaaagtgttcaggatcaggcatacaaggctccggtggtggttgagggaaaagtccaggggcttgttcctgcgggcggcagttcctctaactcgacccgggaaccacccgcatctggcagggtggccctggtgaaggtcttggacaaatggccactccggtcaggcgggcttcagcgggagcaggtcatttccgtaggcagctgcgttcccctcgagcgcaatcagaggtacatcttctttctggaaccgaccgaacagccgttggtgtttaagacagcgttcgctccccttgacacgaacgggaaaaacctcaagaaggaggttgggaaaatcctgtgtaccgattgcgctacaagaccgaaactgaagaagatgaaaagccagactggccaggtaggcgaaaagcagtccctgaaatgtgaagcggcggctggaaacccacaacctagttacagatggttcaaggatggcaaggaactgaacaggtcccgggacatcaggatcaagtacggcaacggccgaaagaatagccgcttacagtttaacaaggttaaggttgaggatgcaggtgaatatgtctgcgaagcagagaatattcttgggaaagatactgtgcgcggccgcctatacgtaaactcagtgtctaccactctcagcagctggtcaggtcacgcccgtaagtgcaatgaaaccgctaaaagctactgcgtgaacgggggtgtgtgttattatatcgagggcataaatcaactgagttgcaaatgtcccaatgggtttttcggtcagagatgcctggagaagctgccactcaggctgtatatgccagatcccaagcagtccgtcctgtgggatacccctgggacaggcgtctccagttcccaatggagcactagtccctctacccttgaccttaactag

SEQ ID NO: 126081 - DNA, 2559 bp, Artificial Sequence
  Description of Artificial Sequence: Synthetic coding sequence
atgaggcaggtttgttgctccgccctacccccccctccactggagaaggggcgctgctctagctactctgactcatctagttcgtctagcgagcggagtagcagttcgtccagcagcagttccgaatcaggcagttcatccagatcgtcatcaaacaatagcagtatttctcgcccagctgcacctcctgaaccgcgcccccagcagcagccgcagccaaggtccccagcagctcgacgagccgctgcacgaagccgcgcagccgcagccggaggtatgcgaagagatccagccccagggttctctatgttgctgttcggtgtcagcctggcctgttattcccctagtctcaagagtgtgcaggaccaggcctacaaggcccccgtggtggtcgaaggcaaggttcaaggcctggtgcccgcaggcggaagcagttccaattcaactcgcgaaccaccagcaagtggtagagtggcactcgtgaaggtgctagacaagtggcctctccgcagcgggggattgcagcgggaacaggtcatcagtgttgggagttgtgtgccactggaacggaaccagcggtatattttcttcctggagcccaccgaacagcccctggtatttaagactgctttcgcccctctggacaccaacggtaaaaatctcaagaaagaggtcgggaagatcctttgtacagattgtgctaccagaccaaagctgaagaaaatgaagtcacagaccggccaggtcggtgaaaagcaatcccttaagtgcgaagccgcagccggcaatccacaaccatcttaccgttggttcaaggacggcaaagaactgaatcgaagccgcgacattcggattaagtatggcaatggaaggaaaaacagcaggctgcagttcaacaaagtcaaagtagaggacgcaggagagtatgtatgtgaggcggagaacattctgggtaaagacacagttcgggggcgcttgtacgtgaacagtgtttccacaacgctttcaagttggtccggacatgcacggaagtgtaatgagacagcaaagtcatattgcgtaaacgggggcgtgtgctactacatagagggtattaatcagttgtcttgtaagtgtccagtcggctatacaggtgaccgatgtcagcagttcgcaatggtcaatttctctactcgccttggcggtgacgtagaagaagcagaggaattgtaccaaaaacgggtgcttacgattaccggcatttgcgtagctctgctggtggttggtatagtgtgcgtggtggcttactgcaagaccaagaaacaaaggaagcaaatgcacaatcacctcagacagaatatgtgtccagcccaccagaaccgaagcctggccaatggcccatcccaccccaggctggatcctgaggaaattcagatggcagactacatctctaagaatgttcccgccaccgatcacgtcattagacgagagacagagaccactttttcaggtagccactcctgcagccccagccatcattgtagtacggctacacctacaagctcccacagacatgaatctcatacgtggtctctcgagagaagtgaaagcctaactagcgatagccagagcggaattatgctgtcgtcagtgggcacaagcaagtgcaatagcccagcatgtgtcgaagctcgagcccggagggcagcagcctacaatcttgaagagagacggagggcgaccgctcctccttaccatgatagcgtggatagtctacgtgattccccacactcagaaaggtacgtttccgccctcaccacacccgctcgactgtcacctgtcgatttccactattctttggcaacacaggtgccaacctttgagatcacaagtccaaacagcgcccacgctgtgagcctgcccccagccgcgcccatttcttaccggctggctgaacagcaaccgctgctgagacaccccgcacctcccggaccggggccaggccctgggcctggaccaggacccggggccgatatgcagcggtcatatgattcatactactaccccgctgcagggcccggcccacgaagagggacatgtgccttggggggcagcctcggctcattgcctgcatcccccttccgcattcctgaggatgatgagtacgagaccactcaagaatgcgccccaccccctccacccagaccaagagcgcggggtgcctctcgcagaaccagtgccggcccacgcaggtggcggagatcgaggttgaacggcttggcagcccagagggctcgggctgcccgagactcactctcgctgagcagtgggagcggaggaggctccgcctccgcatccgacgatgacgccgacgatgcagacggtgccctggcagcggagtctactccctttctcggccttagaggcgcccacgacgccttacggagcgattcaccccccctttgccccgccgctgactcacgcacatattactctctggattctcacagtacgcgggcttccagccgccatagcagagggccaccccctcgcgccaagcaggattccgctcctctgtag

SEQ ID NO: 126082 - DNA, 2535 bp, Artificial Sequence
  Description of Artificial Sequence: Synthetic coding sequence
atgaggcaagtatgctgctctgcgctcccacccccccctctggaaaaaggacgatgcagctcatattccgattcttcttcctcctccagcgaaagaagttcttctagcagctcctcatcgagcgaatctggttcttcctctcgctcatcctctaacaactcctctatctcaagacccgcagcaccacccgaacctaggcctcagcagcaaccacagcctcggagccctgctgcgaggcgcgccgccgcacgttctagagcggcagccgcgggaggcatgcgcagagatccagcccccggtttctccatgctcctatttggcgtgtccctggcctgttacagccccagcctcaagagcgttcaagatcaggcatataaggcacctgtcgttgtagaaggaaaagtgcaaggcctagtccccgccgggggctctagctccaattcaacgagggagccaccagcctctggtagggttgccttggtcaaggtgctggataaatggccactgcggtctggtggcctgcagcgagaacaggtgatctctgttggctcctgcgttcccctagagaggaaccagcggtatattttctttctggagccaacagagcagccattagtctttaagactgctttcgcacctctggacacaaacggaaaaaacctgaagaaagaagtgggaaagattttatgtacagactgtgctacaaggcccaaactgaagaaaatgaagtcacagaccggccaggtgggagaaaagcagtccctgaagtgtgaagccgccgcaggcaacccccaacccagttaccggtggtttaaagatggcaaagaactgaatcggagccgcgatattcgcattaaatatggtaatggtagaaagaactcccgactgcaattcaacaaggtgaaagtggaagacgccggagaatacgtatgcgaagctgagaatattctcggtaaggatacggtgagaggccggttatacgttaattctgtgtctaccaccctgagttcgtggagcggtcatgcccggaaatgtaacgaaaccgctaagtcatattgtgtgaacggtggtgtatgctactatatcgagggaattaaccagttgagctgcaaatgccccgtggggtacactggcgacaggtgccagcagtttgcgatggtgaacttttccaaggctgaagagctgtaccagaagagggtgctgacaattaccgggatctgcgtagccctgctggttgtcgggatcgtctgcgtagtagcttactgcaaaactaagaaacagagaaaacagatgcataaccatctcagacagaatatgtgcccagcccatcagaatcggtcactggccaacggcccttctcatcccagactggaccctgaggaaattcaaatggccgattacatttcaaagaacgtaccggccacagaccatgtaatcagacgggagacagaaactacgttctcaggtagccactcctgtagtccaagccaccactgctcaacagccacacctacttcatctcaccggcacgaatcccatacctggagcctagagcggtcagagtctctcacctccgacagccagtcaggtattatgctgtcctctgtcggtactagcaaatgtaatagccccgcctgtgtggaagccagagctaggcgggccgccgcttacaatctcgaggaaagacgaagggccaccgcaccgccgtatcacgactcggtcgacagcctcagggactcacctcactccgagcgctacgtctcagcactgaccacccctgcaaggctttcccccgtcgatttccattattctctggctacccaggtccccaccttcgagatcacatcgccaaattctgcccacgcagtatcacttccaccagccgccccaatttcctaccggcttgccgagcagcagcctctactgcgacatcccgcccccccagggccggggccaggcccagggcctgggcctggtcctggagctgacatgcagagaagctatgactcctactattatcccgccgccgggcccggccctcgtagagggacctgcgctttgggtggaagcctggggtcattgccagcatctccctttagaatcccagaagatgacgagtacgagacaacccaagagtgtgcgccccctcctccacctcgacctcgcgcacgcggagcctcacgtcgaacttccgccggccctaggcgatggcgcagatctaggctcaacgggctggcagcccaacgggcaagggccgcccgcgactctctctccctgtcaagtggatccggcggggggtcagcctctgcctctgatgacgacgccgacgacgccgacggagctctggctgctgagtcaaccccttttctgggcttgcgcggagctcacgatgccctgcgtagcgactctcctcctttatgccccgccgccgactctcgaacatactacagcctggactctcattctacacgtgcctcttcacggcattcacgaggtccccccccaagggctaagcaagatagcgcccccctctag

SEQ ID NO: 126083 - DNA, 2577 bp, Artificial Sequence
  Description of Artificial Sequence: Synthetic coding sequence
atgaggcaggtgtgctgctctgctctgccgccgcccccactggaaaaaggccgatgttcttcgtactcagactctagcagctcctcttctgagcgcagcagcagttctagtagtagttctagcgaaagcggaagctcttcacggagcagcagtaacaacagctcaatttcacggccagctgcccctcccgaaccacgtccccagcagcagccgcagcctcggtcccccgccgccaggcgggcggccgctcgtagcagagctgccgccgctggcgggatgagacgggaccccgctccgggctttagcatgctgctgttcggtgtgagccttgcttgttactcaccctccctgaagtctgtgcaggaccaggcctacaaggccccagtagtggtggaaggaaaggttcagggcctggtgccagctggcggttcctccagtaatagcacaagagagccccccgcttctggacgtgtcgctctcgtgaaagttttggacaaatggccactgcgaagcggaggtttgcagagagagcaagtcattagcgttggttcatgtgtgccactcgaaaggaatcagcgctacatttttttcctggagcctaccgagcagcctctggtttttaaaaccgcgtttgcaccactggatactaatggcaagaatctcaaaaaggaggttggaaagatcctgtgcaccgactgtgccactaggcctaaactgaagaagatgaagtctcagaccggacaagtgggcgagaagcagtctctcaagtgtgaggcggctgctggcaaccctcagccgtcctacagatggtttaaggatggcaaggagctgaaccgcagccgagacattcgcattaagtatggcaacggccgtaaaaatagccgcctgcaattcaataaagtcaaggtagaagacgcaggcgaatatgtgtgcgaagccgaaaacattctgggaaaggatacggtgcgtgggcgattgtacgtcaactcagtaagcacaacgctgtcttcttggagcggccatgccagaaaatgtaacgagactgcaaaaagctattgtgtcaatggaggggtctgttactatatcgaagggattaatcagctcagttgtaagtgccctaacggcttttttggccaaaggtgtctcgagaaacttcctctgcggttgtacatgccagatccgaagcagaagcatcttggtttcgaacttaaagaagcagaagaactgtatcagaagcgagttcttactattaccggaatctgcgtggcattgcttgttgtgggaatcgtttgcgtggttgcctactgcaaaaccaagaagcagcgaaaacagatgcacaaccacctgcggcagaacatgtgcccagcacaccaaaaccggagcctcgctaatggaccttctcatccaaggttggatccagaggagatccagatggccgattacataagcaaaaacgtgcccgctacagatcatgttatcaggcgcgagaccgagacaacctttagcggcagtcacagctgttccccaagccaccattgctcaacagccacgccgaccagctctcatagacacgagtcccacacctggtccctcgagcgtagcgagagtctaacctcagattcacagagcgggattatgctctcttccgtgggcacatccaagtgtaacagcccagcatgtgtggaggctagggctcgacgggccgcggcatataatttggaggaacgcagacgcgccaccgctccaccataccacgacagcgtggactctctgcgcgattccccccatagcgaaaggtatgtatcggctcttacaaccccggcgcgcctgagccctgtcgacttccactattccctggctacccaagtccccacgtttgagataacaagtcctaactccgctcatgctgtgtcgctgccccccgctgccccaatcagctatcgactggctgagcagcagccactcctgagacacccagctccacctgggccagggccaggtcccggaccgggacccggtccgggggcagacatgcaacggagctatgatagttattactatccagccgccggtccaggaccgcgacgaggaacatgcgccttgggaggttccctggggtcgctccccgctagccctttccgcatcccagaggatgatgagtacgagacaacacaggagtgcgcccccccacccccacctcgtccccgggcgaggggggcctctcgcagaacaagcgctggcccccgcaggtggcggcgcagccgcctgaacggcctggccgcccagcgggctagagccgctcgggattcactgagcctgtcatccggctcagggggtggatctgcaagcgccagtgacgacgacgctgacgacgccgacggagcactggccgcagagtccaccccattcctcggtctgcgcggggcccatgatgctcttcggagtgacagtccgcccttatgtcccgctgctgattccagaacatattatagtctggattcccattccacacgggcgtccagccgacactcccggggcccaccaccgcgggccaagcaggacagcgcacccctgtag

SEQ ID NO: 126084 - DNA, 2091 bp, Artificial Sequence
  Description of Artificial Sequence: Synthetic coding sequence
atgtctgagggcgcagctgccgcctcgccaccaggagcggcctcggcagcagcagctagcgcagaagagggcacggcagctgcggcagcagctgcagcagcaggcggcggacctgacggaggcggggagggcgccgctgaacctcctagagagttgcgctgctctgattgtatagtgtggaaccgccagcaaacgtggctgtgcgttgtgcccctttttatcggcttcattggtttgggccttagcctgatgctgttaaaatggatcgttgtgggatcggtcaaagaatatgtccctacggacctggtcgattcaaagggaatgggacaggatcctttctttctgagcaaacctagtagtttccccaaggccatggagaccacaaccacgactacaagtactactagccctgccactccaagcgcaggtggcgccgccagctcacggacacctaataggatttcgaccaggctgactacgatcacccgggccccaaccaggttccccggtcacagggtgcccattagagcttctcccagatccactacggctaggaataccgctgcgcctgccacagtcccgtcgacaactgccccattctttagttccagcaccctcggttccagaccaccagtgcctggcactccgtccactcaggcaatgcctagttggcctacggctgcctatgcaacatctagctacttacacgatagcacaccgtcttggactttgagcccatttcaggacgctgcatccagttcaagctcaagttcttcatccgccaccacaaccacaccagagacctctactagtccaaaattccacacgacaacatattccaccgagcgttccgagcactttaagccctgccgggataaagatctggcatactgtctgaatgacggagaatgcttcgtgatagagaccctcacggggtcgcacaagcactgtcgctgcaaagaaggttatcaaggcgtacggtgcgatcagttcctgcctaaaaccgattcaatcttgtcagacccaaccgaccacctgggtattgaattcatggaatcagaggaagtataccagcgacaggtgctgtccattagttgcatcatttttggtatcgtcattgtcggtatgttctgcgccgccttctacttcaagagcaaaaaacaagccaaacagatccaggaacagcttaaggtccctcagaatgggaagtcttactccctcaaggcctcatccaccatggccaagtctgaaaatctcgtgaagtcccacgtacagctccagaattacagtaaagtagagagacacccagtgactgcgttggaaaaaatgatggagagtagtttcgtgggtcctcagtcatttccagaagtgcctagtcctgatcgggggtcccaaagcgtgaaacatcacaggtccttaagttcatgttgtagtcctggtcagaggtctggcatgctccatcgaaacgcattccgcagaacgccgcctagcccaagatctcgtctgggaggcattgtggggcccgcttatcaacagctggaagagagcaggatccccgatcaggatactattccttgccagggatactcaagtagcggcctgaagactcagcgtaacacatccatcaacatgcagttgccctccagggagacaaacccttatttcaattccctagaacagaaagacctggttggatacagctccacaagagcaagttctgtccccatcattccgagtgtggggctggaggaaacctgcctgcaaatgccagggatctcggaagtgaagagtatcaagtggtgcaagaattcttattctgcggacgtggttaatgtcagtattcccgtttcagattgtctcatagccgaacagcaggaggtgaagatcctgctcgagacggtgcaagagcagatccggatcctgactgacgcccggcgctctgaggattatgagctcgccagcgtggagactgaagacagcgcctcagaaaatacagccttcctacctctatctccgacagccaaatccgagcgcgaggcacaattcgtgttgcgtaatgagattcagagagattccgcacttacaaaatag

SEQ ID NO: 126085 - DNA, 1500 bp, Artificial Sequence
  Description of Artificial Sequence: Synthetic coding sequence
atggagtgtggcatacctcccacactggtatgcgtgggaagaggagggggactgcacacaataaatatcataatatggtactatttcccctcggcatggaggacttgtttcaacatcagcagctccgttggcctattactgacaaatagctacaaattttacacgaccacctacagcacagaaagaagcgagcattttaagccctgtagagacaaggatttggcctactgcctaaacgacggagaatgctttgtcatcgagactcttactggttcccacaagcactgtcggtgcaaggaaggataccagggagtcagatgtgaccagtttttacctaagacagattctatcctctccgacccaaccgaccatctcggcatcgagttcatggagtccgaagaggtgtaccagcgccaagtactatccatctcttgcattatctttgggattgtgatcgtgggcatgttctgcgccgccttctacttcaagagtaagaagcaggcaaagcagatccaggagcaacttaaagtgccgcaaaacggcaaatcttacagcctcaaggcctcttccacaatggccaaaagtgaaaatctcgtcaagagtcatgtccagctccaaaactattcaaaggtcgaacggcatccagtgactgccctagagaagatgatggagtccagcttcgtgggccctcaatcatttcctgaagttcccagtccagatagaggctcccaaagcgtgaaacatcaccgatccctttcatcctgttgttcccccggtcagcggagcggcatgctacatcgcaacgcgtttcgacgcacgccgccctctcctcggtcccggctgggcggtattgtggggcccgcatatcagcagctggaagaaagcaggatcccggaccaggacaccataccctgccaagggattgaagtgaggaaaactatctcacacctgcccattcagctgtggtgtgttgaacggccactcgatttgaagtacagttcgtccgggctgaaaactcaacgtaacacttccattaacatgcaattgccatccagggaaactaacccttattttaatagtttagagcagaaggacttagtaggatatagctcaaccagagcatcctccgtaccaattatcccaagtgtgggcctggaagagacttgccttcagatgccgggcatttcagaggtcaaaagtataaaatggtgtaaaaatagctattccgctgatgtggttaacgtaagcattcctgtaagtgattgcctcattgccgaacaacaagaggtcaagatactgctcgagactgtccaagagcagatcagaattctgacagacgcaagacggtctgaggactacgagctggcatcggtagagacagaagactccgcttctgagaataccgcattcctgcctctgagcccaacagccaaatccgagcgggaagctcagttcgtcttgaggaacgaaatccaaagggatagcgccttgacaaaatag

SEQ ID NO: 126086 - DNA, 2163 bp, Artificial Sequence
  Description of Artificial Sequence: Synthetic coding sequence
atgagcgaaggtgctgcagccgcatcacctcctggcgcagcatccgctgccgctgcctccgctgaagagggcacagccgcagctgctgcagccgcagcagctggcggcgggcctgacggaggcggcgaaggcgctgccgagccaccgcgcgaactgcgttgcagtgactgtattgtgtggaacaggcaacagacatggctctgtgtcgtgccgctatttattgggtttattggactggggctgtcgctgatgttattaaagtggatcgttgtcggctctgtgaaagaatatgtgccaacagacctggtggactcaaaaggtatgggccaggaccccttcttccttagcaagccttcttcttttcctaaggcaatggagacgacaacaactactacctccacaacaagtcccgctaccccaagcgcaggcggcgccgcaagttcacgcactccaaatcgcatctcgacacgcctgactactattacaagagctccaactaggtttcccggccatcgtgtgccaattcgggcgtcccccagaagcaccacggcaagaaatacagcggctccggccacagttccaagcacaacagcaccgttcttcagttcctcaacactagggtcccgccctccagtgcccggcaccccgtctacccaagccatgccttcctggccaactgccgcgtacgccaccagcagctacctgcatgacagtactccatcttggacgctttctccctttcaggacgctgcttcttccagcagttcttcgtcgtctagtgccactaccacaacaccagaaacctctacatccccaaagttccacaccaccacttatagtaccgagcgcagtgagcacttcaagccttgcagggataaagaccttgcctactgcttgaacgacggagaatgctttgtgatcgagacgctgacgggttcgcacaagcactgtcggtgcaaggaagggtaccagggcgtgaggtgcgaccaattcctccctaaaacagattccattctcagtgaccccactgaccacctgggcatcgaattcatggagagcgaggaggtctatcagcgtcaagtcctctctatctcttgcattatcttcgggattgttattgtggggatgttttgcgccgcattctacttcaaaagtaagaaacaggcgaagcaaattcaggaacagttaaaggtcccccaaaatggtaagagctactcactcaaggcatcctctacaatggccaagtctgagaacttagtgaagagccatgttcaacttcagaactattccaaggttgaaagacaccccgttactgccctagagaagatgatggagagtagtttcgtcggacctcaaagttttccagaagtgccttcccccgacagggggtctcagtcagtgaaacatcaccggagcttatcttcctgttgttctcccggccaaagatcaggcatgctccaccgtaacgctttccggcgaacgccccccagccctcgttctaggctgggtggtattgtgggacccgcataccagcaattggaagaaagcaggatccctgatcaggacacgattccgtgtcagggcattgaggtgcggaagaccatctctcacctccccatacagctgtggtgtgtggaacgaccactggacctcaagtattcctcttctgggctcaaaactcaacgtaatactagcattaacatgcagctgcccagtagggagaccaacccctactttaatagcctcgaacaaaaggatctggtcggatacagcagtactcgggccagctccgtccctattatccccagtgttggcctggaggagacttgtcttcagatgcccggcatatcggaggtgaaatccattaagtggtgcaagaactcctatagcgcagacgtggtgaatgtatcaattccagttagcgactgcctgatagcagagcagcaagaggtcaagatactcttagaaactgttcaggagcaaattcggattttgaccgatgcacgccggtcggaagattatgagcttgcgtccgtcgaaacagaggatagtgctagtgaaaatacagcgttcctgccactgtcccccacagctaaaagcgagagagaggcccagttcgtgttgcgtaacgagattcaacgtgatagcgctctgactaagtag

SEQ ID NO: 126087 - DNA, 2088 bp, Artificial Sequence
  Description of Artificial Sequence: Synthetic coding sequence
atgagtgagggagccgcggcggcctctcccccaggcgctgcctctgctgccgctgcatcggcagaagagggcaccgccgcagccgctgccgcggctgcagcaggggggggacccgatggcggcggcgaaggtgcagcagagcctccgagagagctcagatgctctgattgcatcgtatggaatcgccagcagacttggctttgtgttgtaccccttttcattggatttattgggctgggactgagcctgatgttgcttaagtggattgttgtaggaagtgtcaaagaatatgtgcctacagatctggttgattcgaagggtatgggacaggaccctttctttctgtctaagcccagcagcttcccgaaggcaatggaaacaaccacgactactacttcaacaacctctcccgcaaccccgagtgctgggggcgctgcgtcttctcgcacaccaaaccgcatctcaacacggttgacgactatcacacgggctccaaccaggtttcccggccaccgtgtcccaatcagagcatcacctcgatcaactactgccagaaacaccgccgcacctgctaccgtgccatccaccaccgcacccttcttctcctcgtcaaccctcggatctagaccccccgtaccaggtactccttctacccaggccatgccctcatggcctacagcggcgtacgccacatcctcttacctacatgattctactccctcatggacgctctcgccttttcaggacgctgcctcttcctcctcttcctcatcctcgtccgctaccacgactacccctgagacctccacctccccaaagtttcacaccaccacgtacagtaccgagcgaagcgagcatttcaagccatgtcgggataaggacttggcttattgcctgaacgacggcgaatgttttgtgatcgagacacttactgggtctcacaagcattgccggtgtaaggagggataccagggcgtgcgatgtgaccagtttctcccgaagacggacagcatcttatctgaccccacccatattggaattattttcaccgagagcgaggaagtctaccagcgccaggtgctcagcatctcctgcatcattttcggaatcgttattgtgggcatgttttgcgctgcgttctatttcaagtccaagaagcaggccaaacagatccaagagcagttgaaagtcccccagaacggtaaatcttatagcctaaaagcctcatccacgatggcaaagagcgagaacctggtgaagtcccatgtgcagctgcagaactattcaaaagtcgaacgacaccccgtgactgccctcgagaaaatgatggagtcctctttcgtgggtccccaaagcttccccgaagtgccgtcaccagaccgagggagtcaaagtgtgaaacatcaccgttcattatctagctgctgctcacctggacagaggtccgggatgctgcaccgcaacgcattcagaagaaccccaccatcacctaggtcaagattgggtggtattgtggggcctgcttaccagcagttggaggagagtaggataccggatcaggacaccataccatgtcagggctattcgtcatccgggctgaaaacacagcgaaacacctccattaacatgcagctgccctccagggaaaccaacccttacttcaattccttggaacagaaagacctcgtggggtacagctccacaagggccagcagcgtcccgatcatcccgtctgtcggacttgaagaaacttgtttacagatgccaggcattagtgaggttaagagtatcaaatggtgcaagaattcttactccgccgacgtggtcaacgtgtctatacccgtgagcgattgtctgattgccgagcagcaggaagttaaaattcttctggagaccgttcaagaacagataagaattctaacagatgctcgacgctctgaagattatgagcttgcctccgtggagacagaggactccgctagtgagaacacggcattcctgcccctttctcctacagccaagtccgagagggaggctcaattcgtgctgagaaacgaaatccaacgcgactcggccctaaccaagtag

SEQ ID NO: 126088 - DNA, 1041 bp, Artificial Sequence
  Description of Artificial Sequence: Synthetic coding sequence
atggagagcgaggaggtgtaccagcgacaggtgctgagcatttcctgtataattttcgggatagtgatagttgggatgttttgtgccgcattctacttcaaatccaagaaacaagctaagcagattcaggaacagttgaaggtcccccagaacggaaagagctacagcctgaaggcatcctctactatggctaaaagtgaaaacctggtgaagtcccacgtccagctgcaaaattattctaaggttgaaagacaccctgttaccgctttggagaagatgatggaaagcagctttgtggggccccaatcctttccggaagtgcctagccccgatcgcgggagccagagtgtaaaacaccacagaagtctgagttcttgctgcagtccgggccaacgctccgggatgttacatcgcaacgccttcaggcgcacgccaccctcaccaagatccaggctggggggtattgtcggtcctgcctaccagcagctggaagagtcacggatccctgaccaggatactattccctgccaagggtactcaagctctggcctcaagacacaacggaatacctctataaacatgcagttgccctccagagagacaaacccatactttaattccctggaacagaaggatcttgtgggatattctagcactagagctagctccgtgcccatcatccctagcgttggactcgaggagacatgcctgcaaatgcctggaatctccgaagtgaagtccatcaagtggtgcaagaactcatactccgcagacgtggtaaacgtgtccatccccgtgtctgactgtctgattgccgaacaacaagaggtgaaaatcctcctcgagacggttcaagagcagattagaattctcacagacgcccgcaggtctgaggattatgaactggccagcgtagaaacagaggatagtgccagcgagaataccgcttttctgcctctgagccccacggccaaaagtgaacgggaggcccaattcgtcctgaggaacgagattcagcgtgacagtgctctcactaaatag

SEQ ID NO: 126089 - DNA, 1041 bp, Artificial Sequence
  Description of Artificial Sequence: Synthetic coding sequence
atggaaagcgaagaagtctaccaaagacaggtgctgtcgatcagttgcataatatttggcatcgtgattgtgggcatgttttgtgctgctttctactttaagtctaagaaacaggctaaacagattcaggagcagctgaaagtgccacagaatgggaaatcctatagcctgaaggcttcatctactatggccaagtccgaaaacttagtcaaatcccatgtacagctacagaactattccaaggtggagcggcaccctgtgaccgcgcttgagaaaatgatggaatcatcatttgtaggtccacaatctttccctgaggttcccagtcctgacaggggaagccagtcggtaaaacatcacaggtccctatcaagttgctgttcaccaggccaacgaagcgggatgttacaccggaatgcgtttaggagaacacctccgtcccctagatcccgcctggggggtattgtcggccctgcataccagcagctggaagaaagtcggataccagatcaagataccatcccgtgtcagggatacagctcctcaggcctcaaaacacaacggaatacctccatcaacatgcagctgcccagtcgggagaccaacccatattttaattcgctcgaacagaaagacttagtggggtattcctcaacacgcgcaagttcggtgccaattattccctccgtgggtctggaggagacatgccttcagatgcccggtatttccgaggttaagtcaataaaatggtgcaagaactcctatagcgcggatgtggttaatgtgtcaataccagtttcagattgtcttatcgccgagcagcaggaagtgaaaattttgctggagactgttcaggagcaaatcaggatcttgactgatgcccggcgaagtgaggactacgaactggcttccgtggagactgaagattcagcgtcagagaacacagcatttcttcctctttcaccgaccgccaagtccgaaagggaagcacaatttgtgctccggaatgaaattcagcgtgactcggccctgactaaatag

SEQ ID NO: 126090 - DNA, 171 bp, Artificial Sequence
  Description of Artificial Sequence: Synthetic coding sequence
atgcccacggatcacgaagaaccttgcggcccaagccataaatccttctgcctgaatgggggcctctgctatgttatacccacaatccctagccccttctgcagtctgcacgaaaacgagaatgacaacaatgaggacctttatgacgatctgctgcccttgaacgagtag

SEQ ID NO: 126091 - DNA, 348 bp, Artificial Sequence
  Description of Artificial Sequence: Synthetic coding sequence
atgccaacagaccacgaagaaccgtgcgggccaagtcacaaaagtttttgcctgaacggtggattgtgttatgttatccctactatcccttctcccttttgtaggtgtgtagagaactataccggcgctaggtgtgaggaggtcttcttgcccggcagtagcatccagactaaaagcaacctgtttgaagcttttgtggccctcgccgtcctggttaccctcatcatcggagccttctactttctctgccggaagggacacttccagagggccagcagcgtgcagtatgatattaacctggttgagacatcctccacctccgcccaccatagtcacgagcagcactag

SEQ ID NO: 126092 - DNA, 273 bp, Artificial Sequence
  Description of Artificial Sequence: Synthetic coding sequence
atgcccactgaccacgaggagccttgtggaccctcacacaagagcttttgcttgaacggaggcctgtgctacgtgattccgactatccctagccctttctgtcgctgcgtggaaaattacactggtgcccgctgcgaggaggttttcctcccggggagctctattcagacaaagtctaacctcttcgaggccttcgtggcattggccgttttagtgacactcatcatcggagcgttctattttctgtgtcgctgtgggaacacatgtatgtag

SEQ ID NO: 126093 - DNA, 615 bp, Artificial Sequence
  Description of Artificial Sequence: Synthetic coding sequence
atgatgcccagttgtaaccgatcctgctcatgcagtagaggtccatcggttgaagatggaaagtggtacggtgtccgaagctacctccatctgttttacgaggactgcgctggcacagctctctcagacgatccggagggccctccggtgctatgccctaggaggccctggccctccctttgctggaagatctccctctcgtctgggaccctgctgctcctgctaggcgtggccgcgctgacaactggctatgctgtgcctcctaagctggaaggtattggtgaaggagaatttcttgtgctggaccagagggccgcagattacaaccaagctcttgggacctgccgcctggctgggaccgccttgtgtgtggccgcgggtgtcctgctcgccatctgcctgttctgggctatgatcggttggctgtcgcaggatacgaaggcggaacctctcgatcctgaagccgattcacatgtggaagtgttcggggacgaacccgaacaacagctctcaccgatcttcaggaatgcatcaggtcagtcttggttctcgccacccgcgagcccttttggccagagttctgttcagaccattcagccgaagagggatagttag

SEQ ID NO: 126094 - DNA, 615 bp, Artificial Sequence
  Description of Artificial Sequence: Synthetic coding sequence
atgatgccatcctgtaatcgatcatgcagctgtagtagaggccccagcgtggaagacggcaaatggtacggtgtacgtagctaccttcacctgttctacgaggactgcgcaggaaccgccctaagcgatgacccggagggccctccggtgctgtgtccccgtagaccttggcccagcctgtgttggaaaatctcgttatcatctggtaccctactgctgttattgggcgtagctgcactcactacgggatatgccgtgcccccaaagctcgaaggaataggagagggagaattcctagtgctcgaccaaagagctgccgactacaaccaggcgctggggacatgcagactggccggaaccgcgctttgtgttgccgctggagttttgttggccatttgcctgttttgggctatgattggctggctctctcaggacacaaaagcagagcccctcgatccagaggccgattcccatgtggaagtgttcggcgacgaaccagagcagcagttatcacccatttttaggaacgcctcaggtcaatcatggttttctccccctgccagcccgttcggacaatcctcagtgcaaaccattcagccaaagagggacagctag

SEQ ID NO: 126095 - DNA, 1329 bp, Artificial Sequence
  Description of Artificial Sequence: Synthetic coding sequence
atgtaccagagaatgctccgatgtggtgcggagctggggtcacccgggggcggcggtggcggtgggggtggcggaggtgcgggaggcaggcttgcattgctctggatagtaccgctaaccctgtcgggcctgctgggagtagcttggggagcctctagcttaggggcccatcatattcaccattttcacggaagcagcaaacatcactcagtgcccatcgccatatatcggagcccagcctccctccgcggcggacacgctggtacaacttacatcttctccaagggtggcggtcagattacatacaaatggcctcccaacgatagaccaagcacccgagccgacaggctcgctatcggattcagcaccgtgcagaaggaagctgtcttagtgcgggtggactcttcatctggccttggtgactatcttgagctgcatatccatcagggcaaaattggcgtcaagttcaatgtaggtactgatgacatcgctattgaggaaagcaatgcaatcatcaatgacggcaagtatcacgtcgttcgttttacccgctccggaggaaacgctactctgcaggtggacagctggccagtgatagaacgatacccagcaggtcggcaattgaccattttcaactcacaggctactatcattattggtggaaaagaacaggggcagcccttccaggggcagcttagtggcctctactataatggcctgaaagtccttaatatggcagccgagaacgatgcaaatatcgcgattgtaggaaacgtgcgccttgtgggagaagtgcccagcagcatgaccacagagtcgacggcaaccgctatgcagagcgaaatgtcaacctcgatcatggagactacaacaaccctcgcaacaagcaccgcgagacgcggaaagccacctacgaaggaaccaatctcccaaacaaccgatgacattttggtggcctctgccgaatgtccttccgatgatgaggacatcgatccttgtgaaccatcttctggggggctggctaatcccaccagggcagggggtcgggaaccatacccaggtagtgccgaagtgatcagggaatcctcgtcaacaaccggtatggttgtcgggatcgtggctgcagcggcgctgtgcattttgatcctgctgtacgccatgtataaatatagaaacagagacgaggggtcctaccacgttgacgagtcaaggaactatatctcgaacagtgcccagtctaacggggccgtggtgaaagaaaaacagccctcatctgctaagagcagcaataagaataagaaaaacaaagacaaagaatactatgtgtag

SEQ ID NO: 126096 - DNA, 4524 bp, Artificial Sequence
  Description of Artificial Sequence: Synthetic coding sequence
atgggcaccgccttactccaacgcggaggctgcttcctcctctgtctatcactacttctcctgggttgttgggctgagttgggatccggacttgagtttccaggggccgaaggccagtggacgcggtttcctaagtggaatgcctgttgtgaatccgaaatgagcttccagctcaaaactagatcagcccgtggacttgtactgtacttcgatgatgagggtttctgtgactttttagagcttatactcacgagaggcggcaggctccagctttcattctcaatcttttgtgctgagcccgctaccctccttgctgacacaccggtaaacgatggcgcatggcactccgtccggatccgtcggcagtttcggaacacgactctttttatcgatcaagtggaggctaaatgggtggaagtgaagtcaaagaggcgcgatatgacagtgttttccggattatttgtgggaggcctaccacctgaactgcgagcggcggcattgaaattaactctggcgagcgtacgcgagcgcgaaccgtttaagggatggataagagacgtgcgggtgaacagcagccaggtgctgcccgtggatagcggcgaggttaagctggatgatgagcctcccaacagtggaggtggatccccgtgcgaggcaggggaggaaggggaagggggggtatgcctcaatggaggcgtctgctccgtcgtcgatgaccaagcagtctgcgactgctcaagaactggatttcgcggcaaggactgcagccaggaagacaacaacgtggaagggcttgcccacctgatgatgggggatcagggtaagagcaaagggaaagaggagtatattgctacgttcaagggtagcgagtacttctgctacgaccttagccagaatcctatacaatcttcatctgacgagataactttgtctttcaagacccttcaaagaaacggtcttatgctgcacactgggaagagtgccgattatgtgaatttggctctgaagaacggagcagtgagcttggtgataaacctgggaagtggggctttcgaggctctagtcgaaccagtaaatggcaaatttaatgataacgcgtggcatgatgtaaaagtgacccggaatcttcgacagcatagtgggatcgggcacgcgatggtgaccatctctgttgatggcatcctgaccacaacaggttatacacaggaagactacacaatgcttgggagcgatgacttcttttatgttggcggaagtccctcgacagccgacctcccaggatctccagtctcaaataactttatgggctgcctcaaggaagtggtttataagaacaacgacgtgcggctggagctctctcgcctcgccaagcagggtgatccaaaaatgaagatacacggcgtcgtggctttcaaatgtgaaaacgtagccacattggatccaatcaccttcgaaacccccgagtcctttattagcctgcccaagtggaacgccaaaaagacaggatccattagcttcgacttccgaacaactgagcccaacggactgattttgttttctcacggcaaaccacggcaccaaaaggacgctaagcaccctcaaatgataaaggtggactttttcgcaatcgagatgctcgacggccacctatacttattgctagatatgggtagtggcactatcaagatcaaagccctcctgaaaaaagtgaacgacggtgagtggtaccatgtggactttcagcgcgacggtaggagcggaaccattagcgtaaataccttgcgaacgccttataccgcccctggagaaagcgagatcttagacctcgacgacgagctctaccttggcggactgccagagaataaggccggcttagtgttcccaacagaggtatggacagctctactgaattatgggtacgtgggatgcatcagggacttatttatcgacgggcagtctaaggacatcagacaaatggccgaggtgcagagcaccgccggcgtgaaaccctcttgtagtaaggaaacagccaaaccttgtctcagtaatccgtgtaaaaataacggcatgtgtagggatggctggaaccgttatgtatgtgactgtagtggaaccggctacctggggaggtcttgtgagagagaagccactgttctgtcatacgatggctcaatgtttatgaaaatccagctgccggtcgtcatgcacacagaagctgaagatgttagtctcagattccgcagccagcgggcctatggcattctgatggcaacgaccagccgcgacagcgccgatactctgcggctcgaacttgatgccggtcgggtgaaacttacagtgaatctggactgcatacgcattaattgtaatagctccaaagggcctgagactctgttcgccggctataatttgaatgataatgaatggcatactgtgagagtagtcagaaggggtaagagtctgaaactgaccgttgacgatcaacaggcaatgaccggccaaatggctggggatcatacacgcctggaattccacaatatcgaaacagggataattacagaaagaagatatctgagcagtgtcccaagcaattttatcggacacctccagtcgctgacgttcaatgggatggcctacattgatttgtgtaaaaatggggatatagattactgcgagttgaacgcaaggttcggattccgaaatatcatcgcagaccccgtgacattcaagaccaaatccagttatgtggccctggcaactcttcaggcctatacttccatgcatctgttcttccaattcaaaactacaagcctggacggtttgatcctgtacaactctggtgacggaaacgattttatcgttgtggaactcgtgaaggggtacttacactacgtcttcgatctcggcaatggggcgaacctaattaaggggtctagcaataagcctctgaacgataaccagtggcataacgtgatgataagccgggatacctctaacttacacacagtgaaaatcgatactaaaattacaactcaaattaccgccggcgcgcggaatttggacctgaaaagtgacttgtacattggaggggtcgcaaaagaaacctataagtctcttccgaagctggtacacgcaaaggagggtttccagggatgtttggcatcagtggacctaaacggacggctccctgatctcataagtgacgcattgttttgtaacgggcagatagaacgagggtgtgaggggcccagtacaacctgtcaggaagactcttgcagcaaccagggtgtatgtctgcagcaatgggatggattcagctgcgattgttccatgacttctttttctgggcccttgtgtaatgaccccggaactacctacatcttttctaaagggggagggcagattacttacaaatggcccccaaatgaccgcccctctacccgagcagacagattggccatcggcttttccaccgtgcagaaggaagctgtccttgtgcgcgtggatagcagctcgggactgggggattacctggaactgcatatacatcagggcaaaataggcgtgaagtttaatgtaggaaccgatgacatcgccattgaggaatctaatgccattataaacgacggaaagtatcacgttgtgaggttcacccgatctgggggaaatgccacactgcaagtcgactcctggccagtgattgagcgatatccagctggtaacaatgataatgaaagattggctattgctagacaaaggatcccctatcgacttggccgggtggtggacgagtggctcctcgataagggtaggcagctgacaatcttcaacagtcaggccaccatcatcatcggaggaaaggagcaaggacaacccttccaaggccagctgtccggcctatattataacggcttgaaggtacttaatatggctgcagaaaatgatgccaatattgcgatagtgggcaacgtgcgacttgtgggagaggtccccagctctatgacaaccgagagtaccgccaccgctatgcaaagcgaaatgtctacctctatcatggaaacaacgactaccctggcgacttccaccgcccgacggggcaaaccgccaactaaggagcctatttctcagaccacagatgacatcctggtggcatctgctgagtgcccctccgacgatgaggacatagatccgtgtgaaccaagctcaggcggactggccaacccaactcgggcggggggaagggaaccatatccgggctctgctgaggtcatcagagaaagtagctctaccactggtatggtggtggggatagtggccgcagctgctttgtgtatcctgattctgctgtatgctatgtacaagtacagaaaccgggatgaggggtcctaccacgttgatgagagtcggaattacatcagcaacagcgcacaatcaaacggagccgtcgtgaaggagaagcagcctagcagtgctaaaagctccaacaaaaataaaaagaataaagacaaagaatactacgtgtag

SEQ ID NO: 126097 - DNA, 1488 bp, Artificial Sequence
  Description of Artificial Sequence: Synthetic coding sequence
atgatctcccgagacacttctaatctccacactgtgaaaatcgacactaagatcaccacacaaattactgcgggagccagaaatctggacctgaaatccgacctgtatatcggtggcgtcgctaaggagacatacaagagcttacccaagcttgtgcatgccaaggaagggttccagggttgtctggcatccgtggatctcaacggcaggctacccgatctcatctccgacgcactgttttgtaacggacagatcgagcgtggctgtgaagtggctttaatgaaggctgatctacagggacctagtacgacatgtcaggaagatagctgttcgaaccagggcgtatgtttgcaacagtgggatggtttttcctgcgattgttctatgacttcgttcagcgggccactgtgcaatgaccccggtactacttacatattttccaaaggagggggccagatcacatataagtggcctcctaatgaccgacccagcaccagagccgatcgactggctattgggtttagcacagtgcagaaggaagccgtgctggtgagggttgacagtagttcgggtttaggtgactatctagaattacacatccaccagggaaaaattggcgtcaaattcaacgtcggcacagatgacatagctatcgaggagagcaatgccataattaatgacggaaaataccatgtggtgaggtttacaaggagtggtggcaacgctactctgcaggttgacagctggccggtgatcgagaggtatccagcaggcaggcaactcaccattttcaatagtcaggccaccattattatcgggggcaaagagcagggacagccatttcaaggacagctatctggtctctactataatggcctgaaagtgctgaacatggccgccgaaaatgacgccaatatagcaatcgtcgggaacgtgaggcttgtaggcgaggtgccctcctcaatgactaccgaatcaacagcaacggccatgcagagcgaaatgagcacctccattatggagaccacaactacactagctacaagtaccgctcgtagaggcaaaccgccgactaaagaacctatttcccagaccactgatgatattctcgttgctagtgcagaatgtccaagcgatgatgaggatatcgacccgtgcgaaccatctagtggcgggctcgccaatcccacgcgtgccggtggacgggagccttaccccggcagcgcagaagtgatccgcgaatcgtccagcacaaccggcatggttgtggggatcgtcgcagccgctgcactctgtatcctgatcctgttgtatgccatgtacaaatataggaatcgagatgaggggagttaccacgttgacgaatcaaggaactacatctctaatagcgctcagtcaaacggagccgtcgtgaaggaaaagcagccatcatccgccaaaagcagtaataaaaacaagaaaaataaggataaggagtactatgtctag

SEQ ID NO: 126098 - DNA, 4500 bp, Artificial Sequence
  Description of Artificial Sequence: Synthetic coding sequence
atgggcacagccctccttcagaggggcgggtgtttcttgttatgtctgagcttgctgctgctcggctgctgggctgaactggggtctggacttgagtttcccggagcggaaggacaatggacccgcttcccgaaatggaacgcttgttgtgaatcagagatgtcgttccagcttaaaacgcggagcgcacgaggtctcgtcctatactttgacgatgaagggttttgtgatttcctggagctgatactgacccgcggaggccgccttcagttgtcattttcaatattttgcgctgaacctgctactctgctagccgatacccccgtgaacgatggtgcttggcactccgtccggatccgcaggcagttccgcaataccacactgtttatcgaccaagttgaggcaaagtgggtggaagtgaagtctaagcgcagggacatgaccgtttttagcgggctatttgttggggggctgccaccggaactgcgggctgcggccttaaaactcacacttgcttctgtgcgggagagagaaccgttcaaggggtggatacgggatgtgcgggtcaattcttcacaagtgctccccgtcgacagcggtgaggtcaaactcgacgacgaaccgcctaactccggcgggggctctccttgtgaggccggggaagagggcgaggggggtgtctgcctgaacggaggtgtgtgtagcgtggttgacgaccaggccgtttgtgattgctctcgcactggtttccgggggaaggattgttcgcaagctgacacgaacttggagggcctggctcacctgatgatgggagatcaggcgaagagcaaaagaaaggaagagtacattgccacgtttaagggttctgaatacttttgctacgacttgtctcagaatcctatccagagttcttctgacgagatcactctcagtttcaaaacactgcaaagaaacgggctaatgctccatacaggcaagagtgcagactacgttaatctcgcattgaaaaacggggcggtttctctcgtgatcaatctgggtagcggggcattcgaagctctcgtggagccagtcaatggtaagttcaatgacaacgcctggcatgacgtgaaggtgacacggaacctgcgacaggtcactataagtgtggatggcatactgaccactactgggtatacccaggaggattatacgatgctaggaagcgatgatttcttctacgttggtggtagcccatctactgctgacctccctggatcccccgtctctaataatttcatgggttgcctgaaggaagtggtctacaagaataatgacgtccggctcgagctatctcgattagccaagcagggagacccgaaaatgaaaatacatggggtggtggcgtttaagtgtgagaatgtggcaaccctggaccctattacatttgagaccccggagtcatttatcagcttgccaaagtggaatgccaaaaagacaggctctattagcttcgactttcggactacagaaccaaacggccttatcctgttctcacatggaaagcctcggcatcaaaaggatgccaaacacccccaaatgattaaagtggattttttcgccattgagatgctcgacggtcacctgtatctgcttctggacatggggtctgggaccattaagattaaagccctgctcaagaaggttaatgacggggaatggtaccacgtcgactttcaacgagacggacggagtggcaccatcagcgtgaacaccttgagaacaccatataccgcgccgggtgagtcagaaatcctcgacttggacgacgaactgtacctcggggggctcccagaaaataaggcgggcctggtgtttcccaccgaagtttggacggctttgctcaattatggttacgttggttgtattagggatttgttcattgacggacaaagtaaggacattagacaaatggcagaggtccagtcaacggccggggtgaagcctagctgctctaaagaaaccgccaagccatgcttatccaacccttgtaagaacaacggcatgtgtcgagacggctggaatcgctacgtctgcgactgctccggaacaggataccttggcagaagctgcgagagagaagctactgtgctctcctacgatggcagtatgttcatgaagattcagttgcccgtggtgatgcacacagaagcagaggacgtgagcctcaggttcaggagtcaaagggcctatggtatactcatggctacaacctctcgagactccgccgacactctccggcttgagcttgatgctgggcgggtaaagcttaccgtgaatctggactgtatcaggattaattgcaacagctcaaagggcccagaaacactttttgcgggctacaaccttaacgacaacgagtggcatacagtcagagtggtgagacggggaaagtccctcaagctgacggtcgacgatcaacaggctatgacaggacagatggctggggatcatacacggctcgagttccacaatatagagaccggcattattactgagcgccggtacctgtccagcgtgccttccaactttatagggcatctgcaaagcctcacatttaacggaatggcttacatcgatctctgtaagaacggcgatatcgattactgtgagctgaacgccaggtttggtttccggaatataatagccgaccctgttacattcaaaacgaagtctagctatgttgccctggccacgctccaggcctacacctctatgcatcttttcttccaattcaagacgacaagtctggatggcctcatcctgtacaattctggggacggcaacgacttcattgtagtcgaactggtgaagggctatctccactacgtttttgacctgggaaatggcgcgaacttgatcaagggaagcagtaacaaacccctcaacgataaccagtggcataacgttatgatctcaagggatacttcaaacctgcacacagtgaaaatcgacacgaaaattacaactcagataactgccggcgcccgcaatctggatctgaagtctgacctttatatcggtggggtcgctaaagagacctacaagagtcttcccaagctcgtgcacgcaaaagagggattccaggggtgtctggcatccgtggacctgaatgggcggctgcccgatctcatttctgatgctctattctgtaacgggcaaatagaacgaggatgtgaaggcccttcaacaacctgccaggaggacagttgcagcaatcaaggcgtctgtttacaacaatgggacggattttcgtgcgattgtagtatgacttcattctctgggcccctgtgtaacgatccgggcacgacttacattttttcaaaagggggggggcaaatcacatacaagtggccgcccaacgatcggccttccacacgagccgaccgcctcgcaattgggttttcgacggttcagaaagaggccgttctggtgcgtgtggattcttcgagtggtctcggcgactacctggaattgcacatccatcagggcaaaattggggtgaagttcaatgtgggtacggatgacattgccatcgaggagagtaatgcgataatcaacgacggaaaataccacgtggtccgattcacaagatcaggcggtaacgcaaccttgcaggtggattcatggcctgtgatcgagcgataccccgccggtaacaatgataacgaaagactcgctatcgcgcgccaacggattccctataggttgggacgggtcgtggacgagtggctgctagacaagggccgacagctgacaattttcaatagtcaggctaccatcatcataggggggaaggaacagggccagccatttcagggtcagctctccggtctgtactataacggtctgaaagtcttgaacatggcggctgaaaacgacgccaacatagccatagtgggcaacgttcgacttgtgggcgaagtccccagctcaatgaccactgaaagcactgccacagccatgcaaagcgaaatgtccacgagcataatggagaccacaaccacgcttgctactagcacggctcgcaggggaaagcccccaactaaggagcctatcagtcagactacagatgatattttagtcgcttcagcagagtgcccatccgacgacgaggatattgatccttgtgaaccttcgagtggcggacttgccaatcctactagggccggaggccgggagccctacccagggtcagccgaagtcatacgtgaatcatccagtactaccggtatggtcgtcggcattgtcgccgcagctgctctatgcattcttattctgctgtacgctatgtacaaatatcggaatagggatgagggatcttaccacgtcgatgaaagccgaaactatatatccaatagtgcccagagtaacggggccgttgtcaaagaaaagcagccctcctcagctaagagctcaaacaagaataagaagaataaagacaaagagtattatgtgtag

SEQ ID NO: 126099 - DNA, 4644 bp, Artificial Sequence
  Description of Artificial Sequence: Synthetic coding sequence
atgggcaccgccttacttcagcggggcggatgctttctcttgtgtctgagcctgctcctgttgggatgttgggcagagttgggttctggcctcgagtttccaggggctgagggacagtggacaaggttccccaaatggaatgcatgctgtgaatccgagatgtccttccagctaaagacaaggagcgcaaggggcctggtactatactttgacgacgaagggttttgtgactttctcgagttaatcctcacacgaggagggaggttgcaactgtcctttagcatattctgcgcagagcccgctaccctgctggctgacactcccgtcaacgatggcgcctggcatagtgtgcggatccgcaggcagttccgtaataccacactcttcatagatcaagtggaggccaaatgggttgaggtgaaatccaagagaagagatatgactgtgttttcaggtctttttgtcggcggtctcccccctgagctgcgggctgccgccttgaagctgaccctggcaagcgttagggaaagagagccgttcaaagggtggattcgggacgttagagtcaactcaagccaggtgctgccagttgattcaggagaggttaaactggacgatgaaccccctaactcaggtggaggctcaccctgcgaagctggagaggaaggcgagggcggggtatgtttgaacggcggcgtttgttcagtggtggacgatcaggccgtatgtgactgtagccggactggcttccgaggaaaggattgttcacaagaaatcaaatttggactccagtgtgtgctccccgttttgcttcatgataacgaccagggaaaatactgttgtatcaacacagctaagccccttactgagaaagacaacaatgtagaagggttggcacatctgatgatgggagatcaagggaaaagcaaaggaaaagaagaatacatcgctacattcaaaggcagcgaatatttttgttacgatctgtctcagaaccccatccagtcaagctctgatgagattactctctcgtttaagaccttgcaaagaaacggactgatgctgcacacgggcaaaagcgcagactatgtcaaccttgctctcaaaaatggggccgtttcgctggttatcaacctgggctcaggcgcctttgaagccttggtagagcccgtgaacggaaaattcaacgacaacgcatggcatgatgtgaaagtgactcgcaatctgcgccagcacagcggtataggccatgccatggtaaataagctgcattgttctgttacaattagcgttgacggaatcctgactaccacagggtacacacaggaggactacacgatgctcggatcagacgactttttctatgtggggggctcaccatcaaccgccgacctgccaggctcaccagtgtctaataattttatgggctgtctgaaagaggtagtctataagaacaacgatgtaagactggagctgtcaagacttgccaagcagggcgacccaaaaatgaaaattcatggagtggtggcattcaagtgtgagaacgtggcaactctggatccaatcacattcgaaacacctgaatcattcatctctctgcctaagtggaatgctaaaaaaacgggtagtattagctttgacttcaggacaactgaacctaacggcctaatcctcttttcccacggcaagccacggcatcaaaaagatgccaagcatccacagatgattaaggtcgatttctttgccatcgagatgcttgatggccacctgtatctgctgctggatatgggaagcgggactatcaagatcaaagctttgttgaagaaggtaaatgacggtgaatggtaccatgtggactttcagcgggacggtcgaagcggtacaatcagcgtaaacacgcttagaaccccctacaccgcccctggggaatctgaaattctcgatctggatgatgagctgtacctgggcggcctccccgaaaataaagctgggctggttttccctaccgaggtctggactgctctgctcaactatggctacgtcggctgcattcgggatctgttcattgatggacagagcaaagatattaggcagatggccgaggtccagtccacagctggcgtcaagcctagctgcagcaaagaaacagccaagccttgcctctccaatccctgtaagaacaacggaatgtgccgggacggctggaatcgctacgtttgtgactgctctggcaccggttatctgggaaggtcatgcgagagagaggccactgtgttatcttacgatggaagtatgttcatgaaaatccagcttccagtcgtgatgcacacagaggccgaagatgtgagtctgcggtttagatcacagcgcgcgtacggaatcctaatggcgaccacaagtcgcgactcagccgacacacttcgcctggagcttgacgccggaagagttaagctcacagtgaacttagattgcatcagaattaattgcaactcatctaaggggcctgagacgttgttcgcagggtacaatttgaacgacaacgaatggcacacggtgagagtagtgcgccggggcaagtctctgaagcttacagtcgacgatcagcaagcaatgaccgggcagatggcaggcgaccatactcgtctcgaattccataacatcgagacgggtatcatcacagagcggcggtatctgagcagcgtgcctagcaacttcattgggcacctgcagagtctgaccttcaatggcatggcgtacattgacctgtgcaagaatggagatatcgattactgcgagctcaatgccagattcggattcagaaacattatcgccgaccccgttacattcaagaccaaatcttcctatgtggcactggccacacttcaggcctacacatccatgcacttgtttttccagtttaagactactagcctggatgggctgatcctgtacaactccggcgatggaaacgactttatcgttgtagaactggtaaagggatacctccattatgtcttcgatctggggaacggagctaatctgatcaaaggcagcagtaacaagccactcaatgataatcagtggcacaatgtgatgattagcagagacacgtctaatttgcataccgtgaagatcgacacaaagatcactacccaaattactgctggtgcccggaaccttgacctgaaaagtgatttgtacatcggcggcgtcgcaaaggagacttacaaatctttaccaaaacttgtgcatgccaaagaggggttccagggctgcctggctagcgtagaccttaatgggcggctgcccgacctcatctcagacgctctgttttgcaacggccagatcgaacggggatgcgaaggaccttcaacaacttgtcaagaagactcttgcagcaatcagggggtctgccttcagcaatgggatggatttagttgcgattgctctatgacctcttttagcgggcccctgtgtaatgaccccggaactacttatatcttctccaaaggaggcggccagatcacatataaatggccccctaacgatcgaccatccacccgggctgaccgccttgcgattggcttcagtacagtgcagaaggaggcagtcttagtccgagtggattcctcaagtggcttgggggactatctggagctccacatacatcaagggaagatcggcgtgaagttcaatgttgggacagatgacatcgcaattgaggagagcaacgccatcattaacgatggcaaataccacgtggtgaggtttactaggagcggagggaatgccaccctccaggtggatagttggccagtgatcgagaggtatccagctgggaataatgacaacgaacgtctagccattgcccgccaaaggataccctatcgtcttggcagggtagttgacgagtggttgctcgataagggccgccaactaacaattttcaactcccaggccactatcataatcggcggcaaggaacaagggcagcccttccagggtcagctgtctggactgtattacaacggcctgaaagtgttgaacatggcagctgagaacgacgccaatatagccatcgtcggcaacgttaggctcgtcggagaagtcccttccagtatgaccacagaaagtacagcaaccgccatgcaaagtgagatgtcaactagtatcatggagaccaccaccactctggccacatcaactgccagacgcggaaaacccccaacaaaagagcccataagccagaccacagatgacatcttggtcgcaagtgctgagtgtccctctgacgatgaggatatcgatccatgcgagcccagctcaggaggcttagccaaccccacacgcgctggaggacgtgaaccttacccaggatctgctgaagttattagagagtcctcaagtacaactggaatggtagtgggcatcgtcgctgccgccgcgttatgtatcctgattctgttgtacgccatgtacaagtaccggaacagggacgaaggaagttaccacgttgatgagtcaaggaactacatctctaactcggcacaaagcaacggcgccgttgtgaaggagaaacagccgagttctgccaagagcagtaataagaataagaagaacaaagacaaagagtactatgtatag

SEQ ID NO: 126100 - DNA, 4434 bp, Artificial Sequence
  Description of Artificial Sequence: Synthetic coding sequence
atgggtaccgccctcctgcagagagggggctgtttcctgctgtgtctatcattactactcctcggttgttgggctgagcttgggagcgggttagaattccccggagcagaaggccagtggactcgctttcctaagtggaatgcatgctgcgaatctgaaatgtcgttccaactgaagactagatcagcacgggggctggtgctgtatttcgacgatgaaggcttctgcgactttctggaattgatattaaccagaggagggcgtcttcagctgagtttcagcattttttgtgccgagccagcaaccctcttagcggatactcccgttaacgacggagcatggcactctgtgaggattcgacgccagttcaggaacactaccctgtttattgaccaggtggaggctaaatgggttgaagtcaaatccaagagacgcgatatgactgtgttctcgggactgtttgtaggtggcctgccgcctgaactccgcgcagccgcactcaagcttactctcgcatctgtcagagaaagagagccatttaagggctggattagagacgtgcgtgtgaattcctcccaagtactgccggtcgactccggagaggtgaaactggatgatgaaccacctaactcgggcgggggaagcccctgtgaagctggggaggagggcgagggaggcgtgtgtctaaatggcggcgtctgcagcgtcgttgacgaccaggcggtatgcgattgctcgcgcaccgggtttcgaggcaaagactgctcccaggaggacaataacgtggagggtcttgcccatctgatgatgggtgaccaaggcaaatcaaaaggaaaagaagagtacatcgctacctttaagggctccgagtatttctgctatgacctttcgcagaatcctatacagagctccagcgatgagattactctgtccttcaagactctgcagaggaacggtctaatgctgcacacaggaaaatcagccgactacgtgaatctggccctgaaaaatggggcagtgagtttagtaataaacctggggtctggcgcattcgaagcactcgtggagccggtgaacgggaagtttaatgacaatgcatggcacgatgtgaaagtcacccgcaatcttcggcagcactcgggcattgggcacgccatggtgacaatttccgtggacgggattctgaccaccaccgggtacacacaagaggattatactatgctggggagcgacgactttttctatgttggtggaagcccgagtaccgctgacttacccggttcaccagtgtcaaacaatttcatgggatgcctcaaggaagtggtctataagaacaacgatgtaaggctggaattaagtcgcctggcaaagcagggcgatccgaagatgaagattcatggagtggtggcatttaaatgtgagaatgtagccaccctcgaccctataacatttgagacaccagagtcttttatcagtctgccgaagtggaatgccaagaaaaccggttctatctcatttgatttccgcacaactgagcctaatggcctcattctttttagccatggtaaaccccggcatcagaaggacgcgaaacacccgcagatgatcaaggtagactttttcgccatcgagatgctggatggacacctgtatctgctcctggatatgggctcggggacaattaagatcaaggccttattaaagaaagtgaatgatggggagtggtaccacgtggattttcagagagacggccgctccggcactatttctgttaatactcttagaaccccttatacagcacctggggaaagtgagatcttggacctggacgatgaattgtatctggggggtctccccgaaaacaaagcaggccttgtgtttccaacagaagtgtggacggctctacttaattatggatacgtcggatgcatcagagatctgtttattgacggtcaatctaaagacatccggcagatggccgaggtgcagtctactgctggcgttaaaccaagttgttctaaagagacagctaagccttgtcttagtaacccctgtaaaaacaacggcatgtgccgggacggctggaacagatacgtttgtgattgttcgggaacagggtatctgggaagatcttgtgaaagggaggctactgtgctgtcttatgatggctcgatgtttatgaaaattcagttgccagtggtgatgcatactgaagccgaagatgtttccctgaggtttcgcagtcagcgggcgtatgggatactcatggccactacttcccgggattccgccgacactttgcgtctggagctggacgctgggagagtgaagttaacagtgaatttggattgtattagaattaattgtaatagctccaagggccctgagactctcttcgctgggtacaacttgaacgacaatgagtggcataccgtacgcgtggtgcgacgcggaaagagcctcaaactgactgtagacgatcagcaggccatgaccggtcagatggccggcgaccacaccaggttggaattccacaatatagaaaccggaatcattacagaaaggcgctacctgagcagcgtgccatctaattttatcggtcacttgcagagcctgaccttcaatggaatggcctatattgatctgtgtaaaaacggcgacatagactactgcgagttgaatgcacgcttcggcttccgcaatatcatcgctgaccctgtcacatttaagacaaagtcctcgtatgtcgcgctggccaccttacaagcctatacctcaatgcacctgttttttcagttcaagaccacctcattggacggcctgattttatacaactctggcgacggcaacgattttatcgtggtggagcttgttaaaggctatctccactacgtcttcgacttagggaacggggctaaccttattaagggaagttccaataagcctttgaatgacaaccagtggcataacgtgatgatatcgagagacactagcaacctccataccgtaaagatcgatactaagatcaccacacagataacggccggggcccggaatctcgacctgaaatccgacctttacattggaggcgtcgctaaagagacctataagtctcttcccaagctcgtccacgccaaggagggtttccagggctgcttagcatctgtggatctcaacggccgtctgccagacttaattagcgatgcccttttctgcaacggccagattgagcgaggatgtgagggcccctctaccacctgccaggaagattcttgcagcaatcaaggggtgtgcttgcagcagtgggatgggttttcttgcgactgctccatgacatccttttcgggtcccttgtgtaacgatcccggcactacctacatcttctctaaaggtggaggccaaatcacatacaagtggccgcccaatgacagacccagcacccgcgctgacagacttgctatcgggttctccaccgtgcagaaggaggccgtactcgtgcgggttgattcgtcatctgggctaggtgactatttggaactgcacatccatcagggtaagataggcgtgaagtttaatgtgggcactgatgatatcgcgatcgaggagtccaatgccatcatcaatgacgggaagtaccatgtcgtgaggtttacacgcagcggcggtaacgcaactctgcaagtggatagctggccggtaatcgagcggtacccagcaggcagacagctaactatctttaactcacaggcgacaatcatcatcggggggaaggagcagggccagcccttccaggggcagctgtccgggctttactataatggcctgaaggtgttgaatatggccgccgagaatgacgctaacattgccatagtcgggaacgtgaggcttgttggcgaagtaccctcgagcatgactaccgaatctacggctactgccatgcagtctgaaatgagtaccagtatcatggagacaactacaacgttagccaccagtacagccagaagggggaagccaccaacaaaggagccgattagccagacaaccgacgatatcttagtcgcatccgccgaatgtccgtctgacgacgaggatatcgacccttgcgagccatcctccggagggcttgcgaaccccactcgggcgggaggcagagagccttatcctgggagcgccgaagtaatacgggagagctcaagtaccactggaatggttgtggggatcgttgccgcagccgcattatgcattcttattctgctgtatgccatgtacaagtatcggaacagagacgagggatcttaccacgtggatgagagccggaactacatctcaaacagcgcacagtcaaatggtgcagttgttaaggaaaagcagcccagcagcgccaaatcttctaataagaataagaagaacaaggataaagaatactacgtctag

SEQ ID NO: 126101 - DNA, 4434 bp, Artificial Sequence
  Description of Artificial Sequence: Synthetic coding sequence
atgggtactgctctgctccagaggggcggatgtttccttttatgtttaagtctactgctgctggggtgctgggctgaactcggttccgggcttgaattccctggtgcggagggacagtggacacgcttcccaaaatggaacgcttgttgtgaaagcgaaatgtctttccagctcaagactcggtctgccaggggcctggtgctctatttcgacgatgagggattctgtgatttcctggagctgatattgaccaggggcggacgcctccagctatcttttagtatcttttgcgcagaacccgccactctgcttgcggacacaccagtcaatgatggagcttggcatagtgtacgcattcgcaggcagtttcgcaatactacactgttcatcgaccaggttgaagcaaagtgggtagaggtcaagtctaagcggcgcgatatgacggtgtttagtggactctttgttggcggactgccaccagagttgcgcgccgcagcccttaaactgactctcgcctcagtgagagagagagaacccttcaaagggtggatcagggatgtgagagtaaatagttctcaggtcctcccagtagacagcggggaggttaagttagatgacgaacccccaaacagtggcggcggatctccctgtgaggcgggtgaggaaggggaaggcggagtgtgtctgaatggcggggtctgcagcgtggtcgatgatcaggccgtgtgcgattgctcaaggaccggattcagaggaaaggattgctcccaggccgacaccaacctcgaggggctcgcccacctaatgatgggcgaccaggcaaagagcaagaggaaagaagagtacatcgccactttcaaaggctcggaatatttctgctacgatctctcccaaaacccaattcaatcttcatctgatgagatcaccctgagctttaaaaccctacagcgcaacggcctcatgttacatactgggaaatccgctgattatgtaaacttggcactgaagaatggcgccgtatctctcgtgatcaacttggggtccggagcctttgaggctcttgtcgaaccagtaaatggaaagttcaatgataatgcctggcatgacgtgaaggtgacacgcaatctgcgccagcatagcggtatcggacatgcaatggtcaccatcagtgtggacggaattcttacgactacaggatacacacaggaagactataccatgttgggcagtgacgactttttttacgtgggcggttctccatcaacagccgacttaccggggtcgcccgtgtccaacaatttcatgggttgtctgaaggaggtggtgtacaagaacaacgatgtgcgcttagagttgtctcggttggccaaacagggtgaccccaagatgaagattcacggggtggtagcatttaaatgcgaaaatgtggctaccctcgaccccattacattcgagacaccagaatccttcatcagcctgcctaagtggaatgccaaaaaaaccggtagcatctccttcgattttcgtaccaccgagcctaatgggctcatactgttcagccatggcaaacccaggcaccagaaggacgccaaacacccgcagatgattaaggtagacttctttgcgatagaaatgcttgacgggcatctttatctgcttttggacatgggttctgggaccattaaaatcaaggccctccttaagaaagtcaacgatggcgaatggtatcacgtggacttccaaagggatggccggagtggcacaatctctgtgaatacactgcgcacaccatacacagctccaggcgaaagtgagatcctagacctcgatgacgaactatacttaggcgggctacccgaaaataaggctggccttgtcttcccgactgaagtgtggaccgccctgctgaattatggctacgtcgggtgcattagggacctctttatagatggtcaaagtaaagacataaggcagatggcagaagtgcaatccactgccggcgtcaaacccagctgcagcaaggaaaccgctaagccctgtctaagcaatccatgtaaaaataacgggatgtgccgggacggctggaatcggtacgtgtgtgactgctctgggactggttatttgggacggagctgcgagcgagaggccaccgtcctgagttacgatggctctatgtttatgaagatccagttacctgtcgtcatgcataccgaagctgaagacgtatctctccgctttcgctcccagcgggcctacggtattctcatggcgactaccagtagagactctgcggatacattaaggcttgagttggatgcaggccgcgtgaagctgacggtcaatcttgactgtatacgaatcaattgtaacagctccaagggacccgaaactctgtttgccggctacaatctcaacgataatgaatggcataccgtccgagtggtcagacgtgggaagagcttaaagctgactgtggacgatcagcaggctatgaccggtcagatggcgggcgaccacactcggctcgagttccataacattgaaaccggaattattacagagcggcgctatctctccagtgttccttccaacttcattggccacctccagtccctcacttttaacggcatggcatatatagacctctgtaaaaatggagacatcgattattgtgagttaaacgcccgatttgggtttcgcaatataattgcagaccctgtgacgtttaaaacgaagtcttcttacgtggctttagctaccctgcaggcctacacgtcgatgcacctgttttttcagttcaaaaccactagcctggatggcctaatactctataattccggcgatggcaacgatttcattgtggtcgaactggtgaaggggtacctgcattacgtgtttgacctggggaacggagctaaccttattaagggttcctctaataagccccttaacgataatcagtggcacaacgtgatgattagtagggacaccagtaacttgcacacggtgaagattgacactaaaattactactcaaattactgctggtgctcggaatttagacttaaagagcgatctgtatatcggtggagtcgctaaggaaacatataaatctctccctaagctggtccatgctaaagagggcttccagggctgtctggcgtccgtggacctaaacggccggctgcccgatctgattagtgatgcactcttttgtaatggtcagatcgaacgtggctgcgaaggcccttctacgacttgccaagaggatagctgtagtaaccaaggagtgtgcttgcaacagtgggatggcttctcttgcgactgcagtatgacgtcttttagcggcccactttgcaacgaccccggaaccacctatatattctctaagggaggaggacagatcacttacaagtggcccccaaatgacaggcctagcacaagagccgacagactggccatcggtttcagcactgtccagaaggaagccgttcttgtgagagtggacagttcatctggactaggagattatcttgagcttcatatccaccaggggaaaatcggcgtgaaattcaacgtgggcacagacgatatagcgatcgaagagagtaatgccataatcaatgatgggaagtatcacgtggtgcggttcacaaggagcggtggcaacgcgaccttgcaagtagattcttggcccgtgatcgaaagatacccggccggtaggcaactgactatcttcaactcccaggccaccatcatcatcggtggcaaagagcagggtcagcctttccaaggccagctgtccggcctctactataacggcttgaaggttctcaacatggccgctgagaacgatgctaatattgccatagtgggcaacgttcgcctggtcggcgaggtgcccagttcaatgaccaccgagtctacggccactgccatgcagtctgaaatgtctacatctataatggagacaacgacaaccctggctacatccacggctagaagaggaaagcccccaactaaggagcctatttcgcagacgactgacgacatattggtggcaagcgcggagtgcccatctgatgatgaagacattgacccttgcgaaccaagtagcggcggattggctaatcctactcgggccggaggtcgtgagccataccccgggtccgccgaggtgatcagagaatcctccagcaccactgggatggtcgtcggtatcgtggccgccgcagctctctgcatacttattcttctatatgccatgtataagtaccgcaacagggacgaagggtcttatcacgtggacgagagccgcaactacatatccaattccgcccagagcaatggtgcggtagtgaaggaaaaacagccttctagtgccaagtctagcaacaagaacaaaaagaacaaggataaggagtattacgtgtag

SEQ ID NO: 126102 - DNA, 4647 bp, Artificial Sequence
  Description of Artificial Sequence: Synthetic coding sequence
atgggtacagcattactgcagcgcgggggttgctttttactttgtctgtctctcctgctcctcggctgttgggccgaattgggatccggtctggagttccctggggcagagggtcagtggactcggtttcccaagtggaacgcgtgttgcgaatctgagatgtccttccagctgaagactcggtccgcccggggactggttttatacttcgacgacgagggcttttgcgatttcttagagcttattttgacaagaggcggccggcttcaacttagcttcagcatcttctgcgcagagcctgcaactctgctggctgatacccccgtgaatgacggcgcctggcatagtgttcgcatccgcaggcagttccggaacaccacgctcttcattgatcaggtcgaagcgaaatgggtggaagtcaagtccaagaggagggatatgacagtgttttcagggctgttcgtcgggggactcccaccggagctgagggcagccgcactgaagctgactctggcgagcgtcagggagcgcgaaccttttaagggctggattagggacgtcagagtgaactcaagccaagttctgccagtcgattccggagaggtcaaattagacgacgaacctccaaactccggtggagggtcaccttgcgaggccggtgaggagggcgaaggcggcgtgtgcttgaatgggggcgtctgctctgtggtagatgatcaagccgtatgcgactgtagcagaacaggctttcgaggaaaggactgtagccaggaaattaaatttggacttcagtgcgttctgcccgttctgttgcatgataacgatcagggcaaatactgctgcatcaacaccgccaagcccctgacagagaaaaaggataacgactttgagggccttgctcatctgatgatgggtgatcaggcaaagagcaagaggaaagaggagtacatagctacatttaaaggctctgaatatttttgttacgatttgagccaaaatcccatacagagttctagcgacgagataacactctctttcaagaccctgcagagaaatgggctgatgttacatactggtaaaagcgctgattacgtcaatctggcactcaaaaacggggctgtcagtctagtgatcaatctgggctccggcgcattcgaggctttggtcgaacctgttaatggaaagtttaacgacaatgcctggcatgacgtcaaggtgacaagaaatctgcggcagcacagcggaattggccacgccatggtcaacaagctccattgttccgtgacaatttccgtggacggcatacttaccacaacaggatatacgcaggaagactacacgatgttggggagcgatgacttcttttacgtcggaggcagtccatctacggctgatctaccggggagtcctgtgtcaaataatttcatggggtgtcttaaagaagtggtctacaaaaataatgatgtgcgcctcgagttaagtaggctcgctaaacagggagaccctaagatgaagattcacggcgtcgtcgctttcaagtgtgaaaatgtcgctactctcgatcccattacctttgagacgcccgaatctttcatttcgctacccaagtggaacgccaaaaaaaccgggtctatttcgtttgactttcggacaaccgaacctaacgggctcatccttttttcccacgggaagcctcgacaccaaaaagatgccaagcacccccagatgatcaaggttgacttctttgccatcgagatgctggacggccatttgtaccttctgcttgatatgggaagtggaaccattaagattaaagctctcttgaaaaaggtaaacgatggcgagtggtaccacgtggacttccagagggacggaagaagcgggacaatttccgttaatacactgcggacgccttacaccgcccccggtgaatctgagatcctggacttggatgacgagctgtatctcggaggattacccgagaacaaagccggccttgttttcccgactgaagtctggaccgccctgctcaactatggctacgtcggttgcatccgggacctctttatcgatgggcagtcaaaagatataagacaaatggcagaggtgcagagcactgcaggcgtaaaacccagctgttccaaagagacagcaaaaccctgtctgtcaaatccgtgtaagaataacggtatgtgtagggacggctggaatagatatgtctgtgattgttccggcacaggctatctcggccgcagctgcgagcgggaggcgaccgtcctctcatacgacggatcaatgttcatgaaaattcaactacccgtcgtcatgcataccgaggctgaggacgtgagcctgcgctttcggagccagcgggcctatggcatcttgatggcaactacctcgcgagatagcgcggacaccttgcggctggaactggacgccggcagagtgaagctgaccgttaatttggattgtatccgaatcaactgtaactccagcaagggtcccgaaacattatttgcaggctataacttaaacgataacgaatggcacaccgttcgcgtggtgcgccggggcaagtcattgaagcttactgttgatgaccagcaagcaatgactgggcagatggctggagatcacaccagactggagttccacaacattgagactggcattataactgagcggagatatctaagctcagtgccctccaatttcataggacatttgcagtccctgacattcaatggaatggcctacatcgacctatgcaaaaacggagatatagactactgcgagctcaacgcccgcttcggtttccgaaatatcatagccgaccccgtgaccttcaaaaccaagagctcatacgtagcactggctactctccaagcatacactagtatgcatctcttttttcagttcaaaacgacctcgctagatggcctcatcctgtataatagcggggatgggaacgatttcattgtggttgagctcgtcaaagggtatttacactatgtctttgacctggggaatggggccaatctcataaagggaagttctaataaacccctgaatgacaatcaatggcacaacgtgatgatatctagagacacaagcaacctgcatactgtgaaaatcgacacaaagataacaactcagataacggctggtgcccgcaacctagacctcaagtcagacctgtacattggaggagtggccaaagaaacctacaagtctctgccaaaactggttcacgccaaagaagggttccagggctgtctggcctcagtcgatctcaacggaaggctgcccgatctgatttccgacgcactgttctgcaatggacaaattgaaagaggatgcgaagggccatccacaacatgccaggaggactcctgttctaatcagggtgtgtgtcttcagcaatgggatggctttagttgcgactgcagcatgaccagtttcagcggaccactctgcaacgacccgggaacaacgtacatattttctaaggggggaggacagattacctacaagtggccaccgaacgatcgaccctccacaagggctgatcgtttggccatcggcttttccaccgtccaaaaggaggccgtactggtacgggttgattcttcatccggattgggcgactatctagagctgcacatccaccagggtaaaatcggtgtaaaatttaacgtgggtacagatgacattgccatagaggaatccaatgccatcatcaacgacgggaaataccatgtagtccgctttacccgatcgggaggcaatgccactctgcaggtcgatagctggccagtgatcgaacggtaccccgcaggaaacaatgataacgagcgtctagccatcgcccggcagagaattccttacagactcggaagggtggtcgacgagtggctgctggacaaaggtaggcagctgacaatcttcaactcacaagctaccatcattataggcggcaaggaacaagggcagccctttcagggccagttgagtgggttatactataacggtctcaaagtccttaacatggcagccgaaaatgacgctaatattgctatagtaggcaacgtgagattggtgggagaagttccgtcttccatgaccacagagagcaccgctaccgcaatgcaatccgagatgtctacaagcattatggagactaccaccacccttgctactagtacggctcggcgcggaaaacctccaaccaaggaacctatcagccagaccacagatgacatactggtggcctcagccgaatgtccgagtgacgacgaagacatagacccctgcgagccatccagtggcgggctggcaaatccgacgcgtgccggggggcgcgagccttaccctggttctgctgaagttataagagagagcagttctacaacaggaatggtggtggggatagtggccgctgcagcgttgtgcatactcatcttgctctacgcaatgtacaagtatcgtaaccgagacgaagggtcctatcacgtggacgagtccagaaattatatatcaaactctgcacaatctaatggagctgttgtgaaggagaaacagccctcgtcagccaaatcctcaaacaaaaacaagaaaaataaagataaagaatattatgtgtag

SEQ ID NO: 126103 - DNA, 1191 bp, Artificial Sequence
  Description of Artificial Sequence: Synthetic coding sequence
gcactggagatttgggaacagccgcctgcccctcgcttattattccccggcctccccttccgcacgagccccagccctgcggccttttacagaagccctgccagtctacgcggcggacacgccggaacaacgtacatcttttccaaagggggcggccagataacatacaagtggcccccaaatgacagacccagtacacgggcagacaggctggctatcgggttctcgaccgtgcagaaagaagccgttctggttcgcgtggactctagtagtggcctaggcgactaccttgagctacacatccatcaaggtaaaatcggagtgaagtttaatgttggtactgacgacattgcgatcgaagagagcaatgcaattatcaacgatggcaaataccacgtggtaagattcactaggagcggtggaaacgccaccctgcaagttgatagttggcctgtgatcgagaggtatcccgccggtagacagctgacaatcttcaattcccaagctacaattatcattggcggtaaggagcagggacagccctttcaggggcaactctcaggactttattataacggtttgaaggtgctgaacatggcagctgagaatgacgccaatattgctatagtgggcaacgttcgcctggtgggagaggtgccctcgtcaatgaccactgaaagcaccgcaactgcaatgcagagtgaaatgagtacttctatcatggagaccaccaccacactcgccaccagcactgctcgcaggggcaagccccctacaaaggaaccaatttctcagactacagatgacattttagtggccagcgccgagtgtccttcagacgatgaggacatagacccatgtgagccctccagtggcggcctggcaaacccaacacgagctggcggacgcgagccctatcccggatccgctgaagtcatacgggagtcatcatccacaaccggaatggtggtcgggatagttgctgctgccgcattgtgcatccttattctcctgtatgcgatgtataagtacagaaatagagacgaagggtcttaccacgtggacgagagtcgtaactatatttctaacagcgctcagagtaacggcgccgtcgtcaaagaaaagcagcctagcagcgccaaatcatccaataaaaacaagaagaataaagataaagagtactacgtgtag

SEQ ID NO: 126104 - DNA, 5139 bp, Artificial Sequence
  Description of Artificial Sequence: Synthetic coding sequence
atggcatctggtagccggtggaggcctactccccctccacttctgttactcctccttctggctctcgccgcccgggccgacggtctggaattcggagggggaccaggacagtgggcacggtacgcacggtgggccggcgccgctagttcaggggagctgtcattctccctgcggacaaacgctactagagctctgttgctttacctcgacgatggcggtgactgtgactttctcgaactgctgctcgtagacggcaggctgcgactcagatttactcttagttgcgcagaacccgctacgctgcagttggatacgcccgtagcggatgatcgctggcacatggtgctgctaactcgcgatgctcggcgcactgcgctagccgtggacggcgaagcccgggccgcagaagtgcgctcaaaacggagggaaatgcaagtcgctagcgacctgtttgtcggtggaatcccccctgatgtgcggttgtccgccctaacactgtccaccgttaaatacgagccaccatttcggggactgctggccaacctgaagctgggagagcgcccgcccgcacttcttggctcccagggccttagaggtgcgactgccgacccactgtgtgcgccagctagaaatccttgcgcaaacggcggtctctgtaccgtcctcgccccaggcgaggtgggctgcgactgctctcacaccgggtttgggggaaagttttgttccgaagaagagcacccaatggagggccccgctcatcttacacttaactcggaagtcggttctctgctgttttcagagggaggagccggtcgaggtggtgcaggcgacgtgcaccagccaacaaagggcaaggaagaattcgttgcaacattcaaaggtaatgagtttttttgctatgacctcagccataaccccatacagtcctcgaccgacgagatcacccttgcatttagaacgttgcagcgaaatggtctcatgctccacacagggaagagtgccgattacgtcaatctctctctgaaaagcggggccgtctggctggtgattaatttgggatccggcgccttcgaggccctggtggagcctgtgaacggtaagtttaatgataacgcttggcacgacgtacgcgtgacccgcaacctgcggcagcacgcaggtatcgggcatgccatggtcaataagctgcactacctcgtgaccattagcgtggacggcatcttaacaacaactgggtatacacaggaggattacacaatgttgggtagcgacgactttttctatataggggggagccctaataccgccgacctccccggcagtcccgtgtcaaataactttatgggttgtctgaaggacgtagtgtacaagaacaacgactttaagctggaattatctcgcctggctaaagaaggggacccgaagatgaagctgcagggcgatctgtcctttcgctgtgaagacgtggccgcactggatcctgtcaccttcgagtccccagaggcgttcgttgccctccctagatggtccgcgaaaaggaccgggagtattagtttggactttcgaaccactgaacccaacggactgttgctgttttcccagggccgcagggcaggaggtggcgccggaagccactctagtgcccaaagggcagattacttcgccatggagctgctggatgggcatctgtacctgttgctggatatgggaagcggcgggataaaattgcgggcatctagtagaaaagtgaacgacggcgagtggtgccacgtggactttcagagagatgggcgtaaaggctcaatttcggtgaatagtaggtcgacacctttcttggccaccggcgattctgagatactggatttggaatctgaactatacttagggggcctgccagaaggtggtcgggttgatctgcccctccctcctgaggtatggaccgccgcacttcgcgccggttatgtgggctgcgtgagagaccttttcattgacggcaggtcaagggacctaaggggactggccgaggcacagggagcggtgggcgtggccccattttgtagcagggaaacactaaaacagtgtgcatccgccccttgccggaacgggggcgtatgccgagagggatggaacaggttcatctgcgactgtataggcaccgggttcctgggcagggtgtgcgagcgggaggctacagtgttgtcctacgatggtagcatgtacatgaaaattatgcttcctaatgccatgcataccgaggcggaggacgtaagtcttaggttcatgagtcagcgggcatatggacttatgatggctacaacttctcgggaatccgcagacaccctcaggctcgagctggatggtgggcagatgaagttgaccgttaaccttgactgcctccgggtcggctgtgccccctcgaaagggccagagaccctgttcgcaggacataaattgaatgataacgagtggcatactgtgcgggttgtgcgccgagggaagtcccttcaattatcggttgataatgtcaccgtggaaggtcagatggcgggcgcacacatgaggctggagtttcacaatattgagactggcattatgaccgagcgcaggttcatctccgtggtgccatccaactttattggacacctgagtgggttggtgtttaatggacagccttacatggaccagtgcaaagacggcgacatcacatactgtgagctcaatgccaggttcgggctgcgagctattgtggctgacccagttacttttaagagtcgctcctcttatctggcattggcaaccctccaggcctacgcgtccatgcacctcttcttccagttcaaaactaccgcgcccgacggactcctgctgttcaactccggcaacggcaacgatttcattgtgatagaattggtgaagggatacattcactacgttttcgatctagggaatggacctagcctgatgaaaggaaacagcgataaacccgttaacgacaatcagtggcacaatgtggtggtcagcagagacccagggaacgtgcatacattgaagatagacagccgaacagtcactcagcatagcaatggggctagaaatcttgatctgaaaggagagctgtacatcggcggtctgtccaagaacatgtttagcaacctgccaaagctggtggctagtcgcgatggcttccagggttgcctggcttccgtggatctgaatgggcggctgccagacctaatagcagacgccttgcaccggatagggcaggtggagagggggtgcgatggtccttccaccacgtgtactgaagaaagctgtgccaatcagggcgtgtgtctgcagcagtgggatggattcacttgtgattgtactatgaccagttatggcgggccagtgtgtaatgatcctggcaccacctacatttttggaaaaggtggggctttgatcacatatacctggccccctaacgatcggccctcgacgcgtatggatagactagcagttgggttttccacacatcagagatccgccgtactggtgcgggtagactccgccagcgggcttggcgactatctccagctgcacattgatcagggcaccgtaggagtgattttcaatgtgggaacagatgacatcactatagacgagcctaacgcaattgtgtccgacggaaagtatcacgtcgttcggttcacccgcagtggaggcaacgctactctccaagtggattcctggcctgttaacgaacggtacccagccggcaacttcgataacgaacggctggccatcgcgagacagcgaatcccatacagactaggacgagtggtggacgagtggcttctcgacaaagggcggcagctgaccattttcaattcacaagctgccatcaagattggtggccgggatcagggcagaccgttccaggggcaggtgagtggactgtactacaatggcttaaaagtgctagcattagcagcagaatcagacccaaatgtgcgaactgaaggacaccttagactggtgggggaaggcccttccgtgttactcagcgctgaaactaccgcaactacgctgttggctgacatggcaaccactatcatggagaccaccaccactatggcaactacaaccactcgccggggccgatcgcccaccttgagggatagtacgactcagaacaccgacgacctcctggtcgcctctgcggaatgcccatcagacgatgaggatctggaggagtgcgaacccagcaccgggggcgaattgatcctgcctattatcaccgaagattccctagaccctcctcctgtggcaactcggtccccttttgttccacctccccctacgttctacccattccttactggggtgggcgctacacaagacaccctgccacccccagccgcccggcgaccgcctagcggtggaccatgccaagccgaacgggatgattccgactgcgaggagccgattgaagcctccgggttcgcaagtggcgaggtttttgattcttctttacccccgaccgatgacgaggatttctatactacattccctctcgtgactgataggacaaccctgttgtctcccagaaagcccgctcctagacccaacttacggacggatggcgccaccggagctccaggcgtgctcttcgctccttcagccccagcgccaaacctccctgccggtaaaatgaatcacagagaccccctgcagccgttactggagaatcctcctcttggcccgggagctcccactagcttcgaaccccgccgaccgcctcccctgcggccaggggtgacctcagctccaggtttcccgcacctgcctactgccaatcctaccggtcccggagagagagggccacccggcgctgttgaggtgattcgagagagctcatctaccaccgggatggtcgtcggcatagtggccgccgcagccctgtgcatcctgatactcttgtacgccatgtataagtatagaaaccgcgacgagggcagctatcaagtggaccagtccagaaattatatttcaaattccgcccagagcaatggagccgtggtcaaggaaaaggcacctgcggcacccaagacaccttctaaggcaaagaagaacaaggataaagagtattacgtatag

SEQ ID NO: 126105 - DNA, 4929 bp, Artificial Sequence
  Description of Artificial Sequence: Synthetic coding sequence
atggcctccggatctcgctggaggcccacccctcctcctctgttgctgctcctgctactcgcattggccgcaagagcagacgggctagagtttggaggcggccccggccagtgggccagatatgcccgatgggcaggggcagcttcctctggggagcttagttttagcctccggacaaatgcaacaagggctctgctgctgtacctggatgatgggggtgattgcgacttcctggagctgcttctggtggacggaaggctgcggctgcgctttacgctcagttgtgctgaaccagccacattgcaactcgatacacctgttgcagacgataggtggcatatggtgctgctgacgagagatgctcgacgcacggccctggctgtggatggcgaagcaagggctgcggaagtgagatccaaaaggagggagatgcaggttgcttctgaccttttcgtgggaggtatccccccagatgtgcgcctgtcagcgctcaccctgagcaccgtgaagtacgagccaccatttagagggcttctcgccaacctcaaactgggagagagacccccagctcttttaggatctcagggcctgagaggggctacagcagatccactttgcgcaccagccagaaatccatgtgccaacggggggctgtgcaccgtcttagctccgggggaagttggatgcgattgcagtcatacaggatttggaggtaaattctgcagtgaggctccaagcccttttcaggggcctgcacatctcaccctgaattccgaaggaaaggaagaattcgtcgcgacatttaagggcaatgagttcttctgctacgacctgagtcataatcccatccagtcgtccacggacgaaataacattggccttccgcacactacagagaaacggactgatgttacatacaggcaaatcggccgattacgtaaatctgtctctgaagagcggcgccgtctggcttgtgatcaacctgggatctggagcattcgaagctcttgtggagcccgtaaatggcaaatttaatgataatgcctggcatgatgtgcgcgtgacgcggaatcttagacaacatgcgggaattgggcacgcgatggttaccatctcagtggatggtattctgactactacgggatacacccaagaggattatacaatgctgggatcagatgactttttctacattggggggagtccaaacacagccgacctgcccggaagcccggttagtaacaatttcatgggctgtttgaaggacgtggtttataaaaacaatgatttcaaactggagctgtctagacttgctaaagaaggtgaccccaagatgaaactgcagggcgacctatccttccggtgtgaggacgtggcggcattggacccggtcacatttgaaagcccagaggcttttgtggcactcccccggtggtccgctaagagaaccggatctatttcccttgactttcggaccactgaacccaatggactattgttgttttcacagggtaggcgagcaggcggcggggcaggaagtcactcaagcgcccagagagccgattattttgcaatggagctgttagacggacacctgtacctgctgctggatatggggagtgggggtattaagctcagagcctcatctagaaaagtaaacgatggggagtggtgtcacgtagactttcagagagacgggaggaagggatctatcagtgtgaacagccgatccaccccatttctcgcaacaggcgattcggagatcttggacctcgagtcagagctgtatctgggcgggttgccagaaggggggagggtcgacctgcctctacccccagaagtctggaccgccgccttgagggccgggtatgtgggctgcgtccgggatcttttcatcgatggtcgctcgcgagatctgcgagggctggcagaagcacagggagctgtgggagtcgctccgttctgctctcgggagacgcttaagcagtgtgcaagtgcgccatgccgaaacggcggcgtgtgccgggagggatggaatcggtttatctgcgactgcatcggtactgggtttcttggaagggtgtgtgaacgtgaagctacggtgctgagttacgatggatctatgtatatgaaaatcatgcttccaaatgcgatgcataccgaggccgaagacgtctcactgcgatttatgtcacagcgagcttacggtctgatgatggccactacgtccagagaaagcgctgatactttgagactggagctggatggaggacagatgaaactcactgtcaatttgggaaagggcccggaaacactgtttgctggacacaagttgaatgataatgagtggcacacagtcagagtggtaaggcgggggaagagtttgcagcttagtgtcgacaacgtgaccgtggaagggcaaatggccggagcgcatatgagactcgagtttcacaacattgagaccggtatcatgaccgagaggcgctttattagcgttgtgccatctaacttcattggtcacctgtcaggattggtgttcaacggacagccttatatggaccagtgcaaggacggagacattacctactgcgaactaaacgcacgatttgggcttcgagcgatagtggccgatcctgtaacctttaaaagcaggagctcctacttggctctggcaactcttcaagcctacgcaagtatgcacttgttcttccagtttaagaccacagcacccgatgggctcctgttgtttaattccggcaacggcaacgatttcattgtgatagaattggtgaagggatacattcactacgtctttgacctgggcaatggacccagtctgatgaaaggaaactccgataagccagtgaatgacaaccagtggcataacgtggtggtcagcagggatccaggaaacgttcacacactcaaaattgattcgcgcaccgtaacccaacactcaaatggagccaggaatctcgatctcaagggggagctctacataggcggcctttccaagaacatgttctccaatctcccaaagcttgttgcttctcgcgatggattccaaggctgcctcgcatccgtcgacctgaatggccgcctgcccgatcttatcgccgacgccttgcaccgcattggccaggtggagcgcggttgtgatggcccgtcaacaacgtgtacagaggaaagctgtgcaaatcagggcgtctgcctccagcagtgggatggattcacgtgtgactgtactatgacaagctacggcggccctgtgtgcaacgatcctggaacaacatacatcttcggcaagggcggcgccctcatcacgtatacttggccaccaaacgatcggccctccacacgcatggacagattagccgtgggcttttcgacccaccagaggagcgcagttttagtgcgcgtggattcagctagcggtctgggggactatctacaactgcacatcgatcagggcaccgttggagtcatctttaacgtggggactgatgatatcaccatagacgagccaaacgcaatagtaagcgatgggaaataccacgtcgttcggtttacccgtagcggcgggaacgctaccctgcaggtggattcctggcctgtcaacgagcgctacccggctggccggcagctgacaatttttaactcccaggccgcaatcaagataggcggccgagatcagggtaggcctttccagggacaggtgagcgggttatattacaacggactgaaagttcttgccctggcagcagagtcagaccctaatgtgcggactgaggggcatctccgactggtgggagaaggtccctcagtacttctgtcagccgagacaaccgccacgacccttctggctgatatggctaccaccatcatggagacgaccactaccatggctaccaccaccacacgcagaggcagaagcccaacactgcgcgacagtacaacccagaacacagatgacttgctggtggcatctgcagagtgcccctcagatgatgaggatctggaagaatgcgaaccctcaactggaggggagctcatcttaccaattatcaccgaagattctttagacccgccccccgtggccacgagatcccctttcgtcccaccacccccaactttctacccctttctcacaggagtcggtgcaacacaagatacactaccccctccagccgcccggcggccaccaagtgggggaccctgccaggccgaaagggacgacagtgattgtgaagagcctattgaagcttccggatttgcctctggggaggtgttcgacagctccctgcctcccactgatgacgaagatttctatacaacctttccactggttaccgatagaactactctcctgtcacctcgcaaacctgcccctcggcctaatctcagaaccgatggcgctacaggagctcccggggtacttttcgcccctagcgcccccgcccctaatttgcctgctgggaagatgaaccatcgcgaccctctgcaaccattattggagaacccacctctgggccctggcgccccgacctcctttgagcctcgacgccctccgcccttgcggccaggggttaccagcgccccagggtttccccatctaccaaccgcgaatccaacagggcctggcgaacgaggccctcccggggccgtagaagtgatccgggaatctagctccaccaccggcatggttgtgggcatcgtggcagcagccgcactgtgtattcttatcctgctatatgccatgtacaaataccgtaaccgcgatgaaggatcataccaggttgaccagagtcggaattacatttcaaattcagcccagtcaaacggggcggttgtcaaagagaaagcccccgccgctcctaaaacgccaagcaaagctaagaagaacaaggacaaggaatactacgtgtag

SEQ ID NO: 126106 - DNA, 5139 bp, Artificial Sequence
  Description of Artificial Sequence: Synthetic coding sequence
atggctagcgggagtcgttggcgaccgacacccccgcccctcctgttgctcctcctgttagcgctggccgcgcgcgctgatggtctcgagttcggcgggggtcccgggcagtgggcgcgatatgccagatgggccggagccgcttccagtggagagttgagtttttcactccggacgaatgctacccgcgcccttcttctgtaccttgatgacggaggtgattgtgacttcttggaactcctgttagttgatggccggcttcgcctgcggttcactctgagttgcgctgagccagccaccttgcaactggacacccccgtggccgatgacaggtggcacatggtgttgcttactcgggatgccagaagaaccgcccttgcagtcgacggcgaggccagagctgcagaagtgaggtctaaaagacgcgaaatgcaggtagcgtccgatttgtttgtgggaggcattcctcctgacgtacgcctgtctgccttaacactctccactgtcaagtacgaacctcctttccgcggcctgctcgccaatctgaagctgggtgagcgaccccccgccctacttggatcccagggcctgcgaggtgccacggcagacccattatgtgctccagctcgcaatccttgtgctaacgggggcctgtgcactgtgctggcccctggagaggtggggtgtgattgcagccacaccggcttcggaggtaagttttgctcagaagaggagcaccccatggaaggcccggcgcacctaactctgaattcagaggttggctcccttctgtttagcgaaggcggggccgggcggggcggggcgggagacgtgcaccagccaaccaaaggcaaggaagagtttgttgccacctttaaggggaacgaatttttctgttacgacttgagtcataacccaatccaaagctcaacagacgagattaccctggcctttaggacactccaaaggaacgggcttatgttgcataccgggaaatctgccgattacgtcaacctttccctcaaatctggggcagtgtggctggtgatcaatttaggcagcggtgccttcgaagctctggtcgaaccggtgaacggaaagtttaatgataatgcgtggcatgatgttagggttaccagaaacctgaggcagcatgcgggcatcgggcacgctatggtgaacaaactccactacctcgtgaccattagtgttgacgggatcctcacaactacggggtacacgcaggaagactatactatgctcggcagtgacgattttttctacattggcggatctccgaacaccgcagatctgcccggatctcccgtctccaacaattttatgggttgtctgaaagatgtcgtgtacaaaaataatgacttcaaacttgaactttcccgtttggcaaaggaaggcgacccaaagatgaagctgcaaggggaccttagctttagatgcgaggatgtggccgctttagatccagttactttcgaaagcccggaagccttcgtggcgctacccaggtggagcgcaaaaaggactggctccatcagcttagatttcaggaccactgagcccaatggactcctcctgttttcgcagggcagaagagcagggggaggagcaggaagccacagctccgcacagagggccgattatttcgccatggagctgcttgatggtcacttgtatcttctcttggacatgggtagcggaggcattaagctgagagcaagcagcagaaaagtgaatgatggagaatggtgccacgtggacttccagcgcgacggaaggaaaggatctatttcagtcaactcaaggtcgactccttttctggcaaccggagatagcgagattctggacctcgagtctgagctgtatctcggggggctgcctgaaggagggcgcgtggatctgccgttgccccccgaggtgtggaccgctgccctgagagcgggatacgtggggtgcgtgcgggacctgtttatcgacggccggtccagggacttgagaggcctggctgaagcacagggcgcggtaggggtagcgcccttctgttctagggagacactcaagcagtgtgcttccgccccctgcaggaatggaggcgtctgccgggaaggctggaaccgattcatctgcgattgcataggaactggcttcctgggacgggtgtgtgagagggaagccacggtgctctcatacgacggtagtatgtatatgaagatcatgctcccaaatgctatgcatacagaagccgaagacgtctcattacgatttatgagtcagagggcatacggtctgatgatggccactactagcagagagtcagcagacactctgcggctcgaactcgacggcgggcagatgaagctcacagtcaatttggattgtttacgagtaggctgtgcccctagtaaaggacccgagaccttgttcgctgggcacaagcttaacgacaacgagtggcataccgtgcgcgtggtcagacgggggaaaagcctgcagttaagtgtagacaacgtgaccgtagagggacaaatggcaggggcccatatgaggctcgagtttcataatattgagaccggcataatgacagagcgcaggtttatttctgtcgtccctagtaatttcatcggacacttgtccggacttgtgttcaacgggcagccgtatatggatcaatgcaaggatggggacataacatactgcgagctaaacgcacgtttcggacttcgtgcaatcgtggccgaccctgtaaccttcaagtcaaggtcttcttaccttgcgctggctacactgcaggcatatgcttcaatgcacctctttttccagtttaaaacgacagcacctgatggactcctactgttcaattccggaaatgggaatgattttatagtgatcgagctggtaaaaggttacattcactacgtgttcgacctcggaaatggtccctctctcatgaagggtaacagcgataagcccgtcaacgataatcagtggcataatgtcgttgtctcgagagaccccggcaacgttcatacactcaagatagacagtcgtactgtcacacagcacagcaatggggcacgcaacctggacttgaagggggaactatacattggcggcctgagcaaaaatatgttttcaaacctacctaaattagtggcttctcgcgacggcttccagggctgtctcgcctctgtggacctgaacggaagactgcctgacctcattgcagacgccctgcataggattggccaagtcgagcgcggctgcgacggccctagtactacctgcactgaggaatcctgtgccaaccaaggcgtatgtctgcagcaatgggatggattcacgtgcgactgcaccatgacctcatatggtggcccagtctgcaacgatcctggcacaacctatatattcggaaagggtggggccctgataacctacacatggccacccaacgaccggccaagcactcgcatggataggctcgcggtaggattcagcacgcatcagcggagtgccgttcttgtaagggtggactcagccagcggccttggagactatctgcagctccacattgaccaaggcactgtgggggtaatcttcaacgtgggcacagacgatattacaatcgatgagcctaacgccatcgttagcgatgggaaatatcacgtggtgcggttcacccgatcagggggcaacgcgacactacaggttgactcctggcctgtcaatgagcgttatccagccggtaacttcgacaacgaacgacttgccatcgcccgacagcggatcccctaccgcctcgggagggtggtcgacgaatggctgctggacaagggacgacaattgaccattttcaactcgcaagctgccattaaaattggcggacgtgatcagggccggccctttcaagggcaagtctccgggttgtactataatgggctcaaggtactcgcgcttgcagccgagtccgatcctaacgtgcgtacagaggggcatctgagactagtcggggaaggaccgagcgtgctgctttccgccgaaactaccgccactacactgctggcagatatggctacaactattatggaaacaaccacgacaatggcaaccaccacaacacgtagggggaggtcccccacacttcgggattctactactcagaacacggatgacctgctcgtggcctctgccgagtgcccatcggatgatgaagacctcgaagagtgtgagccaagtaccggcggggaattgatcttgcctatcattacagaagatagtctggatccccccccagttgctacccgttctccctttgtgccgcccccaccgacattttacccttttttaaccggggttggcgcgacgcaagacaccctgcctcctccggccgccagacgcccaccctcaggtgggccatgccaggcagagagggacgattcagactgcgaagaaccgatcgaagcttcgggtttcgcgagtggagaggtttttgattcctctctgccccctaccgacgatgaggatttctacacaacattccctctagttactgatcggaccaccttgctgagcccaagaaaacctgctcctaggcccaacttgagaaccgatggggcaaccggagcacccggggtcctttttgccccatccgcaccagctcccaacctgccagctggcaaaatgaaccaccgggaccctctgcaacccctcctggagaatccacccctgggacctggggcccccactagcttcgagccgcggcgtccacctcccctgagaccgggtgttaccagtgcccccggcttcccgcatcttccgacggccaatccaaccggccctggggagcggggacctccgggcgcagtggaggtaattcgcgaaagcagcagcactaccggcatggtggttggaatcgtagcggctgcagcactgtgtatcctaattcttttgtatgccatgtataaataccggaaccgggatgagggaagctaccaggtcgatcagtctagaaattacattagcaactccgcgcagtctaatggagctgtagtcaaagaaaaggcccctgccgctccgaagacgccgagcaaagctaaaaagaacaaggacaaggagtactacgtttag

SEQ ID NO: 126107 - DNA, 4929 bp, Artificial Sequence
  Description of Artificial Sequence: Synthetic coding sequence
atggcaagcgggtccaggtggcggcctacacccccccctctcctcctgctgctgctgctggctctggcggcacgtgcagatggcctcgaatttggtggaggaccaggtcagtgggctaggtacgcccgatgggcaggggctgcaagctctggcgagctctcattctctcttagaacaaacgccactagagcactgctgctgtaccttgacgatggtggtgattgcgactttctggaactcttactggtggatggacggctacggctccggttcaccttgtcctgcgctgaaccagcaacactgcagcttgacacaccggtcgcggatgatcgctggcacatggttctgctgacgcgcgatgctcggaggaccgcgttagccgtcgacggagaagctcgagctgccgaggtgcgttcaaaacgaagggaaatgcaggtggcctcggatctgttcgtgggcgggatcccacccgacgtccggctcagcgctttaaccttatccactgtaaaatacgagcccccatttcgcgggctactggccaatctcaagctgggggagaggcctccggccctgctgggatcacagggactccgaggcgccaccgctgaccctttatgtgctcccgcaaggaatccttgtgccaacgggggcctctgcaccgttctggcacctggagaagtcggttgcgattgctctcacaccggcttcgggggaaagttttgtagtgaggaggagcacccaatggaaggtccggcccatcttactctgaacagcgaagggaaggaggagttcgtggccacgttcaagggtaatgagttcttctgctatgatctgagccacaaccccatccaaagtagtactgacgagataactcttgcttttagaacactccaacggaatggcctgatgcttcacacgggcaagtctgctgactatgttaacctaagcctcaagtccggcgctgtttggctagtgatcaacctgggatcgggtgcatttgaggccttagttgaacctgttaatggaaagttcaatgacaacgcttggcatgatgtgcgcgtgacacgtaatctcagacagcacgccgggatcggccacgcaatggtgactataagcgtagacggcatcctaactacgactggctacacccaggaagactatacaatgctgggaagcgatgacttcttttacataggaggctcccccaatacagcagacctgcccggttcccccgtatcaaataattttatggggtgtttgaaagatgttgtgtacaaaaacaacgattttaagctggaactgagccggctggcaaaggaaggggaccccaagatgaagctgcagggtgacctaagctttaggtgcgaggacgtagccgcactagacccggtgacctttgaatcacccgaggcctttgtggccctccccaggtggtctgcgaaacgaacaggctccataagcctcgattttcgcactactgagcctaatgggctcttgctgttctcgcagggccgccgcgcgggcggtggcgctggcagccatagctctgcacagcgggcagattatttcgccatggagttgctcgacgggcacctctaccttctgctggatatgggttccgggggtataaaactacgcgcgtcttcacgcaaagtgaatgacggagagtggtgccacgtagactttcagcgagatggcagaaagggctccatttctgtgaacagcaggagcacgcccttccttgcaaccggcgacagcgaaatcttggacctagaaagtgagctttacctcgggggtttaccggagggcggccgcgtagatcttccgctgccgccagaagtgtggacagctgcactgcgcgctggctacgtggggtgtgtccgggacctgttcatcgacggaagatcaagagatcttcgcggactcgctgaggctcagggtgccgtcggcgttgccccattttgctccagagaaaccctgaaacagtgtgcaagcgcaccttgccgcaatggaggcgtgtgtcgcgagggttggaatcgtttcatctgtgactgtatcggaaccggctttctgggacgggtttgcgagcgcgaggctacagtgttatcctacgatggctctatgtacatgaagatcatgcttccgaacgcaatgcacaccgaggctgaagacgtcagcctgcgattcatgtctcagcgagcttacgggctgatgatggctacgactagccgggagagcgcagatacgctcagactggagctggacggaggccagatgaaactgactgtgaacttgggaaaaggcccggagacgctgtttgccggacataagctgaacgacaatgaatggcatactgtccgtgtggtgcggcggggaaaatccctccaactttccgtggacaacgtgaccgttgagggccaaatggccggagctcacatgcgtctcgagttccacaacattgagactggaattatgactgagcgccgtttcatctcagtggtgcctagcaacttcattggacatctaagtggcctggtgttcaacggccagccctatatggaccagtgtaaggacggagatattacttactgcgaactgaacgctcggttcggattgcgcgctatcgtcgccgacccggtgacattcaaaagccgcagcagctatctggccctggccaccctgcaggcatacgcttctatgcatctgttcttccaattcaaaacgaccgcccctgacggccttctgctgttcaattcaggaaacggaaacgatttcatcgtgatcgagttagttaaggggtacattcactatgtatttgatttgggcaatggtcctagcctgatgaaaggcaactcggataagccagttaacgacaaccagtggcacaatgtcgtcgtgagccgcgatcctggtaacgtccatacactgaaaattgactcccgcacagtgacacagcacagtaatggagccaggaacctagaccttaaaggtgagttgtacatcggcggtttgtcaaagaatatgttcagcaatctccctaagctggtggcctcgagagatggcttccaggggtgcctggcctccgtggacctcaacggaagactgcccgacctcatcgcagacgctctccacaggataggccaagtggagaggggctgcgatggaccatctacgacctgtaccgaagagagctgcgcaaatcagggggtctgcctgcagcaatgggatgggtttacttgcgattgtacaatgacttcctacggtgggcctgtttgcaatgaccccggcactacatacattttcggcaagggcggagccctgatcacatatacgtggcccccgaatgatcgcccaagtacccgtatggatcgtctggcagtaggtttttctacgcatcagagatcagccgtgctcgtaagggtagactccgctagtggtttaggggactacctgcagcttcacatcgatcagggcacggtgggcgtgatattcaatgtaggcactgatgacattactattgatgagccaaacgccattgtgagtgatggaaagtaccatgtggtgcgatttactcgctccggaggcaatgccactctgcaagtggacagctggcccgtaaacgagaggtaccccgccggccggcagctcacgatctttaattcacaggccgctattaaaattggcggcagggatcagggaaggccgttccagggtcaagtctccggcttgtactataacggcttaaaggtcctcgctttggccgccgaatctgatccaaacgtacgaactgaggggcacctccgacttgtaggagaaggcccttccgtgctactctctgctgaaacaaccgcaacgacattactcgccgatatggcgacaacaatcatggaaacgacaactactatggctaccacaacaactcgcagaggacggtcccctactctgagggacagcactacccaaaatacagacgatctgctagtcgctagtgccgagtgcccttctgatgatgaggatttggaggagtgtgagccttctacgggtggtgaactaatcctccctatcatcaccgaggattccctcgatccccctcctgttgcgacacgctcaccattcgtgccgcccccccccactttctacccttttcttacaggtgttggggccacccaggatacactgcctccacccgctgcgcggcggcctccttctggcggcccttgccaagctgaacgagatgattccgactgtgaggagcctatcgaagccagcggatttgccagcggagaggtctttgatagctctctgccccctacagatgacgaagacttttacaccactttcccattggtgacagatcggactacactcctatcacctcgcaaaccagcccccagacccaacctccggactgacggcgccacaggggcgcccggcgtgctcttcgcaccctccgcccccgcacccaacctgcctgcaggaaagatgaatcaccgtgaccctctgcagccacttctggagaatccacccttgggacctggcgcaccaacttcgttcgagccccgccgcccgccaccactgcggccaggcgtgacaagcgcccctggctttccgcacctaccaactgctaatccgaccggaccaggggaacgaggacccccaggagcggtggaggtaattagagaatcttcctctacaacaggcatggtggttggtatcgttgcagcggcagccctgtgcattctgatactgctctacgcgatgtataagtatagaaatcgggacgaggggagctatcaagtggatcagtctagaaactatatcagcaacagtgcccaatcaaacggggccgtcgtgaaggaaaaggccccagctgctcctaagaccccatctaaagccaaaaagaacaaagataaggagtactacgtctag

SEQ ID NO: 126108 - DNA, 5118 bp, Artificial Sequence
  Description of Artificial Sequence: Synthetic coding sequence
atggcgagtggctctagatggagacctacaccccctcctctcctgctgcttctgctcctggccttagcagcccgggctgacggactggaattcggcggcggacccggacagtgggcaaggtatgcccggtgggcaggagcggcttcctcaggagagttatccttttcccttcgcacgaacgccacccgagctctgctgctgtatctggatgacgggggagattgtgatttccttgaactgttgttagtggatggcagactgaggcttagattcactcttagctgcgccgagcccgccaccttacaactagacactccagtggctgatgaccggtggcacatggtgctcctgacccgggacgctaggaggactgctttagcagtcgatggtgaggcacgagcagccgaggtacgctccaagcggagagagatgcaagtggccagtgacttgttcgttgggggcattcccccagatgtgcgattgtcagccctgaccctgagcaccgtcaagtatgagcccccctttcggggactgctggcaaacctaaagctcggcgaacggccacctgctctgcttggctctcaaggccttagaggggctaccgcggatcctctttgtgctcccgcacgtaatccatgcgcgaacggtggactgtgcacggtcttggcgcctggtgaggtgggctgcgactgttcacataccgggttcggaggcaaattctgcagtgaggaagagcacccgatggagggccctgctcacctgacactgaatagcgaagtgggctcccttctctttagcgagggtggcgcaggccgcggtggcgccggcgacgtgcaccagcctacaaagggaaaggaagagtttgtggccacttttaagggcaatgagttcttttgttatgacctgagccacaatcctatccaatccagcacggacgagatcactctggcattcagaaccctccagaggaatggactcatgctacacaccggcaaatctgctgattatgttaatctcagtttgaaatccggggcggtgtggctcgtgattaacctgggcagcggcgctttcgaggccctggtggaaccagtcaacggaaagttcaacgacaacgcctggcatgatgtaagggttacgcgcaacctgcgacaacacgccggaattggtcatgcaatggtgactatttcagtggacggcatcctcacaacgacagggtatactcaagaagactacactatgctgggcagcgatgactttttctacattggtggtagtccgaatactgcagatcttcccgggagcccagtcagcaacaatttcatggggtgcctgaaagatgtcgtgtacaaaaataacgacttcaaactggaactgtcccgtttggcgaaggagggtgatcctaagatgaagctgcaaggagacttatcatttcggtgtgaggacgtggctgcactcgatcccgtgacgttcgagagccccgaggccttcgtggctcttcctcgctggtctgctaagcgcacaggcagcatctctttggattttcgcacaactgagcccaatggcctcctgctgttttcgcaaggtcggagggctggcggtggagccggctcacattcaagtgcccaacgcgcagactatttcgccatggagctgctggatgggcacctctatctgttgttggatatgggctccggaggaattaaactacgtgcctccagcagaaaagtgaacgacggtgagtggtgtcatgtggactttcaaagggatggaagaaaagggtccatctccgtcaactcccgaagcacacctttcctggccactggcgattccgaaattctcgaccttgagtcagaactgtatctgggcgggctgccagagggaggtcgagtagatctgcctctccctcctgaggtctggaccgccgcgctgcgagcaggatatgtagggtgcgtgcgcgatctgttcatagatggccgaagtcgtgatctccgaggcctcgctgaggctcagggcgcagtcggagtagcaccgttctgtagcagggagactctaaaacagtgtgcaagcgcgccatgcagaaacggtggagtgtgtagagaaggatggaatcggttcatttgcgactgtatagggactggtttcctgggacgcgtatgtgaaagagaggctaccgtgctttcttatgatggctccatgtacatgaaaattatgctgcccaacgctatgcatactgaggccgaggatgtgtccctccggttcatgtctcagagagcgtacggcctgatgatggccaccacctctcgcgaatctgctgataccttgagactggagctggacggtggtcagatgaaactgacggtgaatctcgactgtctccgggtggggtgcgcccctagtaaaggtcctgagactctgtttgcaggccacaaactgaatgacaacgagtggcacacagtgagagtagtgaggaggggcaaatctttacagcttagtgtcgacaacgtaaccgttgaggggcagatggctggcgcccacatgcggttagaattccacaatatagagacaggcatcatgactgaaagaaggttcatttccgtcgtcccatctaatttcattgggcacctcagtggtctcgtcttcaacggccagccctacatggaccagtgcaaggacggggacattacctattgtgagctgaacgcaagattcggccttagagcaatagtggcagatccagtgaccttcaaaagcaggagctcttaccttgccttggcaactctgcaagcatacgcctctatgcatctattcttccagtttaaaacaaccgcccctgacggactcttgcttttcaactcgggcaatggtaatgacttcattgtcatcgagctggtcaaaggatacatccactatgtctttgacctaggcaatggaccctctctcatgaaagggaattcggataaaccagtcaatgataaccagtggcacaacgtggtggtatcgcgtgaccctggcaacgtgcataccctgaagattgattcacgaaccgtgacgcaacactctaatggggctcgtaatctggatctgaagggcgaactttacattggtggtctgtccaaaaacatgttcagcaatcttcctaaattggttgcctctcgcgacggcttccagggttgcctggcctccgtggacctgaatggcaggctgccagatctcattgcagacgccctccacagaatcggccaggtggaacgaggctgcgacggaccatcaacgacttgcacggaagagtcatgtgccaaccaaggggtgtgcctacagcaatgggatggttttacctgcgattgcaccatgacgtcctacggtggacccgtgtgtaatgacccagggacaacttatatctttggaaagggcggagctttgatcacatacacgtggcctccaaatgatcggcctagtaccaggatggatagactggctgtagggttctctacgcatcagcgttctgcagttcttgtgcgtgtcgattctgcatccgggctcggggactatttacagttgcacatcgaccaaggaacggtcggagtaatcttcaatgtcggaacagacgatatcacgatcgatgaaccaaacgccatcgtaagtgacggcaagtatcatgtcgtccgttttaccagatccggtggcaacgcaaccttgcaggtggattcctggcccgttaacgagaggtacccagccgggaattttgataatgagaggctggcaattgctagacaaagaatcccctataggctggggcgcgtcgtggacgaatggctcctggacaagggccgccagctgaccatctttaactcgcaggccgctataaagataggcggccgtgatcagggaaggcctttccaaggccaggtgtctgggctgtattataacggcctgaaggttctggcccttgctgctgagtctgatcccaatgtgcgcacagaaggacacttacggctggtcggcgagggcccgagcgtgcttctgagtgctgagaccacggccaccactcttctcgcagatatggctactactattatggagacgacaacgaccatggccaccacgaccacacggagggggcggtcccccaccctgagagactcaactacccagaatactgatgatcttctcgtggcatctgctgagtgcccttctgacgacgaggatctggaggagtgtgagccttcaactgggggcgagctaattttgcccatcattactgaggacagcctggatcccccgcctgtggctacacggtcgccctttgttccccctcctcctaccttctatccttttctcacaggggttggcgcaacccaggacaccctccccccgcccgcagcgaggcgcccaccatctggcggaccatgccaggccgaacgtgatgatagcgattgcgaggaacccatcgaagccagcggctttgcttccggggaagtattcgactcttcgctgccacccacagacgacgaggacttctacaccacatttcctctggttactgatcgtactaccctgttgtccccaaggaaacctgcacctaggccaaacctgagaaccgacggcgccactggggccccgggtgtgctattcgctcccagcgccccagccccaaatctgccagccgggaagatgaaccatcgcgaccccctacagcctctcctggagaatccccctctcggcccgggcgcccctaccagcttcgagcctaggcgccctcccccacttagaccaggggtgacctctgcaccagggttcccccatctacccactgcgaaccccaccgggcctggtgaacgcgggcccccaggtgccgtggaggtgattagagaatctagctccacaacgggcatggtggttggaattgtggccgcagcagcgctgtgcatactgatcttactctacgctatgtacaaataccgtaacagggatgaaggctcttatcaggtcgatcagagtcggaactacatatccaacagcgctcaaagtaacggggcagtggtgaaggagaaagccccagcagcccccaaaactccgagcaaggccaagaagaataaggataaggagtattatgtgtag

SEQ ID NO: 126109 - DNA, 2001 bp, Artificial Sequence
  Description of Artificial Sequence: Synthetic coding sequence
atgcctcccggcggttctggccccggtggatgtcctagaaggcctccagcactggccggtcccctgcctccaccaccacctcccccacctccccctttactgccgttgctgccactccttcttctcctgctgctgggagccgccgagggtgcgcgggtgagctccagcttaagcaccacgcaccacgtccaccatttccattctaagcatggaaccgtgcctatcgcgattaaccgcatgcccttcctgacccgaggcggtcacgcagggactacttatattttcgggaagggcggggccctgattacttacacctggcctcccaatgacaggcctagtactagaatggatcgcctcgcggtgggcttttctacccaccagcgaagcgcggtcttagtccgagtagatagcgccagtgggcttggtgactatctacagctccacatagaccaagggactgtaggcgtgatcttcaacgtgggaacagatgacattacgattgatgaacccaatgcaatcgtgagcgatgggaagtatcatgtggtcagattcacacggtctggaggcaatgccacccttcaggtagattcctggcctgtcaatgaacggtacccagccgggaacttcgacaatgaaaggctggctatcgctcggcaaaggattccttatcgcctgggccgcgtagtggacgaatggttgctggacaaggggagacagttaaccatctttaacagccaggcagccataaagattggcggcagagatcaagggcgaccctttcagggccaggtgtctgggctgtattacaatggccttaaggtcctcgccttagctgcagagagtgatcctaatgtgagaacagaaggccacctcagactggtaggtgagggcccatcagtgttgcttagcgctgagaccacagccactactctcctggccgacatggcaaccacaatcatggaaactaccaccaccatggccacaacaaccacccggcgcgggaggtcccccactctccgcgatagtacaacgcaaaacactgacgatctcctggtcgcttctgccgagtgcccctccgacgacgaggatcttgaagagtgtgagccctctaccgggggggaactgatcctccctatcattacagaagattccctggatcctccccctgtggccaccagatctcccttcgtacctccccccccaaccttctacccttttttgacgggtgtcggcgctacacaagatactctccctccacccgctgccagacggccaccctccgggggaccgtgtcaggctgagcgggacgactccgattgcgaagagccaatcgaagcgagcgggttcgcatcaggagaggtcttcgattcatctcttccgccgactgatgacgaagatttctatacaacctttcctctcgtcactgacagaactacgttactgtctccacgaaaaccagccccacgccctaatctacgcaccgacggggccaccggcgctccaggtgtgctgttcgccccgagcgcaccagcacccaacctccctgcgggtaagatgaatcatagggacccactccagcccttgctggagaaccctccattggggccgggcgctcctacgtcgtttgaacccaggaggcctccaccactccgccccggcgtaacttccgcccccggttttccacacctgccaacagccaaccccacaggtcctggtgaacgcggaccccccggagctgtagaagtcatccgtgaatctagcagtacaactggtatggtcgtaggcattgttgctgcggctgcgctgtgcatattaatcctgctttacgcaatgtacaagtaccggaacagagacgagggaagttaccaggtggaccagagcaggaactatatcagcaactctgctcaatcgaatggagccgtggtgaaagagaaagctcccgctgctcccaagacaccctccaaggccaaaaaaaacaaggacaaagaatactacgtgtag

SEQ ID NO: 126110 - DNA, 1299 bp, Artificial Sequence
  Description of Artificial Sequence: Synthetic coding sequence
atgcacctgagaatacacgcccgtaggtctccccctcgaaggccggcgtggaccctcgggatctggtttttgttctgggggtgcatagtctccagtgtgtggagcagctcaaatgtcgcctcctcttcatctacttcttcgtcccctggatcccactcacagcacgaacaccacttccacggctctaagcaccactcagtgcctatctctatctacaggagtcctgtctcgcttaggggcggccatgctggagcaacgtatatcttcggtaagagtggcgggcttattttgtacacctggcctgcgaatgatcgaccgtcgacaaggtcggatagactcgcggtcgggttttccacgaccgttaaagatggcatccttgtccgaattgatagtgcacccggactcggcgacttccttcagctgcacatcgagcaaggaaagatcggagtcgtgttcaatataggtacagtggacatcagtatcaaggaagaaaggaccccagtcaacgacggaaagtaccatgtggttagattcacgagaaacggtggaaatgcgacactgcaggtggacaactggccagtcaacgagcactaccccacggggcgtcagctcacgatatttaacacccaggcacaaatcgccataggcggcaaagacaagggaagactcttccaagggcagctgtccggactgtattacgatggtcttaaagtcctgaacatggccgccgagaataaccctaatatcaagattaacggctcagtgcgtctcgtaggcgaagtcccttctatcctcggcacaacccagacgacatctatgcccccggagatgagcaccactgtcatggaaactaccaccacaatggccaccacaactacgaggaaaaataggagtacagcctctatccaacccacctccgatgatttagtgtcaagcgccgaatgcagctctgacgacgaggattttgtcgagtgtgagcctagcacagggcggtccgcaaatcccaccgaacctggcattagacgcgtccctggggctagcgaggtgatccgtgaaagctcttcaaccactggcatggttgtgggcattgtggcagctgctgctctttgtatcctcatcctcctgtacgccatgtacaagtacagaaatcgcgacgaggggagttaccaggtggacgaaactcgaaactacatatctaacagtgcacaaagcaacgggactctcatgaaagagaagcaacaatcctctaagagcggacacaaaaagcagaaaaacaaagatagagagtactatgtatag

SEQ ID NO: 126111 - DNA, 4932 bp, Artificial Sequence
  Description of Artificial Sequence: Synthetic coding sequence
atgtcatcgactttacactccgtattctttaccctgaaagttagtatcttactgggcagtctgctggggttatgtctgggactggagtttatgggacttcccaaccagtgggctcgctatctgcgctgggatgcatctacccgctctgacctatccttccagtttaagaccaatgtgagcacggggctgctgctgtatctcgatgacgggggggtatgcgatttcctctgtctgagtctagtggacgggagggtgcagctgaggttcagcatggactgcgcagagaccgccgtgctgagcaataaacaggtgaatgatagctcctggcactttctcatggtaagtcgggacaggctcagaaccgtgctgatgttagacggcgaagggcagtctggcgaattacaaccccagaggccatatatggacgtggtctcggacttgttcttgggcggagtgccaaccgacattagaccaagcgcccttactcttgacggcgtgcaggcaatgcctggattcaagggcctaattcttgatctgaagtatggcaactccgaacctaggttgcttggcagcagaggagtgcaaatggacgccgagggcccttgcggggagcggccctgcgaaaatggggggatctgttttttgttggacggccaccctacctgcgattgtagtacaaccgggtacggcggtaaactgtgctcagagggcagtagcggcgacccatgcctcagccatcttatgatgtccgagcaggccagagaagaaaacgtggctacattcaggggaagcgaatacttgtgttatgacctgtcccagaaccctatccagagctcctcagacgagatcaccctgagcttcaaaacttggcagcgaaacggtctcatcctgcatacgggtaaatcggcggactatgtaaacctcgccctgaaagacggggccgtcagcctagtgattaacctcggctccggagccttcgaggctatcgttgaacctgtcaatggaaagttcaacgacaacgcttggcacgacgtgaaggtgacacggaacctcaggcaggtcacgatttccgtcgacggtattctcaccacaactgggtacacgcaggaggactatacaatgctcgggtcagacgactttttctacgtgggtggcagcccgtcaacagccgaccttccaggcagcccagtgtccaataactttatgggctgtctgaaagaagtggtttataaaaacaatgatattcggttggagctgagcaggctggctagaatagccgacactaaaatgaaaatctacggcgaggtcgtctttaaatgtgagaatgtggccacactcgatcccatcaacttcgaaactccggaggcgtacatctccctccctaagtggaataccaagcgtatgggttccatcagtttcgatttcaggactaccgagcccaatggacttatattgttcacacacggcaaaccgcaggagcggaaggatgcccgctcacagaaaaataccaaagtggacttctttgccgtggagctcctcgatggaaatctctatctacttctggacatggggtcggggacaatcaaagtaaaggccacgcaaaaaaaggctaacgacggcgaatggtatcacgttgatatccagagagacgggaggtctgggacgatctctgtgaatagccgtcgcacaccatttaccgcatccggtgaatcagaaatcctggatttggaaggagacatgtatctgggcggattgccggagaatagggcgggactcattttgccgaccgagctctggacagcaatgctgaattacggctatgtgggctgtatccgggacttgtttattgacggacggagcaaaaatatcagacaactcgctgaaatgcagaatgccgccggcgtgaaatctagctgcagccgtatgtctgccaaacagtgtgactcatacccttgcaaaaacaacgcggtgtgtaaggacggctggaacaggtttatctgtgactgcacagggaccggctattggggacgtacatgtgagcgagaggcctccatattgagctatgacggctccatgtacatgaagattatcatgccgatggtgatgcacaccgaggcagaggacgtgtcctttcggttcatgagccaacgggcctacggattactcgtggccaccacgtccagggacagcgctgataccctgagactcgagctggatggagggcgggttaagcttatggtgaacctcgattgcattaggatcaactgtaatagcagcaagggccctgaaacactgtatgccggacaaaagctgaatgacaacgagtggcacaccgttagggttgttcggcgcggtaagtctctcaagctcaccgtcgatgatgatgtagcagaagggaccatggtgggagaccacactagactggagttccacaacattgaaaccggcatcatgactgaaaagcgctacatcagtgtggtcccttcatcgttcattgggcacctacagagtctgatgttcaatgggctactgtatatcgatctgtgcaagaacggggacatcgattattgtgaactaaaagctcggtttggccttcgcaacattattgccgatcctgttacattcaaaaccaaaagcagctatctgtcactcgctacgctgcaggcttatactagcatgcacttgttttttcagttcaagaccaccagtccagatggttttattttatttaacagcggcgacggcaacgacttcattgcggttgagctcgttaagggatacatccactacgtttttgacctggggaatggtccaaacgtgattaaagggaactccgaccggccgctgaatgacaaccaatggcataatgtagtaatcaccagggataactcgaatactcatagcttgaaggtggatacgaaggtggtaacccaggttattaatggtgctaagaacttggacctcaaaggcgatctctacatggcaggacttgcccagggcatgtacagcaaccttccaaagctagtggcgagtcgagacggatttcagggctgccttgctagcgtcgacctgaatgggcgtttgcctgatctgataaatgacgccctgcatcggtctggacagattgagcgaggttgcgagggaccctctactacatgccaggaggactcttgcgccaatcagggggtgtgcatgcaacagtgggaaggctttacatgtgactgttccatgacctcttatagcggtaaccagtgtaatgatcccggagccacctatattttcggcaagagcggtggcctgatcctatacacctggcctgcaaacgatcggccttcaactaggagtgaccggctggccgttgggttcagtaccaccgtcaaggacggcatcttagttcgcatagatagcgcgcctggcttaggggactttcttcaactccatatcgaacaagggaaaattggggtcgtcttcaacattggcacagtcgatatctcgatcaaagaagagcgaacacctgtgaatgatgggaaataccacgtggtcaggttcacccgaaacggtgggaacgctacactgcaagtggataactggccagtgaacgagcactaccctactggtcgtcagctcacaatttttaatactcaggcccaaatcgcaataggaggaaaagacaagggccggctgttccagggccagctctctggactgtactacgacggcctgaaggtcttaaatatggctgccgaaaacaatccgaacatcaagatcaacggtagtgtcagacttgttggagaagtcccctccattctggggacaacacagaccacctcaatgccccctgaaatgagtacaacagtgatggagactacaaccactatggccaccaccacaactcgcaagaatcggagtactgcttcaatccagcccaccagcgacgacctcgtgtcaagcgcagagtgcagctccgacgatgaagacttcgttgagtgcgaaccttctaccgccagaggtgagctggttattcccctcctggtagaggaccccctcgcaacgcctccaatcgcgacaagagccccaagcatcacactgccacccacttttaggccactgctcactattatagagacaaccaaggacagcctttcaatgacctcggaagctggccttccttgcctgtcagatcagggctctgacgggtgcgacgatgacggtctggtaatttctggctacgggagcggcgagacattcgacagtaacctgccccctactgacgatgaggacttttatacaacattcagccttgtgactgacaagtctctgagcacgtccatcttcgagggcggctataaggcacatgcacctaaatgggagtctaaggactttcggcctaataaagtttccgaaacctcacgcacaacaaccacgtccttgtcaccagagctcatccgtttcacagcttccagcagtagcgggatggtacccaagctaccggctgggaagatgaacaatagagatctgaaaccacagcccgacatcgtgctgctcccactccctaccgcctatgagttagattcgacaaagctgaagtccccactgatcacatctcctatgtttagaaacgtgcctactgcaaaccctaccgagcctgggatcaggcgagtgcccggagcatctgaggtcattcgggaaagttcaagcaccactggaatggtcgttgggatcgtggcggcggccgccctttgtatcctgattctactttatgccatgtacaaatacagaaaccgcgacgaaggatcataccaggtcgacgagactcgcaactatattagtaattccgcgcagagcaacgggacccttatgaaggaaaagcagcagtccagcaagtccggccataagaagcagaaaaacaaagatcgtgaatactatgtatag

SEQ ID NO: 126112 - DNA, 4179 bp, Artificial Sequence
  Description of Artificial Sequence: Synthetic coding sequence
atgagttctacactgcattccgtcttcttcaccctcaaagtgtctattctgcttgggtccttgcttggactgtgcttgggcctcgaattcatgggcttaccaaaccagtgggctaggtatctgagatgggatgcctccacacggagcgatctgtccttccagtttaagaccaatgttagtacaggcttacttctctacttggatgatggcggcgtctgtgacttcttatgccttagtctcgtggacggacgcgtgcagcttcgattctcaatggattgtgctgaaactgccgtactgtccaacaagcaagtcaatgatagctcttggcacttcctaatggtcagtcgagataggctgcgcacagtgctaatgttagatggagaaggtcagtctggggagctccaacctcaacgcccttatatggacgtagtgtccgatttgttcctcggcggtgttcctacagatattcgcccctccgcactcacactcgacggagtgcaggcaatgccaggctttaagggcctcattttggatctgaaatatgggaattccgagcccaggctactgggttctagaggagtccaaatggacgccgagggcccttgcggcgagagaccctgcgagaacggcggtatctgcttcttgctcgacggccacccgacctgcgattgttcgacgactgggtacggcgggaaattgtgctccgagggtctgtcccatttgatgatgtcggagcaggggaggtggaaggctcgtgaagagaatgtcgcgacttttcgcggttccgaatatctgtgttatgacctgtcccagaacccaatacagtccagttctgatgagatcacattgagtttcaagacctggcagagaaacggccttattttgcatacaggaaaaagcgctgactacgttaatttagccttaaaagacggagccgtttccttagtcataaatctgggatctggagcttttgaggctattgtggagcccgtgaatggcaaatttaacgacaatgcatggcatgacgtaaaagtaactcggaacttgcgacaagttaccatttccgtcgacggtatcttgacaacaaccggctacacgcaagaagattatacgatgctgggtagtgacgacttcttctacgtaggtggctctccatccaccgcagatctccctggctcccccgtctccaacaactttatgggttgtttgaaggaggtcgtgtataagaacaatgatataaggctggaattaagccgactcgctcgaatcgcggatacaaagatgaaaatctacggagaggtggtcttcaaatgtgagaacgttgcgacccttgatcccatcaattttgaaacccccgaggcatatatctctctgcccaaatggaacacgaaacgtatgggttctatctcttttgactttcgcacgactgagccaaacggcctaattctcttcactcatggcaaaccccaggagcgtaaggacgcccggtcccagaagaacacaaaagttgatttttttgcggtggaactgcttgatggcaacttgtatctgttgctcgacatgggctccggcacgatcaaggtgaaggcaacccagaaaaaggccaatgacggagaatggtatcacgtcgatattcaaagggatggccgcagcggtaccatcagcgtgaattcgaggcggactccctttacagcaagcggcgagagcgaaattctcgaccttgagggggatatgtacctgggtgggctgccagaaaacagggcagggctgattctaccaaccgagttgtggaccgcaatgctcaactatggctacgtaggctgcattagagatcttttcatagacggccgttctaagaatattaggcaacttgcagaaatgcagaacgccgcaggggtgaagagttcatgttccaggatgagcgccaaacagtgtgactcatatccgtgcaagaataatgccgtgtgcaaggacggctggaatagatttatctgcgactgtacaggtacaggctactgggggagaacatgcgaacgcgaggcgtctatccttagttatgacggctccatgtatatgaagatcattatgcccatggtgatgcacaccgaagccgaagatgtgtcttttagattcatgagccaaagagcctacgggctgctggtagcaacaacttccagggactcagccgataccctgcgtctggagctagacggcggacgcgtgaaactgatggtgaaccttggtaaagggcccgaaaccctgtacgccggacagaagctgaacgacaatgaatggcacactgttagggtggtccggcgggggaagagtctgaagctgacagtggacgatgacgtggctgaaggcacgatggtgggagatcatacacgcttggagttccataacattgaaactgggattatgactgaaaagcggtatatctctgttgtacccagctcctttattggtcacctgcagagcctgatgttcaacgggctgctgtacattgacctctgcaagaacggcgatattgactactgcgagctcaaggcaagattcggtctgcgtaatatcatcgctgatcctgtgacctttaaaactaaatcttcctatctgtccctggctaccctgcaggcttacacctccatgcatctgttctttcagtttaagacaacctcaccagatggatttattttatttaacagcggcgacggaaatgatttcatagcagtggagctggtgaagggctatatccattatgtctttgacctgggcaacggccctaacgtgatcaaaggcaatagcgatcgccccctgaacgataaccaatggcataacgtggtcataactcgtgataactccaatacacacagtctcaaggtagatacaaaagtagtaacacaggttattaacggcgccaaaaatctggacctgaaaggcgacctctacatggcaggattggcccagggcatgtacagtaatttgccaaaactggtagcaagcagagacggattccagggctgcctcgcctcagtggatctgaatggacggcttccagatttgataaacgatgctttgcacaggtctgggcagatcgagagagggtgcgagggaccatcaactacatgccaagaggacagttgtgccaaccagggcgtgtgcatgcagcagtgggaaggctttacttgcgactgttccatgacaagctatagtggcaatcagtgtaacgaccccggagctacatacatattcggaaagtccgggggtttgatcctgtatacatggcctgcaaacgatcggccttccacaagatctgatcgcctagctgtgggattctctacaaccgtgaaagatggcatattggtgcgcatcgacagtgcacccggcctcggagacttcctccagctgcacattgagcagggtaagattggggtggtttttaatatcgggacagtcgacatcagtattaaggaggagcgaactccagtgaacgatggcaaataccatgtcgtgcgcttcacacgtaacgggggtaatgctactctgcaggtcgataactggcccgtgaatgagcattatcccaccgggaatactgataacgagcggttccagatggtgaagcaaaagatcccattcaagtataaccgccccgtggaagagtggttgcaagagaaaggacgccagctgaccattttcaacactcaagcacaaattgccattggtggcaaagacaagggaagattgttccagggccagctgagtggactgtattacgacggtctcaaagtgttaaatatggccgctgagaataaccccaacataaagatcaacggttctgtgcgactggtcggcgaagttccctctatccttggaaccacccagacaacctctatgccacctgaaatgtccactacagtaatggaaaccaccaccacaatggccacaacaactacaagaaagaaccgtagcactgcgtccatccaaccgacttctgatgatctcgtaagcagcgcagagtgctcttctgacgatgaagacttcgtggaatgtgaaccatctactggacgaagcgccaggtccagcaacgcagcccgatctctacgagcagcactcacgtggacctggcgtctcacatacacttttacacccatcatatttatctcctgtgtcgtccattcatag

SEQ ID NO: 126113 - DNA, 3186 bp, Artificial Sequence
  Description of Artificial Sequence: Synthetic coding sequence
atgctgggttccgacgacttcttttacgtagggggcagcccctcaacggcagatttgccagggtcacctgtctccaacaatttcatgggatgcctgaaggaggtagtttacaagaataatgatattcgactagagctgtctagattagcgagaattgccgataccaagatgaagatctacggcgaggtagtgttcaagtgtgaaaacgtggcaacattggaccctattaacttcgagactcccgaagcttatatttcactccctaagtggaacaccaagaggatgggctccatatcttttgattttcgcacaactgagcctaatggactgattctctttactcacggcaaacctcaggagcgcaaagatgcacgctctcagaagaataccaaggtggacttcttcgctgttgaactgctggacgggaatctgtatctccttctagatatgggctccggtaccatcaaagtgaaagcaacacaaaagaaggccaatgacggcgaatggtatcatgttgacatacagagggatggccggagcggcacaatcagtgtcaactcaaggagaacccctttcactgcctccggggagtccgagattttggacttagaaggggacatgtatctggggggattgcctgagaatcgggctggcctcattctcccaactgagctttggaccgctatgctgaactacggctatgtcggctgtattcgtgacctcttcatcgacggacgaagtaagaatatccggcagctggctgaaatgcagaatgccgccggcgttaaatcatcctgttctagaatgtccgcgaagcagtgtgattcatacccctgtaagaacaacgctgtttgcaaggatggttggaaccgtttcatttgcgactgcaccggtaccggttactggggtagaacctgcgagagggaggcctccattcttagttacgacggtagcatgtacatgaagattatcatgccgatggtgatgcataccgaggctgaggatgtttctttcaggtttatgtctcaacgggcatacggactactcgtggcaacaacatctagggactctgcagacactcttagactcgagctggatggggggcgtgttaagttgatggtgaatctggactgtattcgcattaactgtaactcatccaaaggacctgaaacactgtacgcgggccagaagcttaatgataacgagtggcatacagtccgagtggtgcgccgcgggaagtctctgaagctcaccgtcgacgacgatgtggcagaaggtacgatggttggggaccacacacgactagagttccacaatatcgaaaccggcatcatgactgaaaaacggtatatttcggtcgtaccttcatcgtttattgggcacttgcagtcccttatgttcaatgggctcctctatatcgacctgtgcaaaaatggtgatatagactactgcgagctaaaagctaggtttgggctcaggaacatcatcgccgaccccgtgaccttcaaaacaaaatcaagttacctgagcttggcaacactacaggcctatacctctatgcacctgttcttccaattcaaaacaacgagtcctgacggatttattctgtttaattccggagacggcaatgattttatcgccgtggaactcgtgaaaggatacatccattatgtcttcgacttaggcaacggccctaacgtcatcaaaggaaatagcgacagaccgctaaacgataatcagtggcataacgtggtgatcactagggataattcgaacactcactctctgaaagttgatacaaaagtagtcacccaggtgattaatggggccaaaaatctggatctgaaaggcgacttgtatatggctggcctcgcccagggtatgtactcaaatctacctaaacttgtggctagtcgagacggcttccaagggtgcctcgcctctgtagacttaaatggtagactgccagacctgatcaatgatgctctgcaccgctctggccagattgagcgcggctgcgaaggaccaagtaccacctgccaggaggattcttgtgccaatcaaggggtgtgtatgcagcaatgggaggggttcacttgcgattgttcgatgactagctatagtgggaaccagtgtaacgatcccggggctacctatattttcggcaagagcggagggcttattctttacacctggccagccaacgatcggccatccactcgcagtgacagactggccgtgggcttctctacaaccgttaaggacggcatcctcgtgcgcattgacagcgctcccggacttggcgattttttgcaactgcatatcgagcagggaaagatcggagtggtttttaatatcggcacggttgatatatccattaaagaggaacggacccccgtaaatgacggcaagtaccacgtggtccgtttcacacgcaatggcgggaatgcaacgctgcaggtggataactggcctgtcaatgaacattatcccacaggcaggcagctgaccattttcaacacccaggctcagattgctatcggggggaaagataagggccggctttttcaaggacaactgagcggcctttattatgatggcctgaaggtcctcaatatggctgctgaaaacaacccgaatatcaaaattaatggtagcgtcagactggtcggggaagtgcccagtatactgggtactacccagacaacaagcatgccccccgagatgtccacaaccgtcatggagaccacgaccacaatggcaacaaccaccacgaggaagaacaggagcacagcgagtatccagccaaccagcgacgatctggtgtcttcagctgagtgtagctccgacgatgaggacttcgttgagtgcgaaccaagtactgccaatccaaccgaaccaggaatacgtagagttccaggtgcgagtgaagttatccgggagagttcctcaactacgggcatggtggtcggaatcgtcgctgccgccgcactttgcatcctgattctgctgtatgctatgtataagtacagaaatcgcgatgaaggatcataccaagttgatgagacccggaactacatctcaaattccgcgcagagcaatggaaccctgatgaaggagaagcagcaaagcagcaaatcaggtcacaagaagcagaaaaacaaagatagagagtactatgtgtag

SEQ ID NO: 126114 - DNA, 1380 bp, Artificial Sequence
  Description of Artificial Sequence: Synthetic coding sequence
atgcaccttagaattcacgcacggcgctcaccccctaggcgccccgcttggaccctgggcatttggtttcttttctggggctgcatagtatcatcagtgtggtcatccagtaacgtggcctcctctagctcgaccagcagttctcccgggtcccactcgcaacacgaacatcatttccacgggtccaaacatcactctgtcccgatctcgatataccggtctcccgtttccctacgtggaggccacgctggagccacgtatattttcggcaaatccgggggccttattctgtacacgtggcccgcaaatgaccggccctccacacgctcagatcgcctggcagtcggattttcaaccaccgttaaggacggaattctcgttcgtatagatagcgcgccggggctgggcgactttcttcagttacacatcgaacagggtaagatcggtgtggtcttcaatatcgggacagttgacatttccattaaggaggagaggactcctgttaatgatgggaaataccatgtcgtcaggtttacgagaaacgggggaaacgctacgctgcaggtcgataattggcccgttaatgaacactatccaaccggtaataccgacaatgaaagattccagatggttaaacagaagattcccttcaagtacaatcgtcccgtagaagagtggctccaggaaaagggcaggcaactgaccatcttcaatacgcaggcccagatcgccattggagggaaagataagggacggctgtttcagggccaattgtctggtctgtattacgacggcctcaaggtgctgaacatggccgccgaaaataatccaaatattaaaattaacggatccgttagactcgtcggcgaggtcccatctattctcggtacgacgcagaccacgtcaatgccaccagaaatgtcaaccaccgtgatggagaccaccacaaccatggccacgacaaccacacgaaagaacagaagtaccgcgagtatccagccaacctccgatgacctcgtctctagtgccgaatgcagctctgacgatgaagattttgttgagtgcgagccttctacagctaatcctactgaacctgggatccggcgagtgcccggagccagtgaggtgataagagagtcctcctccaccaccggcatggtcgtagggatcgtcgcagcagccgctctgtgtatacttatcctgctgtacgcaatgtacaaatacagaaaccgagacgagggctcttatcaggtggacgaaacgcgcaattacattagtaactccgcgcagtctaatgggaccctgatgaaggaaaagcagcaatcatctaaatctggtcataagaagcagaagaataaggatcgcgaatattatgtttag

SEQ ID NO: 126115 - DNA, 3186 bp, Artificial Sequence
  Description of Artificial Sequence: Synthetic coding sequence
atgctgggtagcgatgacttcttctacgtgggaggttcgccatccactgccgacctgcccggctcccccgtgagcaacaatttcatggggtgtctgaaagaagttgtgtataaaaataatgacattcggcttgagctctcccgtctcgcgagaatcgcagacaccaaaatgaaaatttatggagaggtggtctttaagtgcgagaacgtagccaccttagacccgattaatttcgagacaccagaggcatatatctccttgccaaagtggaacacgaaacgaatgggcagtattagtttcgatttccggaccactgagccgaatgggctaatcttatttactcatggcaagcctcaagaacgtaaagacgccagatctcagaaaaacacgaaggtggatttcttcgccgtcgagctgctggacggcaacctgtacttgcttcttgatatgggatcgggtaccatcaaagttaaggctacccagaaaaaagctaacgacggcgagtggtatcacgtggacattcaacgggatgggcggtctggaacaatttcagtgaactccagacgtacaccttttactgcgagcggtgagtctgagattctcgatctggagggtgacatgtatctcggtgggctgccggaaaatagggcaggactcatcttacccaccgagctgtggacagcaatgcttaactatggttatgtcggatgtatcagggacctgttcatagacggacggtctaagaatatcaggcagctggccgagatgcagaatgccgcaggcgtaaagtcctcttgctctcgcatgtccgccaaacaatgcgactcttatccgtgtaagaataacgccgtttgtaaggacgggtggaatcgttttatctgtgattgtacgggcacggggtactggggcagaacctgtgagcgcgaagctagtattctgtcttacgatggtagcatgtacatgaaaattattatgccaatggtgatgcacacagaagcagaggacgtcagcttcaggtttatgagccagagagcatatggactcttggtggcgacaacctcccgcgattccgcagacacactgcgactggaactagatgggggtcgtgtgaagttgatggtgaacctggattgcatcagaatcaattgtaattcatcaaaggggccagagacactctatgctggccagaaactgaatgacaacgagtggcatactgtgcgcgtggttcgccgggggaagtccctgaagctgacagtcgacgacgatgtggcagaaggcacaatggtcggcgatcacacgcgccttgaatttcataacatagagacgggtattatgacggaaaagaggtacatatccgttgtgccatcatcttttattggtcacctgcaatcccttatgtttaatggtctgctttacattgacctctgcaagaacggggatatcgattactgcgagctgaaggcaaggttcgggctgcggaatataattgcagaccccgtgacatttaagaccaagtccagctatctttctctggctaccctgcaggcgtacacaagcatgcatctcttttttcaattcaaaactacctccccagatggatttattctgttcaatagtggtgatggcaacgacttcatcgccgttgagctggtgaagggatacattcactacgtcttcgatctgggcaatggcccaaatgtgataaaaggaaatagtgacagacctttgaacgataaccagtggcataatgtggttatcactcgggacaactcaaatacacacagtctgaaggtcgatacgaaggttgttactcaggttatcaacggggccaagaacctggatttgaaaggcgacctctacatggctgggttggcacagggcatgtattccaatcttccaaagctcgtcgcgtccagagatggcttccagggctgcttggcaagcgtggacttgaatggtcggcttccagacttgatcaacgacgctttgcatcggtcagggcagatcgagcgcggatgtgaaggtcccagcacaacgtgccaggaggatagctgtgcaaaccagggtgtctgtatgcagcagtgggaaggttttacgtgtgattgctctatgacctcttatagtgggaaccaatgtaatgaccccggcgctacctatatcttcggcaagagcggcgggctgatcctgtatacctggccagcaaacgaccgacccagcactcgcagcgaccggctggccgtcggattctcgacgacagtgaaggatggtatcctggtgagaattgacagcgcccctgggctcggcgacttcctgcagctccacatagaacaaggaaagataggggtagtgtttaacatcgggaccgtggacataagtataaaggaagagcgcacaccagttaacgacgggaagtaccacgttgtgcggttcactcggaatggggggaatgccacgctgcaggtggataattggccagtgaacgagcactatccgactggaagacagctaactatctttaacactcaggctcaaatcgcaattggcgggaaagataagggcagattgttccagggtcagctatccggactttactacgatggtttgaaggtgctgaatatggcggccgagaataatccaaatattaagattaacggctctgtgagactggtcggggaagtcccatccattttaggcactacacagaccacctccatgcccccagaaatgtccacgacggtgatggaaacgactactacaatggcaaccactacaacaaggaagaatagaagcaccgcctctatacagccgacttccgatgacctcgtgtctagcgctgaatgctctagcgatgatgaggattttgtggagtgtgagccgagcactgccaatcccactgagcctggaatccggcgtgtgcccggcgccagcgaggtaattcgggagtcgagcagcactacaggaatggttgttggcattgtcgccgccgcagctctgtgcattctcattctcctctatgccatgtataaatatcggaaccgcgacgaaggtagttatcaggttgacgagacaagaaactacatcagcaatagcgcacagtcaaatggtacacttatgaaggagaagcagcagagctcaaaaagcggccataaaaagcaaaagaataaggaccgcgagtattacgtctag

SEQ ID NO: 126116 - DNA, 1914 bp, Artificial Sequence
  Description of Artificial Sequence: Synthetic coding sequence
atgcacctgagaattcacgccagaaggagtcctccccggcgacccgcttggaccttggggatatggtttctgttttggggttgcatagtctcctccgtgtggagttcctctaatgtggcgtccagcagcagcacaagctctagtcctgggtcgcattcccagcacgaacaccacttccacggctcgaagcaccattccgtgcccatttcaatctatagaagtcctgtctccctgaggggtggccatgccggggcaacatacattttcggaaaaagcgggggcctcattctatatacttggcccgcaaacgatcgaccctctacacgatcagatcgcctggctgtcggctttagtacaaccgtcaaggacggaattctggtccgaatcgactcagcccccggactcggcgattttctgcaacttcatattgagcagggcaagatcggcgtggttttcaacattggaactgtcgatatctcaatcaaggaggaacgaacacctgtcaatgatggcaaataccatgtggtcagattcaccaggaatgggggcaacgcgacccttcaggtcgataattggccagtcaatgagcactatccaacagggcggcaactaacaatcttcaatacacaggcacagattgccatcggtgggaaggacaagggacggctattccaaggccagctgagtggcttgtattatgacggtctgaaggtgttgaacatggctgctgagaacaacccaaacatcaagatcaacggctcggtgcggctcgtcggagaggtgccctctatacttggcactacccaaaccacaagtatgccccctgaaatgtctactactgtgatggaaacgaccacaacaatggctactactaccacccgtaagaacagatctacagcaagcatccagcccacctctgacgacctcgttagcagtgctgagtgcagctcagatgacgaagatttcgtggaatgcgagccttccactgggggcgagctggtgatccccctgctagttgaagaccctctggccactcctccaatcgccacgcgggccccgagtatcactctaccacccactttccgaccactgctgactataatcgagaccaccaaggattccttgtccatgaccagtgaagccggcctgccatgcctgtctgaccaaggttctgacggctgcgatgacgatggattggtgatcagcggctacggatccggcgagacctttgactccaatctgccacccacggacgatgaagacttttacaccaccttctccctggtcaccgataagtcgctgagtaccagcatctttgagggaggctataaagcccacgctcccaaatgggaatccaaggactttagaccaaacaaagtgtctgaaacttctcgaacaactacgacaagcctatcgccagaactcatacggtttacagcatcatcatcgtctggcatggtccccaagttacctgccgggaaaatgaataatagagatctgaagccacagccggatatcgtcctcctcccactccccaccgcatacgagctggactctaccaaactgaagagccccctaataacctcaccaatgttcagaaacgtgcctaccgctaacccaaccgagcctgggattaggagagtgcccggcgcctctgaggtgatccgggaaagtagctctacaacagggatggtggtgggcatcgtcgctgcagcagccctctgcattctcatcctgctatacgcaatgtataaatataggaaccgggacgaagggagctaccaagtggatgaaacccggaattacatctcaaactccgcacaaagcaacggaacgctgatgaaagaaaaacaacagagtagcaagagtggtcataagaagcagaaaaataaggatcgcgaatattacgtctag

SEQ ID NO: 126117 - DNA, 429 bp, Artificial Sequence
  Description of Artificial Sequence: Synthetic coding sequence
atgggtcttaagctaaacggtaggtatatcagcttaatcctggcagtgcagattgcctatttagtccaggcagtccgagccgcaggtaaatgcgacgctgtgttcaaggggttttctgattgcctgctcaaattgggagactccatggccaattatcctcaggggctggacgataaaactaatattaaaacggtgtgcacctattgggaagactttcactcctgtactgttaccgccttaacggattgccaagaaggtgcgaaggatatgtgggataagctgcggaaggagtctaagaatctcaacatccagggctctctgtttgaactgtgcggctccggcaatggcgccgccgggtccctgctgccagctttccctgtactgcttgtcagcctgagtgccgcattagcaacctggttatcattttag

SEQ ID NO: 126118 - DNA, 8841 bp, Artificial Sequence
  Description of Artificial Sequence: Synthetic coding sequence
atggcctcagaaaaacctgggcccggccccgggcttgagccccagcccgtgggtctgatcgcggtcggagcagccgggggcggtggcgggggctctgggggcgggggtactggcggctctggaatgggggaactgaggggcgcaagtggttccggaagcgtgatgctgccagcaggcatgatcaatcccagcgtgccaattaggaacatacggatgaagttcgccgtgttgatcggcctcattcaggtgggggaggtgagtaatcgggatatagtggaaacagtcctgaacctccttgtcggcggcgaattcgatctagaaatgaacttcattatccaagacgccgaatccataacatgtatgacagaactcttggagcactgtgatgtgacttgtcaggcggagatttggagtatgtttactgctatcctacgtaagagcgtgcggaacctgcagacctctacagaggtcgggcttatcgagcaggtcctcctgaagatgtccgctgtcgacgacatgatcgccgatcttttggtggacatgttgggcgtgctggcaagttattccatcactgttaaggaattgaagcttcttttctcaatgctccgcggagaatcaggcatctggcctcggcatgcagtgaagcttctgtcagtcctgaatcaaatgcctcagaggcacggtccagatactttcttcaattttccagggtgtagtgccgcagcaatcgctctgccgcctattgctaaatggccgtaccagaacggattcaccttaaatacttggtttcggatggatcctctgaacaacatcaacgtagataaggataaaccatatctttattgcttcaggacctctaagggtgtcgggtacagtgcacacttcgtggggaactgcctgatcgtgacctccctgaaaagtaagggcaaaggtttccagcactgcgtcaagtacgatttccagccaaggaaatggtatatgatttccattgtccatatctacaaccgatggcgcaatagcgagatcaggtgctacgtgaacggacaactagtgagctacggcgatatggcatggcatgtaaatactaacgacagctatgataagtgcttccttggcagtagcgaaacagctgatgcgaatagggtgttttgcgggcagcttggagcagtgtatgtgttttccgaggcattaaatcctgcccagattttcgcaattcatcagctgggccctggatataagtctacattcaagttcaagtctgagagcgacatccacctggcggagcatcataagcaggtcctatacgacggcaagctggcctcttctattgctttcacgtacaatgctaaggccaccgatgcacagctctgcctcgaatcttctccaaaagaaaatgctagcatatttgtgcatagcccgcatgccctgatgcttcaggacgtcaaagccattgtgacacattcaatacattcagcaattcacagcataggagggatccaagtcctcttcccactgtttgcccagttggacaatcggcagttgaatgattctcaggttgaaaccaccgtatgcgccactcttttagcttttctcgtggagctacttaagagctcagtggcgatgcaagagcagatgttggggggtaaaggatttctggtgatcggctacctcttggaaaagtcatccagggtccatataaccagggcagtgctagaacagttcctcagtttcgcaaagtacctggacggcctgagccacggcgcaccactgctaaagcagttgtgtgaccatattttatttaaccctgcaatatggattcataccccggccaaggtccaattgagtttgtacacctacctgtcggcagaattcattgggacggccaccatttatacgacaattaggagggtaggaactgtattacaattaatgcacaccctgaaatactactattgggtgattaatcctgccgactcatccgggatcactccaaagggtctggatggcccaaggccttctcaaaaggagatcatttcccttcgggccttcatgctattgtttctcaaacagctgatccttaaggacagaggagtcaaagaggacgaactgcagtctatccttaattatctgcttactatgcacgaagacgagaacatccacgatgtcctgcagctacttgtggccttgatgtctgagcacccagcctctatgattcccgccttcgatcagcgcaacggcatcagagttatctacaagctgttggccagcaagtctgaaagcatctgggtccaagccttaaaagtgctgggttattttctgaaacatctgggtcacaaacgcaaagtggaaatcatgcacactcattcccttttcacactcctgggtgagcggctcatgttgcacacaaatacggtgaccgtcacaacctacaacaccttgtatgaaattttgactgaacaggtgtgtacccaggtagtccacaagccacatcccgagccggattcaactgtaaagattcaaaacccgatgatcctgaaggtggtggcaaccctcttaaagaattccaccccgagcgctgagcttatggaagtgcggcgacttttcctatcagacatgattaaactcttctcaaacagcagggaaaaccgtcgctgtctcctgcaatgttccgtttggcaagactggatgttctctctcggctatattaatccaaaaaacagtgaggagcagaaaattacggagatggtctacaacattttcaggatcctgctctatcacgcaattaaatacgaatgggggggttggagagtgtgggttgataccttaagcatcgctcacagcaaggtaacatacgaggcccataaggagtacttggcgaaaatgtatgaagaataccagcgacaagaagaagagaatatcaaaaaaggaaagaaggggaatgtctcaactattagtggtttatcttctcagaccaccggcgccaaaggtgggatggaaatcagggagattgaggacctcagccagtctcagagcccagagtccgaaaccgactatcccgtgagcactgacacacgggatttgttaatgtctactaaggtgagtgatgatatactgggcaatagcgaccgccctgggagcggagtacacgttgaggtgcatgacttgcttgtggacatcaaggcagaaaaggtcgaggccacagaggtcaagctggatgacatggatctgtcgcccgaaacattggtagggggcgagaacggggccctagtcgaagtggagtctttgctcgacaacgtgtactcagcagccgtggaaaaacttcagaataacgtgcacggctccgtaggcattatcaagaagaatgaggagaaggataacgggcctctgatcactctagccgacgagaaagaggacttgccaaactcctccacctcgttcctgtttgataagatcccgaagcaagaggagaaactccttcccgaactctcaagtaatcatatcatcccaaacatacaggatacccaggttcacctcggggtcagtgatgacctagggctgctggcgcatatgaccgggtcggtggatctgacttgcactagctctattattgaagaaaaggagttcaaaatccacactacgtccgatggtatgagttctatctcggagcgggacctggccagctcaactaaaggtctggaatatgctgagatgacggccaccaccctggagactgagagttcaagcagtaaaattgtcccaaatatcgacgccggttccataatctccgatacagaacgctctgatgacggcaaagaaagcggcaaggagatccgcaaaattcaaaccactacaaccacccaggctgtgcagggacgtagcatcacacagcaggatagagatctccgcgtcgaccttgggtttcgaggaatgcccatgaccgaggagcagaggagacagttttcccccgggccacggaccaccatgttccgtattcccgaattcaaatggagccctatgcatcagagactcctgaccgatctgttgttcgcactggagactgatgtgcacgtgtggcgctctcattcgacaaagtccgttatggattttgtgaatagcaacgaaaatataatcttcgtacataatactattcacctcatttcccagatggtcgacaacatcattattgcctgtggaggcatactgccacttctgtccgctgccacctctcctactgtgagcaaaacagaattggaaaatatcgaggtcacccaaggaatgtcagctgaaaccgccgttacctttctatccagacttatggccatggtcgatgtgctggtattcgcctcctccctcaatttttcagagatcgaggcagaaaagaacatgtcttctggcgggctgatgcgccagtgcctgaggctcgtgtgttgtgtggccgttaggaattgtcttgagtgcagacagagacagcgcgaccgtgggaacaagagctcacacggctcctctaaaccacaagaggtcccacagtcggtgactgccactgccgcaagcaaaacaccccttgagaacgtgcctggtaacctgagtcctattaaggaccctgataggctcctgcaggatgttgatatcaacagattacgagcagtagtttttcgcgacgtggatgatagtaaacaggcacagtttctggccctcgcagttgtgtattttatttccgttctgatggtcagcaagtaccgcgacattttggagccacaaagagagaccacccgcacggggagccagccaggccgcaatatcagacaagagatcaattcaccaacgtcaaccgtcgtcgtcataccctctattccccacccctcattgaatcatggcttcctggcaaaactcattcccgaacagagcttcggacattctttctacaaagaaacccccgccgcgttcccagataccatcaaggagaaggagactccaactccaggagaagacatacaagtggagtcaagcattccacacacggacagtggtattggggaggaacaggtggcaagcatactcaacggagcagagttggaaaccagcacaggtccagatgccatgagcgagcttttgagcaccttaagtagtgaagtgaaaaagtctcaagagagtctgactgagaaccccagcgagacccttaagcccgccacctccatatcttccatctcacagactaaagggattaacgtaaaggaaattcttaagtcactagttgctgcaccggtggagattgccgagtgcggtcctgagccaataccatatcccgatcccgcactgaagcgagaaactcaggctatactacctatgcaattccactcctttgacagaagcgttgtggtgcctgttaaaaaacctccccctggctccctggctgttactactgtgggagccaccactgcaggtagtggactgcctaccggtagtacgagcaacatctttgcagccacgggagccacccccaaatcgatgatcaatacaacgggcgcagtggatagtggaagctctagctctagcagcagtagttcttttgtaaatggagctacttctaagaatttgcccgctgtacagacagtggcacctatgcccgaagactcggcagagaatatgtccatcaccgctaaattggaacgcgccctggaaaaggtggctccattgctgagagaaatcttcgtcgattttgctccattcctctcgcgcactctactcggctctcacggccaggagttgcttattgagggtctggtgtgtatgaagtccagtacgtcagtggtcgagctggttatgctgttgtgctcacaggaatggcagaatagcatccagaagaatgccggtctggcattcatagaacttattaacgagggcaggctcctttgccatgctatgaaagaccacattgttcgggtggccaacgaagccgagttcattctcaacaggcagagggcagaagatgtgcacaagcatgccgagttcgaaagtcagtgtgctcaatatgccgccgatcgtcgggaggaggagaagatgtgcgatcacttaattagtgcagcgaagcatcgggatcacgtcacggcaaaccagttgaaacagaagatcttgaacatattgactaacaagcatggggcctggggcgctgtgtcccactctcaactccatgatttttggagactcgattactgggaggacgacttaagaaggaggagaagattcgttcgtaatgccttcggctcaacgcacgctgaggctctgcttaaggccgcaatcgaatacggaaccgaagaggacgtggtgaaatctaagaagacattccggagccaggccatagtgaatcagaatgctgagacagagctgatgttagagggggacgatgacgccgtgtctcttttacaagaaaaggaaatcgacaacttagcggggcctgtggtgttgtctactccagcccagctcatagctccggtagtcgtcgctaaaggaactttgagcataacaactacagaaatctacttcgaagtcgacgaggatgatagcgccttcaagaagattgacaccaaagttctcgcatacactgaagggttacacgggaagtggatgttctcggagatcagggcagttttctcaaggagatatttgctgcaaaatacggccctggaggtatttatggctaatcgcacaagcgttatgtttaactttccagatcaagccaccgtgaagaaggtagtgtatagcttgcctcgggtaggagttgggacaagctacggccttcctcaggcccgccgcataagcctagccacgcccagacagctgtacaagtcatctaacatgacacagcgctggcaacggagggagatttccaacttcgaatacctgatgtttctgaatacaatcgccggcaggacatataacgacctgaatcagtatcctgtgtttccctgggtgctgaccaactacgagtctgaggaactggatctgacactgccagggaattttcgggacctttctaagccgattggcgcattaaatcctaagagggcagtcttttacgctgaacgctacgagacatgggaggatgaccaatccccgccctaccactacaatacacattattcaaccgcgacctcgacactttcttggctggtgagaattgaacctttcactacctttttcctgaatgccaacgatggaaaatttgatcacccagacagaaccttctcttcagtggcaaggtcttggcgcacgtctcaacgcgatacatccgacgttaaggagctgattccagaattctactacttgcccgagatgtttgtgaattccaatggctataacctcggggtacgcgaagacgaagttgtggtgaatgacgtcgatctcccaccatgggcaaaaaaaccagaggactttgtgcgcatcaatcgcatggctctcgaatctgaattcgtgtcatgccaactgcatcagtggatagatctcatctttggctacaaacagcgcggacctgaggcagtcagagccttaaatgtgttccattatctaacatatgaaggttctgtcaatctagattctatcacggaccccgtgctgagggaggctatggaggctcagattcagaacttcggccagacacccagccagttgctcattgaaccccacccaccacggtcgagcgccatgcacctgtgttttctgccccaaagtccattgatgtttaaggaccagatgcagcaggatgtgatcatggtgctaaaatttccatccaactccccggtgacccacgtcgcggctaatactttaccccacttaaccataccagcagtcgtgaccgtgacgtgttctcgattgtttgccgtgaaccgttggcacaatactgtcggactcagaggcgccccaggatatagccttgaccaagcccatcatctgcctattgagatggaccccttgatcgcaaataattcaggcgtgaacaaacggcagatcactgacctcgttgaccaatcgattcagattaacgctcactgctttgtggtgacagcagataatcggtacatcttgatctgcggattttgggataagagttttcgggtgtactcgaccgagactgggaagctcacacaaatcgtctttggacactgggacgtcgtgacgtgcctcgcgaggagtgagtcttatattgggggagactgctacatcgtatccggatcccgcgacgccacactactactgtggtactggagcggccggcatcacattataggggataatccaaactcatccgattatcctgctcccagagccgttcttacaggacacgaccatgaggtagtttgtgtctctgtctgcgccgagctcggacttgtgatctcaggtgctaaggagggtccctgccttgtgcatacaatcactggagacctgttgcgggcgctggaagggcctgagaattgccttttccctagactgatttctgtgtcctctgaggggcactgcatcatttattacgagcggggtcgcttctccaacttctcaatcaacggtaagctcctggcacagatggaaatcaatgattctacacgagccatccttctgtcttccgatggacagaacttagtgaccggcggtgataacggagtggtcgaggtgtggcaggcttgcgattttaaacagctgtatatctatccggggtgtgacgccggcatccgggccatggacctctctcatgaccagcggactctaattaccggcatggcttcagggagtatcgtggcttttaacatagacttcaacagatggcactatgaacaccagaaccgctattag

SEQ ID NO: 126119 - DNA, 1575 bp, Artificial Sequence
  Description of Artificial Sequence: Synthetic coding sequence
atgttcgttaattccaacgggtacaatctcggcgtgagggaagacgaagtggtggtcaacgacgtggatctgcccccatgggcaaaaaaacccgaggattttgtccggatcaatcgcatggctcttgaaagcgaattcgtcagctgccagctccaccagtggattgacctgatttttgggtacaagcagcgcggcccagaagctgtccgcgcgctgaacgtgtttcattatctcacttatgagggctctgtaaatctcgactccatcactgatcctgtgctgcgggaaattcctgaagcctattttattagggatccccataccttcctcttaactaaagacttcatcaaagccatggaggcccagattcaaaactttggacagaccccttcacaactgcttatagagccccatccaccccgaagttccgccatgcacctgtgctttctcccacagtctccactgatgttcaaggatcaaatgcaacaggatgtcatcatggtgctcaagtttccctccaatagcccagtaacacacgtcgccgctaacacactgccacacctaactatccccgccgtcgtgacagtgacgtgctctagattatttgcagtcaatcggtggcacaatacagttggccttcgaggggcgcccggctatagtcttgaccaggctcaccacctgccaattgaaatggaccccctcatagccaataacagcggcgtgaataaaagacagattaccgacctcgttgatcagtccattcagatcaatgcacactgttttgtcgtcactgccgacaatagatatattctgatttgcggcttttgggataagagttttagggtgtattcgaccgagactggaaaactgactcaaatcgtatttgggcactgggatgtagtcacttgtttggcacggtcagaatcttacatcggcggcgactgctatattgtatccggatctcgggatgccacactgcttctttggtactggagcggccggcatcacattattggcgataacccgaactctagcgattaccctgctcctcgcgctgtgcttacgggacatgatcatgaagtagtgtgtgtatcggtgtgcgcagaattgggcctcgtgatctctggggcaaaggagggcccatgcctggtacatactattactggtgacctcctgcgcgcgcttgaaggccccgaaaattgtttgtttcccaggcttatcagtgtttcatccgaggggcactgtatcatctattacgagagaggcagattttctaacttctctatcaacggcaagctgcttgcacaaatggaaattaacgactccacccgcgccatcctcctgagcagtgacggacagaacctagtgactgggggagacaacggcgttgttgaagtgtggcaggcatgtgactttaagcagctttacatttatccaggctgtgatgctggcattagggctatggatttgtcgcacgatcaacgtacactgattactggcatggccagcgggtcgattgtggccttcaacatcgatttcaaccgctggcattatgaacaccaaaaccgatactag

SEQ ID NO: 126120 - DNA, 8832 bp, Artificial Sequence
  Description of Artificial Sequence: Synthetic coding sequence
atggcttcggaaaaaccggggcccgggccaggtcttgaaccgcaacctgtgggccttatcgccgtgggcgccgccgggggagggggcggcggttcaggtggcgggggaaccgggggctccggcatgggggaattgagaggggcgagcggaagtggatctgtgatgctgcctgcgggcatgatcaaccccagcgtgccaatcaggaatatcaggatgaagttcgccgtgctcatcggcctcatacaagttggagaagtgtccaatagggatatagtcgagaccgtgctgaatcttctagttggtggtgagttcgacctcgaaatgaatttcattatacaagatgctgagtcaatcacgtgcatgacggagttactggagcactgcgatgtcacttgccaggccgagatctggtccatgtttacggccatcctgcggaagtccgtccgaaatctgcaaacttcaaccgaagtgggactgatcgaacaggtgttattgaagatgagcgcagtcgatgatatgattgccgatctgctcgtagatatgctgggggtgcttgccagctattcaattacagttaaggaactcaagctgcttttttccatgctgaggggggaatctggcatttggcctagacatgccgtcaaactgctgtcagtactgaaccaaatgccccagcgccacggtcccgacaccttcttcaacttccccggctgcagcgccgccgccatcgccctaccccctatcgccaagtggccataccagaacggattcactttgaacacctggtttagaatggatcctctgaacaatatcaacgttgataaagataaaccatacctgtattgcttccgcacgagtaaaggagtcggatattccgcccacttcgtggggaattgcctcattgtgactagtctcaagtctaagggcaagggcttccaacactgtgtgaaatatgatttccagccccgcaagtggtacatgattagtatagtgcacatttacaatagatggaggaatagcgagatccgatgctacgtgaacggtcagctggtatcctatggcgacatggcctggcatgtgaacacaaacgatagttatgacaagtgttttctcggcagctccgagaccgccgacgcaaacagggtcttttgtggacaactcggggccgtctacgtcttttcagaggctttgaaccccgcacagatttttgctatccaccagcttggtcctggctataaaagcacctttaaattcaagtcggaatccgatattcacttggctgagcatcataagcaggtgctgtacgacggcaaattggcctcttccatcgcattcacatacaacgccaaggccactgatgcccagctttgtctcgaatcttctccaaaagaaaatgctagcatatttgtccactccccccatgcgttgatgttacaagatgtgaaggctattgtgacccatagcatccacagcgccatacacagcatcggcggaatccaggttctctttcctctgtttgcgcagctcgacaataggcagctgaacgactcccaagtggagactaccgtttgtgccactctgcttgctttcctcgtggaattgctgaagtcatctgtagctatgcaggaacagatgttgggcggtaagggctttctggtcatcgggtatttgctcgaaaagtcctctagagttcatattacccgggctgtgttggaacaattcctgagttttgctaaatacttagatggcctttcccacggagcgccactcctgaaacaattatgcgaccatattctgttcaatcccgccatctggatccacacccctgcaaaagtgcagcttagcctgtatacatacctgtctgcggaattcataggtaccgcaactatctacacaaccatcagacgtgtgggaactgtgctgcagctgatgcacacgctgaagtattattattgggtaattaatcctgcagactcctccggcatcaccccaaaagggctcgacggccctcggccttcacagaaggaaatcataagcttacgggctttcatgctgctgttcctcaaacaactgatcctcaaggacaggggggtgaaggaggatgaactgcagtcaatactgaattatcttcttactatgcacgaggatgagaacatccatgacgtgctgcagcttttggtcgcactgatgagcgaacaccctgccagcatgattcctgctttcgatcaaagaaacggaatccgtgtcatttataagttgttggcatctaaaagcgaatccatttgggtccaggcactgaaagttctcggctattttcttaaacatctgggccacaagcgaaaggtggagattatgcatacacatagcctctttaccttacttggtgaaaggcttatgctgcacacgaacaccgtgacagtgaccacctacaacaccctgtatgaaattctcaccgaacaagtttgtactcaggttgtacacaaaccccatcccgagcccgattcaacggtcaaaatccagaatcctatgatactgaaagtcgttgccactctcttgaaaaactctactcctagcgcggagctcatggaggtgaggcgtcttttcttatccgacatgatcaaacttttctcaaactcccgggagaataggcgctgcctcctgcagtgtagcgtgtggcaagattggatgttcagcctgggctacattaaccccaagaattctgaagaacagaagatcaccgagatggtgtacaatatctttagaattttgctttatcatgcgattaagtatgagtgggggggttggagagtttgggtggatacactttctatagcccactcaaaggtaacttatgaggcccacaaggagtacctagcgaagatgtatgaagaataccagcgccaggaggaagaaaacattaagaagggaaagaaagggaatgtgtcaactatctccggactgtctagccaaacaacgggagctaaaggaggcatggaaatccgggaaatcgaagatctcagccagtcacagtcacccgaatccgagaccgattaccctgtgtctacagatacacgggatctgttaatgagcactaaggtcagcgacgacattcttggcaattcagaccgacctgggtctggcgtacacgtggaagtgcacgatctgctggtcgacattaaggcggagaaggttgaagccaccgaggtgaaactggatgacatggatctatcacctgagacactggtgggcggcgagaatggggctcttgtcgaggttgaatcgcttttggacaacgtgtacagtgccgcagttgaaaaactgcagaataatgtgcatggctcagtcggtattataaagaaaaatgaagagaaagacaatggacctcttattacactggctgacgaaaaggaagacctacccaatagttcgacctcatttctattcgacaagatccccaagcaggaggagaaactcctgcctgagctttccagcaatcacattattcccaacattcaggatacccaagttcacctaggcgtgtctgatgatctgggcctactggctcacatgactggctcagtagatctgacatgtacctcaagcataattgaggagaaagagtttaagattcacacgaccagcgatggtatgtccagcatcagcgagagggatctcgcaagctccacaaagggactggagtacgcagagatgacggcgactacactggaaactgaatcctcgtcgtccaagatcgtgcccaatatcgatgcaggctccatcatcagtgatacggagcggagtgacgacggaaaggaatccggcaaagagataaggaagattcagacaaccacgaccacccaagctgtgcagggaagatccattacgcagcaggatagggacctgcgggttgatctaggttttaggggcatgcccatgacagaggaacagcgaaggcaattttccccaggtccacggacaactatgtttagaatacccgagtttaagtggagtcccatgcatcaaaggctgctcacagatctgttgttcgcactggagacagatgttcacgtgtggcgcagtcacagcaccaaaagtgtgatggatttcgtgaacagcaacgaaaacattatcttcgtgcataataccattcatctgatcagtcagatggtcgacaacattatcatcgcgtgcggagggatcctgccactgctgtccgcagcaacaagcccgaccactgaactggagaacatcgaggtgactcagggtatgtctgcggagaccgcagtgaccttcttaagtaggcttatggccatggtggacgtgctcgtgtttgcctccagtctcaacttttccgagatagaggccgagaagaacatgtccagcggcggcctgatgaggcagtgtttgcgccttgtgtgctgtgtggctgttcgcaactgtctggaatgccgccagagacagcgggatcgtgggaataaatccagtcacggatcaagcaagcctcaggaagtcccacagtctgttacagcaacagccgctagcaaaactcctctggaaaacgttcccggcaacctgtccccaatcaaagaccccgaccgcttgttacaggacgttgacatcaatagactccgagcagtagttttccgcgatgtggacgacagcaaacaggctcaatttttggcattagctgtagtgtattttatctccgtgcttatggtgtctaagtaccgcgacatcctggaacctcagcgcgagacgaccagaaccggcagtcagcccggccgcaacatacgccaagagattaattctcctacttctacagttgtggtaattccaagcatacctcacccatcattgaatcatgggttcctggccaaactgatacctgaacaaagctttgggcactcattctataaagagaccccagccgcctttccagatacaattaaggaaaaagaaacccccacccctggcgaggacatccaagtggagagttcgatcccacacaccgatagtggtatcggcgaagaacaagtcgcttccatcctgaatggtgctgagttggagacaagcaccggtccagacgcaatgtcagaactgctgtccaccttgtcaagtgaagtgaaaaaaagtcaggagtccctgacggaaaatccaagcgagactctcaagcccgccactagcatttcgtccatctctcaaaccaaaggaatcaacgtgaaggagatcttaaaaagtctcgtcgctgcgcctgtggaaatagccgaatgtggtcccgagccgataccctacccagatcctgccctgaagagagaaactcaagccattctcccaatgcagttccattcattcgatcggtctgtggtcgtaccagtaaagaagcctcctcctggatccctcgcagttaccacagtgggagccaccacggcagggtctggactgcccacgggatcaaccagtaatatctttgctgccactggagctacacctaaaagcatgatcaacacaactggggccgtagacagcgggtcttcatcttcgtctagtagcagttcctttgtgaatggcgccacgtctaaaaacttacccgccgtgcagaccgtggctcctatgcctgaggacagcgcggaaaacatgagtatcaccgctaaactggagcgggctctggagaaggttgcacctttgcttagggagatcttcgttgactttgctcccttcctctctcggactctacttgggtcccatggacaggaactcttgattgaaggcctggtgtgtatgaagtcgtctacatccgtggtagaattggttatgttactgtgtagccaggaatggcagaactcaatccaaaaaaacgcagggctggccttcatcgagctcataaatgaagggcgcttgctgtgtcacgccatgaaagaccacattgtgagagtcgcgaacgaagctgaatttattctgaatcgtcagcgggccgaagatgtgcataaacatgccgaattcgagtctcaatgtgcccagtatgcagctgaccgacgcgaagaggaaaaaatgtgcgatcatctgatttccgccgcaaaacacagggaccatgtcactgcgaaccagctgaagcagaaaattttgaacatcctaactaacaagcatggggcatggggcgctgtcagccattctcagttacatgatttctggcggcttgactactgggaggacgacttgagaagacgaagaagatttgtccgaaacgcttttgggtcgacacatgcggaggctctgctaaaggccgcaatagaatacggaaccgaagaggacgtggtgaaatcaaaaaaaaccttccgaagccaggctattgtaaatcagaacgcagagacagagttgatgctagagggcgacgacgacgcagtgtctctgctgcaggagaaagaaatcgacaacctcgcgggtccagtggttttgtccacacccgcccaattaatcgcacctgtggttgtagccaaagggactctatctatcaccaccaccgaaatctacttcgaagttgacgaagacgactcagcatttaaaaagatcgacacaaaagttctggcgtacaccgagggacttcacggcaaatggatgttctccgagattcgtgctgtgtttagtcgccgctatttgcttcaaaacactgccctggaggtgtttatggctaaccgcacatccgtaatgtttaacttcccggatcaggctactgtgaaaaaggtggtctattcactgccccgcgtgggggttggtacctcatatgggctgcctcaggctcgcagaatctcactcgcaacaccaaggcagctgtataaaagctcgaatatgacccaacggtggcagaggagagaaatctcaaactttgaatacttgatgttcctgaataccatagctggccgaacatacaatgatttgaaccagtatcctgtgtttccatgggtgcttacgaattatgagtctgaggagctggatcttacattacccggaaactttcgcgacttaagtaaaccaattggtgcactaaaccctaagcgagccgtcttttatgcagaacggtacgaaacatgggaggatgaccagtcccccccttatcactacaatacccactatagcactgcgacgtctacactgagttggctagttaggatcgaacccttcaccacttttttcctgaatgcaaacgatggaaaattcgatcacccagataggacctttagctccgtggccaggagctggaggacatctcagcgggataccagcgacgtcaaggaacttattccagagttttactacctgccagagatgttcgtgaacagtaatgggtataacttaggggtaagagaggacgaagtggtggtcaacgatgttgatctccccccctgggcaaaaaaacctgaagactttgtacggataaatcgcatggctcttgagtcggagttcgtatcatgccaactgcatcaatggatcgacctgatatttggatacaagcagcgtggacctgaagcagtacgggctttaaacgtttttcattacttaacctatgaaggatccgtcaatctagatagcattaccgatccagtgctacgagaagcaatggaagctcagatccagaactttggccagacaccaagccaactgctcatcgaaccacacccccccagaagctcagccatgcatctctgtttcctgccccagtcccccctgatgtttaaggaccagatgcagcaggatgtgatcatggtcctgaaattccccagcaattcccccgtgactcatgttgctgctaatactctgcctcatcttaccattccagcagtggtgacggtgacttgctcccgtctgttcgcagtgaatcgatggcataataccgtgggcctgcgtggggcccctggatactcattggaccaggctcaccaccttccaatcgagatggatccactcatcgcaaacaattccggcgtcaacaagcgtcagatcacagacctggtggaccagtccatccagataaatgcacactgctttgtggtgacagcggataaccgatacatccttatctgcggattttgggacaagtcttttagagtgtacagcactgagaccggtaagctcacacaaattgtattcggtcactgggatgtcgtcacttgtctggctcgtagcgagtcctatatcgggggcgactgttacattgttagcgggtctcgtgatgccacactgctactgtggtactggtctggaagacaccacatcatcggagataatcctaactctagtgattaccctgctcccagagccgtactcacaggccatgaccacgaagttgtgtgtgtatctgtctgtgcggagcttggactggtaatctcaggcgctaaggaggggccctgcttggtgcacactattacgggtgatctacttagagccctcgagggacctgagaactgtttattccctcggttgatctctgtgagcagcgagggacactgcataatttattacgaaagaggcagattcagtaatttctccattaatggcaagcttcttgcgcagatggaaattaacgactcaacccgagccatacttcttagcagtgacggacaaaatctggtgaccgggggggataatggagtcgtagaggtctggcaggcctgcgacttcaaacagctctatatctacccgggttgtgatgcggggatccgggccatggatctctctcacgaccagaggacgctgatcaccggcatggcctcaggctcaatcgtcgcctttaacattgatttcaacagatggcactatgaacatcagaatagatactag

SEQ ID NO: 126121 - DNA, 8841 bp, Artificial Sequence
  Description of Artificial Sequence: Synthetic coding sequence
atggcaagcgagaaaccggggccgggccccgggttggagccacagcctgtcgggctcattgccgtcggggcggccgggggaggaggaggagggagcggaggcggcggaacaggcggttcaggaatgggagaattgcggggagcaagcgggtccgggtccgtaatgcttccagcagggatgattaacccatcagtccctatccggaatataaggatgaaatttgccgttctaatcggactgatccaggttggagaagtgtctaaccgggatatcgtggaaacagttcttaacttgctggtgggaggcgagtttgacctggagatgaatttcataatccaggatgctgagagtatcacgtgtatgactgaattgttagagcattgtgacgtgacatgccaggccgaaatatggtcgatgtttacagcaattctgcggaaatccgtgcggaatctacagacctccacggaggtggggctgattgagcaagtcctgctcaaaatgtcggccgtggacgatatgattgctgatcttctcgtcgatatgctaggggtgctggcctcatacagtattacggtgaaggaacttaagctattgttttcgatgttgaggggagaatcagggatttggcccaggcatgctgtgaaattactgtccgtcttgaaccagatgcctcagcgacatggccccgatacttttttcaatttccctggatgctcagctgcagccattgcactacctcctattgcaaagtggccctatcaaaatggctttacccttaatacttggtttaggatggatcccctgaacaacatcaacgtggataaagataagccctatctgtattgttttcgcacctcaaaaggggtgggctattctgcgcattttgtgggcaactgtctgatcgtgacctccttgaagagcaaggggaaggggttccagcactgcgtgaagtacgatttccagcctcggaaatggtacatgataagcattgtccatatttataaccggtggcgcaattctgaaattagatgctatgtaaatggacaactcgtaagctatggggacatggcatggcacgtcaacacaaatgatagctatgacaagtgttttctggggagtagtgaaaccgcagatgctaaccgggtgttctgtggtcaacttggtgctgtctacgtcttcagtgaagctttgaacccagcccagatttttgccatccaccagcttggtcccgggtacaagtccaccttcaaattcaagtctgagtccgacatccaccttgcggagcatcacaagcaggtgctttacgatggtaagctggcaagcagcatagcatttacctacaacgccaaggcgacagatgctcagctgtgcctggagagttctccaaaggagaacgcatctatcttcgtgcacagtcctcatgcactgatgctacaggacgttaaggcgatcgtcactcacagcattcactctgcgatccattctatcggcggcattcaggttctctttccactatttgcccaattggacaatcgccagttaaacgacagccaggtcgagaccaccgtgtgtgctacccttttagcattcttagtggagctgctgaagagctctgtagccatgcaagaacaaatgctgggagggaagggttttctcgtgatcggctaccttcttgagaagagcagtagagtgcacatcacacgggccgtgttagaacaattcctgagcttcgcaaaatatctcgatggcttgtcccacggggccccactgttaaaacagctgtgtgatcatatcctttttaaccccgctatttggattcacactccggcgaaagtgcagctgtcgctctatacctatttaagtgctgagtttatcggcaccgctaccatttacacaactatcagacgtgtgggtaccgttctccagttaatgcatactttaaaatactattattgggtgataaatcccgctgacagttcaggaatcacacccaaaggactagacgggccccggccaagtcaaaaagagatcatctcactgcgcgcgttcatgctgttattcctgaagcagctcatcctgaaggaccgtggggtgaaagaggacgagctgcagagcatcctgaattacctcctgactatgcatgaagatgaaaatatacacgatgtcctccagctcctagtggctctgatgtcggaacaccccgcaagcatgattcccgcctttgaccagcgtaacgggattagggttatctacaaactcctggcatccaaatcagaatctatctgggttcaggcactcaaagtgctcggatactttctaaagcatttgggccataaaagaaaggtggaaatcatgcacactcactcactcttcacactcctgggcgaacgactgatgctccacactaacactgtaactgttacgacatacaataccctttacgagatactcactgagcaggtatgtacccaggtggtgcataaacctcatcccgagccggattccactgtgaagatacagaatccaatgatccttaaggtggttgctaccctactcaagaacagtacccctagtgcagagctgatggaggttcgcagactgttcctaagcgacatgattaagctattttccaactctcgtgagaatagacggtgcctacttcaatgctctgtctggcaggactggatgttttcgctgggctacataaatccgaagaactctgaagagcaaaagataaccgagatggtgtataatatctttcggattctgttatatcatgcaattaagtatgagtggggggggtggagagtgtgggtggacactttgtcaattgcgcatagcaaggtgacctacgaggcccacaaagagtacctggctaagatgtacgaagagtatcagaggcaggaagaagagaacatcaagaagggaaagaaaggcaacgtcagcaccatttctggcttgtcatcccagacgaccggggccaaaggtggtatggaaatccgcgaaatcgaggatctttcccaaagccagtcccctgagtctgaaaccgactaccctgtgagcaccgacacaagagatctcctcatgtcgaccaaagtcagtgacgatatcctgggtaattccgatcggccaggaagcggcgtacatgtcgaagtgcacgaccttcttgtggacattaaggctgaaaaggtggaggccaccgaagtgaagctggacgacatggatctaagcccggagaccctagtgggaggtgagaacggcgccctggtggaggtggaaagcttgctggataacgtatatagcgccgccgtggagaagctccagaacaacgtgcacggaagtgtgggcattataaagaagaatgaggagaaggataacggacctttaatcactctggccgacgagaaggaggacctgcctaattcttctacaagttttctgttcgacaagattccgaagcaagaggaaaagttgctgcccgaactcagtagcaatcatatcatccctaatattcaggacactcaggtacatctgggggtgtccgacgatctgggcctgcttgcccacatgaccgggagcgtggacttaacatgcacaagttcgataattgaggaaaaagaatttaagattcataccacctctgacggaatgtcgagcatctcagagcgcgacttggcaagttcgaccaaaggcctcgagtatgccgagatgactgctacaaccctggagacggagtcgtccagttcaaagattgtgccaaatatcgacgccggaagtatcatctcagacacggagcgcagcgatgatggtaaagagtcagggaaggaaatccgaaagattcagactacaaccactacccaagcagtgcagggacgctctattacacaacaggatcgcgatctccgcgtggatttgggatttcgcgggatgcccatgactgaggagcagaggcggcagttttcgccaggcccacgcacaacaatgttcagaattccagagtttaaatggtcgcctatgcatcagaggttgctgaccgatctcctttttgctcttgaaaccgacgtccacgtatggagatcacattccacaaagagtgtcatggacttcgtgaacagcaacgaaaacatcatcttcgtgcataacacaatccatctcatctcccaaatggtcgataacatcattatcgcatgcggggggattttgcccctacttagtgctgctacaagtccaactggatcgaagaccgagctggagaacatcgaggtcacgcaggggatgagcgcagagaccgcagtgaccttcttatctcgtctcatggctatggtcgacgtcctcgttttcgctagtagtctgaattttagcgaaattgaagccgagaagaacatgtccagtggtgggttgatgcgccagtgcctccgactggtctgttgcgttgcagtccgcaattgcctcgaatgtagacagaggcagcgggacagaggcaacaagtcttcccacggatcgagcaaaccacaggaggtcccgcaatccgtgaccgctactgcagcctccaaaaccccgttagaaaatgttcctggcaacctctctccaatcaaagatccggatcgcctgctgcaggatgtggatatcaacaggcttcgggcagtcgtgtttcgagacgtggacgattctaaacaggcacaatttctagcattggccgtggtgtactttatctctgtgttgatggtgagcaaatatagagatatcctggagccacaaagagaaaccactagaacagggtcccagccaggccgaaatattcggcaagaaatcaatagccccacttctaccgtcgtggtcatccctagcattccgcacccgagccttaatcacgggtttttggctaagttgatccctgaacagagctttgggcacagtttctataaagaaacccctgctgctttccccgacacgatcaaggagaaagaaacgcctactccgggagaggatattcaggtagagtcctccatcccacatactgattcaggaatcggagaagagcaagttgcgtctatcctgaatggtgcagagctggaaacatctactggtccagacgcaatgagcgagctgctgtctaccctgtcctctgaggttaagaaatcccaggaatctttaactgagaacccctctgagacactgaagccggcaacatccattagcagtatatctcagacaaagggaattaatgtgaaagaaatcctgaagtctctcgttgcagcccctgtagaaatcgcggagtgtggccctgaaccaatcccctaccctgacccagcccttaagcgcgagacccaagccattcttcctatgcaattccatagtttcgacagatccgtggtggtgcctgttaagaagccccccccaggatccctcgccgttaccaccgtgggggctaccacagctggttctgggttaccaactggctcaacttcaaatatttttgccgccaccggcgcgaccccaaaatcaatgatcaatacaactggcgccgtagactctgggtcttcaagctcatccagtagctccagcttcgtcaatggggctacttctaagaatctgccagcagtgcagaccgtcgcacccatgccagaggactcagcagagaacatgtctattactgcaaaactggagcgggctttggaaaaagtcgccccactgctaagggaaatcttcgtagacttcgcccctttcttgtcacgcaccttgttggggtctcacgggcaggagctgctgatcgaaggtttggtgtgcatgaagtcctcaacaagcgtggtggaactcgtgatgttgctctgttcccaggagtggcagaactccattcagaaaaatgctggactggcatttatcgaactcatcaacgagggccgactgctgtgtcatgcgatgaaagaccatatcgttcgcgtggctaacgaggctgagttcatattaaacaggcagagggctgaagacgttcacaagcacgccgagttcgaatctcaatgcgcccagtacgcagctgatcgtcgcgaggaggaaaaaatgtgcgaccatttgattagtgccgcgaagcacagagatcacgtgactgctaatcaactcaagcagaagattcttaacattcttacaaacaaacacggcgcctggggggccgtgagccactctcagttgcatgatttttggagactggattactgggaggacgatctgagacgcagacgtcggttcgtcaggaacgcctttggctccacacacgcagaggctctgctgaaagcagctattgagtatgggactgaggaagatgttgtgaaaagcaaaaagacctttagaagtcaggccattgtcaaccaaaacgcagagactgaactgatgttagagggcgacgatgatgcggtgagcctgctacaggagaaggaaatcgacaatctagcaggaccagtggtcctgagcacccctgctcaattgatagcccccgttgtggtggcgaaaggaacactgagcatcaccactaccgaaatatattttgaggtggatgaggacgattctgcgtttaaaaagattgatacaaaagtgttggcatacacggagggtttgcacggcaagtggatgttttctgagatccgagctgtgttctcacggcggtacctcctccagaatacggcgctggaggtgttcatggcgaacaggactagcgtgatgttcaacttcccagatcaggctaccgtgaagaaggtagtttattccctgccgcgagtgggtgtgggcacaagctatggccttccccaggcacgcagaatctcactagcaacaccacgacagctttataagtcatcaaatatgacccagcgctggcaacgacgggaaatatcaaatttcgaatacctgatgtttctcaacactattgcaggacgcacttacaatgacttaaatcaatatccagtgtttccatgggttctgacgaactacgagagcgaggagctggatctgactctaccaggtaactttagagacttgtcaaagcctattggggcactcaatccaaagagggcagtcttctatgccgagaggtacgaaacatgggaggacgaccaatcccccccttatcactacaatacccactactccactgccacctctacgttgtcatggctggtccgcatcgagccctttactaccttctttctgaatgcaaatgacgggaaattcgatcatcccgacagaaccttctcttcagtagctcgctcttggagaactagtcagcgcgatacctcagacgttaaagagctgataccagaattttactatctccccgagatgtttgtgaacagcaacggctataatctcggcgttcgggaagatgaggtggtggtgaacgatgtggacctccctccatgggccaaaaagcctgaagatttcgttcgcatcaaccgcatggcgctggaaagtgaattcgtatcttgccagctacaccagtggattgacctgatcttcgggtataagcaacgcggcccggaagccgtgcgcgcactgaacgtgttccactatctgacatatgagggatcggtcaacctcgattccatcacagaccctgttcttagagaggcaatggaggctcagatacaaaattttggccaaacccccagccagctcctgatagaaccgcatcctccacggagctcagctatgcacctgtgctttttgccacagtcaccacttatgtttaaggaccaaatgcagcaggacgtaataatggtcttaaaatttccttccaactcacctgtgacccatgtggcagctaacacacttccacacctgacgatcccagcggtggtgaccgtcacctgcagccgtctgttcgccgtcaacaggtggcataataccgtgggactccggggtgctccgggctacagccttgaccaggcccaccacctgccaatcgagatggatccattaatcgccaataattccggcgtcaataagagacagatcacggatctcgttgaccagtccattcagataaacgcccattgcttcgtggtgactgctgataacaggtatatcctgatttgtgggttctgggacaaaagctttagggtttattcgacggaaaccggcaaactgacacaaatcgtgttcggtcactgggacgtagtaacttgtttagcgcgcagcgagagctacataggtggggattgctacattgtctctggtagccgagacgcaacactcctcctttggtattggtcaggtagacatcacattattggcgacaacccaaatagcagtgactatcccgccccaagggcggtcctgactggccacgaccacgaggtggtttgtgtgtctgtctgtgcagagttgggcctcgtgataagtggcgccaaagagggcccctgcttggtacacacgatcaccggagatctgctgcgcgccctggagggccccgagaattgcctattcccccgtctcataagcgtcagcagtgaaggacattgcatcatatactatgaacggggcaggttcagtaatttctccatcaatggaaagctcttagcccagatggaaataaacgactctaccagagccattctcttgtcttcagacgggcagaatctggtcaccggcggagataatggggttgttgaagtgtggcaggcatgcgatttcaagcagctgtatatctatcctggatgcgatgctggtatccgcgcaatggacttaagccacgatcagaggactctaatcaccggtatggcctctggctcgatcgtagcatttaatatagatttcaaccgctggcactacgaacaccagaacagatactag

SEQ ID NO: 126122 - DNA, 1575 bp, Artificial Sequence
  Description of Artificial Sequence: Synthetic coding sequence
atgttcgtcaattccaacggttacaatctgggcgttagagaggatgaggtggttgtgaacgacgtagatcttccaccgtgggcaaagaaaccggaggacttcgtgcggatcaatcggatggccctggagtcagagtttgttagttgtcagctgcaccaatggatagacctgatcttcggttacaagcagcgcgggccagaggccgttagggcccttaatgtttttcattacttgacgtacgagggctccgtcaacctggatagtattacagaccccgtcctccgggagatccctgaagcctattttatccgcgatccgcacacctttttactcactaaagatttcatcaaggccatggaggcgcaaatacagaattttggacagacacctagccagctgctcatcgaaccacatccaccgcggtctagtgccatgcacctgtgctttctgccccaaagccccctgatgttcaaagaccaaatgcaacaagacgtgattatggttttgaagttcccatccaatagccctgtgactcacgttgctgcaaatacactaccgcacctgactatcccagcagtggtcacggtaacctgctcaagattattcgccgtcaacagatggcacaacaccgtcgggctaagaggggccccagggtactctctcgaccaggctcaccacctgccaatagagatggatcccctgatcgcaaacaactccggagtgaacaaacgccagataacagacctggtcgatcagtccatacagataaacgcccactgttttgtcgtgaccgcagataaccgatatatcctgatttgcggattctgggacaagtctttccgtgtttattcaacggagacggggaagcttactcagatagtgttcggccattgggatgttgtgacttgcctggcacgctccgaaagttacatcggaggagattgttacatcgtctctggtagtagagacgccacactgctactgtggtactggagcggcagacatcatatcatcggggataatcctaacagctccgattacccagcccctcgcgccgtcctgacaggtcacgatcacgaggtcgtatgtgtatcagtgtgcgcagaactcggattggtgatcagcggagccaaggagggtccatgtctagtgcatacaataaccggggatctgctgagagctcttgagggcccagagaactgcctttttccacggctaatctccgtctcttccgagggccactgtatcatctactacgagcgcgggaggttctcaaacttttctataaacggcaaactcctcgctcagatggagatcaatgattcaaccagagccatactcctcagttctgatggccagaacttagtaaccggcggggacaacggggtggttgaggtatggcaagcctgcgattttaagcagctgtatatttatcctggctgcgacgctggcattcgggccatggatcttagccacgatcagcgcaccctgatcactggcatggcctcagggtccatcgtggcctttaacattgactttaatcgctggcactacgagcaccaaaatcgctactag

SEQ ID NO: 126123 - DNA, 4728 bp, Artificial Sequence
  Description of Artificial Sequence: Synthetic coding sequence
atgcatcaaagactcctaaccgatctgttgtttgcactagaaactgacgtgcatgtctggcggtctcactccaccaaatccgtcatggactttgtaaatagtaatgagaatattatcttcgtgcacaacactattcatctgatttctcagatggttgacaacatcatcatagcttgtggcggtatcctccctctgctgagcgctgctacctctccaactacagagctggaaaatatcgaggtgacacagggcatgagcgccgaaacagctgtgactttcttgtcccggctgatggccatggtggacgtgttggtatttgctagttcgctgaatttttcagagatagaagccgagaagaatatgtcatccggcggtctcatgagacagtgcctcaggttggtgtgctgcgtggctgttcgaaattgtcttgagtgtaggcagcgccagagggaccgtgggaacaaatcgtcccatggaagtagtaagccccaggaagtaccacagtctgtcacagctacagctgcatctaaaacccctctggagaacgtcccaggaaatctgagtccgataaaggatccggaccgcttattgcaggatgtggatatcaacaggctccgcgctgttgtttttcgggacgtagacgactccaaacaagcacagttcttggccttggccgtagtttatttcatctccgtgcttatggtgtccaagtaccgcgatatcttagaacctcagcgcgaaactacacgcacaggtagtcagccaggccgtaacattcgccaggagatcaattctcccacttctaccgagacgccagctgccttcccagacactattaaggagaaagagacccccacgccaggagaagacatccaagtggaaagctcaattcctcataccgacagcggcatcggggaagaacaggtggcaagtattctcaatggcgcagaacttgagactagcacaggccctgacgccatgtccgaattactgtcaacccttagctccgaagttaagaaaagccaggaaagcttgaccgagaatccctctgagactctgaaacccgcaacttccatctcctcaatatcccaaacaaaggggattaatgttaaagaaattctcaagtccttggtggctgcccctgtcgaaattgctgaatgtgggcccgagcccatcccatatcctgacccagctctaaaaagggagacccaggccatcctgccaatgcagttccactcatttgatcgctcggtcgtggtcccagttaagaaacctccaccgggatcattggccgtgacaaccgttggggccaccaccgctgggtccggcctccctacaggctcaaccagcaacattttcgctgccacaggggctactcccaaatccatgatcaatacaactggagccgtggattctggctcaagttcttcatcatctagtagtagttttgtgaatggtgccaccagtaaaaatctgcccgcggtgcagactgtagcaccgatgccagaggattcagctgagaatatgagcatcacagctaaactggagagggcactggaaaaagtcgcgcctctcctgagggaaatttttgtggactttgcaccttttctctcgcgcaccttacttgggtctcatggccaagagcttctgatcgagggattggtgtgcatgaaatccagcacatccgttgtggagcttgttatgctgctatgttcccaggagtggcagaatagcatccagaaaaatgccgggctcgctttcatcgagcttataaatgaaggtcggctactatgtcacgcaatgaaggaccatattgtgagagtcgcgaatgaggcagagttcattctgaatagacagcgagcggaggacgtgcataagcatgcggaattcgagtcccagtgcgcacagtatgctgccgaccggcgggaggaggaaaagatgtgcgaccacctgatatccgctgccaaacacagagaccacgtaaccgccaaccagctgaaacagaaaatacttaacatactgactaataagcatggagcctggggggccgtcagtcatagccagctacacgacttttggagactcgattactgggaggacgatctgcgcagacgcagaaggttcgtgcgcaatgcttttgggtccacccacgctgaagctctgttgaaggccgctatcgagtatggaactgaagaggacgtcgtgaagtccaaaaaaacatttcggagccaggctatcgtcaaccagaacgccgaaaccgagctgatgctggaaggtgatgacgatgcagtgagcctgttgcaagaaaaagaaatagataatttggctgggcccgtagtgctgtctacacccgcacagttgatagcccccgtggttgtggcgaaaggcaccctgagcatcaccacgactgaaatttactttgaggtcgacgaggatgacagcgccttcaagaagatcgataccaaagtgcttgcctatacagaaggcctgcatggcaaatggatgtttagcgaaattagagcagtattttccaggagatatttgctgcagaataccgctcttgaggtgtttatggcgaacaggacctccgttatgttcaattttccagaccaagctactgtgaagaaggtagtctactcattgccacgcgtgggcgtgggtacttcatacgggctccctcaagctcggcgcatttctctggccacgccccgtcagctgtataaatccagtaacatgacacaacgctggcagaggcgagagatcagcaatttcgagtatctgatgttcctgaacaccattgccgggcgaacatacaacgatcttaatcagtatcccgtgttcccatgggtcctcactaattacgagtcagaggagctggatctcactctcccaggcaactttagagacctttctaaaccaataggcgccctgaatccgaagcgggcagtgttttacgccgagagatacgaaacttgggaggatgaccaatctcccccttaccactacaacacacattatagcaccgcgacctccaccctctcctggctggtacgcattgagcccttcaccactttcttcctcaatgccaacgacggaaaattcgaccacccagacaggaccttttcatctgtggccaggtcatggcgaacctcccagagggatactagcgacgtgaaagagctgatacccgaattctactacctgcctgaaatgtttgtcaactctaatgggtacaatctgggcgttcgcgaggacgaggtggtggtgaacgatgtagatttgcctccttgggcaaagaagcctgaagactttgtcagaataaaccgcatggccttggagtcagagttcgtatcttgccagctacaccagtggatagacctaattttcggctataaacagcgaggaccagaggcagtccgcgccttgaatgtgtttcactacctcacttacgaaggcagtgtcaatctggacagcataacagatcctgtattacgggaggccatggaagctcagatccagaactttggccagacaccttcccaactcctgattgagccgcatcctcctcgatcttctgcgatgcatctgtgctttctgccacaatctcccctgatgttcaaggaccaaatgcagcaagatgtcataatggttttgaaattcccctctaacagcccggtaacacatgtggccgccaatacgctcccccatctgacaatccccgccgtagtcaccgtcacctgcagcaggttgtttgccgtgaacagatggcataataccgtgggactgaggggggcccctggctattccctggaccaagcgcatcatctaccaattgagatggaccctctgatcgccaacaatagtggggttaataaaaggcagattaccgaccttgtagaccaaagcattcagatcaacgctcactgcttcgttgtgactgccgacaacaggtacatcctcatatgcggattttgggacaagtctttcagagtctactccaccgagaccgggaaactcacccagatcgtgttcggacactgggacgtggtgacctgcctagcaagaagtgaatcttatatcggcggcgattgttatatcgtctctggttcaagggatgccactctcctgttgtggtattggagcggccgccaccacattataggtgacaacccaaactctagtgaatgcgactaccccgcgcctcgagccgtgctgacaggacatgatcatgaggtggtttgtgtttctgtgtgcgccgagctggggttggtaatttccggcgctaaagagggcccatgtctggtgcacacaatcaccggcgatttgttgcgagcccttgagggcccagagaattgcttatttcctcgtctaatttcagtgagctccgaagggcactgcatcatctactatgagcgtggccgtttctctaacttcagtatcaatggcaagctgctggcgcaaatggaaattaacgactctacccgtgcaatcctgctgagcagtgacgggcaaaaccttgttaccgggggcgataatggtgtggtggaggtgtggcaagcgtgcgactttaaacagctgtacatttaccccgggtgtgacgctggcatacgcgccatggacctgtcccatgatcagaggaccctgattaccggtatggcctccggatcaatcgttgcttttaacattgacttcaataggtggcattatgagcaccagaacagatactag

SEQ ID NO: 126124 - DNA, 2220 bp, Artificial Sequence
  Description of Artificial Sequence: Synthetic coding sequence
atgttttcagaaataagggcggtatttagcagaaggtacctcctgcagaatacggcgctcgaggtgttcatggccaaccgcactagcgtcatgttcaacttccccgatcaggctacggtaaagaaggtcgtgtattctctgccaagggtaggagtaggaacttcttacggactgccgcaagcccggaggatctctctggcaaccccacgccagctctataaatctagtaatatgacccagaggtggcagcggagggaaattagcaacttcgaatatctgatgtttctgaatacgatcgcggggcgtacgtacaacgatctgaaccagtaccctgtcttcccatgggttttgacgaactatgagtcagaagagctggatctaacacttcccggaaactttagagatctgtctaagcctattggggcactgaaccccaagcgggcggtgttctacgctgagagatacgaaacttgggaggatgaccaaagccccccttaccactataacacccactactcaacagcaactagtactcttagttggttagtccgaatcgagcctttcaccactttttttctgaacgcaaatgatgggaagtttgatcacccagatagaaccttctcaagtgtggctcgcagctggagaacctctcagagagataccagcgatgtgaaagagttgattccagagttctattacctgccagagatgttcgtgaactccaatggctacaacctgggagttcgggaagatgaggttgtggtgaatgatgttgacctccccccttgggcaaaaaagcctgaggacttcgtgaggattaatcgcatggccctggaatccgagttcgtcagctgccagttacaccaatggattgatctaatcttcggctacaaacagaggggcccagaggccgtgcgggctttgaacgtttttcactacttgacatatgaaggaagtgtcaatctggattcgattacggaccccgtgcttcgggaagcaatggaagctcagattcagaacttcggccagactccgtcccagctcctgatagagccacacccccctagaagcagtgccatgcacctctgtttcctgcctcagtccccactaatgtttaaagaccaaatgcagcaggatgtgattatggtactcaagttccctagcaactctccggtgacccacgttgcagctaacaccctcccgcacctaacaatacccgctgtcgtcaccgtcacctgctccaggttgttcgccgtaaatcggtggcataacaccgtgggactcagaggggccccagggtactcgctcgatcaggcccaccatcttccaatcgagatggacccactgatcgccaataattctggcgttaataagaggcagatcaccgatctagtggaccagagcatacaaatcaacgcacattgttttgtggttacggccgataacaggtatattctgatctgtggtttctgggacaagtccttcagagtctactccaccgagacaggcaagctgacccaaatcgtgtttggacactgggacgtcgttacctgtcttgctagaagtgagtcatatatcggaggggattgttatattgtgagtggaagtcgggatgctaccctgctcctgtggtactggtccggcagacatcacattataggagacaatccgaactcctccgactaccccgcaccacgcgccgtcctgactggacacgaccacgaggttgtatgtgtgtccgtatgcgcagaactgggcctcgtcattagcggagccaaggagggcccgtgtctcgttcataccatcacaggggaccttcttcgggcccttgaaggcccggaaaattgtctcttcccccgccttatctccgtcagctcggagggccattgcattatctactacgagcgaggccgctttagcaacttcagtatcaatggtaagttgctggctcaaatggagatcaacgattccactagagcgattctcctgtctagtgacgggcagaatttagtaactggcggcgacaatggagtagtcgaggtgtggcaggcttgcgacttcaagcaactatatatatatcctgggtgtgatgccgggattcgtgccatggacctttcccatgaccagcgcactctgataacagggatggcatccggcagcatagttgcctttaatattgactttaaccgatggcattacgaacatcagaatcgttactag

SEQ ID NO: 126125 - DNA, 8841 bp, Artificial Sequence
  Description of Artificial Sequence: Synthetic coding sequence
atggctagcgaaaagccaggaccaggacccggactggagccgcagcctgtgggtctgattgcagttggagcagctggtggtggtggcggcggttccggcggtggcgggacaggagggagtgggatgggcgaactaaggggggcctctgggtctggttctgtgatgcttccagcaggaatgataaacccatcagtccctattcgtaacattaggatgaagttcgcagtgttaatcggcctcattcaagtgggagaggttagtaatagggacatcgtcgagacggtgctcaacctgctggtgggtggcgaatttgatctggagatgaactttattattcaagacgccgaaagtattacatgtatgacggaattgctggaacactgcgacgtcacttgccaggccgaaatatggagcatgtttaccgcgatattgaggaagtcagtacgtaacttgcagacgtcaaccgaagtcgggctcatcgagcaggtgctgctgaaaatgagcgccgttgacgacatgatcgctgatctcttagtcgatatgctcggggtccttgcttcctactccatcaccgtgaaagaattgaagctgctgttttcaatgctgagaggcgaaagcggtatttggccgcggcacgccgtcaagttgctatctgtgctcaaccagatgccacagcggcacggtccagatactttcttcaactttccagggtgtagtgcggctgcaatcgccttgccacccattgctaagtggccatatcaaaatggctttacgctcaacacatggtttcgaatggatccactcaacaacatcaatgtagacaaagacaaaccctacttgtactgttttagaactagcaaaggagtcggatactcagcacactttgtaggaaactgcttaattgtcacgagtctcaaaagtaaggggaaaggtttccaacactgtgtgaaatatgattttcagccaaggaaatggtatatgatttccatcgtacatatctataacaggtggagaaatagcgaaatacgatgctacgtgaatggacaactggtgtcctatggtgacatggcatggcacgttaatacgaacgacagctacgacaaatgttttctggggagttccgagacagcggacgcaaatcgagtgttctgtggtcaactgggggccgtgtacgttttctccgaagcactgaatccggcacaaattttcgccattcaccagctgggcccgggatataagtccacctttaaatttaagtcggagagtgatatccacctggcagaacaccataagcaggtgctgtacgatggaaagttggcatccagcatcgcttttacgtacaatgcaaaagccacagatgcacagttatgtctggaatcgagccccaaagagaatgctagcatctttgtgcactcaccgcacgcactcatgttgcaagatgtgaaggccatcgtgacacattctatccacagcgccattcactctattgggggcatccaggtcctcttcccacttttcgcccagcttgataacaggcagctcaacgacagtcaagtagagaccactgtatgtgcgactcttctggccttccttgtggaattgctcaaaagctccgtggccatgcaagagcaaatgctggggggcaaaggcttcttggtgatcgggtacctgcttgagaagagttcacgcgtccacatcacccgagccgttcttgaacaatttttaagtttcgctaagtacttggatgggctctctcacggggctccactgctcaagcaactttgtgatcacatcctctttaaccccgccatctggatccatacgccagcaaaagtgcaactctcactttatacgtatctgtcagccgaatttattggcacagccaccatttacacaactattcgacgcgtgggcacagtgctgcagcttatgcacactctgaaatactattattgggtgatcaatccagccgacagtagcggcattaccccaaagggactagacggcccacgcccttctcagaaagagattatctctctgagagcctttatgctgctttttctgaaacagctcattctgaaggaccgaggagttaaggaagatgaactgcagtccatcctgaactatttgttaaccatgcatgaggacgagaatatccacgatgtattgcagctcttagtcgccttaatgtctgagcacccagcaagcatgatccctgccttcgatcagcgaaacggtatcagggttatctataagcttctagctagtaagtctgagagcatttgggttcaggccttgaaggtgctgggatattttcttaagcatttggggcataagaggaaggtggaaattatgcacacccactctttgttcaccctgctgggcgagcggctcatgctgcatacaaacacggtcactgtgacaacctacaatacgttatacgaaattctgaccgaacaggtttgcacccaagtggtgcacaagccccacccggaaccggactccactgtgaagattcaaaatcccatgatccttaaagtcgtggccacactcctgaaaaatagcactccctctgcagagctcatggaagttagacgactcttcctcagcgatatgatcaagctcttttccaactcccgcgagaacagacgatgtctgttacagtgttccgtctggcaggactggatgtttagtctcggatatatcaacccaaaaaattcggaagaacaaaagattactgagatggtttataacatcttccgaatactactgtaccacgccattaagtatgagtgggggggctggcgcgtgtgggtggacaccttgagcatcgcccatagcaaagttacatatgaagcccataaagaatatcttgccaaaatgtatgaagaataccagcggcaggaagaggagaacataaaaaaaggcaaaaaggggaacgtgagtacaatatcagggctttcatcccaaacaactggtgcaaaaggagggatggaaattcgtgaaatcgaggatctgtcacagtcccagtcgcctgaatccgaaaccgactacccagtctccactgacacccgagatcttctcatgtctaccaaggtgagtgacgatatcctaggcaattccgaccgacctggaagcggagtacatgtggaggtgcatgacctgctggtagacataaaagcagaaaaggttgaggccaccgaagttaagttagatgacatggaccttagccctgagacacttgtgggtggcgagaacggcgcacttgtggaggtagagtctctcttggataatgtatattcggcagccgtggagaagctgcagaacaacgtacacggctccgtgggtatcatcaagaaaaatgaagagaaggacaatggcccgctgattactctggctgacgagaaggaggatctgcctaactcttccaccagttttctgtttgataaaatcccaaaacaggaagaaaagctcctgcccgaactgtcttctaatcacatcataccaaatattcaagatacgcaggtgcacctgggggtgagtgacgatctaggcctattagcacatatgacaggatcggtggacctcacctgcacctcctctatcattgaggaaaaggagttcaagattcacaccacgtctgacgggatgagttctatttcggagcgggatctggcctctagcaccaagggcttggagtacgccgagatgaccgcaactacactggagacagagtcttcatctagtaaaatcgtgccaaatatcgacgccgggtccatcatcagtgacactgagcggtcggatgatggaaaagagtccggaaaggagatacgcaaaatacagactacaactacaacccaagcggtccagggtagaagtataacacagcaggacagagacctgcgagtcgacctggggttccgcgggatgcctatgaccgaggagcagaggcgccagtttagtcccgggccaagaacaactatgttccgcatccctgagtttaagtggtccccaatgcaccagcgactgctcaccgacctgctgtttgccctggagacagacgtgcacgtttggcgtagccatagcacaaaatcagttatggacttcgtgaactctaacgagaatatcatcttcgtccacaatactatccacctcatctctcagatggtagataatattatcatcgcttgcggcggcatccttccgctgctctctgctgcgacctccccaaccgtctctaaaactgaactggagaacatcgaggtgacccaaggcatgagcgcagaaacagcagtgaccttcctgagcaggctaatggcaatggtcgacgtgttggtgttcgcatcaagtctgaactttagcgagatcgaagctgaaaaaaatatgtcttccggcgggctcatgcgacagtgtttgaggctcgtgtgttgtgtcgctgtccgcaattgcctagagtgtcgtcagagacagagggaccggggaaataagtcctcacacggctcctccaagccccaagaggtgccacagtcagtgaccgccaccgccgcctccaaaacgcccttagagaacgtcccaggtaacctgtcacccatcaaggacccagatcggcttttgcaggatgttgacattaaccgcctgagagcagttgtgttcagagacgtggatgacagcaagcaggcacaatttcttgcactggctgtcgtgtattttatatcagtcctgatggtgtccaagtaccgagatatcttagagccccagcgtgagactaccagaactggatcgcagcctggtcggaacatccgccaggagattaattcaccaacctccaccgtggtggtgattccgtcaataccgcacccgagcttaaatcatgggtttttagctaagttaatccctgagcaatcatttgggcacagcttctataaggagaccccggcagcttttcctgacacaatcaaagagaaagagacccccacgccaggcgaggatattcaggtagagtccagtattccccatacagactcgggtatcggagaagaacaggttgcttcaattctcaacggcgcggagctcgagacatctactggaccggacgccatgtcagagttgctttcaaccctgagcagtgaagtgaagaagtcccaggagtctcttaccgagaacccatctgagacactaaaacccgccacctctatttcttctatttcacagacaaagggtattaatgtcaaagagattctgaagtcactggtcgccgctcccgtggagatagccgagtgcggcccggaacctattccatacccagatcctgctctcaagagagagacacaggctatactgcccatgcaatttcactcgttcgatcggtcagtggtggtaccagtgaagaagcccccacccggctcactggcggtcaccacagtcggggcgaccaccgccggtagcggcctgcccactggcagtacttccaacatctttgccgccaccggagcaactcctaagagtatgatcaatacaacaggcgccgttgacagcggtagctcctcctcatctagttctagctctttcgtaaatggcgcaacctctaagaacttaccagcggttcagactgtcgctccaatgccagaggattcagccgaaaatatgagcatcactgcaaagctagaaagggcgctcgagaaggttgcacctctgcttcgggagatctttgtggactttgcaccctttctcagtaggacactgttagggtcccatgggcaggagctcctgattgaaggtctggtgtgtatgaaatccagtacctcagtggtggaactggtcatgctcctctgcagtcaggaatggcagaactctatccagaaaaacgccggcttagcgttcatagaactcatcaacgaaggtagactactgtgccacgctatgaaagatcatatcgtgcgggtggctaatgaggccgaatttatcttgaatcgccagagagctgaagatgtgcataagcatgccgagttcgagtcccagtgcgcccagtacgctgcagaccgacgggaagaggaaaagatgtgtgatcatttgatctcagcagctaaacatcgggaccatgtaactgcaaaccagctgaaacagaagattctcaacattctgaccaataagcacggggcctggggggcggtatcccatagccagttgcacgacttttggcggctcgattactgggaggatgatctccgccggcgccggagatttgtgaggaacgcattcgggtctacacacgctgaggcattacttaaggctgcaatcgagtacggtacggaagaggatgtcgtgaaaagtaagaagacctttaggagccaagccatagtgaatcaaaacgccgagacagaactgatgttagagggcgatgatgacgcggtaagcctgctgcaggagaaagagattgacaacctggcagggcccgtcgttttgagcacaccagcacagttgatcgctccggtggttgttgcaaagggaaccctgagcattacaaccacggagatctacttcgaggtggatgaagacgattcagcatttaagaagatcgatacaaaggtgctcgcctatacagaagggctgcatgggaagtggatgttttctgagattcgcgcagtcttctccaggcgatatttgctccagaacacagctttggaagtcttcatggctaatcgcacttccgtcatgtttaacttccctgaccaggcaaccgtcaagaaagtggtatatagcctcccgcgtgtgggcgttggtacgtcctacggcctacctcaagcccggaggatcagccttgctactcctcggcagctgtataagtccagtaatatgacacagcgatggcagcgaagagaaatttccaacttcgagtatcttatgttcctgaacactatagccggacgtacctacaacgacctgaatcagtatcccgtgttcccctgggtcttgactaattatgagtcagaagagcttgatcttaccttaccaggcaattttagagatttgagtaagccaattggggcactgaatcccaagcgagcggttttttatgcggagaggtatgaaacctgggaggacgatcaaagtccaccttaccattacaatacccactattctactgctacttccaccctgagttggctggtgagaattgagccttttacgacattcttccttaatgccaatgatggtaagttcgatcatcccgataggactttttcttccgtggcaaggtcctggaggactagtcaaagggatacaagcgatgtgaaggaactcatccctgagttctactacctgccggagatgttcgtgaattcaaatggatacaatctgggcgtgcgtgaggatgaagtggtggtcaacgatgtggatctcccgccttgggccaaaaaacctgaggacttcgtgagaatcaacaggatggcgctggagtctgagttcgtctcttgccagctgcatcagtggatcgatcttatcttcggctacaagcagcgtggtccagaagcagtgagggcactgaatgtttttcactacctaacctatgagggctccgtcaacttggatagcattacggacccagtgcttagagaggcaatggaggcccagattcagaatttcggccaaactccgagccagttattgattgagccccaccccccaaggtcatccgctatgcatctctgctttctgccgcagtcacctctcatgttcaaagaccagatgcagcaggatgtgattatggtcctgaagtttccatcaaattcacccgttactcatgtggccgccaatactctaccacatttgacgattcctgccgtagtgacggtaacgtgttctcggctgtttgccgttaacaggtggcataacaccgtggggctcaggggagcccccgggtattctctggatcaggctcaccatctccctatcgagatggaccctctcattgcgaataacagcggggtgaacaagagacaaattaccgatttggtagaccagtccatccagattaatgcccactgcttcgttgtaaccgctgacaaccgatatatactgatctgcgggttctgggataagagcttcagggtttactccacagagacaggtaaactgacgcagatcgtgttcggccattgggatgtggtcacctgtctcgcccggagcgagtcatacataggcggcgattgttacatcgtctctggttcccgggatgctacacttctcctgtggtactggagtggccgtcatcacatcattggagacaacccaaacagttccgactatccggcgcctcgtgcggtcttgactggtcatgatcacgaggtggtctgcgtcagcgtgtgcgcggagctcggccttgtgatttccggcgccaaggaggggccatgcttggtgcataccataacgggagacctcctgcgtgccctggaagggcctgagaactgcctgtttccaaggctgataagcgtcagttcagaagggcactgtattatctactatgagagagggcgcttttccaacttctctataaacggcaagctgttagctcagatggagatcaatgactccactcgagccatcctgttatcttccgatggacagaacctagtcacgggcggcgacaatggagtcgtcgaggtctggcaggcctgcgacttcaagcagctgtacatctacccaggctgtgacgcagggatcagggccatggacctgtcacacgaccagagaactttgataacaggaatggcgtccgggtccatcgtggcctttaatatcgatttcaatagatggcattatgagcaccagaacagatattag

SEQ ID NO: 126126 - DNA, 834 bp, Artificial Sequence
  Description of Artificial Sequence: Synthetic coding sequence
atgtttagcgagattagagcagtcttctcaaggagatatctgctgcagaacacagcgctcgaagtgtttatggctaatcgcacaagcgttatgtttaactttcccgatcaggccacagtgaagaaagtggtctattcactacccagagttggtgtcggtaccagctacggcctgccacaggccagaagaatctcccttgcaacccccaggcagctgtacaaatcatccaacatgacacagagatggcagaggagggaaatttccaacttcgaatacttgatgtttcttaatacaatcgcggggcgcacatataacgatctgaaccagtatccagtcttcccatgggtgctaaccaattacgagtctgaagagcttgatctgacgctacccggaaatttccgggacttgagcaagccgatcggcgcacttaaccccaaacgtgctgtgttctatgcggagagatacgaaacgtgggaggatgaccagagccctccttatcactataatacccactactccaccgctacctctaccttatcttggttagtgcggatcgaaccttttactaccttcttccttaatgcaaatgatggtaagttcgatcaccctgaccgcaccttctcctccgtggcccggagttggcgcacctcacagcgcgatacatctgacgtcaaagaattgattccagaattctactaccttccagagatgtttgttaactccaacggttataaccttggcgtgagagaagatgaggtggtggttaatgacgtagacctgcccccttgggcaaaaaaccttaagacactttgtgggtcaacggggtggccatag

SEQ ID NO: 126127 - DNA, 7815 bp, Artificial Sequence
  Description of Artificial Sequence: Synthetic coding sequence
atggcaagtcgggagcgactgtttgagctgtggatgctctactgtacaaagaaggaccctgattacttgaagctgtggctggacactttcgtgtccagttatgaacagtttttagacgtggacttcgagaaactaccgactagggtcgatgatatgccacctggcatctctttgctacccgacaatattcttcaggtgttacggattcaactgctacagtgtgttcaaaagatggctgacggcctggaagagcagcaacaggccttgtccattttgttggtcaaattttttattattctgtgtaggaatttgagcaacgtcgaagaaattgggacatgctcctatataaactatgtgattacaatgacaactctatacattcagcagttgaagtcgaaaaaaaaggagaaggaaatggccgatcagacttgtatagaagaattcgtcatccacgcacttgccttttgcgagagcctctacgatccctatagaaattggagacacagaatctccggaagaatcctatccactgtcgaaaaatcgcgccaaaaatataagccagcaagcctaacagtcgagtttgtcccgtttttctaccagtgttttcaggagtcggaacacttaaaggagagcttgaagtgttgcctacttcatctgtttggggctatcgttgcaggaggccagaggaacgcacttcaggccatatctccagccacgatggaggttctgatgcgggtcctggctgactgcgactcttgggaggacggcgatccggaggaggtcggtcggaaagccgagcttaccctgaagtgcttgacagaggtcgtgcatattttattgtcaagcaactcagatcagcggcaggtggaaacctctactattttagaaaactatttcaaactactgaacagtgaccattctgctcttccaaaccagcggagatcacggcagtgggaaaatcgcttcattgcactacagatcaaaatgcttaatacaatcactgcaatgttggactgtaccgacaggcccgtgctccaggctatctttcttaattcaaactgctttgagcacttaattaggctactgcagaattgcaaagtgttccagggccagctggactgcctagccatttccactatacaggcactgacagcagtcatgaacaagtcaccagccgccaaggaagttttcaaggagagaatcggttacacccacatgctcgaggtgctgaagtctcttggacagccaccactggagctgctcaaggaactcatgaatatggctgtcgaaggagaccacacaagtgttgggattctaggcatttccaatgtgcaaccgctgcttttgctgattcagtggctgcccgaattgcaatcccatgatctgcagatctttatcagtgattggctgaagcgcatttgctgtattaaccgacagagccgcaccacttgcgttaatgctaacatgggaattaggattatcgagacactggacctccactccagcctccatcagacatgtgccgagaatctgatcgcgatccacgggtccctaggatcgcaatcagtctcctcagaggaaatccggcgcctgttgcgtcttctccgcgtggacgagtcagaatccgtgcacccctatgtgacgcctgtaacccgcgccattttaactatggcgcgaaagctgtccctagaatccgctctacagtatttcaatctgtcccatagcatggccgggatcagcgtgccccctatccagaagtggccaggctctgctttctcattctctgcttggttctgtctggaccaggatcagctgaccctcgggatcgctaacaaagggggaaaacgaaagcagctatatagttttttcactggaagcggtatggggttcgaagcctttataactcacagcggcatgctcgtggtggctgtttgtaccaagcgcgagtatgccactgtgatgctccccgatcattccttttgcgactccctgtggcacaatatcacggtggtgcatatgcctggaaagcggcccttcggtcaatcctttgtatacatctacgataacgggcagcagaaggtcagtgctccgctccgtttccctgccatgaatgaacctttcacctcctgttgtattggcagcgccggccagagaaccacaaccccccctccctcacagatcccagacccaccatttagctctccaataacaccacaccgaacgtcctttggtggcatcctaagctccgcttcttggggtggcactattgagaagagtaagttaattactaaactgatctctgcaggtactcaagactcagagtggggctgcccaacgtcactcgagggacagttaggctccgtgatcatcttctatgagcctcttcaaccaccccaggtgaaagctctttacctggcaggtcccaactgcctttctccgtggaagtgtcaggaatccgatatggccgacctgcctggtaacatccttttatactataccgccaaagcctgcaagaactccatttgtttagacctgtcaacaaactgtttgcatgggaggctgaccggaaataaggtcgtgaactgggatattaaagacatcatcaactgcattgggggccttaacgtgttattccccttgcttgaacagatcagccatttctctgaaggccaaattcctgaggagaagaacgagtctactgttccagagagtgtgaccccggtggaaggcgattggttagtatggaccagtacgaaggcatcggagagccggctagaacggaatctggttgccacgttcatacttatcgtgaagcatttcatccaaagacatccaatcaaccaagggaacctaatccactcacacggcgtcgcaacgctgggggccttgcttcagaaagtacctagcaccctgatggacgtgaatgtgctcatggctgtgcaactgctgatagagcaggtgagcctggagaagaatatgcagcttcttcagcagatgtaccaatacttactcttcgatttcaggatatggaaccgtggcgatttcccattccgtattggacatattcagtatctgagcaccataattaaagactcaagacgcgtgtttcgtaaaaaatacggagtgcagtttttgctcgacacccttcgtatctactacggtaatggttgtaaatataacgagctctctttggacgacattcggacaattaggacaagcctctacggcctgatcaaatattttctctgtaagggcgggtctcatgaagaaattcagtcgataatgggctacatcgcagctaccaatgaggaggagcagctctttggcatattggacgtccttttcagccttttacgaactagcccgacgagaggccagctgttcttactgctcttcgaaccaggaaatgctgatatcctgtacgccctgcttctcaaccagaagtactcagatagactacgagaaatcatatttaaaatcatggagcaaatgctgaagtgcactaacgtgtacgagaggtccaagcagcacattcggctaagagaggtgggatactcggggttggggcttctcctgaatgaagctctcgtcaacacttctttgatcaagaatctcactcatcagataattaatactgaccctgtgatcaacttcaaagatctcttgagcgtggtatacatttcccacagagcccacatcaatgtgcgagttgccatatgcagaaaagtcttacagatcttgcagttccagcccgatgcagcccatcaaatcagccagcaggttgggtggcaggacacccttgtgcgactgttcctgaaggccaagtttgaaaatgggaatactcttcataagcacagccgcgccgtgctcatgaaggataatgacaaaaacatgtctacagaggacacgaagaaaaattctgacgagaaaactgacgaagaaaagattacttcgttcgcttcagcgaacgtgtccagcgaccagtggtcactggaggatcggcactctctggactccaacactcctctgttcccagaagattcatcagtgggcgaactgagtttcaaaagtgagaaccaggaagaattctggcattctaacccttctcacctgagcctagacttatccggcattgactcctgtgaaatgagcgattctggatcccaggtgccagactcgcttcctagtacacctagcccagtcgaaagcactaagtcctttagtgtgcatagtgaccgagaaagttctatcacaaacgacatgggcttttctgacgatttctcactgctcgagagccaagagcggtgtgaggaggagctgttacaactgcttactcacatcttgaattatgtgatgtgtaagggcctggaaaaatctgacgacgatacctggatcgagcggggtcaagtgttctccgcactgagtaagccaggaatctcaagcgagctcttgaggccatctgatgagatcaagctgacactgttgcagaaaatgcttgaatgggccataagtgagaatagagaggccaaaacaaacccggtaaccgccgaaaacgcttttcgcttggtgctcattatacaagactttctgcagagcgagggactggtcaacagtaatatgtggacagagaaactgttagaagacatgatgctgctcttcgactgtctgagcgtgtgttattccgagtctcccgtttgggttaaactgagccaaatacagattcagttgctgttaggattcattggtaggggcaacctccaggtatgtgccatggctagcgcaaaactgaacacgctcctccagacgaaagttatagagaatcaggacgaggcctgttatatactgggcaaactcgagcacgtgttgagccagtctattaaagagcagacggagatatacagctttctgattccactagtgcggacgctcgtcagcaaaatttacgagctcttattcatgaatctacatctgccaagcctgccctttaccaacggcagttcatctttcttcgaggacttccaggaatactgtaattccaacgagtggcaagtctatattgagaagtacattgtgccatacatgaaacagtacgaggcacacacattctacgatggacatgagaacatggctctttactggaaagactgttatgaagctctgatggtgaacatgcataaaagggatagagagggcggcgaaagcaaattgaagttccaggaattgtttgtcgaaccatttaatagaaaggcaagacaggaaaatctccgttacaataatatgctgaagcagctcagttcccaacagcttgccactctacggaggtggaaggccatccagctgtacctgacctgtgagcggggcccttgggccaaaagaaagcagaacccaattcactggaagttggccaacgtggagaactattcacggatgagactcaagctcgtgccaaactataatttcaaaacacacgaggaagcctccgcccttcgagataacctgggcatccagcatagccaacctagcagcgacacattacttttagaggtcgtcaagcaggtgaaagtgtctgacatggtcgaggataagctggacctccccgaagaagatattaccgccagggtaaacgtcgacgaaaaggaagaacaggatcagaaagaaaagctcgtactcatggaagattgtgagctgatcacaattattgacgtcatccccgggagactggagataacgacacaacatatatacttctatgacggatctattgaaaaagaagatggagtgggcttcgacttcaagtggccccacagccaaattagggagatccatctgagaaggtataatctacgtaggtcagccctcgagattttccacgttgaccagtcaaactacttcctgaattttaaaaaggaagtccggaataaaatatactcgaggctgctgtccctgcattctccgaacagttattacggatcgaggtccccccaggagctatttaaagcctccggattgacgcagaaatgggtgaatagagaaatttcaaacttcgattatcttattcagattaacaccatggccggcaggacatataacgacctggcccaataccccgtgtttccttggattcttcaggactatacatccgaggagcttgatctgaataatcctgccgtcttcagagacctgtcaaaaccaattggcgttgtaaatgaaaaaaatgcaaaggcaatgcgggagaagtatgagaatttcgaagaccctatggggaccattgataagttccactacggtacgcattactctaacagtgctggcgtgatgcactatctcatccgcgtcgaaccgtttaccactctgcatatacagctccagagcgggaggtttgactgcgcagatagacagttccactctatccctgccacatggcaggccctcatggataatccatacgacgtgaaagaattaatccctgaattcttttacttcccggagtttctagagaaccagaaccagttcaatttggggcgcctgcagatttccaaggaacttgtcaatgacgtgatattgcccaagtgggcaaagtccgcagaggactttatttacaaacacagaaaggcactggagtccgaatatgtttccgctcacctgcacgaatggattgacctgattttcggttacaagcagaggggccccgccgccgtggaagccctcaatgtcttttactactgttcctacgagggagccgtcgacctggacgcgctgacggatgagaaagaacgaaaggcattggagggcatgattaacaatttcggccaaacaccctgccagctgctcaagattaccattagcatgaactatgtgattggcacacacggatggctgccctatgaccgaaatatcagcaattatttcactttcatcaaggaccagaccgtgacgaaccccaagacccagcgtagcattaacgggtcctttgctcccggtctggagatcacgtcaaaacttttcgttgtctctcacgatgctaaactacttttcagcgccgggtactgggacaactccatccaggtcatgagtctgaccaaaggcaaaattatttcgcacattatacgccacatggacattgtgacttgccttgccactgattactgcggcatccacttaattagcggaagccgcgacaccacgtgcatgatctggcagatcacccagcagggtggagtccctgtgggccttgctagcaagccatttcaaatactctatgggcacactaatgaggtactgagcgtaggtatatctactgaactggacatggccgtctccggatcccgcgacgggactgtgatcatacatacgatccctaacttagctataagctgggagggccacatagtggtgtactcatctacagaggagaagaccacccttaaagacaaaaatgccttgcacttatttagtatcaacggtaagtacctgggctcacaaattttaaaggagcaagtctctgacatctgcattattggcgagcacattgtgactggctccattcagggtttcctgagcattagggatctgcattccctgaatctaagtatcaaccctttagctatgcggttacctattcactgcgtgtgtgttacaaaggagtattcccacattctggtggggctcgaggatggcaaattgatcgtagtgggagtggggaagccggccgaaatgagaagcgggcagctgagcaggaaattttggggctcatctaagaggttaagccagatctccgccggtgagactgagtacaacacgcaggactcgaagtag

SEQ ID NO: 126128 - DNA, 8085 bp, Artificial Sequence
  Description of Artificial Sequence: Synthetic coding sequence
atggcatctagagagcgcctgtttgagttgtggatgctgtattgcacaaagaaggatcctgattatctgaaactctggctagatacctttgtcagttcttacgaacagtttctggacgtggacttcgagaaactacccacacgagttgacgatatgccaccaggaattagcctgctgcccgataatattctgcaagttctccgaatccagttactccagtgtgtccagaagatggcagacggcctcgaggagcagcaacaagctctgtccattctgcttgtgaagttctttatcatcctgtgcagaaatctgagcaacgtggaagagattggtacatgcagctacataaactatgtgattaccatgaccactctgtacattcaacagcttaagtcaaaaaaaaaagagaaagaaatggctgaccaaacgtgtatagaagaatttgtaatccacgctttggccttttgcgagtccctgtatgacccttatcgaaactggcggcatagaatttctggtcgcatcttgtctacggttgaaaagtcacgacagaagtacaaaccagccagccttaccgtggaattcgttccgtttttctaccaatgctttcaggagagcgaacaccttaaggagtccctgaagtgctgcttactgcatctgtttggcgcaatcgtggcaggtggccagcgaaacgctctacaggcaataagccctgcaactatggaagtcctgatgagggtgctggccgattgtgattcttgggaagacggggatccagaggaggtgggcaggaaagccgagctaactctcaaatgccttaccgaggtggtacacatactactcagttcaaatagcgaccaaaggcaggtggagacatccacaattttagagaattacttcaagctactgaattctgaccactctgccctccccaatcagcgcagaagcaggcagtgggagaaccggtttatcgctctgcagataaagatgctaaacactattacagcgatgctggactgtaccgataggcccgtacttcaagccatcttcctgaactctaactgttttgagcacttgataaggctgctccaaaattgcaaggttttccagggccaactggactgcctggcgatatctactattcaggccctgaccgcggttatgaacaagtctcccgcagcaaaagaggtattcaaagaacggattggatatacccacatgctcgaggtgttgaaaagcttgggccagcccccactggaactgctaaaggagctcatgaatatggctgtggaaggtgatcacacgtccgtcggcatcttgggcatctctaacgttcaaccactcctgctcctgattcagtggctgccggagttgcagtcacatgacctgcagatattcatctctgactggctcaaacggatctgctgtatcaataggcaatcacgaacgacctgcgtcaatgcgaacatggggattcggattatcgagacattggatttacattcctccctccatcagacctgtgctgagaacctgattgcaatacatggatctctgggaagccagtccgtaagtagcgaggagattaggcggctgctccggctgctgagagttgacgaatcagagtcagttcacccttacgtaacacccgtgacaagggctatcttgactatggcgcggaagctgtcactcgagtctgccctgcagtattttaacctttcccacagcatggccggtatctcagtgccacctattcagaaatggccaggcagtgccttcagtttctccgcttggttttgtctggatcaggatcagctgacacttggaattgctaacaaggggggcaaacggaagcaactgtactccttttttaccggcagcgggatgggttttgaggcatttatcacccattcgggcatgctcgtggtagctgtctgcactaaaagggagtatgccacggtgatgctccctgaccattcattctgcgactccctctggcacaatattaccgttgtccacatgcccggaaaaagaccatttggccaatcatttgtgtacatatacgacaatggacagcagaaagtctctgcaccattgaggttccctgccatgaacgagccttttacctcttgctgtatcggctcagcagggcaaagaactactactccacctcctagccaaatacccgacccaccgttttcttctccaatcactccacatcgcaccagtttcggcggaatactgtcgtcagcctcatggggaggaacaatcgagaagtctaaactaatcacgaagctgatatctgcgggtacccaagatagtgagtggggttgccccacctccttggagggccaacttggaagcgtcattatcttttatgagccgctacagccccctcaggtgaaagccttatatctggccggccctaattgcttgtcaccctggaaatgtcaggaaagtgatatggctgaccttccgggaaatatcttgctgtattataccgcaaaagcctgtaaaaatagcatatgtctggacctgtccacaaattgtctccacggccggttgactggcaacaaggtggtgaattgggacattaaagacatcatcaattgcataggcggacttaacgtgcttttcccacttttagagcaaatcagtcatttctctgagggacagattccagaggaaaaaaacgagagcacggtgccagagagcgtcacacccgtcgaaggggattggttggtctggacttctactaaagcgagcgagtcaaggctggagagaaatctggttgcgacctttatcctgatcgtgaaacactttatccagagacaccccattaaccagggtaatttaatccatagtcacggagtcgctacgttgggagcactgctgcagaaagtcccaagcactctgatggacgttaatgtcctcatggcggtgcagttgctcattgaacaggtgtccctcgaaaaaaacatgcagcttctgcaacagatgtaccagtacttattattcgatttccgcatatggaataggggcgacttcccattccgcataggccacattcaatacttgagcacaattatcaaggattcaaggagggttttccggaagaagtacggagtccagttcctccttgacaccctccgcatttactatggcaatggatgcaaatataacgagctatcgttggatgacatccgcacaatacgcacgagtttgtacggcttaattaagtatttcctatgcaaggggggcagtcacgaggaaatacagtcaataatggggtatattgcggctaccaatgaggaggaacagttatttggcatcctcgacgtgctgttcagtcttctgcgaaccagcccaaccaggggacagctctttcttttactgtttgagccaggcaatgcagatattctgtatgccctcctgttgaatcagaaatatagcgaccggctgcgcgagatcatatttaagatcatggaacagatgctgaagtgtacaaatgtttacgagcggagcaaacaacacatccggttgcgggaagttggctactcaggactgggcctgctgctgaatgaggcgctggtgaacacgtcccttataaagaacctcactcatcagattatcaacaccgatcccgtgatcaactttaaggacctgctctctgtagtgtacataagccaccgtgcccacatcaacgttagagtggctatctgtaggaaagtgttacagatcctccagttccagcccgatgcagcacaccagatctcacaacaggttggatggcaggataccctcgtgcgactgtttttgaaggcaaaatttgagaacggtaataccctccacaaacatagccgagcagtcctcatgaaggacaacgacaagaacatgtccaccgaagatactaagaaaaatagtgatgagaagaccgacgaggagaaaatcacgtcattcgcctccgccaatgtgtcctccgatcagtggagtctcgaagatagacactccttagacagcaacacacccctctttcctgaggactctagtgttggcgaactttcttttaagtctgaaaaccaagaagagttctggcactctaaccccagtcacctttctctggacctttctggtatcgactcctgcgagatgagcgactccggatcacaagtgcccgattctttaccatcaactccctcaccggtcgagtcaactaaatccttttctgtccattcagaccgcgagagtagcatcacaaatgatatgggcttttctgatgacttttccttgctggagtcgcaggaacggtgtgaggaggagttgttacaactgctcacgcatatccttaattatgtgatgtgcaagggcctggagaagtccgatgatgacacatggatcgagagaggccaggtgttcagcgccctgtccaaaccagggatatcgagcgaattgctccgacctagtgacgaaattaagctgaccttgctccagaagatgctggaatgggctatctcagaaaacagggaagccaaaactaaccctgtcaccgccgagaacgccttccggcttgtactcataatccaggattttctccagtctgaaggactggttaactcaaacatgtggacagaaaaactcctggaggatatgatgctgctgtttgattgtttaagcgtgtgttatagcgagtcgcccgtctgggtgaaactgtcacagatccagattcagttgctcctgggcttcattgggaggggcaacctgcaggtgtgcgctatggcctcggctaagctcaatactctgctgcagacgaaagtgattgaaaatcaggatgaggcctgttatatcctgggaaagttggaacacgtgctgtcacagtcaataaaagagcagacagagatctattcattcttgattcccctggtcaggactctggtgtctaagatctatgagctcttgtttatgaacctgcatcttccctctctcccctttaccaatggtagctctagcttcttcgaggattttcaggagtactgcaacagtaatgagtggcaggtttatatcgaaaaatacatcgtgccctacatgaagcagtatgaggcccacaccttttacgacgggcacgaaaacatggccttgtactggaaggactgttatgaagctcttatggtgaacatgcacaaacgtgatagagaaggcggagagtccaagttgaaatttcaggagctctttgtggagccctttaaccgcaaagcccggcaagagaatttgcggtacaacaacatgctcaagcagctttcttctcagcagctcgccacccttcgtagatggaaagccatacagctctacctgacttgcgagcgcggcccctgggccaaacggaagcagaatcctatccactggaaattggccaatgtggaaaactatagtcgaatgcgcctgaaactcgtcccaaactataactttaagacccatgaagaggcctccgctctccgggacaaccttggtatccaacattcccagccctcgtctgataccctgctgctggaggtcgtgaaacaggtaaaggtttctgacatggttgaagataaactcgacctgcccgaagaggacatcactgcccgtgtaaacgtggatgaaaaagaggaacaggatcagaaggaaaaactggtgttgatggaggactgcgagctcatcacaatcatcgatgtaatacccgggcgcttggagatcactacccagcatatctacttttacgatggtagcatcgaaaaggaggatggcgtcggtttcgatttcaagtggcctcacagccagataagagaaattcatctcagacgctataatttgcgacggtccgcattagaaatctttcacgttgaccagagtaattactttctgaactttaaaaaagaagtcaggaataaaatctactccaggctgctctctctgcattctccaaacagctattacggatcacgctccccacaggaactgtttaaagcgagtggattgacacagaagtgggtcaatagggaaatcagcaactttgactatctgattcaaattaacaccatggcgggtagaacctataacgacctggcacagtaccccgtgtttccctggatactgcaagattacacttctgaagagttggaccttaataatccagccgtattcagagatttgtccaaacctataggcgtcgttaacgagaagaatgcaaaggctatgagagagaagtacgaaaattttgaggatcccatgggaaccattgataagttccattatgggacacattacagcaatagcgcaggggtgatgcattacttaataagagtcgaaccatttaccactctccacatccagctgcaaagtgggagattcgattgcgctgataggcagttccactcaattcccgctacatggcaggccctgatggataacccttatgatgtgaaggaactgatcccggagttcttctatttccccgagtttctggaaaaccaaaaccaatttaacctagggaggctccagatttccaaggaactcgtgaacgatgtgatactgccgaaatgggccaaaagcgcagaagactttatctacaagcatagaaaagcactggagtctgagtatgttagcgcacacctacacgagtggattgatttaatcttcggttataaacaaagaggcccagctgccgttgaggctctgaatgtgttttactactgtagctacgagggcgcagtggatctggacgcgctaaccgatgagaaggaacgaaaggctctcgagggtatgatcaacaacttcggccaaacgccttgtcaactgctaaaggagcctcaccccccacggctgtcggctgaggaggccgttcagaagccaactaagattgacacttctaccctgaatttattccagcacctgcccgagctgaagtcttttttcattgaaggaatcagcgacggaattcccctactcaaggccacgatccctaagaatcagtaccggagtttcatgagtcaaggatcaccggagctcctgatcacaatttccatgaactatgtgattgggacccatggatggcttccttatgacagaaatatatctaactactttacttttatcaaagaccagacggtcacaaacccaaaaacacagcgatccattaatggctccttcgcacccggcctggaaatcacctctaagttattcgtggtgtcccatgatgctaaactactcttctctgctggatattgggacaattcgatccaggtcatgtccctgactaagggcaaaatcatcagccacattatccggcacatggacattgtgacgtgtttggccaccgactactgcggcattcaccttataagtggatcccgcgacactacttgcatgatctggcagatcactcagcagggcggcgtgcctgtgggtctggcgagcaaacctttccaaattttatacggccatactaatgaagtgttgagtgtaggtattagcaccgaactggacatggccgtttcagggagtagggatgggacagtgatcatccatactattcagaaaggccaatacatgcgcacgctccgccccccctgtgagtccagtctgttccttacaatcccaaatttagccatttcctgggaaggacacatagtggtctactcatcaacagaagaaaagacaacactcaaggacaaaaatgccctccatttgtttagcatcaacgggaaatatctggggtctcagattctcaaggagcaggtgagtgacatatgcatcattggtgagcatatcgtgaccggtagtatccaaggatttctttccatacgggacctgcactccctcaacttgagtatcaatcctctggcaatgaggctgccaatccactgtgtgtgcgtgacaaaagaatatagccacatcctcgtcgggcttgaagatggcaaactgatcgtggtgggggtcggtaagccagcagagatgaggtctgggcagctttccagaaaattctggggaagctctaagaggttatctcagatctccgcgggagaaacagaatacaatacccaagattccaaatag

SEQ ID NO: 126129 - DNA, 7713 bp, Artificial Sequence
  Description of Artificial Sequence: Synthetic coding sequence
atggccgcttcagagaggttgtatgagctgtggttgctgtattatgctcagaaggacctgggttatctgcagcagtggctgaaagcctttgtcggcgcctttaaaaagtccatcagcctgagctctctcgaacctagaagacctgaagaggcgggggcagaagtccccctcttgcccctggatgagttgcacgtactggcagaacagctccaccaggccgatttagagcaagccctgctcctgttaaagctcttcattattctttgcagaaacctggaaaatatcgaggctggccgaggtcaagtgttggtacctcgcgtgctagcactcctaacaaagctagtggcggagctgaaaggatgtccacctccccaggggcggggcacgcagctggagaacgtggcccttcatgcactcctgttatgcgagggcttgtttgacccctatcagacctggcgcagacaaaggtccggagaagtgatttcttcgaaagaaaaaagcaagtacaaatttcccccagctgccctcccccaggagttctcagcgttttttcaggagtctctgcaaaatgcggaccacctcccacctattctgctactccggctgatccacctgttttgtgccgtactggctggcggtaaagaaaacgggcagatggctgtgagtgatggaagcgtcaagggcctcctgtcagtcgtgcgaggctggtctcgaggaccagctcccgacccgtgcctggttcccttggccttagaagccctcgtcggagccgtgcatgttctacatgcctcgagggctccaccacggggccctgagctgagggcactgctggaatcctattttcacgtgctgaacgcagattggcctgccggcttatcttccggacccgaagaagctctcgtgacccttcgcgtgtcgatgttggatgccattcctatgatgctggcctgtgaagacaggccagtgctccaggcaaccttcctcagtaataactgttttgaacatctaactcgcctgattcagaattctaaactctacctccagagccgggcacctcctgaaggcgattcagacctggctacacgcctgctcacggagccagacgttcagaaagtgttggaccaggacactgatgctattgcagtgcacgttgtgagggtgctgacgtgcatcatgagtgattctcccagtgccaaggaagtctttaaagaaagaattggttatccgcatctccaagaagtgctgcaatcccatggcccacctacgcataggctgctgcaagaactgctgaatatggctgtggagggcgaccacagtatgtgcccaccaccgccgatcaggaatgagcagccagttttggtcctcgctcagtggcttccctcattgcccacggcagagttacggcttttcttggctcagaggctgcgctggctgtgcgacagctgccccgccagccgggcaacctgtgtccaagcaggcctggtaggctgcctcttagagacactgagcacgggcctggctctggaagcccggtgccaggaacagctcttagccttgttgcaggcgttggggcgggtttcaatccgcccaatggagcttcggcacctactgagaccaagacctggtctcgacagcgaaccaggcggtgcggaggccgggaaggccaggcatgctggtgctgtcattagaactctgagcggcatggcaaggcaccagggccctgcgcgggctttgcgctattttgatctcactccgtcaatggccggcatcatggtcccacccgtgcagcggtggcctggccccggcttcacattccacgcttggctttgcctccatcctatggacactgctccaacccctgccccgactcgacctctgcagaggaaacaactctatagtttcttcacatcctcagggtccggttttgaggctttcttcactgcagcaggtaccctggtggtggccgtgtgcactaggaaggaatatctgactatgtcactaccagaagtctctttcgcagactccgcttggcactgcgtggcaatcgtgcacgtgcccgggcgcaggccgttcagtcagaatctcgttcacgtttataaggacggacatttggttaagaccgcaccacttcgctgcccctctctatccgaacccttttctagctgttgcattggttcggcaggataccgaaccactacgaccacaacaggacttccaacaccccctgtgccagcgaccctcgcttacacgcatcctgccctgacacgtagccagagtgttcccgcttcaacgggcctgggctggggatcggggctggtggcccctcttcaggaaggtagtatcgactccacgctagcggggacccaggacactaggtggggcagcccaaccagcctcgagggggagcttggagcagtggctatttttcatgaggccctgcaggccaccgcactgcgtaccctgtgtaccctcggcccaaacgaaaccgcgcctttcaagccggagggtgagctgcacgaattgagtacacgcctgctgctgcattactcccctcaggcttgtaaaaacaacatctgtctggatctgagtccatcacatggtctggatggtcgtttgaccggacatcgcgtggagacctgggacgtgaaggacgtggtcaactgcgtcggaggcatgggggctttattaccgcttctcgaacgcgtggccgcccaacctaaagaagcagaggctggtcccgccgagacccacgacctggtcggccctgaactcacgagcggacacaacacacagggtctagtgctccccctggggaagagtagcgaagagcggatggaacgaaatgccgtggcagcctttctgctaatgctgagaaactttctacagggccacatggtgaatcaggagtctctggtgcagtgtcagggccctgccatcataggtgctctgctgagaaaagtcccctcctgggccatggacatgaacgtgttaatgtccgctcagctactgatggagcaagtggcggccgaaggctccggcccattgctgtatctcctgtaccagcacctgctatttaacttccatttgtggacactgagtgattttgccgtgagactcggccatatacagtatatgagcagcatcgtgcgagaacacagacagaagcttcggaagaagtatggggtgcagttcattctggacgcgctgaggacacattattcaccacagagggagcgaccgttagctgccgatgatctacgaactgtccagacctcactcctgggactggcaagagagttcctggtcaggtcactgagcgcggatgacgtccaggtcactcagacgatgctgtctttcctggcagccaccggagacgatgggcagatcctccgacgcctgcagcaaaacgagcggctgcccgaaaggagtcgacagcgcctgcgcctcagagagtgtggtttacagggactcgtcgcctgtctgcccgaaggaaccgtttcaccccagctctgccaagggctctacaagctattcttgggtgctggaagcggtaacaccgccggaggaggaggatcctcaggcaccctcaccccagccagccaacccgggaccccaagccctctcgatggacccaggcctttccctgccgcccctgggcgacacagctcctccctgagcaacgtgctggaggacggaagcctgccagaaccgaccatttctggcgacgataccagcaacactagtaatccacagcaaacaagtgaggaagaactgtgtaacctcctaacaaacgtcctcttttcggttacttggcgcggcgtggagggctctgacgaggccgcttggagggagcgtggccaagtttttagtgtgcttacccagctcggggcttccgccacgttagtccggccaccagattgcataaagagaagcctgctggaaatgatgcttgaatcagccctcacagatattaaggaggccccagttggggtgctggccagccttactcagcaggcactgtggctgctgcggctgcttcaggatttcttatgcgccgaaggacacgggaaccaggagctgtggtcagaaaaactgttcgaaggggtgtgtagcctcctggatcggctgggagcctggcctcatctcgctaatgggaccgcagatcttcgcgaaatggcccagatcgggctcagactggtactggggtacatcttgctggaagacccacaactgcacgctcaggcatacgtacgactccatatgttgctgcagacggccgtccctgccagacgagaggaggcttgttatgtgcttagtaagttggaggctgcattaggccgtgtgctgaacacaagctccctggaatctgcaaccgatgaggccgggagtccgctcgccgctgccgctgcagctgccgcggctgaacggtgttcctggctggtccctctggttcgcactctgctcgaccgagcttacgagcctttggggttgcagtgggggctgccctctttgccacccacaaatggtagtcctaccttttttgaagatttccaggccttctgcgccacgcctgaatggaggcactttatcgataaacaggtgcaacctaccatgagtcagtttgagatggatacatacgccaaatcccacgacctgatgagcggcttctggaatgcctgctacgatatgttgatgtccagtgggcagagaagacagtgggagcgagcccaatcacggagagccttccaagagctcgtactggaacctgcccagagaagggcccgtctggaagggctccgttacactgcggtgcttaaacaacaggccacccagcactccatggctctgttgcactggggggccctgtggcggcagctggcatctccctgcggggcctgggccctcagggatactcctatcccacgttggaaactaagttccgcggagacgtattcacgaatgagacttaagctcgtccctaatcatcatttcgatccccatcttgaggcatcagcccttagagacaacctgggcgaggtccctttgacgcctacagaagaggcaagtttacccctggccgttactaaagaagcaaaagtgagtacaccacccgagttgctgcaggaggaccagctgggggaagacgagctcgctgaactcgagacccctatggaggcagctgagctcgacgaacagcgagagaaactggtcctctccgcggagtgtcagcttgtcactgttgttgccgtggttcccggcctcttggaggtgaccacacagaacgtgtacttctatgacggctccactgaacgggtcgaaacagaggaaggaattggatacgacttccgtagaccattagcccaactgcgcgaggttcacctgcggcgtttcaatctccgcaggtccgccctggagctgttttttattgaccaggcaaattacttcctgaatttcccttgcaaagtgggaacaacaccagtgtcctctcccagccagaccccgagaccccagcctgggccaataccacctcatacacaggtgagaaaccaggtgtactcctggttactcaggctgcgtccaccttcacagggttacctgagttctcggtcaccccaggaaatgctgagagctagcggcctgacacagaaatgggtgcaaagggagatttccaatttcgaatacttaatgcagctgaatactatcgctggcagaacttataacgacttatctcagtaccctgtctttccttgggtcctccaagattatgtcagtccgactttggatttgtccaatcccgctgtcttccgcgacctgtccaagccaatcggcgtggtgaatccgaagcacgctcaactggtgcgagaaaaatatgagtctttcgaggaccctgcaggaacgatagacaagtttcactacgggactcactactccaatgcggccggagtcatgcattaccttatccgcgtcgaaccttttacctccctgcacgttcaacttcaatctggacgatttgattgttctgatcggcaattccacagtgtcgcggccgcttggcaggcgagactagagagccctgccgacgtcaaggagttgatccccgagtttttctattttcctgattttctggaaaatcagaatgggtttgacctcgggtgcttgcaactgactaacgaaaaagtgggtgatgtcgtcctaccaccctgggcctcatcaccagaagatttcattcagcaacacaggcaggcactcgagagcgaatatgtttcggcacacctccatgaatggatcgacctcattttcggatataagcaacgtggcccagctgcagaggaggctttaaacgtattctactactgtacctatgagggcgctgtcgacttagaccatgtcacagatgagagagagagaaaagctttagaggggataatctcgaatttcggacagaccccctgtcaactcctgaaggagccccacccaacacgcctcagtgcagaggaggccgctcaccgtctggctagactcgacactaacagcccatctatctttcagcatttggacgagctgaaggcattcttcgccgaagtggtaagtgatggagtccccttggtacttgcactggtgccacataggcagccgcactcatttataactcagggctccccagacctgctggtgacagtctcagcaagtgggttgctgggcacccattcgtggctcccctacgaccggaatatctccaattattttagcttcagtaaggatcctaccatgggatcccacaagacccaaagattattgtctggtccctgggtccccggctcaggagtttccggccaagccttagcagttgcgcctgacggaaaactgctcttctctggcggccactgggacggctcgctgcgagtgacggcccttccaagaggcaaattgctgtcccagcttagttgccacctagacgtggttacatgcctggccttggatacctgcggcatctatctgatctctggatctcgggatacgacctgcatggtgtggagattgctccaccaggggggtctgtccgtagggctagcaccgaaacctgttcaggtattgtacgggcacggagcagccgtgtcctgtgtagcaatctccactgagttagacatggctgtgtccggctccgaggacggaactgtgatcattcacactgtgcgacgtggacagtttgttgccgccttgaggcccctgggagcaacctttcctggacccatcttccatcttgctctcggcagcgagggtcagattgtcgtccagagctccgcatgggagcgcccgggcgcccaagtgacgtattctctccacctatacagtgtcaacggcaagctacgcgcatcactcccactcgcagaacagcctacagccttgaccgtcaccgaggactttgtgcttcttggcactgctcaatgtgcactgcacatcctccagctgaacaccctccttcccgctgctcctcctttaccgatgaaagtggccatccgatctgttgccgttactaaagagcgatcgcacgtgctggttgggctggaggacgggaaactgattgttgtggtggccgggcagccgagtgaagtaagaagcagtcaattcgctaggaagctgtggaggagtagtcgccgaatatcgcaggtctccagcggcgagacggaatacaatcctacagaagccagatag

SEQ ID NO: 126130 - DNA, 1848 bp, Artificial Sequence
  Description of Artificial Sequence: Synthetic coding sequence
atggaaccagctttaggaccaggcgttcagaaagacctcggatacctgcagcaatggctgaaagcgtttgttggagcatttaagaagtcaatttcgctttctagtctcgagccaagaaggccggaagaggctggggcggaggtacccttgttgccactggacgagttacacgtactggctgagcagctgcaccaagctgatctggaacaggctctgcttctgttgaaattattcattatattatgtaggaatcttgagaacatcgaggccgggcgaggtcaggtattagttcctcgcgtcctggccttgctaactaagttggttgcggaactgaaggggtgccctccaccccagggcaggggtacccagctagaaaatgtggcacttcacgctcttttactgtgcgaagggctgttcgacccataccagacatggagacgacagcggagcggagaggtgatctcctcaaaagagaaatctaaatacaagtttcccccagcagccctcccacaggagttctcagccttcttccaggagtctttgcaaaacgctgaccacttgccaccgatattacttctgcgactcattcacctgttctgcgccgtcctcgccgggggcaaggaaaacggccagatggccgtgtccgacgggtcagtgaaagggctactgtccgtggtacggggctggtcccgcggcccagccccggatccttgcctcgttcctctggccctcgaggctcttgttggggctgtgcacgtgctgcacgcctcccgggcccctcccagaggccctgaactgcgggctctgctggaatcttactttcacgtgcttaacgcagattggccagcaggactgtcttccggcccagaggaagcgttggtgacactgcgcgtgtcgatgctcgatgccattccaatgatgctggcctgtgaagacaggccagtgctacaagcaaccttcctaagtaacaactgttttgaacacctgacccggctcatccagaactccaaagttctggatcaggacactgacgctattgccgttcatgtcgtcagagtactgacctgtatcatgtcagacagcccgtccgctaaagaggtgttcaaagagcgcattggttatccccatttgcaggaggttctgcagtcgcacggcccccccacccatcgacttcttcaagaactactcaacatggcagtggaaggagatcactcaatgtgtcctcctcccccaataagaaacgaacagccggtgctggtcctggcccagtggttaccatctttacccacagccgaactgcgtctattcctcgctcagcgcttgcgctggttatgtgacagttgtcctgcatcacgcgcgacgtgtgtccaggcaggcctagtaggctgcctgttagaaaccctgtcgaccggactcgcgctagaggccagatgtcaggagcagcttctggcactactccaagccctgggaagagttagcatccgcccgatggaactgaggcatctgctacgacctaggcccggcctcgacagcgagcccggtggagctgaggcaggcaaagctagacatgcaggtgccgttatccgtaccttgtctggaatggcacgacaccagggccctgcgcgggctttacgctattttgaccttacacccagcatggccggcattatggtgcccccggtccagaggtggccaggtccgggatttacttttcacgcttggttatgcctccatcctatggatacagcacccacgccagcccctcccactctgccatcttccgggataggcggtcggtgctaccctctacgggactggcgagcagaagtgccacctctagcaggctag

SEQ ID NO: 126131 - DNA, 3012 bp, Artificial Sequence
  Description of Artificial Sequence: Synthetic coding sequence
atgtcacagttcgagatggatacctatgctaagtctcatgaccttatgtccggattttggaacgcttgttacgacatgctcatgagtagtggccaacgtcgacagtgggaacgggcacaatcgcggcgggcatttcaggagctcgtgctggaacctgcacagcggcgggctcgcctcgaaggcctgcggtataccgccgtgctgaagcagcaggccacccagcactccatggcacttcttcattggggggccttatggcggcagttggcctctccttgtggtgcgtgggctctgagagacacacccatcccccgctggaagctgtcatccgccgagacctacagccgcatgagactcaagctggttcctaaccatcactttgatccccatttagaggcttcagctctaagagacaacctgggggaggtaccgttgacacctaccgaggaggccagcttgccattggcggtgactaaggaagcgaaggtcagcaccccccctgagttgcttcaggaagatcagctgggcgaggatgagctggcggaactggagacacccatggaagcagccgagctagatgaacagcgcgagaagctagtgctatcagccgaatgtcagttggtgaccgtcgtggccgttgttccaggcttgcttgaggtcaccactcagaacgtctatttctacgacggaagtacagaaagagttgagacagaagagggcattgggtatgactttaggcgacctttagcgcagctgcgcgaagtacacttgagacgattcaacttgcgccgatctgcccttgagctcttttttatagatcaggcgaactattttctcaattttccctgcaaagtcggaaccactcccgtctcctcccccagtcagacgcctcgcccgcagccgggtccgattccccctcacacccaggtaaggaatcaggtgtatagctggcttctgaggctgcgacccccgtcacagggatacctgtccagcaggtccccccaggagatgcttcgggcaagcggcctgacccagaaatgggtgcaacgcgaaatttcaaacttcgagtacttaatgcagctcaacaccatagccgggaggacctataacgatctttctcagtatcccgtgttcccctgggttctgcaggattacgtgagtcctaccctcgatctgagcaaccccgcagtcttccgtgatttgtccaaacctattggcgtggtcaaccctaagcatgcacagctggtgcgagaaaagtatgaaagttttgaagatccagccggtactatcgacaaattccactacggcacacattattctaatgctgccggtgtgatgcattatctgattcgggtcgaaccatttacctcattgcacgtgcagctacagtctggcaggttcgactgctctgataggcagtttcattctgtggccgcagcctggcaggccaggctggagtcccccgctgacgttaaagagctcattccagaattcttctacttccctgactttctcgagaaccaaaatggcttcgatctcgggtgtctgcaactgaccaacgaaaaggtgggagatgtcgtgttgcccccctgggcctcctcccctgaggactttattcaacagcaccgacaagcgctagaatctgaatacgtgtccgcacacttgcacgagtggattgacctaattttcgggtacaaacagcgagggcccgctgccgaagaggcactcaatgtattctactattgtacctatgagggcgccgtcgatttagatcacgtcactgacgaacgagagcgcaaggcgctcgaggggataatttccaattttggccagaccccatgtcaactgctgaaagaaccccatcccacgagactttctgccgaggaagctgcccacagactggcaagactggacaccaattcccccagcatctttcaacacttagacgaactgaaagcctttttcgctgaagtgacagtgtcggcgtccgggctcctggggactcatagttggctgccttatgaccgtaacatctccaactatttctcatttagcaaggatcctacaatgggcagccacaagacccaaaggctgttaagcggcccgtgggttcctggtagcggcgtttctggccaggccctcgccgtcgcccccgatgggaaactcctctttagcggaggccactgggacgggagcctgcgcgtcaccgctttaccacgaggaaagttgctgagccagctcagctgtcatctggacgtggtaacatgtctggccctagatacatgcggcatctacctgataagtgggagtcgcgatacgacttgtatggtgtggcgtcttctgcaccaaggcgggctctcagtcggattggcacccaaaccagttcaggtgctgtatggccatggcgctgccgtatcctgtgtagctatatcgacggaactggatatggctgtttccggaagtgaggacggcacagtaatcattcacaccgtcaggaggggacaatttgttgccgctctcagacccctgggcgctacctttcctggcccaattttccatttagccctggggtcggaaggtcaaatcgttgtacaatcttcggcgtgggaaaggcctggggctcaggtgacttattctttacacctatattccgtcaacggtaaactgagagccagcctcccattagctgagcagcctacggccctgactgttactgaagattttgttctccttgggacagcacaatgcgcccttcacatcctgcagttgaatacactactcccggcagctccccctttgccaatgaaggtggcaattaggtcggtggcagttacaaaggaacggtctcacgtgctggttggtctggaagacggtaagttaatcgttgtggttgccggacaaccgtctgaggtgcgatcctcccagttcgctcggaagctatggaggagcagcagaaggataagccaggtctcttctggtgaaactgaatataatccgacggaggcaagatag

SEQ ID NO: 126132 - DNA, 2094 bp, Artificial Sequence
  Description of Artificial Sequence: Synthetic coding sequence
atgcttcgggcctcgggcctgacgcaaaagtgggtgcaacgggagatctcaaactttgagtatctcatgcagctgaacactatcgccggacggacatataacgaccttagccagtaccccgtttttccttgggtgcttcaggactacgtgtccccaacactcgatctatctaacccagctgtgtttcgagacttaagtaagccaattggggtcgtgaaccctaaacatgcacagctggtgcgggagaagtacgagtccttcgaggatcccgcaggcacaatagacaaattccactatggcacccattacagcaatgcggcaggggttatgcattatctgattagggtcgagccattcacaagtctccatgtgcagctccaaagtggacgttttgattgtagtgacaggcagtttcatagcgtggctgccgcctggcaggcacgactcgaatcgcctgcggatgtcaaggagcttatcccagaattcttctatttccctgactttctcgagaaccagaacggtttcgacctaggatgccttcaactaaccaacgaaaaagtgggcgacgttgtccttcccccctgggcaagttctcctgaagactttattcagcagcacagacaggctcttgagtctgagtacgtttcggcacacctgcatgaatggattgatctgatcttcggctacaagcaacgcgggcccgcagccgaggaggctctgaatgtgttctattattgcacttacgagggtgccgtggacttagaccacgtcactgacgagagagagcggaaagctctggaggggatcatatccaacttcggacagactccgtgccagttactgaaggagccacatcctacgcggctctctgcagaggaggccgcacatcgactggccaggctcgatacaaattctccatcaatcttccagcacttggacgagttaaaagcttttttcgccgaggtggtttctgacggagtgccactagttctggccctggtcccgcatcgccagccacacagtttcatcactcaggggtcgccggacctactggttactgtatcagcatctggcttactaggcactcatagctggcttccttatgacagaaatatttcgaactacttttcattctcaaaggatcctacaatgggatcacacaaaacccaacggctgttgagcggcccgtgggtgccgggaagtggagtgagcggtcaggcactagccgttgcgccagacgggaagttactcttttcgggcgggcactgggatggttcactgcgagtgactgccctacccagaggaaagctcctatcacaactttcatgccacctggacgttgtgacatgtctggcactggatacctgtggaatctaccttatctcgggatcacgggacaccacatgcatggtctggcgactcttgcatcagggcggcctgtctgttggattagccccgaaacctgtccaagtgctctacgggcacggcgcagccgtaagctgcgtcgcaatttccacagaactggatatggccgtgtcaggctccgaggacggtactgtcattatacacaccgtcaggcggggtcagtttgtggctgccctgaggccgctcggcgccacatttccgggaccaattttccacttggcattagggtctgagggacagattgtcgttcagtcttccgcatgggaaagacccggagctcaggtaacatattcactgcatctgtacagcgtgaatggtaagttacgagcctcactgcctcttgccgaacagcccaccgctttaaccgtgacagaagacttcgtactgctcgggacagctcaatgtgccctgcacatcctgcaacttaacacgttgcttcctgcagcgcctccactgccaatgaaggtcgccattaggtccgtggctgttactaaggagagatcccatgtcttagtggggctcgaagacggaaagctcatcgtggtggttgcaggccagccgagcgaagtgaggagttcacagtttgctcggaagctctggcgctccagcaggaggataagccaagtgagctccggcgagactgaatacaatccaacagaggccagatag

SEQ ID NO: 126133 - DNA, 8265 bp, Artificial Sequence
  Description of Artificial Sequence: Synthetic coding sequence
atggcggcatccgagcggctctacgagttgtggctgctctactatgcacagaaggatctcggttatctacagcaatggctgaaggccttcgtgggcgcttttaaaaagagcattagcctttcatccttggaaccaagacgcccagaagaagccggcgctgaagtgcctctcttacccctggatgagctgcatgtcctcgccgagcaattgcaccaggctgatctggagcaggctctcctgctactcaaactcttcatcattttgtgtagaaacctggagaacatagaagcaggccgggggcaggtgttggttccacgggtgttggctctcttgacaaagctggtggccgaactgaaaggctgtcctccaccccaaggcagaggtacccaattagagaacgtggctctccacgcactgctcctgtgtgaaggtctgtttgacccataccaaacctggcggcggcagcgtagtggtgaggtgatttcgtccaaggagaagtccaaatacaaatttccccccgctgccctcccccaagaattttcggccttttttcaagagagcttgcaaaatgccgatcatctgccccccattctcttacttcggttgattcatctattctgcgcggtgttagcaggtggcaaggaaaatggacagatggctgtgtcagatgggtccgtcaagggcctgctttccgtggtccgcggctggagtaggggacccgcaccagacccttgccttgttcctctggctctggaggccctggttggagcagttcatgtgctgcatgcttcaagagccccccctcgggggccagaattgagggctctgcttgaatcatacttccacgtgctcaatgctgactggcccgccgggttgagctcaggacctgaggaggcgctggtgaccctgcgggttagtatgctagacgccatacccatgatgctggcctgcgaggatagacccgttctccaggctacattcctatctaataattgctttgaacatctcacgagattaattcagaactcaaagttgtatctccagagtagggcaccacccgagggggacagcgacctcgccactaggttactcaccgagcccgacgtgcagaaggtgctggatcaggatacagacgcgattgcagttcacgtggtacgggttctgacctgtattatgtctgacagcccaagtgcaaaggaagtctttaaggaacggattggataccctcaccttcaggaggttctgcaatcccacggcccacccacgcaccgcctgctgcaggagctgttaaacatggcagttgaaggtgaccattctatgtgccctcctcctcccattcgcaatgagcagccggtgttggtcttagcccaatggcttccgtccttaccaactgccgaactgagactctttttggctcagaggctccgctggctctgcgacagctgtccggcatcccgtgccacatgcgttcaagctggcctggtgggctgccttctggaaaccctgtcgactggccttgcacttgaggccagatgtcaggaacaactcctggctttgctccaagcgcttggacgcgtgtcaattcgacctatggagttgcggcatctgttgaggccaaggcccggccttgactccgagccaggaggggctgaggcggggaaggcccgacacgcaggagctgtgattcggacattatccggaatggcgcggcaccagggacccgcgagggccctccggtactttgacctgaccccctccatggcaggaatcatggtccctcctgtccagcggtggcccggacccggctttaccttccacgcatggttgtgtctgcacccaatggataccgccccaacgccagccccaactcggcccctgcaacgcaagcagttatactcctttttcacttcttctgggagcggctttgaggcgttttttacggcggccgggacactcgttgtcgctgtgtgcacaagaaaggaatacctgaccatgagcctacccgaggtttctttcgcagatagtgcatggcattgcgtggctatcgtccacgtaccgggtagaagaccgttttctcaaaacctggtgcatgtgtataaagatggacacttagtgaaaaccgctcccctcaggtgccccagcctgtccgaaccttttagtagctgttgtatcggtagcgcaggttataggaccaccactacaacgaccggactccctacacccccggtgcccgccacattggcctacacccatccagccctaactaggtctcagtccgtccccgcatccacaggcctaggatggggatccggactagtggcacctctgcaggagggatctatcgattctactctggccggaacacaagacacccgatgggggagccccacctcactggaaggggagctgggcgctgtggctatttttcacgaagccctgcaggccacagctctgagaactctgtgtacattaggaccaaatgaaaccgctccctttaaacctgagggggagctgcacgaattgtctacgagacttttgctgcattatagccctcaggcgtgcaagaataatatttgcctcgatctgagcccctctcacggactagatgggcgcctcacaggccatcgagttgaaacatgggacgtgaaggacgtggtgaactgcgttggaggcatgggagccctcctccctttacttgagagggtagctgcccaacctaaagaggcggaggcagggcctgctgagactcatgatctggtggggcccgaactgacaagtggacataatactcaggggctagtgctgccactgggcaaaagcagcgaagagcggatggaacgcaacgcagttgccgcattccttcttatgctccgcaactttctacaaggtcacatggtgaatcaggaaagcctggttcagtgtcaggggcctgcaattatcggggcgcttctgcgaaaggtcccttcctgggccatggatatgaatgtgctaatgtccgcccaactgctcatggagcaagtcgccgcagagggctctggaccactgctgtatctgctgtaccaacatcttcttttcaatttccatctgtggacacttagcgacttcgccgtgcgcctgggccatatccagtacatgtcctctattgtgcgcgaacacaggcagaaactgcgcaagaaatacggagtgcagttcatccttgacgccttgcggacccactattccccccagcgggagcggccgcttgcagccgacgatcttagaaccgttcagacttcactgctggggttagcacgggagtttctggtaaggtctctgagcgccgatgatgtgcaggtcacgcagactatgctgagcttcctggccgctacaggagatgacggccaggctgtcggtgccctcgacttactgctagcgctgctgcatgggtcgctcgttcaggagtccctcgccgtttttttgctcgagcctgggaatctcgaagtgttgctcgcgctccttgtgcgccccggctcccttcccctattgcccgacagagtgtgtaagatccttcgccgactccaacagaacgaacggcttccggagcgctccagacagagacttcgcctgcgggagtgcgggctgcagggtcttgttgcttgtctaccagaaggtactgtgtctcctcaactgtgccagggactgtacaaactgttcctcggtgccgactgcctgaatctctccgatctcctggccgtggttcagttgtctctgcaggccgaccttagtgtccggctggacatttgccgccagttattccatctcatctacggccagccagacgtggtacgtcttctggcccgccaagccggctggcaggatgttctgactagactgtacgtgcttgaagccgcaacggccggctccccccccccttccagtcccgagagtcccacctcccctaagcctgcaccacccaaacctcccaccgagagtcccgcagagccttctgacgtgtttttaccaagcgaggctccttgccccgaccccgatggcttttaccatgccctgagtccattctgcactccctttgaccttggactcgagcgaagtagcgtaggatccggaaatactgccggaggcggtggatcttcaggcacactgacacccgcctcacagcccggcacccctagccctctagacggccccagacccttcccagcggcccctggccggcactccagctccctgtctaacgtgctggaagatggctccctgcccgagcccactatttcaggagacgacaccagcaataccagcaacccacagcaaacgtctgaggaggagctctgtaacctcctgaccaatgtgcttttttcagtgacctggcgcggagtcgagggaagcgatgaagccgcctggagagagcggggacaagtgttcagtgttctgacccagcttggggcatccgccacattagttaggccgccagactgtatcaagaggtccctgttggaaatgatgttagaatcagccctgactgacatcaaggaggcccccgtcggagtcttagcttcactgacccagcaagctctctggctcctgagattactccaagacttcctatgtgccgaaggccacgggaaccaggaactatggtcggaaaagttattcgaaggcgtctgcagcttgttagatagactcggcgcctggccgcatttggctaatgggaccgcagatctgcgagagatggcacagattggccttcggctggtgctcggctatatccttctggaagaccctcaactccacgcccaggcctacgttcgcctgcatatgctgcttcagaccgccgtgccggcaagacgggaggaagcttgctatgtgctgtcaaagttggaggccgcgctcgggcgcgtgttaaacacctccagcctcgagagtgctaccgatgaggccgggtcacctttagccgctgcggccgcagctgccgctgccgaacgctgcagctggttggtgccgttagtgcgaactctgctcgacagagcctatgaacccctggggctacagtggggacttccatctctcccccctacaaacggttcccctacctttttcgaagacttccaagccttctgcgctacaccagaatggcggcactttattgataagcaagtgcaaccaacaatgagccagtttgagatggatacctatgcgaaatcgcatgacctgatgagtggtttttggaacgcgtgctatgatatgctcatgtcctcaggccagcgacgacaatgggaaagagctcagtcgagaagggcattccaggaactcgttctggagccagctcaacggagagctaggcttgaggggctgagatatacggccgtactcaaacagcaggcaacacagcattctatggcactcctccactggggggctctttggcgtcagttggcctctccatgtggtgcatgggccctgcgtgatacacccatacctaggtggaaactgagctccgctgagacctactcacggatgaggctgaaactggtccccaaccatcactttgacccccaccttgaggcctcagccttacgagacaacctgggcgaggtaccacttacccccaccgaggaggcgagtttgcccctggctgtgacaaaggaggccaaggtgagcaccccgccggaattacttcaggaagatcaattgggtgaagacgaactggccgaactcgaaaccccaatggaggcagcagaactggatgaacagcgagagaagctggtgctttctgccgagtgtcagctagtgaccgtggtggctgtggtgccaggacttcttgaagtaacaacacagaacgtctacttctatgacggttctaccgagagagtggaaactgaggagggaattggctacgattttcgacggcccctcgcccagctgcgggaagtccatctgaggaggttcaaccttcgtaggagcgcgttggaacttttcttcattgaccaggccaactattttcttaacttcccctgcaaagttggaactacccctgtatcaagcccatcacagactccaagacctcagcctggccccattccacctcatactcaggttcggaaccaagtgtatagctggcttctcaggctgcggcccccaagccaggggtatctctcctctcgatccccccaggagatgttgagggccagcgggctcacccagaagtgggtgcagcgagaaatctcgaacttcgaatacctcatgcagctgaacaccatagctgggagaacctacaacgatctttcacagtacccagtgttcccttgggtgctgcaggactacgtctcccccactctcgacctgtctaatcccgccgtgtttcgagatctgagtaagcccatcggtgtggttaatcccaagcacgcgcagttagtgcgcgagaaatacgagagttttgaagaccccgctggaaccattgataagtttcactatggtacgcattactctaatgctgcaggagtgatgcattatctaatccgcgtcgagccattcacctcgttgcacgttcagttgcagagcggccgcttcgattgcagcgatagacagtttcacagtgtagctgcggcttggcaggcgcggctggaatcgccagcagacgtgaaagaactaattccagaatttttttatttcccagacttccttgaaaatcagaacggatttgacctgggctgtctacagctgacaaatgagaaagttggtgatgttgtgctacccccttgggcatcaagccccgaagacttcatacaacagcaccgccaggccctcgagagcgagtatgtgtccgcgcacctccacgaatggattgatctgatttttggctataagcagcgagggcctgccgctgaggaggcgctaaacgtattctattattgcacttacgagggtgccgtcgatttagaccacgtgactgacgagagagagagaaaagcattggagggtataattagcaactttggccaaacaccttgccagctcctgaaggagccacacccaacccgtctgtccgccgaggaggcagctcatcgcctggcccgactggacactaattctccctcgatttttcagcatctcgatgaactgaaggccttcttcgcagaagtcgtctcggacggggtgccactggtgctagccctcgtgccccataggcagccccattcattcattactcagggctctcctgacctgttagtcaccgtctctgcctccggattacttggtacccacagttggctaccctacgaccgcaacatctccaattacttcagtttttcaaaggacccaacaatgggctcccataagacccagcgactgctgagtgggccatgggtgcccggtagcggagtcagtggccaggcactggcggtagctcccgatggtaagctgctgtttagcggagggcactgggacgggagcctgagggtaaccgccctgcctaggggaaaattgctaagtcagttgtcctgccatttggatgtggtaacttgcctggcattagacacgtgcggaatttacctgatttcgggctcccgggacacaacctgcatggtgtggaggttgttgcaccaaggaggcctctccgtcggcttggcacccaaacccgtgcaggtcctctacggccatggagccgcggtgagttgcgtggcaatctcaactgagctggatatggctgtttctggatcagaggatgggaccgtgatcatacataccgtacgtcgcgggcagtttgtggccgccctgagaccactgggcgcaacatttccaggacccatcttccatcttgccctcggcagtgagggacaaatcgtggttcaaagtagtgcctgggagcgcccgggcgctcaagtgacctactccctgcatctgtacagcgtgaacgggaaactgcgggcaagtttgcccttagctgagcagccaactgcactgaccgtaaccgaggacttcgtgctattaggcaccgctcagtgcgcactgcacatcctgcaactgaataccttgctgccggccgccccaccactgccgatgaaggtcgcaatccgatccgtagcggtgactaaggaaaggtctcatgtgctcgtcggactggaggatggtaagctgatagtcgtcgttgctgggcagcccagtgaggtgcggtcctcacaatttgcccggaagctgtggaggtcttctcgccggatctctcaagtttccagcggagagacagaatacaaccctacagaggcacggtag

SEQ ID NO: 126134 - DNA, 7116 bp, Artificial Sequence
  Description of Artificial Sequence: Synthetic coding sequence
atggccgcacccgagtcgggtccagccctctctccagggacagccgagggggaggaagagacaattctttatgatttgctggttaacaccgaatggcccccagagactgaggtgcagccaagagggaatcagaagcacggggcttccttcattattacaaaggctatccgcgatcggttgctgtttttgcgccagtatatatggtacagcccggctcccttcctcctgcccgatggtctggtccgcctcgttaacaaacaaattaattggcacctggttctggccagcaatggcaaactgctcgcagccgtccaggaccaatgcgtggagatccgatccgccaaggacgattttacaagtatcattggaaaatgtcaggttcccaaagatccaaagccacaatggcgccgtgtagcctggagttatgactgtacactgcttgcctatgccgagtctacgggaaccgtgcgggtatttgatctgatgggttcagagctgttcgtaatttccccagcatcgtcattcattggcgacttaagctacgcgatcgccggactgatattcttggagtataaggcaagcgcccaatggagcgctgagctactggtgattaattataggggggaactcagatcctatcttgtatcagtgggaacgaatcagagctatcaagagtcccactgcttctcattctctagtcattacccacatggcatcaacaccgcgatctaccacccgggccatcggctgctgctcgtaggagggtgcgaaaccgctgaggtgggcatgtcgaaagcatccagttgtgggttgtccgcttggcgagtgctaagcgggtcaccgtattataagcaggttaccaacggtggggacggtgtgactgccgtgcccaaaactttgggtctactgaggatgctaagcgtcaagttttattctcgccagggacaagagcaggatggtatattcaaaatgtctctttccccagatggaatgctgttggctgcaattcatttcagcgggaaactgagtatttgggctatcccctctctgaaacagcagggggagtggggccagaatgagcaacccgggtacgacgacctgaacccagattggcggttaagcaccgagaagaggaaaaagattaaggataaggagtcattttaccccttgatcgacgtgaactggtgggccgacagcgcggtgacactcgcaaggtgctcaggggccctgaccgtgagttctgttaaaacattaaaaaacctcctggggaagagctgtgagtggttcgaacccagccctcaagtgacagcaacgcacgatggcgggttcctgtcactggagtgcgagatcaaactcgcgcctaaaaggagcaggcttgagaccagagcgggtgaagaggatgaaggagaggaggattctgattccgactacgaaatcagcgccaaggccaggtattttggttatatcaagcaaggcctgtacctggtcacggaaatggagaggtttgctccgccccgtaagcggccgaggacaatcacaaaaaattacaggctcgtgtccctccgtagcaccactcctgaggaattgtaccaaagaaagatagaaagcgaggagtatgaagaggctctaagcctggcccatacatacgggttggataccgatctcgtgtatcagagacaatggagaaagagcgctgttaatgtggctagcatacagaattacttgagtaaaatcaagaagagaagctgggtgctgcacgaatgcttagagcgggtgcctgaaaatgtcgatgcagcaaaggagctgcttcagtacggactgaaagggaccgacctcgaagcacttctcgctataggcaaaggggcggatgatggtagattcactctgcccggcgagatagatatcgacagtatctcttatgaagaactgagtccccctgacgaggaacccgcaaagaacaaaaaggagaaagaactgaaaaaaagacaggagctgctcaagctggtgaacttttcaaaactcacgctggaacagaaagaactttgccgctgtcgccggaagctcctgacatacctggataggcttgctacatatgaggaaatactgggcgtcccacacgctagcgagcagcggtacgacgccgagtttttcaagaaattcaggaaccagaatatcgtgctaagtgcaaggacctatgctcaggagagtaacgtgcaagccctcgagatattgtttacctaccatgggtccgacctgctcccacatcgtctggctattctctccaactttcctgagacaacttctccccacgaatattcggtactgctgccagaggcctgttttaacggcgactctctgatgatcatcccatggcatgagcacaagcatcgggcaaaagactggtgcgaggaactagcgtgccggatggtggtggagcctaatctccaagatgagagcgagttcctctacgctgcccagcctgaactgcttagattcaggatgacacagctcactgttgagaaggtgatggattggtaccagacgcgcgccgaggagattgagcattacgccaggcaggtcgactgcgccctttctcttatacgcctcggcatggagaggaacatcccaggcttgctggtgttatgtgataacctggtcaccctggaaactctggtctacgaggcacgttgtgacgtgacccttacattgaaggagctccagcagatgaaggacattgagaaactgcggcttctcatgaatagctgttcagaggacaagtacgtgacgtccgcataccagtggatggtgccttttcttcataggtgcgagaagcagtctcccggtgtagctaacgaacttctgaaggagtatttagtgactttggctaaaggcgatcttaagtttcctctcaagatatttcagcatagcaagccagacctgcaacagaaaatcattcccgatcaggaccagctaatggcaatcgcgctggagtgcatttacacctgtgaaagaaacgatcagttgtgcctgtgttacgatctgctggaatgtcttccggaacgggggtatggagacaagacggaggcaacaactaaacttcacgacatggtggaccagcttgagcagatcctgtctgtttccgaattactcgaaaaacacggcctggagaaacccatatctttcgttaagaatacacagtcatcctccgaggaagccaggaagttgatggttagactgaccagacacactggaaggaaacagcctcccgtcagtgagagccattggcgcacgctcctccaggatatgctgactatgcagcagaatgtctacacttgcctggacagtgacgcctgttacgaaatattcacagaatcactgctatgtagtagccggctcgagaatatccacctggccggccaaatgatgcattgtagcgcttgctccgagaatcctccagccggtattgcccacaagggcaagccacactaccgtgtcagctatgaaaagtcaattgacctggtcctggcagcaagcagagaatatttcaactctagcactaatctgaccgattcatgcatggacctagcacgttgctgtctgcaactgatcaccgaccgaccaccagcaatacaggaggaacttgatctgatccaggccgtgggctgtcttgaggaattcggggtgaagattttgccattgcaggtaagactctgccctgatagaatctcgctgattaaagaatgcatctcccagagtcctacatgctataaacaatccaccaaattgctgggattagctgaactgctgcgggtagcgggcgaaaatcctgaggagaggaggggacaggtcctgattctgctggtcgaacaggccttgcgctttcatgactacaaagctgccagcatgcactgtcaggagttgatggccacgggctacccaaagagctgggacgtgtgttctcaactcgggcagagcgagggatatcaggatttggctacgcgacaagagttgatggctttcgccttgacccactgtccaccaagtagcattgaactgttgctggctgctagcagctcactccagacagaaatcctttaccaacgggtgaattttcagatacaccacgaaggcggggagaacataagtgccagccccttaacttccaaggcagttcaggaggacgaggtcggtgtgccaggaagcaacagtgccgatctcctccgttggaccactgctaccacaatgaaagtattatccaataccacaaccacaacaaaagccgttcttcaagccgtgagcgatggtcagtggtggaaaaagtcgttgacttacctgcgtcctctccaaggacagaaatgcggtggcgcgtatcagatcggcacgacagcaaacgaggacctggaaaagcagggctgtcaccccttctacgaaagcgtgatctcaaacccattcgtggccgagagcgaggggacttacgatacttatcagcacgtgcccgtggaaagttttgcagaggtgcttttgaggaccgggaagctcgctgaagccaagaataaaggcgaggtattcccaactacggaagtcctgctccagctggcctctgaggctcttccaaatgacatgactttagccctcgcctatctgctggccctcccacaagttctcgatgctaatcgatgttttgaaaagcagagccccagcgcactgtcactgcaactggccgcttattattactctctgcaaatttatgcacgtctcgccccatgctttcgcgacaagtgccacccgctttaccgcgccgatccaaaggagctaattaaaatggtgacacggcatgtcacaagacatgagcatgaagcttggccagaggacctgatctctctaacaaaacagttacattgttacaatgaacggcttctagatttcactcaggcgcagatacttcagggtctgaggaaaggcgtggacgtgcagagattcactgccgacgaccagtataaaagagaaaccattttgggactggcagagaccctggaagagtcggtttacagcatcgcgattagcctagcacagaggtactcagtgtctcgctgggaggtcttcatgacccacttggaattcttgtttacggacagcggtctcagtaccctggagatcgaaaatagagcccaggatctgcacttgttcgagacactcaagactgaccctgaggcattccatcagcatatggtcaaatacatctaccctactattggtgggttcgaccatgaacgcttacagtactactttacactcctcgagaactgcgggtgtgccgatctgggtaactgcgctattaaaccggagacccatataagactccttaagaaatttaaggtggtcgccagcggattgaattacaaaaagctaactgacgaaaacatgagtcctcttgaggctttagagccggtcctgagcagccagaatatcctgagtatttcaaaacttgtgcccaaaatccccgagaaagacggacagatgctctctcccagtagcttgtacaccatttggctgcagaaactgttttggaccggcgatccgcatcttataaaacaagtgcccggaagtagcccagagtggctgcacgcctatgacgtatgcatgaagtattttgaccgcctgcacccaggtgatttgatcactgttgttgatgccgtgaccttctctcccaaggcagtgacaaagctctcggtggaagcacgaaaggagatgacacggaaagcaatcaaaactgtgaagcatttcatcgaaaagccaagaaaaagaaattctgaggacgaggcacaggaagccaaggattctaaagtcacctatgcggacacacttaatcacctggaaaaatcactcgcccacctcgagacgttgtcccacagcttcatcctgagtttaaaaaacagtgagcaggagacactccagaaatattcacatctatatgacctgagtcggtccgaaaaggagaaacttcatgatgaagccgtcgccatttgcttggacggtcagcccctcgcgatgatccagcagctgctggaggtggccgtcggaccactcgacatctccccaaaggatatagtgcagtctgccattatgaaaattatctcagcgctgagcggaggctcagctgacttaggtggccccagggacccactgaaggttttggagggagtggtggccgctgttcatgcttccgtcgacaagggcgaggagctggtgtcgcctgaagacttacttgagtggttaagaccgttttgtgcagatgacgcttggcctgtgcggccacggattcatgtgctgcagatcctgggccagtctttccacctcacagaggaggactccaaattactggtttttttccggaccgaggctattctcaaggcctcatggccccagagacaggtcgatatcgccgatatagaaaacgaagaaaaccgctattgtttgttcatggagctgctagaatccagtcatcacgaggcggagtttcaacatctcgtcctactccttcaggcttggccaccaatgaagtcagaatacgtcatcacaaataatccttgggtacgcctcgcaaccgtgatgttgacccgctgtacaatggagaataaagagggtctggggaatgaggtgctcaaaatgtgccgaagcctctataatactaagcagatgctccccgccgagggagtcaaagagctgtgtttattactcctcaaccagagtttgctcttgccatctctgaagctcctactcgaatcccgcgacgagcatctgcacgaaatggccctcgaacagatcactgccgtaacgactgtgaacgattctaactgcgaccaagagctgctgagtttgcttctcgacgcaaaattgctggtgaaatgcgtttctactcctttctacccccgcatcgtagatcacctcctggcatctttgcagcaggggaggtgggacgctgaggaactgggcagacacctgagagaagctggccacgaagctgaggcgggaagtctcttgcttgccgtccgtggcacacatcaggccttccgcactttcagcacagcattgcgagctgctcagcactgggtttag

SEQ ID NO: 126135 - DNA, 6756 bp, Artificial Sequence
  Description of Artificial Sequence: Synthetic coding sequence
atggccgcccctgagtctggcccagccttgtctcccggaacggccgaaggcgaggaagaaactattctttacgatctactggtcaacactgagtggccgcccgagacagaagtgcagcctcgagggaatcaaaaacacggggcatcttttatcataactaaggcaatcagggaccgcctcctgttcttgaggcagtatatttggtatagcccagctcccttccttctccctgatggactcgtgagactcgtgaataaacaaataaactggcatctggtactagcatccaacggaaaacttctggcagctgtgcaggatcagtgtgtcgaaattaggagcgcaaaagacgactttacttctataattggaaaatgtcaggtccccaaagatcctaaaccccaatggaggcgcgtggcatggtcttatgactgcactctcctcgcatacgccgagagcacaggaacagtgcgtgtattcgatctgatgggaagcgagctgttcgtcattagtccagcctctagtttcatcggcgacctcagctacgccatcgctggcttgatctttttggagtacaaggcaagtgctcaatggagcgccgagcttcttgtaatcaactataggggtgaactgcgcagctacctggtctcagtgggcacaaaccagtcataccaggagagtcactgtttttcattctccagtcactatccccatggaattaacaccgcaatttaccacccgggccaccgactgctgctcgtcggcgggtgcgaaaccgccgaagtgggcatgtcgaaagcctccagctgcgggctgagcgcctggcgtgtgcttagcggctccccctactacaagcaggtcaccaatggaggtgacggggtgaccgcagtccccaaaaccttggggctgctacgcatgctctccgtcaaattttacagcagacaggggcaagagcaagatggcatcttcaagatgtccctatctcctgacggcatgctgttggctgcaattcacttttcaggcaagctgtccatttgggccattccatctcttaaacagcagggtgaatggggccagaatgaacagcccggatacgatgatctcaatcctgattggaggttatctactgaaaagcggaaaaagattaaagataaggagtctttctatcctttgatagatgtaaactggtgggctgacagcgcagtgactctggcaagatgcagtggggcactcaccgtttctagcgttaaaactctcaaaaacttgctcggcaagagctgtgaatggtttgaacctagccctcaggtgacagctactcacgacgggggattcctcagcctggaatgcgaaatcaaactcgccccgaaacgcagtaggctggagacccgtgccggtgaagaggatgagggagaagaagattctgattcagactacgagattagcgccaaagcgcgatactttggctatattaaacaagggctttatctcgtcacagagatggagcgctttgcccctccccgaaagagaccgcgcaccatcaccaagaattaccggctagtcagcctgaggagcacaacgcctgaagaattgtaccagagaaaaattgaaagcgaagaatacgaggaagcccttagtttggcacacacatatggcctggatacggatctggtataccaaaggcaatggcgtaagagtgcggtgaatgtggcctctatccagaactatctgtccaaaatcaagaagcgcagttgggtgctgcatgagtgcctggagcgcgtcccagagaacgtcgacgccgcaaaggaactgctgcaatacgggctgaaaggcaccgatctggaggcgttacttgcaataggcaaaggagcagacgatggtagattcacactgcctggcgagatcgatatcgattcaatctcatatgaggaactgtccccccccgacgaggaacccgccaaaaacaagaaagaaaaagagctgaagaagcgtcaagagctgctaaaactggtgaatttttcaaaactaacactggagcaaaaagagttatgtcgttgcagaagaaaactgctaacgtatctggatagactggccacatatgaagagatcctcggcgtgccccacgcatccgaacaacgatacgatgctgaatttttcaagaagttccgaaaccagaacatcgtcttgtcagcgagaacctatgcacaggaaagtaacgtacaggccctggagatcctgtttacctaccatggctcagacctactcccacaccgcttggctatcttgagcaacttccccgagactacctctccccacgagtattcggtcttgcttccagaagcctgcttcaatggcgatagcctgatgataataccatggcacgaacacaagcacagagccaaggattggtgtgaagagttagcctgccgaatggtggtggagcctaacctgcaagacgaatcggagtttctgtatgccgctcaaccggagctgctccgattccgtatgacgcagctcacggtggaaaaagtgatggactggtaccagaccagggcggaggagatagagcattacgcacggcaactacaacagaagattattcctgatcaggaccaactgatggcaatcgcccttgagtgcatctacacgtgcgagcgcaacgatcagctgtgtctatgctatgatcttctcgaatgtctccccgagcgcgggtatggagataagacagaagccactacaaaactgcatgacatggtggatcaattggagcagattctatccgtctctgagctcctggagaagcacggacttgagaaaccaatttccttcgtcaaaaacacgcagtcctcaagcgaggaggccagaaagctgatggttaggcttacaagacacacagggcggaaacagcccccagtcagcgaaagtcactggcgtactctgttgcaggatatgcttaccatgcagcagaacgtgtatacctgcctcgattcagacgcctgttatgaaatttttaccgagagtcttctgtgtagtagccggctggagaatatccacctggccggccagatgatgcattgctctgcatgcagcgagaatccaccggctgggatagcccacaaaggtaagcctcactatcgcgtctcatatgagaaatccatcgacctagtgctggccgcgtcccgcgaatacttcaattcctcaacaaacctcaccgactcctgtatggacctcgccagatgctgcctgcagttaattaccgatcgtcccccagccattcaggaggagctggacctcatccaggcagtcggatgcctagaggaatttggagtcaagatcctgcctctgcaagtacggctctgcccggatcgcatttctctgatcaaagaatgtatctcccagagccctacttgttataaacagtctacaaaactgctgggcctggccgagttactgcgagtggccggagagaatcctgaggaaagacgcggccaggtcctcatcctgctcgttgaacaggccctaagattccatgactacaaagctgcatccatgcactgccaggagctgatggccacaggctaccctaaaagttgggatgtatgctcacagttgggacagtcggagggctatcaggatctcgcgacgagacaggagctgatggccttcgccttgacgcattgccctccctcatctattgaactcctgctcgccgcctcctcctcactacagactgaaattctctatcagcgagttaactttcagattcatcatgaggggggagaaaacatctctgcctccccacttacaagcaaggctgtgcaggaggatgaggttggggtccccggcagcaactccgctgatctgttgcgatggacaactgccacgactatgaaggtgttgagtaataccactacaactaccaaggctgttttgcaggcagtgtccgatggacagtggtggaagaagagtctgacttatcttagacctttgcagggccagaagtgcggtggcgcgtaccaaatcggaaccacagctaacgaagacctcgaaaaacagggatgtcaccccttctatgaatctgtgatatctaaccccttcgttgccgagagtgaaggtacctatgatacttaccaacatgtgccagtagaatctttcgcagaggtcttgctgagaactggcaagctagctgaggctaaaaacaaaggtgaagtgttcccaactacagaggttcttctgcagctggccagtgaagccctgccaaatgatatgaccctcgccctcgcttacctccttgcactgccacaagtgttggatgcaaaccgatgtttcgagaaacagtcgccgtcagctctatctctacaactggctgcctattactactcactgcagatctacgcccggttagcaccctgtttcagagacaagtgccatcccctgtacagggcagatccgaaagagttaattaaaatggtaacacgccacgtgacgaggcatgagcacgaagcctggccggaagatctgatatctttgactaagcaattgcactgctataatgagcggcttttagatttcacgcaggcacaaatactgcaagggctgcgtaagggcgtcgacgtacagagattcaccgcggatgatcagtacaaaagagaaacaatcttaggactggcagagacactagaggagtccgtttattcaatcgcgatctcactcgcgcagaggtactccgtttcccgatgggaggtattcatgacccacctcgaatttctgttcactgacagtggactgtcgaccctggaaattgagaacagggctcaagatctgcacctatttgagactcttaaaactgaccccgaggcttttcatcagcacatggtaaaatacatctatcccacaatcggtggtttcgatcacgaaagacttcagtattacttcaccctccttgagaattgtggatgtgcggacttgggaaactgtgccataaaaccggaaacccatatcaggctactgaagaagtttaaggtggtggcatccgggttgaattataagaagctgaccgatgaaaatatgtccccgttggaagccttggagccagtcctcagtagccagaacatcctctccatctctaagttggtcccaaagatccctgaaaaagacggccagatgttgtcgcctagctctctttataccatctggcttcagaaattattctggaccggggatccccacctgatcaaacaggttcctggctctagtccagagtggctgcacgcttacgatgtgtgcatgaaatacttcgacagactgcatccaggcgatctgatcaccgtcgttgatgcggtgaccttttcacctaaggccgtcaccaaactgagcgttgaggctcggaaagaaatgacacgtaaggcgattaagacagtgaaacattttattgaaaagccacgaaagcgtaactcagaagatgaagctcaggaggccaaggattccaaagttacatacgcggatacactgaatcatctggagaaatccctcgcacacttggaaaccctgtcccattcgtttattctgtccctgaagaatagtgagcaggagactctgcagaaatattctcatctttacgatttatctagatccgaaaaagaaaaattgcatgatgaggcagtggcgatctgcctggacggccagcctcttgcaatgattcagcagttactggaggtggctgtcggtccattagacattagtcccaaagacatcgtccagtctgcaatcatgaaaattatttcagctctgtccggaggttcagcggatctgggtggtccccgcgacccacttaaagtgttggagggggtcgttgctgctgttcacgcatccgtggataagggggaggagttggtgtcacccgaagacctactagaatggctccgacccttctgtgccgatgacgcttggccagttcgcccccggatacacgtgcttcagattctcgggcaatccttccacctgactgaagaggatagcaaactcctcgtgttcttcagaaccgaggccatcttgaaagctagctggccccaacgacaggttgacattgctgacatcgagaatgaagagaaccgatattgcctttttatggaacttctggagtcttctcatcacgaggcagaattccagcacttggtgctccttctacaggcttggcccccgatgaagagcgaatacgtcataaccaacaacccatgggtacgcctggctacagtcatgctgacaaggtgcacgatggagaacaaagagggccttggcaacgaagtgttgaagatgtgtcggagtctctacaacaccaagcagatgctgcccgctgaaggggttaaagagctgtgtctcctgctgctgaaccagagcttacttctgcccagtctgaagctgttgctagaatccagagatgaacatctgcacgagatggcccttgagcaaattaccgctgtgactaccgtgaacgacagtaactgtgatcaggagctcctgagtctgctccttgacgctaagctgctggtaaagtgtgtttccacccctttctaccctcggattgtcgatcatttactcgctagcttgcagcaaggtaggtgggacgcggaggaactggggcgtcatctcagagaagcaggccacgaagccgaagctggatctctgctgctggccgtgcgcggaacccatcaggccttcaggaccttctccaccgctttgcgcgctgcccaacactgggtctag

SEQ ID NO: 126136 - DNA, 10662 bp, Artificial Sequence
  Description of Artificial Sequence: Synthetic coding sequence
atggtggtcagcgctggaccttggagtagcgagaaggccgagatgaacattctagagattaacgagactctcagaccacagcttgctgagaaaaagcaacagttcaggaatctaaaggaaaagtgctttctgacacagctcgctggttttttagctaatagacagaagaagtataaatatgaggagtgcaaggatttgattaagttcatgctgcgtaacgaaaggcagttcaaagaagaaaaactggcagagcagctgaaacaggcagaggaactgaggcaatataaggtcctggtgcacagccaggagagggaactcacgcaactacgcgagaaactgagagaaggtcgagacgctagtagaagcctgtatgaacaccttcaggctctgctaactccagatgaacccgacaagtctcaggggcaggatctgcaggagcagttggccgaggggtgtaggctcgcccagcacctggtgcaaaaactctctcccgagaacgatgaagacgaggacgaggatgtgcaagtagaagaagctgaaaaggtgttggaatcttccgccccaagagaggtgcagaaagctgaggaatcaaaggtgccagaagactccctggaggagtgcgcgataacatgctcgaacagtcatggtccctgcgactccaatcagccacataaaaatattaagatcacatttgaggaggatgaagttaactcaacgctcgtcgttgatcgcgaatccagtcatgatgaatgccaggacgcactcaacatcctgccagtcccagggccgactagctccgccacaaacgtgtcaatggtcgtctctgcggggccattgagttccgaaaaagccgaaatgaatatccttgagatcaacgaaaaactgcggccacaattggcagagaaaaaacagcagttccggaatctgaaggagaagtgttttctgacccaactttctgggttcctggctaaccagcaaaagaaatacaaatacgaagaatgcaaagacctgattaagtttatgttgcgtaatgagagacaatttaaggaggagaaactcgccgaacaacttaagcaagcggaagaattacggcagtacaaagtcctcgttcacgcacaagagcgtgagctgactcagctgaaggagaagctaagggagggcagggacgcgtcgcggtctctcaatgagcaccttcaggccttgctgaccccctatgaacctgacaagtctcaaggccaagacctgcaggagcagctggctgagggctgtcgactggctcaacatcttgttcagaagctctcaccagagaacgacaatgatgatgacgaggatgtgcaggttgaagtggctgaaaaggtgcaaaagtcctcagcccctcgcgaaatgcagaaggctgaggaaaaggaggtgcctgaagatagcctagaagagtgtgcgatcacatactccaattcacacggttcgtacgactcaaaccagcctcataggaagaccaagattacattcgaagaggataaggtcgactcaacactgattggcagctcgtcccatgtggaatgggaagatgccgtgcatattatccccgagaacgaaagcgatgacgaagaggaagaggagaaaggaccagtgtcaccgcgcaatctacaggagagcgaagaggaggaggttccccaggaatcatgggacgaggggtatagtacactgagcatccccccagaaatgctggcttcgtatcagtcctacagcagcacattccattctctggaggaacagcaggtttgtatggccgtggacatcggacggcataggtgggatcaggtcaagaaggaggaccaggaagccacaggcccaaggttgtccagggagcttctggacgagaaagaacccgaggtgttacaggattcactggacaggtgctactctaccccatcgggctatttggaattaccggatctgggccaaccatactcgtccgccgtgtacagcctcgaggagcagtaccttggactggcgctggacgtggaccgaattaaaaaggaccaagaggaggaggaggatcaggggcccccctgtcctagactttctagagagctgctcgaggtcgtcgagcctgaggttctgcaggatagcctggaccgctgttactccaccccatcctcttgcctcgagcagcctgacagctgtcagccatatggcagcagcttctacgcactggaagagaagcacgtaggattttctttagatgtgggagagatcgaaaagaaaggtaaaggcaagaagagacgcggacgtaggtctaagaaggagcggcgaaggggaaggaaggagggcgaagaggatcagaacccaccttgtccaagattgtcccgtgagctgctggacgagaaggggcccgaggtacttcaggactcgctcgatagatgttacagcactccatcggggtgtctggaacttaccgactcctgccagccgtataggagcgcattttatgtcctagagcaacaacgcgtgggctttgctgtagacatggatgaaatcgaaaaataccaggaggtcgaggaagatcaggatccttcctgtcccaggctgtcccgggaattactagatgaaaaggaacccgaagtccttcaggattctctggataggtgctacagcaccccttccggctacctcgaactcccagacctgggacagccatattcttccgcagtgtacagtctcgaagagcaatatttggggcttgccctggatgtggaccgcattaagaaggatcaggaggaagaagaggaccaggggcccccttgccctcgcctgtctcgcgagttgttggaggttgttgagcccgaggtgttacaggattccctcgatagatgctactccactccctctagctgtttggaacagccagactcctgccaaccttacggctcgtctttctatgcgctggaggagaagcacgtgggtttttctctggacgtgggcgaaattgaaaagaagggcaaggggaagaaacggcggggcagaaggagcaaaaaggagcgtagacgtggacgcaaggagggggaagaagatcaaaaccctccttgtccacgcctgagcagggaactgctggacgagaagggacccgaggtccttcaggatagcctcgacaggtgttattctactcccagcggctgcctggaactcaccgactcctgtcagccctatcgatcagctttctacgtgttggaacagcaaagagtcggcttcgccgtggacatggacgaaatcgagaagtaccaagaggttgaggaagaccaggatccctcatgccctagactcagtagagaattgcttgacgagaaagaacctgaggtgcttcaggactccttggacagatgctattccaccccctccgggtacctcgagctgcccgacctcgggcagccctacagctccgcagtatattctttagaggaacagtacctcgggttagccttggatgtcgacaggattaagaaggatgaagaggaagaggaggatcaggatccgccttgtcctcgactaagccgtgaattattagaggtagtagctcctgaggttctccaggattcccttgataggtgctattccaccccatcatcatgtctggaacagccggacagttgtcagccctacggaagttccttctacgcacttgaggagaaacatgtaggcttctctctcgatgttggggagatcgagaaaaaagggaaaggcaaaaagcgacgtggaaggaggtctaagaaagagaggcggcggggcagaaaagagggcgaggaagatcaaaaccccccctgcccaagactgagccgcgagctcctggatgagaaaggccccgaggttctccaggactctctagatcgttgctacagcactccctctggttgtcttgaacttacggattcatgccagccctacagaagcgcattctacgtgttagaacagcagcgagttggtatggcggtggacatggatgaaattgagaaatatcaggaagtcgaagaggatcaagatccatcctgcccccgactgtctcgcgagctgctggacgagaaggagcccgaagtgctccaagattcgctcaacaggtgttattcaaccccatcaggctatctagagctgcctgatctcgggcaaccctactcgtccgcagtctacagtttggaggagcagtatctggggctcgcactcgatgtggacaggatcaagaaggaccaggaagaggaagaagatgaggatcaggatcctccgtgtcccaggctcagcagagagctgctcgaggtcgtggaaccagaagtcctgcaggattccttggatagatgctattctactccctctagttgtctagagcagccggattcttgtcagccatacggctcatcgttctacgcgctagaggagaaccacgtcgggttctccctcgatgtcggcgagattgagaaaaagggcaaaggaaagaagcgcagagggcggcgctccaagaaggagcgccgcagagggagaaaggaaggggaggaggaccaaaacccgccgtgcccacgcctctccagggaactgctggacgagaagggacctgaagtcttgcaggattcactagaccgttgttattctaccccaagtggttgccttgagctgaccgattcttgtcagccataccgatccgctttctatgtgctggaacagcagcacgtgggcttagctgtggacatggatgaaatagaaaaataccaagaggtggaggaggaccaggacccttcttgtcctagactgtcacgtgaattactagatgagaaagagccagaggtcctgcaggattccctggaccggtgctattcaacaccgagcggatacttggaactgccggatctcggccagccttattcttcggctgtgtattcattggaggagcagtacctgggcttagccctggatgtggaccgaataaagaaggatcaggaggaggaggaagaccagggtccaccttgtccacggctgtcccgggagcttcttgaagtggtcgagcctgaagtgctgcaggactccctcgataggtgctattctactcccagttcatgtctggaacaacccgattcttgccaaccatatgggtcaagcttttatgctctggaggagaaccatgtcggcttcagcctggacgtgggagagatcgaaaaaaaaggcaagggcaaaaagcgaaggggcagacggtccaaaaaggagagacggagaggccggaaagagggtgaggaggatcaaaatccaccctgcccaagactgagtcgcgaactcctagacgaaaagggtcccgaggttctgcaggattctctcgacagatgctacagtaccccttccggatgcctcgagttaaccgactcttgccagccttatcggagcgccttctatgtcctcgagcagcagcacgtcggacttgccgtggacatggatgagatcgagaagtaccaggaagttgaggaagatcaagacccttcctgccctcgactgtcacgcgagctcctggatgaaaaggaacccgaggtgctgcaggactcattagacagatgttactccaccccaagtggatatctggagcttccagacttggggcaaccctattcctcagctgtgtatagcctggaagaacagtatctcggactggcactggatgtggaccggatcaaaaaggatcaagaagaggaagaagatcaggggcccccttgtcctcggttaagcagggaattactggaggtcgtggagcctgaagtgctccaagacagtttggaccgctgctacagtacgccttcttcttgtttagagcagcctgactcctgtcagccgtacgggagcagcttttatgctctggaggaaaaccacgtgggcttttccctggacgtaggtgaaattgaaaagaaagggaaagggaagaaacgtcgcggccggcgctcgaaaaaagagcgtcggcgcggcaggaaggaaggcgaggaggaccagaatcccccttgcccgagattatccagagagctcctggacgaaaagggccctgaggttctgcaggattcacttgacagatgctatagtactccatccggttgtcttgaactgaccgactcatgtcaaccctaccgcagcgctttctacgtcttggaacagcagcatgtaggactcgccgtcgatatggacgaaatagagaagtaccaggaggtggaagaggatcaggacccatcttgtccacgactgagtagagaacttctggacgaaaaggagccggaggtgttacaggatagcctggatcgctgctattcgacaccgagcggctacctggagctgccagatctagggcagccttactcctctgcagtctacagccttgaggaacaatacctgggcctcgccctggatgtagatcgtataaagaaggaccaggaagaagaggaagatcaaggtccgccctgtcctcggttgtcacgggaattactggaggtcgtggagcccgaggttttacaggacagtctggaccggtgttatagtacacctagcagttgcctcgaacaaccagacagctgccaaccctacggatcctcattttacgctctggaagagaatcacgtaggatttagtctggacgtgggtgaaatcgagaaaaaggggaaaggcaagaagagacggggtcggcggtctaagaaggaaagaaggagggggcgcaaggagggcgaggaggatcaaaatcctccctgtcctcgcttatccagagagctcctggatgaaaagggccctgaggtcctgcaggactctctagataggtgttatagcaccccaagcggttgccttgagctgacagacagttgccaaccttacaggtctgcattctatgtgctcgaacagcaacatgtgggcctcgcagtggatatggatgaaatcgagaagtatcaggaagttgaagaggatcaggaccctagttgtcctcggctgagccgcgagctactcgacgagaaggaaccggaggtcctacaggatagcctagaccgttgttacagtacccccagcggttatctggagctccccgatcttggccagccttactctagtgcggtgtattctctggaggagcagtacttgggtttggccttggatgtcgacagaatcaaaaaggaccaagaggaggaggaggaccagggaccaccgtgtcccagactctcacgcgagctgctggaagtggtcgaacccgaagtgctacaggattccctggacaggtgttactcaacaccttcatcatgtcttgaacagccagattcttgtcagccttatggctcgtctttctacgctctggaagaaaatcatgtcggcttttccctggacgtcggggaaatcgagaaaaaaggcaagggcaagaagagacggggaagacggtctaaaaaggagaggagacgaggaaggaaggaaggggaagaggaccagaatcccccgtgcccccgcttgtcccgagagcttctggatgaaaaaggccccgaggtgctccaggattctctggaccggtgctactcaaccccttcaggctgccttgagctgaccgatagttgtcaaccgtaccgaagcgctttttatgtgctggaacagcagcatgtcgggctcgccgtggatatggacgagattgagaaataccaggaggtggaagaggatcaagacccatcctgcccaagattgagccgcgaactcctggatgaaaaggagccagaggtcctgcaggacagtctggacaggtgttacagtaccccaagtggctacctggagttgccagatctgggccaaccttactcatcagccgtgtatagcctcgaagagcagtatctgggcttagctctggacgtcgacaggattaagaaggaccaagaagaggaggaggatcagggcccaccctgccctcgcttgtcccgagaattgttggaagtcgttgagccggaggttcttcaggattcccttgaccgttgctatagtactccatccagctgtctagaacagcctgatagctgccagccctacggcagttccttctacgccctggaagaaaagcatgtgggcttcagtctggatgtgggagaaatcgagaaaaagggcaagggtaaaaagcgacgaggacgcaggagcaaaaaggaacgccgccggggccgcaaagagggcgaagaagatcagaatcctccttgccctcggctcagtcgcgaacttctggacgagaaaggtcctgaagtgctccaggacagcctcgaccgatgttactcaaccccatcaggttgcttagagctaaccgacagttgccagccctaccggagtgctttctacgtcctggagcaacagcacgtaggtctggcagtggatatggacgagattgaaaaatatcaggaggtcgaggaggatcaggacccaagttgtccgcggttgtcacgggagttactggacgaaaaggagcctgaggttctgcaagattcactagatcgatgctactctacaccctctgggtatctggagctccccgatctaggccagccctactcctccgccgtgtatagtctcgaggaacagtatctgggattggcgttggacgttgatagaattaaaaaagatcaggaagaagaggaagatcagggcccgccttgtcccaggcttagtcgagagctcctggaggttgttgagccagaagtgcttcaagactcattggacaggtgctacagtacccctagtagctgtctggagcagccagattcttgtcaaccttacgggtcctccttttacgccctggaggaaaagcacgtgggcttctccctagacgtgggggaaattgagaagaagggaaaggggaagaagaggcgagggcgtcgctcgaaaaaagagcggagacgcggtcgcaaggaaggagaggaggatcagaaccctccttgcccaaggctttcccgagagcttctcgacgagaagggaccgaaggtgctccaggatagcctggatcgctgctacagcactccctctggttgtcttgagctgtgtgacagctgtcagccctaccggtctgccttttacgtactggagcagcagcgggtggggctggctgtggacatggacgaaatcgagaaatatcaggaagttgaggaagaccaggacccaagctgtccaaggctgagtcgcgagctgcttgatgagaagggccccgaggtgctccaggacagcctcgatcgctgctacagtaccccaagcggctgcctcgaactctgcgactcttgtcagccctataggtcagcattctatatcctggagcagcagcgcgtaggcctggccgtcgacatggacgaaatcgagaagtaccaagaggttgaagaagatcaggacccatcctgtccaaggcttagcagagagctgctggacgagaaggaacctgaggttctgcaggactccctggacaggtgctacagcacaccatctggatacctcgaactccctgatttgggccaaccatactcaagcgccgtatacagtctcgaagagcagtatctggggttagccctcgatgtggaccgcataaaaaaggaccaagaagaagaggaggatcaggggcccccctgccctcgcctttccagggaactactggaggtcgtggaaccggaagtcctccaggattcgctcgatcggtgttacagtacccctagcagttgtttagagcagcctgactcgtgtcaaccttatgggtcctctttctatgctctcgaggagaaacacgtgggtttctccttggatgtgggagagatcgaaaaaaaggggaagggtaagaagcgccggggaaggcgatctaaaaaggagcgacgacgcggtcgaaaggaaggcgaggaggaccagaatcctccctgtcctcgcctgtcacgggaactgcttgacgagaaaggtccagaggtccttcaagacagtcttgaccgttgctattctacccccagtggttgccttgaactctgcgactcctgccagccataccgttcggcattttatgtcctcgagcagcagcacgtggggctcgcagtagatatggatgagatcgagaaataccaggaagtggaagaggaccaggatccttcctgcccgcgactaagccgcgaactcctggacgaaaaggagcctgaagtgctccaggatagcttagaccggtgctacagcacaccttccggctacctcgaactccccgatctggggcagccttattcaagcgccgtgtactctctcgaagagcagtacctaggtctggctctcgacgtggacaagatcgagaaaaaaggcaaaggcaaaaaaaggcgcggtaggaggagtaagaaggagaggcggcgtggacgaaaggagggagaggaggatcagaatcctccatgtccccgtctaaacggagtactaatggaggttgaggaaagagaagtgctccaggattcactggatcgatgctacagtaccccgtctatgtattttgagctacctgactcttttcagcattataggtccgtgttctattccttcgaagagcagcacatcagctttgcactctatgtagataaccgatttttcaccctaactgtgactagcctgcacctggtctttcagatgggggtgatatttcctcagtag

SEQ ID NO: 126137 - DNA, 900 bp, Artificial Sequence
  Description of Artificial Sequence: Synthetic coding sequence
atggtggtgtccgccggcccactaagcagcgaaaaagctgaaatgaatatactcgagatcaatgagaagctgaggcctcagcttgccgaaaagaagcagcaattccgaaacctgaaagagaaatgttttttaacacaactttcaggctttttggccaaccagcagaagaagtacaagtatgaagaatgtaaggatctcatcaagttcatgttgagaaacgaaagacagtttaaagaggagaaacttgctgaacagcttaaacaagccgaagaattaaggcaatacaaagttcttgtccatgcgcaggagcgtgagctgacccagctgaaagagaagctccgtgagggaagagatgcttcacgctcgctcaatgagcacctccaggcactgcttaccccgtatgagcctgataaaagccaggggcaggacttgcaagagcagctggccgaaggatgtcgcctggcacaacacctggtccagaagttgagccctgagaacgataacgatgacgacgaggatgtgcaagtagaagtggcagagaaggtgcagaaaagctcagccccccgagagatgcaaaaggccgaggagaaggaggtccctgaagactcgttagaagaatgtgcaatcacatactccaactcccatggaagctatgattcaaaccagcctcaccgcaagacaaaaattacatttgaagaggataaggtggactctaccctgatcggatcttcatcacatgtggaatgggaggacgcagtccacatcattcctgagaatgagtccgatgacgaagaggaggaggagaaaggcccagttagcccacgcacctctgtgggatcatccgaaaaggggggtccccggggtaatcgctcacaagctcagcagggcgccgcaggatag

SEQ ID NO: 126138 - DNA, 2010 bp, Artificial Sequence
  Description of Artificial Sequence: Synthetic coding sequence
atggttgtgagtgccggacctctatcctcagagaaggccgagatgaacatactagagatcaacgaaaagcttcggcctcagttggctgagaaaaaacagcagtttagaaatctcaaagagaaatgcttcctgacgcagctctccgggttcctggccaaccagcagaaaaagtacaagtatgaggagtgtaaagacttaataaaattcatgctgagaaacgagaggcagttcaaggaagaaaaactagctgaacagctgaaacaagccgaggagctgaggcaatacaaggtgctcgtgcacgcacaagaaagagaacttacccagctcaaagagaagttgcgagagggtcgagacgcaagcagatccctgaatgagcatttgcaggcccttctgaccccttacgaacctgacaaatcccagggacaggaccttcaggaacaattggccgagggctgcagacttgcccaacacctggtgcagaagctctctcccgaaaacgacaacgacgacgatgaagatgtccaggttgaggtcgcggagaaagttcagaagtcatctgcacctcgcgagatgcagaaagcagaggagaaggaggtcccagaggacagtctcgaagagtgcgccataacctacagcaactctcacggaagctacgactccaaccagcctcatcgcaagactaagatcacctttgaggaggacaaggttgactctaccttaatcggatcttcttctcacgttgagtgggaggatgccgtgcacattattcccgaaaatgaatctgacgacgaggaggaggaagagaaaggacccgtaagccccagaaacctgcaagagtcggaagaagaagaggtacctcaggagtcctgggacgaggggtacagtaccctctccatccccccagagatgttagcttcttatcagtcgtactcatcaaccttccactcactggaggaacagcaagtgtgtatggctgtggacatcgggcggcatcggtgggaccaagtgaaaaaagaggatcaggaagccacggggccatccagggagctgctcgatgaaaagggacccgaagttttccaagacagccaggatcgttgttactctactccctctggctgtttagaactcaccgacagctgccaaccctatcgcagcgcgttttatatactggaacagcagagggtaggcctggccattgacatggacgagatcgagaagtaccaagaagtagaggaagaccaggacccatcttgccctaggttgtcccgggaattgctagacgagaaggaacccgaggtcttgcaggacagcctcgaccggtgttactccaccccttctggctaccttgaactgcctgatctgggccagccctactcatctgccgtgtatagtttggaagagcaatacctgggactggccttggacgtagatcggatcaagaaggatcaggaggaagaggaagaccaaggtccgccttgcccacgcctgagccgcgagctccttgacgaaaaaggacctgaagtgcttcaggatagtctagataggtgttacagcaccccgtcaggttgcttagagttaaccgatagctgccagccttatcgatcagcattttacgttctggagcagcaacacgtgggactcgcagtggatatggatgagatagagaagaagggtaaagggaaaaagcggaggggcagacgttccaaaaaggagcggaggcgggggaggaaggagggcgaagaggaccaaaatccaccgtgtcctcgcctcaacggtgttcttatggaggtcgaggagagggaggtgctgcaagattcactagatagatgttacagcactccaagcatgtatttcgaattgcccgacagcttccagcactatcgatctgtgttctactcattcgaagagcagcatatttccttcgccttatatgtcgacaataggttttttactctgacagttacctctctgcatctcgtcttccaaatgggtgtgatttttccccaatag

SEQ ID NO: 126139 - DNA, 2022 bp, Artificial Sequence
  Description of Artificial Sequence: Synthetic coding sequence
atggtagtttccgccggcccctggtcctccgaaaaggcagaaatgaatatcttagaaatcaacgagacgctccggccccagcttgctgagaagaaacagcagttcagaaacctgaaggaaaaatgctttcttacccagctggccggcttccttgccaaccggcagaagaagtataaatacgaagaatgcaaggatctgatcaaatttatgcttcggaacgagcgccagtttaaggaggaaaagcttgccgagcagcttaaacaggccgaagaactcaggcagtataaggtgctcgtccactcacaagagcgcgaactgacccagttgcgggaaaaactgagagaaggacgtgatgccagtcgttctctgtatgagcacttgcaggccctgcttacgcctgacgagccagacaagtcacaggggcaggatctgcaggaacagctcgctgaggggtgccgcctggcccagcacttagtgcagaaactgtcccctgagaatgatgaggacgaagatgaagatgtgcaggtagaagaggctgagaaagtgctggagtcctctgcaccacgggaagtgcagaaggctgaagaaagcaaagtccccgaagacagtttggaggaatgtgccatcacatgttcaaacagccatggaccttgcgattccaaccaaccccacaagaatattaagattacatttgaggaagacgaagttaactcaacactagtggttgatagggagtcctcccacgatgaatgtcaagacgccctgaatatcctccctgaaaatgagagcgatgacgaggaggaggaggagaagggaccagtgtctcccagaaatttgcaggaatcagaagaagaggaggttccgcaggagtcttgggatgaaggctattccaccctttccatcccccctgaaatgctggcttcatatcagtcttacagcagcacctttcatagcctggaagaacaacaagtctgtatggctgttgatatcggcaggcaccgttgggatcaggtgaagaaggaagaccaggaggccacagggcctagactgagtagagaactgctggatgagaagggacccgaggtcttacaagattcactcgaccgctgttattccacccctagcggatgcttggagctcaccgattcttgtcagccttatagatcggcgttctacgtgttagagcagcagcgcgttggatttgccgttgatatggacgagatcgagaaatatcaggaggtggaggaggatcaggacccgtcttgtccacggctaagtcgagaactgctggacgaaaaggagcctgaggtcctgcaggattcactcgaccgctgttactcgacaccttccggatacctggaactacctgatcttgggcaaccgtatagtagtgctgtctattcccttgaagagcagtatcttgggcttgcgctggatgtggaccgtatcaagaaagatcaggaggaagaagaggaccagggcccaccctgcccccgtctaagcagagagctcttagaagtcgtggaaccggaggtattgcaggacagtctggatcggtgctactctaccccctctagctgtctcgagcagcctgactcttgtcaaccatacggatcttcgttctacgctcttgaggagaagcatgtgggctttagtctagacgtcggggagattgagaaaaaaggaaaaggaaagaagcggagagggagacgctctaaaaaggagagaaggagaggccggaaggagggcgaggaagaccagaatcccccatgccctcggctgaacggggtacttatggaagtagaggagcgggaagtcctgcaggactccctcgacagatgctattccacccccagtatgtattttgagctgcccgacagtttccagcactataggtccgtgttttacagtttcgaagaacagcacatttcttttgcattatacgtcgataacagattctttaccctgacagtcacctccctgcatctggtgttccaaatgggcgtgatctttcctcagtag

SEQ ID NO: 126140 - DNA, 519 bp, Artificial Sequence
  Description of Artificial Sequence: Synthetic coding sequence
atggccgttgacatcggtcggcacaggtgggatcaagtaaaaaaggaggaccaggaagccacaggcccaagccgtgagcttttggacgagaaaggaccggaggttttccaggatagccaggacagatgctactctaccccctctggctgtttggagctcacggacagttgtcaaccatacagatccgctttctacattctagagcagcaacgggtgggactcgcgatcgatatggacgagattgagaagtatcaagaggtggaggaggatcaagatcccagctgcccacggttgtctcgtgagttgctagacgagaaagagccggaggtgctccaagattccctggatcgttgttatagtactccatcagggtatctggaactccccgacttgggccagccctactccagtgctgtgtactctctcgaagagcagtacctgggactcgccctggacgtggatagaatcaaaaaggaccaggaggaggaagaggatcaaggccccccttgtccaaggtag

SEQ ID NO: 126141 - DNA, 2295 bp, Artificial Sequence
  Description of Artificial Sequence: Synthetic coding sequence
atgttcagcaactctactggtcgattacctggccagcctaccgaagaaatccaacagtacaaagtgcttgtgcattctcaggagcgggaacttactcagttgcgggaaaagctcagagaaggaagggacgcctcccggtcactgtacgaacacctgcaggctctgctgacacctgacgaacccgacaagtcacagggccaggacctccaggagcagctggcggagggctgccgcctggcgcagcacttggttcagaagctgtcgccagagaacgacgaagatgaagacgaggacgtccaggttgaagaagctgagaaagttcttgagagtagcgctcccagggaagttcagaaggctgaggaatctaaggtgcctgaggattccttggaggaatgcgccatcacatgttcaaatagccatggcccttgtgattccaaccagcctcacaagaatattaagataaccttcgaagaagacgaggtcaattctacactggtcgtggacagggagagctctcatgacgagtgccaggatgccttgaacatcctgccggtgcctggacctactagcagcgccaccaacgtgtccatggtcgtgtcagctggccctctgagttcagagaaagcagaaatgaatatcctggagattaatgaaaaactgcgtcctcagctggcggagaaaaagcagcagtttaggaatctgaaggagaagtgttttctcactcagctaagcggctttctggccaaccagcaaaaaaagtacaagtacgaggagtgtaaagatctaatcaaattcatgttgcgcaacgagaggcagttcaaagaggagaagctggccgagcagttaaagcaggcagaggaactccgtcagtataaagtgctcgtacatgcccaggaaagggagcttacacagctcaaagagaaactgcgtgaaggaagggatgcctctaggagtttgaacgagcacctgcaggccctacttacgccctacgaacctgacaaaagtcaggggcaggacctgcaggaacagttggcagaaggatgccgactggcacaacacctcgtgcaaaagcttagtcccgagaacgacaacgatgacgacgaagacgtgcaagtggaagtggccgaaaaggtccaaaagtctagtgctccaagggaaatgcagaaagccgaagagaaggaggtgcccgaagattctctcgaagagtgcgcaatcacctacagtaacagtcatggatcctacgacagcaatcagccgcatcgtaagacgaagattacctttgaagaggataaagtggattctaccctaattggcagctccagccacgtggagtgggaagacgctgttcacataatacccgagaacgaaagcgacgatgaagaggaggaagagaaaggtccagttagtccaagaaatctgcaggagagtgaagaggaagaggtcccgcaggagagttgggacgagggttacagtacactatctattccccccgaaatgcttgcttcctaccagagctacagttctactttccattctcttgaagaacagcaggtgtgcatggccgtcgatatcggcagacaccggtgggaccaagttaaaaaagaagatcaggaagccactggtccgagactctcccgtgaattgctggatgagaaaggcccagaggtgctccaggacagtttggacaggtgctacagtacaccaagtggttgcttggaactaacagattcctgccagccgtaccgctctgcattctacgttctcgagcaacagcacgtaggattggctgtggatatggacgaaatcgaaaagtaccaagaagtagaggaagatcaagacccctcctgtcctaggttgtcgcgggagttactcgatgaaaaggagcctgaggtgctacaggactcactcgatcggtgttacagtaccccttccggctacctggaactgccagatctggggcagccatatagctcagcggtttactcgttggaagaacagtacctcgggttagcattggacgtcgacagaatcaagaaagaccaggaggaagaagaggaccaaggccccccgtgtcctagattgtctagggaactgttggaggtggtagagcccgaggtcttacaagactcgctagataggtgctattctactcctagctcctgcctcgagcaacctgattcatgccaaccatatggatccagcttttacgcgctggaggaaaaacacgtcggcttctctctggatgtgggagagatcgaaaaaaagggtaaaggaaaaaagcgacgaggacgatag

SEQ ID NO: 126142 - DNA, 105 bp, Artificial Sequence
  Description of Artificial Sequence: Synthetic coding sequence
atcggtagcagtagccatgttgagtgggaggacgcggttcatatcattccagagaatgaatcagacgacgaggaagaggaagagaaaggaccagtcagcccgtag

SEQ ID NO: 126143 - DNA, 2517 bp, Artificial Sequence
  Description of Artificial Sequence: Synthetic coding sequence
atggtggtttcagccggaccttggtcctccgagaaagcagaaatgaacattctggagataaacgaaaagctgagaccacagttggctgagaataaacaacagtttcgcaacctgaaggagcgatgtttcctaacccagttggctggttttctagccaacagacagaagaagtacaaatacgaggaatgcaaagatctgatcaaattcatgcttcgcaatgaaaggcaatttaaagaagagaaacttgctgagcagttaaagcaggccgaggagctgaggcagtacaaggtcttggtacactcccaggaaagagaacttacacagctgcgagaaaaacttcgggagggacgggatgcttccaggtcgctcaacgagcacttacaggcccttttaactccagatgagcctgataaaagtcagggacaggatcttcaggagcagctggctgaggggtgccggctggcacagcatctcgtgcaaaagctctccccggagaatgacgaagacgaagatgaggacgtgcaggtcgaggaagacgagaaggtcctggaaagcagcgcccccagagaagtacagaaagccgaggaaagcaaggtccctgaggacagtctggaggaatgcgcaatcacatgctctaactctcacggaccctgtgacagcatccagccacataaaaatattaaaataaccttcgaggaggacaaggttaactcgtctcttgttgtcgacagggaatcctcccacgatggttgccaggacgcgttaaatatactcccagtgccaggaccaacaagttccgctactaatgtctctatggtcgtcagtgctggccctttgtcttcagagaaggccgagatgaacatactcgagattaatgagaagctgtgccctcagctcgcggaaaagaagcagcaattccggtcattgaaagagaagtgtttcgtgacccaggtcgcttgttttctggccaagcagcagaacaagtataagtacgaagagtgtaaggaccttataaaatccatgctgagaaatgaacgccaattcaaggaggagaaattggccgagcagctgaagcaggcagaggagttgcggcagtacaaagtactagtccactctcaggagcgcgagttaactcagctacgcgaaaagcttagggaagggcgggatgcctcccggtcattgaacgagcacttacaagctctcctcaccccagacgaacccgacaaaagtcaaggtcaagaccttcaggagcagcttgctgaaggctgccggctggcccaacatctggtccagaagctgtctccggagaacgataacgacgacgatgaagacgtacaggtggaggtggccgagaaggtccagaaaagttcgtctccacgcgagatgcagaaagcagaagaaaaggaagttccagaagattctctcgaagagtgcgctatcacatgttcaaatagtcacggcccttacgactctaatcagccgcatcggaagcctaagtcacacctgaggaaaacaaagagcacccagctctccttggctcaccccctgatgctgaatgggaggatgttgtatacgctgtctcagaagatgaaagttatgatgcggaagagaaaaaagaaaggtcaatgcctgccggggatctgtagaagtcttaagcggcggaaatcccctcggtcgcccgggatgaaagtgattcgcttgtctcagttccttctgaaaggccacaggtgggatcaggtgaaaaaggaagatcaggaagccaccggaccaaggctgtccagagaacttttagacgaaaaggagcccgaggtgctacaggattccctggaccggtgttattcgacccctagcgtttacctgggtttaaccgacagttgccaaccctacaggtctgcattctacgtattggaacaacaacgcatcggcctggcagtggatatggatgaaatagagaaatatcaagaggtcgaagaagatcaggatccctcatgtcctaggctgagtcgggagttattggccgaaaaggaacctgaagtcttgcaggactccctggatcggtgttacagcactccttccggatatttagaattacctgatcttgggcagccgtaccggtccgctgtctactcccttgaggaacagtacctaggcctggccttagacgtggaccgcatcaaaaaggaccaggaagaggaagaagaccagggcccaccttgccctcggctcagcagggagttgctggaggtcgtcgaaccggaagtcctccaggattcccttgatgttatccaactcctgcccgtcgtcctgaacagcctgactcctgcaagtcccacggaagtgcctttcatgcattggcgaaaaaacatgctggcatttctactgacttgggaaaagctgaagcggcgaggacgtgggcgcaaagagggcgaagaggaccagaggagaaaggaagaaggagaggaaaagaagggaaagaaaatcaagacacaccacgctccaggctccgctgcatgctag

SEQ ID NO: 126144 - DNA, 2373 bp, Artificial Sequence
  Description of Artificial Sequence: Synthetic coding sequence
atgttcagcaattccaccggcagactgccaggccagcccactgaagagatccagcagtacaaggttctggtgcacagtcaggaaagggaactaactcaattgagagagaagctccgcgaaggtcgagatgcatcccgttccctaaacgaacatctgcaagctctgttgacccctgacgaaccagataaatcccagggccaggatctccaggagcaactggccgaaggctgtcgcctggcccagcatctggtccagaaactgtctcctgagaatgacgaggatgaggacgaggatgtgcaggttgaggaagacgaaaaagttttggaaagcagtgcccccagagaggttcagaaagccgaggagtcgaaggtacccgaggacagtctggaagaatgcgcgatcacttgctcaaactcccacggtccttgtgattcgatccagccacataagaacataaagatcacatttgaagaggacaaggtgaactcctcgctggtggtagatagggagtcctcacatgacggatgtcaggatgcactcaacattctgcctgtgcccggaccgacttcttccgctaccaatgttagtatggttgtgtcagccggacccctgagcagtgaaaaggccgagatgaatattctggagatcaacgaaaaactgtgccctcagttggcggagaagaagcaacaatttcgttcgctgaaagagaagtgcttcgtgactcaggtggcctgttttttagccaagcagcagaacaaatacaaatacgaagaatgtaaagaccttatcaaatccatgctgaggaacgagaggcaatttaaggaggagaagcttgctgagcagctgaaacaagctgaggaactcagacagtataaagtgctagtgcattcccaggagagggaattgacccagcttcgggagaagctcagagaaggaagagacgcatcccggtcgctgaatgagcatcttcaggctctgctcactcctgacgagcctgacaagtctcaggggcaagacttgcaggaacaactcgccgaaggatgtcgactggcccagcaccttgtgcagaagttgtctcctgaaaacgataacgacgatgatgaggacgtgcaagttgaggttgcagagaaagtgcagaaatcctcatctcctcgggagatgcaaaaagccgaggaaaaagaggtgcccgaggatagtcttgaagagtgcgctataacctgttctaactcacacggtccatacgattcaaaccagcctcaccgcaagacgaagataaccttcgaggaagacaaggtcgacagcaccctgattggatcttcctcgcacgtcgaatgggaggacgccgtacatatcattccagaaaacgaatctgacgacgaggaagaggaggaaaaaggtcccgtgtcaccccggaacctgcaggagtctgaggaggaagaagttccacaggaatcatgggacgagggttattccacactgagcatcccacccgagcgcctcgcttcgtaccaaagttatagctctaccttccacagcctcgaggaacaacaggtgtgcatggccgtcgatatcggaaggcatcggtgggatcaggtcaaaaaggaggaccaggaagctactggtccacgtctgtccagagaactgctggacgagaaggagcctgaagtgttacaggacagcctggacaggtgttattcaaccccatcagtatatctggggctcacagattcttgccaaccataccggagtgctttttatgttttggaacagcagagaatcgggctggctgttgatatggatgaaatcgagaagtatcaagaagtggaggaggaccaggatccctcgtgtccacgcctgtccagagagcttcttgcggaaaaggaacctgaggtgctgcaggatagtctcgatagatgctactcaactcccagtggatatttggagttgccagacctcggccaaccatacagatctgcagtgtacagcctcgaggagcagtatctcggacttgcgctcgatgtagaccgtataaaaaaggatcaggaggaggaagaagatcaggggcccccatgtcccagactgagccgagaactgctggaggtcgttgagcccgaagtgttacaagattccctggatgtcattcagttactgcctgtggttctgaatagcctcactcctgcctcccccacggaagtgcctttcatgcactggaggaaaaacatgcttgccttccttctcacctgggagaagctcaagagacggggtcgaggccgcaaggaaggagaggaggaccagaggcgaaaggaagagggcgaggaaaaaaaagggaagaaaattaaaacccaccacgccccaggatccgccgcgtgttag

SEQ ID NO: 126145 - DNA, 258 bp, Artificial Sequence
  Description of Artificial Sequence: Synthetic coding sequence
gaaatgcaaaaagctgaagagaaagaggtacccgaagacagccttgaagaatgcgccatcacctgtagcaactcccacggcccatacgattctaaccaaccccacagaaaaacgaagataacctttgaggaggataaggtcgactccaccctgattgggtctagctctcatgtagagtgggaggacgccgtgcacatcattcccgaaaatgaatctgacgacgaagaagaagaagagaaaggaccagtgagcccctag

SEQ ID NO: 126146 - DNA, 1101 bp, Artificial Sequence
  Description of Artificial Sequence: Synthetic coding sequence
ctagcttcataccagagctatagctctacattccactcgttggaggaacaacaggtatgtatggccgtagacatcggccgacataggtgggaccaagtgaagaaagaggatcaggaggccaccggacctcgattgtctagagagcttcttgacgagaaagagcccgaagtattgcaggactcacttgacagatgttactccaccccaagcgtatatctgggcctgacagattcatgccagccttaccgttcggcattctatgtactggaacagcaacgcatcggactagctgtggacatggatgagatcgagaaataccaggaggtggaagaagaccaagatccatcttgcccccgccttagccgtgagctcttagccgaaaaagagccggaggtactccaggatagcctggatagatgttactcgaccccaagcggctatcttgagctgccggaccttggtcagccgtaccggagcgcagtgtatagccttgaggaacaatacctcggactcgcactggatgttgatagaattaagaaggaccaggaagaagaggaagaccaaggaccaccttgcccccggctttcacgcgagctgctagaggttgtggagcctgaagtgctccaggactccctctgttactctactccaagcagctgtttggagcagcctgactcctgtcagccctatggcagctcattctacgcattggaggagaaacacgttggattttcactcgacgtgggcgagattgagaagaaaggaaagggcaaaaagaggaggggaagaagatctaaaaaaaagcgtcgacgtggccgtaaggagggggaggaagaccagaatcccccctgcccacggctgagctccgtgcttatggaagtagaagtgccagaggtgctgcaggattccctcgatcgctactacagtacaccttctatgtactttgaacttccagattcttttcagcattaccgaagcgtcttctactccttcgaagagcagcatattagctttgctctcgacatggacaaccgattcttcacccttaccgtaagatcccttcacctggtgttccaaatgggggtcatttttccccaatag

SEQ ID NO: 126147 - DNA, 2598 bp, Artificial Sequence
  Description of Artificial Sequence: Synthetic coding sequence
atggttgtgtcagccggcccatggtcctcagagaaggcagagatgaacatcctggagattaacgagaagttgagaccgcagctggctgaaaataagcagcagttccgcaacctgaaggaacggtgttttttaacccaactggctggatttctggccaaccggcagaagaaatacaagtatgaggaatgcaaggacctcattaaatttatgctacgtaacgaaaggcagttcaaagaggagaaactggctgagcaactcaaacaggctgaggaattgcgacagtacaaagtactggtgcacagtcaggaacgcgaactgacgcaactgagagagaaactgcgtgaaggaagagacgccagcagatccctgaatgaacacctgcaggccctccttaccccagatgagcctgataagagccaaggacaggatttacaggagcagctggccgagggttgccgattggctcaacacttagtacagaagctgagccctgaaaatgatgaggatgaagatgaggacgtccaagtggaggaagacgagaaagtgctcgaatcatctgccccacgtgaagtgcagaaggccgaggaatctaaggtgcctgaggactcccttgaggaatgcgccatcacgtgttcaaactctcacggtccatgtgatagcatacaaccacataagaacatcaagatcacgttcgaggaagacaaagtgaattcgagtttagtcgttgatcgagaaagtagccacgacggatgtcaagacgccctgaatatcttgcccgtaccgggccctaccagcagtgctactaacgtgtctatggtcgtttccgccgggccacttagctccgaaaaggccgagatgaatattctcgagatcaacgaaaagctctgtcctcagctggctgaaaagaaacagcagtttagaagcctcaaggagaaatgtttcgtcacacaggtcgcctgctttcttgcgaaacagcaaaacaagtacaaatacgaggagtgtaaggacctgataaaatcaatgctgagaaatgagagacagtttaaggaggagaaacttgccgaacagctgaagcaagcggaagaattgcgacagtacaaagtcctagttcactcacaggagagggaactcacccagctgagggaaaaactacgggaaggtcgggacgcctccagatcactgaacgagcacttacaggccctcttgacgcccgacgagcccgacaagtcacaaggtcaggatttacaggagcaacttgccgagggctgtcgtcttgcacagcacctcgttcagaagctgtccccagagaacgacaatgatgacgacgaggacgtgcaggtggaagtggcggaaaaggtacaaaagtccagctcaccccgagagatgcagaaagccgaagagaaggaggtcccagaagacagcctggaagaatgtgccatcacatgcagtaattcgcatggaccttacgattcaaaccagccccatcgtaagaccaagataaccttcgaggaagataaggtggactccacgctaattggatcttcttcacacgtcgagtgggaggatgctgtgcacataattccagagaacgagagcgacgacgaggaagaggaggagaaggggcccgtatccccccgaaatctgcaggagtctgaagaggaagaggtgccccaggagagctgggatgagggttattccactctgagtatcccccccgagaggctggcgtcctaccagagttactcctctacattccactcactcgaggagcagcaggtatgcatggctgttgacattggccgtcacagatgggaccaagtgaagaaggaagatcaagaggctacgggcccgcgcctgtcaagggaacttttggatgaaaaggagcctgaagtccttcaagactccctggaccgctgttactccaccccctccgtttacctcggactgactgatagctgccagccttatagatcggccttttacgtgctggagcagcagaggatcggcctggcagtcgatatggatgaaatcgagaaataccaggaagtagaggaggatcaagatccctcatgccctcgtcttagtcgagaacttttggccgagaaggaaccagaagtgctccaagattctctggatcggtgctacagtaccccttcaggatacctggagctgcctgacttaggccagccctaccgctccgcagtctacagcctagaagaacagtatctgggccttgctcttgatgtggatagaattaagaaagatcaggaggaggaggaagatcaggggccaccctgccctcggctgtcccgggagctattagaggtcgttgagccggaagtactgcaggactcactggacgtgatacagctgttaccagtcgtgcttaatagcctgactcctgcaagtccgacagaggttccattcatgcactggaggaaaaacatgttggccttcctgttgacctgggagaagctaaagcgccgcgggcgcgggcggaaagaaggtgaagaagatcagcggcggaaagaggagggggaagagaagaaggggaagaaaattaagactcaccacgcccccggtagtgccgcctgctag

SEQ ID NO: 126148 - DNA, 2373 bp, Artificial Sequence
  Description of Artificial Sequence: Synthetic coding sequence
atgttttcaaattcaactgggcgcctcccggggcagcccaccgaagaaattcagcagtacaaggtgctagtgcatagccaggaacgagaattaacccagctgagagagaagctccgtgaaggaagggatgcaagccggtccttaaacgaacacttgcaggctctgctgaccccagacgagcccgacaagtcacaggggcaggatttgcaagaacagttggccgaaggttgcagattggcccagcagctggtacagaaactctccccggaaaatgatgaagacgaggacgaagatgttcaggtagaagaagacgagaaggtcttggagtcctccgcgccaagagaagtgcaaaaggccgaagagtccaaagtgccagaagattccttggaagagtgcgctattacttgcagtaattcccacgggccttgcgattccaaccagccacataaaaacatcaagatcaccttcgaggaagacaaggtgaatagcagtttggtagtggaccgtgaatacagtcatgacgagtgccaggatgctctgaacatactccctgttcccggcccaactagtagcgccactaatgtcagtatggtggtgtcagcagggcccttgtcctctgagaaagccgagatgaatatcctagaaatcaatgagaagctaaggcctcaactggccgaaaaaaaacaacagtttcggtctctgaaggagaaatgttttgtgacacaagtggcttgctttcttgccaagcagcagaacaagtacaagtacgaggagtgtaaagatctcattaaatctatgctccgaaatgaactgcaatttaaagaagaaaaattagccgagcaacttaaacaggcggaagagttgcgacagtacaaggtgcttgttcattctcaggaaagggagctaacccagttgcgcgaaaagctgagagagggacgtgatgcatccagatccctgaatgaacacctgcaggccctgctgaccccagacgagccagataagagccagggacaggacctgcaagaacagctggctgagggctgccgcttggcccaacacctggtccaaaagctatctccggagaatgacaatgatgatgacgaggacgtgcaggttgaggttgctgaaaaagtgcagaagagctcaagcccacgggaaatgcagaaggctgaggagaaggaggtaccagaggactccctggaagaatgcgccatcacctgcagcaatagccatgggccctatgacagcaatcagcctcaccgtaagaccaaaattacatttgaagaagacaaagtggactctacactcatcggctcctcttcccacgtggagtgggaagacgcggtgcacattattcctgaaaacgaatctgatgatgaggaagaagaagagaaggggcctgtttcaccccggaaccttcaggaaagcgaggaggaagaagtgccccaggagtcttgggatgagggctactccacactgagtatacctccagagagactcgcctcctaccagagctattctagcacttttcattccctggaggagcagcaggtctgcatggcagtggatataggacggcataggtgggatcaggtcaagaaggaagatcaagaggccactgggcctagactttcacgtgagctactggctgagaaagaacccgaggtgctgcaagacagcctagatcgctgttattcaacaccgtccgtctacctagggcttacagacagctgtcagccataccggtcagcattctacgtactcgagcagcagagagtgggtctggcagtggacatggacgaaatagagaaatatcaggaggtggaagaagaccaagatccgtcttgtccgaggctcagtagggaactgctggccgagaaggaacctgaagtcttacaggattcccttgaccgatgctacagcacaccttccggatatctagaattacctgacctgggacaaccttaccgtagtgccgtgtatagcctggaggaacagtatctgggcttagctcttgacgtggaccgcataaagaaagaccaggaggaagaagaggaccagggaccgccttgtcccagactcagcagagaactgttagaagttgttgaacctgaggtcctacaagatagtctggacgtgatccagctcttacctgtggtgctgaatagcctcacccctgcctctcctaccgaagtgcctttcatgcattggcggaaaaacatgttggctttcctgctgacctgggaaaagttaaaaagaagaggccgcggacggaaggaaggcgaggaggatcagcgacgcaaagaggaaggagaggaaaaaaaaggaaaaaaaattaagacacaccatgccccaggctcaacggcttgctag

SEQ ID NO: 126149 - DNA, 234 bp, Artificial Sequence
  Description of Artificial Sequence: Synthetic coding sequence
atggatgagatagagaagtatcaagaagtcgaggaggatcaggacccttcctgcccaagactctcacgcgagctacttgccgaaaaggagcctgaagttctccaggactcgctggatcgttgctattccacgccatcaggttacctggagctgcctgatctggggcagccctatcgttccgccgtctatagtctggaggagcagtacctgggcctggcgctcgacgttgactag

SEQ ID NO: 126150 - DNA, 234 bp, Artificial Sequence
  Description of Artificial Sequence: Synthetic coding sequence
atggacgaaatcgaaaagtatcaagaggttgaagaagatcaggatccttcgtgtcctcgccttagccgcgaattgctggctgagaaagagccagaggtgcttcaggattcacttgaccgttggtatagcactcccagcggatacctggaactacccgatttgggccaaccttaccgttcagccgtttatagcctggaagaacagtatcttggccttgcactggacgtggactag

SEQ ID NO: 126151 - DNA, 234 bp, Artificial Sequence
  Description of Artificial Sequence: Synthetic coding sequence
atggacgagatcgagaagtaccaagaagttgaggaagatcaggacccgagctgccctcgcctgagtagagagttattggcagaaaaggaaccggaggtgctccaggacagtctggatcgatgctactcgaccccatccgggtaccttgagctcccggacctgggccaaccttataggtcagcagtgtactccctcgaagagcagtacctgggtctcgccttagacgtcgattag

SEQ ID NO: 126152 - DNA, 207 bp, Artificial Sequence
  Description of Artificial Sequence: Synthetic coding sequence
gaaatgcagaaggcagaggagaaagaagtgccagaagactcgttggaagaatgcgcgatcacgtgctctaattcacacggcccatatgatagtaaccagcctcatcgtaaaacaaagatcacctttgaggaagataaagtcgattccacactcattggatcaagctcacatgtggagtgggaagacgctgtgcatatcattccatag

SEQ ID NO: 126153 - DNA, 9996 bp, Artificial Sequence
  Description of Artificial Sequence: Synthetic coding sequence
atggtcgtgtcagccggcccttggtcatccgagaaggcagaaatgaacattttggagattaacgaaaagctgaggcctcagctggccgaaaacaagcaacagttccgcaatcttaaagaaaggtgttttttgacgcagctagccggttttctcgcaaatagacagaagaaatacaagtacgaggaatgcaaagacctgatcaaatttatgctgcgcaatgagcgacaatttaaggaggagaagctagcagaacagctgaagcaagctgaagaactgaggcaatacaaagtgctcgtccactctcaggagcgcgagttgactcagctaagagagaagctgcgtgagggaagggatgcgagcagatcgttgaacgagcacctccaggcattgctgacacctgacgagcccgataagtcgcaaggacaagacctccaggaacagttggccgagggctgcaggcttgctcagcagttggtccagaaactgtcaccagagaacgatgaggacgaagacgaagacgtccaggttgaggaggatgagaaagttttagagtcatctgcccctagagaggtgcagaaagccgaagagagtaaggtgcctgaagactctctggaggagtgcgctatcacatgcagcaacagccatggcccttgtgattccaatcagccacacaaaaacataaaaataacattcgaagaggacaaggtcaattccactgtcgtggtggaccggaaatcaagccacgacgagtgtcaggatgcgctcaatattctgcccgtaccagggccaacctccagcgccaccaacgttagcatggttgtgtccgctggacccctgtcctctgagaaggcagaaatgaacatcctcgagattaacgagaaactgcggccacagctggcagagaagaaacagcagtttaggtccctgaaggaaaagtgctttgtgacccagctggcgggtttcctcgcaaaacagcaaaacaaatacaaatacgaagagtgcaaggacctgattaaaagcatgctgcgcaatgaactccagttcaaagaagaaaagctggccgagcaattgaaacaggcagaagaactgcgtcagtacaaagtgctagtgcacagccaggaacgggaacttacacaactgcgcgagaaattgagggagggccgggatgcttcgagatcccttaacgagcacctccaagctctgttgaccccagatgaaccagataaaagccaagggcaggatctgcaagaacaactggctgaaggatgccgcctcgcacagcatctagttcagaagctctcccccgaaaacgacgaggacgaagacgaagatgtgcaggttgaagaagatgagaaagtcctagaaagcagttctcctcgagagatgcagaaggccgaagagtccaaagtgcctgaagatagcctggaagagtgcgcaattacttgctcaaatagccacggcccatgtgactcgaatcagcctcacaaaaatatcaaaataactttcgaggaggacaaggttaattcgtctctggtggttgaccgcgagtatagccacgatgaatgtcaagatgcactcaatatacttccagttcccgggcctacctcctccgccacaaatgtctccatggtggtatcagcaggcccactctcatccgagaaagctgagatgaatatcctggaaatcaacgaaaagctccggccgcagctggcagaaaaaaagcagcagttccggagcctaaaagaaaaatgcttcgtgactcaggtggcctgtttcctggctaaacagcagaacaagtataagtacgaggaatgcaaggacctgattaagagtatgttgcgtaatgaattgcagttcaaagaggagaaattagctgaacagctaaaacaggcggaagagttacgccaatataaagtcctggtccattcacaggagcgggaattgacacagctgagagaaaaactgcgggagggtagggatgcttctaggagcttgaatgaacacctgcaggccttgctgacacccgatgagcctgataaatcacagggccaggatttgcaggagcagctggctgaagggtgccgcctagcccagcatctcgtgcaaaaattaagcccagagaacgataacgacgacgacgaggacgtgcaggtggaggtggctgaaaaagtccagaagagtagttcccctcgcgagatgcagaaggctgaggagaaggaagtgcctgaagacagcctggaagagtgtgccatcacctgcagcaatagccatgggccatatgactccaatcagcctcaccgcaaaaccaagattaccttcgaggaagacaaggtggactctactctgattgggagctcctctcatgttgagtgggaagacgcagtccacatcatccccgaaaacgagagtgatgatgaagaggaagaagagaaaggtcctgtaagtccacgcaacctgcaggagtccgaggaagaggaggtgccgcaggaatcctgggatgagggttattctaccctgagtataccccccgaaaggctggcctcttatcagtcatactcaagtactttccactcactcgaggaacagcaggtgtgtatggccgtggatataggctctgagtactcaattgtgaaggtcatcaagctacagttcatggctcagtcccaggcaatgcccgtgcccacatggacggactgccatgatatcgagctcaaggcaggacatcggtgggatcaggtgaagaaggaagatcaggaagctaccgggcctaggctgtcccgggagcttttagctgagaaggaaccggaggtgttacaggattctctggaccgatgctactctacacccagcgtgtacttgggattgactgactcgtgccagccatatcgttctgctttttatgtgctggaacagcagcgcgttggcttagccgtggatatggatgagatcgaaaagtatcaagaagtcgaggaggaccaagatccatcctgcccccggctatctagagaactacttgcggagaaggagccagaggtgcttcaggacagtcttgaccgttggtatagcactccgtcgggctatcttgagctgcccgacctcggtcagccataccgatctgcagtgtacagcctagaggaacagtacctggggctggccctcgacgtcgatcgcattaagaaggaccaggaggaggaggaggatcagggcccaccgtgccctcgcctatccagggagctactcgaggtcgtcgaacctgaagtgctccaggattccctcgaccggtgctactccacgcctagctcctgcttggagcagccagattcctgccagccatatcggtccagcttttatgcactggaggaaaagcacgtgggattttcactggacgtgggggagatcgaaaagaaggggaagggcaagaagcgaagaggtagaagaagcaaaaaaaaaagaagacggggcaggaaggagggagaagaagaccagaatccaccctgtccaagactctctagagaactcctcgctgaaaaggaacccgaggtgctacaggattccctcgataggtggtactccaccccatctgtttacctgggcttgactgatccttgtcagccctatcggagtgccttttatgtgttggagcagcagagagtgggactggccgtcgacatggacgagattgagaagtatcaggaagtggaagaagatcaggatccttcctgcccaagactgtctagggagttgctggcagaaaaagagcccgaagtcttacaggactctctcgataggtggtacagcaccccttccgggtacctggaactcccggacttggggcagccttatcggagcgctgtatactcactggaagaacaatatttaggcctggcactggacgtggatcggattaagaaggatcaagaagaggaggaagatcagggcccgccctgtccaagacttagcagggagctcctcgaggtggttgagcccgaagtcctgcaagactctctagaccgctgctactctacaccatcttcttgcctggaacagccggactcctgtcaaccgtacaggagctccttttacgcactcgaggagaagcatgtgggatttagcctggatgtcggcgagattgaaaagaaggggaaaggcaagaaacgcagaggacgccgtagcaaaaagaaaaggagacggggcaggaaggagggagaagaggatcaaaaccccccatgcccaaggctgtcccgggagctattagccgaaaaagaacccgaggtcttgcaggactccctggatcggtggtacagcaccccgtccgtctacctggggcttactgacccgtgccagccttatcgttcggctttctacgttctggaacaacagcgtgtgggactagccgtggatatggatgaaattgaaaaatatcaagaagttgaagaggatcaggacccatcttgtcctaggctttccagagaactgcttgccgaaaaggagcctgaagtgctccaagattcactagaccggtggtactcgactcccagtgggtatctggagttacctgaccttgggcagccttaccgcagcgcagtgtacagcctcgaggaacagtacttaggcctggccctggacgtggatcgaataaagaaagaccaggaagaggaggaggaccagggtcctccttgcccaaggctcagccgcgagttacttgaggtggtggaacctgaagttctgcaggactctttggataggtgttactcaactccttcatcttgtttagagcagcccgactcctgccagccctatcggtcctctttctacgcactagaggagaaacatgtgggattctccttggacgttggggaaatcgagaagaaagggaagggaaaaaaaaggcgcgggcgtcgaagcaaaaagaaacgtagaagaggtcgcaaggagggcgaggaagatcagaaccccccatgtcctcggctgagccgggaacttctggcggagaaagagcctgaggttctccaggattctctggatcgatggtattctacaccttccgtctatctcggactgactgatccttgccagccgtatcgatccgctttctatgtcctggagcagcagagagtggggttagccgtagatatggatgagatcgagaagtaccaggaagtagaagaggatcaggaccccagctgccctagactcagtagagaactactggccgagaaggagccagaggtcttgcaagattcccttgaccggtggtacagtacgccatctgggtatctggagcttcctgacttaggtcagccataccgttccgccgtatattctctggaagagcagtacctcggcctggctctagatgtggacagaatcaagaaagatcaagaggaagaagaagaccaaggccctccatgtcctcgcctgtcacgggaactgctcgaagtcgtggagccagaggtgctgcaggacagtctggaccgatgctactctaccccttcttcctgtcttgagcagcctgatagctgccagccatatcgtagttccttctacgctctcgaagagaagcacgtaggcttctcactggacgttggggaaattgaaaagaaaggtaagggcaaaaagcggaggggtcggcgaagtaagaaaaaacggcggcgaggcagaaaagaaggggaggaggatcagaacccaccatgcccacgactaagcagagagcttctggctgaaaaggaaccagaggtgctgcaggattctttggaccgatggtatagcactcccagtgtctacttgggacttaccgacccatgccaaccctatcgaagcgccttctacgtcctcgagcagcagagggtcgggctcgccgtagacatggatgaaatcgagaagtaccaggaggttgaggaagatcaggacccatcttgtccccggctgtccagggaactgttggcagagaaagaacccgaggtccttcaagatagcctggataggtggtatagcacaccatctggctacttggaactaccagatctgggtcaaccgtaccggtccgcagtgtattccctcgaggaacaatatctcgggctggcattggacgtggataaaattgaaaaataccaggaagtagaagaggatcaggaccctagctgccccagactgagccgggagcttctagcagagaaagagccagaggtacttcaggactctcttgaccgctggtatagcactccgtccgtgtacttaggcctcacggacccatgccagccttatcggagtgctttctatgtgttagagcagcagagggttggactcgctgtggacatggacgagatcgagaagtaccaggaggtagaggaggatcaagatccctcatgtccgcggctttctcgagagctgcttgccgagaaagagccagaggtactccaggattccctcgaccgctgttacagcacacccagcgggtacctggaactacctgatctgggccagccctatcgaagcgcagtttactcactcgaggaacagtacttggggctggcattggatgtagaccggatcaagaaagatcaagaagaggaggaggaccaaggtcccccttgcccccggttatcgagagaactactggaagtagtcgagcctgaggtgctgcaggattcactggaccgttgctattcaacaccttccagctgtctggagcagccagatagttgtcagccctaccgatcctccttttacgctcttgaggagaagcatgtgggcttcagcctggacgtgggcgaaatcgaaaaataccaagaggtggaagaagaccaagacccctcgtgcccacgattgtctagggagctccttgccgaaaaggagccagaagtcctccaggatagtctcgaccggtggtactctacacccagtgtgtatctgggcctgaccgatccatgccagccttataggtccgctttctacgtgctggagcagcagcgagtgggattggcggtcgatatggacgagatagaaaagtatcaggaagtcgaagaagatcaggacccctcctgtcctaggctctccagggagctcctggccgagaaggaacccgaagtactgcaagatagcctcgatcggtgctattcaaccccaagcggctatctggaattacccgacctgggacaaccttaccggtcagctgtgtacagtctggaggaacagtatctgggcctggctctagacgtcgatcgaattaaaaaggatcaggaggaagaagaagatcagggcccaccctgtccccggctcagtagagagctcctcgaggtggtagaacccgaagtgctgcaggactcgcttgaccgctgttactctactccctcctcctgcctggagcagcccgatagctgccagccatacaggtcctccttctatgcgttggaggagaaacatgttgggttttcgctcgatgttggggagattgagaaaaaaggtaagggcaaaaagagaagggggcggcggagcaagaagaaaagacgtcggggtcggaaagaaggcgaagaagaccagaatccaccgtgccctcgcttgtctcgggaacttctagctgagaaggagccagaagtactgcaggacagtctcgataggtggtacagcaccccgtccgtttacctgggcctgacagatccctgtcagccatacagatcagccttttatgtgctggagcagcagagagtggggctcgccgttgatatggacgaaatagaaaagtatcaggaggtagaggaggatcaggatccctcgtgtccccggttatctcgcgaactgttggccgagaaggagcccgaagtgctgcaggattcactcgatcgttggtactccacgccctccggctaccttgagcttcccgatctcggacagccataccgtagtgctgtctatagcctggaggagcagtatcttggcctggccttggatgtggataggattaagaaggaccaagaagaggaagaagaccaggggccaccttgccctcgcctgtctcgcgagctgttggaagtggtcgaacctgaggtgctacaggacagcctggatcggtgctacagcacaccctctagctgcttggaacaacctgactcatgtcagccataccgatcgtccttttatgccctcgaagagaaacatgtgggattcagcctcgacgtgggcgagatcgagaagaaagggaaaggtaaaaaaaggagaggtcgacggtccaagaagaagcgaagacgtggccgcaaagaaggggaggaggaccagaacccaccctgcccacgcctatcgcgagagcttttagccgaaaaggaaccagaggtcctccaggattcattggaccgctggtactctactcctagtgtctaccttggactgaccgacccttgccagccctatcgttctgccttttatgtgcttgagcagcagagagtaggtctcgccgtggacatggacgagattgaaaaatatcaggaggtggaagaagaccaagacccatcttgtccccggctaagcagggagctgctggcggagaaggagccggaggtgctccaagacagccttgatagatgttacagcaccccatctggatacctggaactgcccgatctggggcaaccttaccgatcggccgtatactctttagaagagcaatacttgggcctggccctcgacgtcgatcgaataaagaaagatcaggaagaggaggaagaccagggaccaccatgtcctcgcctctcccgagaacttctcgaagtggttgagcctgaggtgctgcaggattcccttgataggtgctacagcacccccagtagctgtctggagcaaccagatagctgtcagccctaccggagttccttctacgctctcgaagagaagcacgtgggatttagcctcgacgtgggagaaatcgaaaaaaaaggaaaagggaagaagcggcgtggccgccgctccaaaaaaaagcgcagaagggggaggaaagaaggtgaggaagatcagaacccaccttgcccccggctctctcgcgaactgctcgccgaaaaggagcctgaggttctgcaggattcgctcgaccgttggtatagcacccctagtgtctacctcggtttgaccgatccttgtcagccctgcaggagcgccttttacgttctggagcagcagagagtggggctagctgtggatatggacgaaatcgaaaagtatcaggaggtcgaagaagatcaggacccatcatgcccacgtctgtcacgcgagcttctggccgagaaagaacccgaagttctgcaggattcccttgatcgatgttattccactcctagtggctacctggaacttccagatttggggcaaccttaccggtctgccgtttattcgctggaagagcaatacctcggactggctttagacgttgatcgcatcaaaaaggatcaagaggaagaagaagaccagggccccccctgcccacgcctgtccagggaactcttggaggtggttgaacccgaagtcctccaagatagcttagaccgctgttactctacacctagcagctgcctcgagcagccagattcttgccagccatacaggtcaagtttttacgccttggaggagaagcacgtgggctttagcctcgacgtgggggagattgaaaaaaagggcaaaggcaagaagagacgcgggcgcaggtcaaagaaaaaacgcagacgcggaagaaaagaaggtgaggaggatcaaaaccctccctgtcctcggttgaacagcgtgctgatggaggtagaagagcctgaagtgctgcaggattccctcgataggtgctactcgacaccttccatgtacttcgaactgcccgactccttccagcactatcgaagcgtgttttattcattcgaagagcagcacatcacattcgccctggacatggacaattcctttttcaccctaaccgttaccagccttcacctggtgtttcaaatgggggtgatctttccgcagtag

SEQ ID NO: 126154 - DNA, 234 bp, Artificial Sequence
  Description of Artificial Sequence: Synthetic coding sequence
atggatgaaatcgaaaagtaccaggaagtggaagaggatcaggatccctcttgtcccagactctcgagggagctgttggctgaaaaggagccagaagtattgcaagatagtctcgatcgttgttacagcaccccttctggatacctggaactgccagatttggggcagccctatcggtccgccgtgtactcacttgaggaacaatatctagggctcgccctcgacgtagactag

SEQ ID NO: 126155 - DNA, 2517 bp, Artificial Sequence
  Description of Artificial Sequence: Synthetic coding sequence
atggtggtgagtgcaggcccctggagtagcgaaaaggctgaaatgaatattctcgaaataaacgaaaagctgcgcccccaacttgcagagaataaacagcaatttcggaacctgaaggaacggtgtttcttgacacagcttgcagggttcttggctaaccgacagaagaagtataagtatgaagaatgtaaagacctaatcaaattcatgctgcgcaacgagcgccagttcaaagaagaaaaactggccgaacaattgaagcaggccgaggaattgaggcagtacaaagtccttgtccacagccaggagcgcgaattaacccagcttcgcgagaagctgcgggagggacgggacgcttcacgctctctgaacgagcatttgcaagccctgctcactcccgatgagcccgacaagtcccagggacaagacctgcaggaacagctggcggagggatgccggcttgcacagcagctcgtgcagaaactgtctccagaaaatgacgaagatgaagatgaagatgtgcaggtggaagaggatgagaaagtgctcgagagctccgcccctagggaagtccaaaaggcggaagagtctaaagtccccgaggattcacttgaggagtgtgctatcacttgcagtaattcccatggaccctgcgactccaatcagccacacaaaaacatcaagatcacgtttgaagaggataaagtgaattcaagtttagtcgtggatcgcgaatattctcacgatgaatgtcaggatgcgctgaatattctgcccgtgccaggtcctacttcaagcgccaccaatgtaagcatggtcgtgtccgccggccctctgagctcagagaaagccgagatgaatatcttggaaatcaacgagaagctccgtccccaactcgctgagaaaaagcagcaatttcgtagtttgaaggagaaatgttttgtaacccaggtcgcttgcttcctggccaaacagcaaaacaaatacaagtatgaggagtgtaaagacttaatcaaaagtatgcttagaaacgaactgcaatttaaagaagaaaagctggctgaacagctcaagcaggcagaagagctgcgccaatacaaagtcctggtgcattcccaggagcgtgaattgactcaactgagagaaaagctgagggaaggacgcgatgctagccggagtctgaacgaacatctgcaggcactgttgactcccgacgagccagacaagtctcagggacaggatttgcaagaacagctggcagagggttgtcggttggcccagcaccttgttcaaaaacttagtcccgagaatgataacgacgatgacgaggatgtccaggtagaagtagcagagaaggtgcagaaatcctctagtcccagggagatgcagaaggccgaagaaaaggaggttcccgaagattccctggaggaatgtgccataacttgctcaaatagtcatggaccctacgactcgaatcagcctcaccggaagcctaagagccacttgcggaaaacaaaaagcacccagctgagcctggcccaccccttgatgctcaacggtcggatgctgtatacactaagtcaaaaaatgaaagtgatgatgcgcaagcgcaagaaaaaggggcagtgcctgcccgggatctgccgctctctcaagcgtcggaagtcccctcgctcccccggaatgaaggtgatccgcctctcgcagtttctgctcaagggccatcgctgggaccaggtgaaaaaggaggaccaggaggctacaggaccgcggctaagcagagaactcttggccgaaaaagagcccgaagtacttcaggactccttggacagatgttacagcactccatctgtgtacctagggttgactgatagctgtcagccctacaggtcagccttctacgtgttggagcagcagagagtgggattggctgtggatatggacgagattgagaaataccaggaagtggaggaggatcaagacccgagctgcccacggctatcccgtgaactgctagctgagaaggaaccagaagtactccaagacagccttgaccggtgctattcaaccccctccggctacctcgaactcccagatctaggacagccctatagaagtgccgtttactctctggaggagcaataccttggcctcgccctagatgtggatagaatcaaaaaggaccaggaagaagaagaagatcagggtccaccctgccctcgattgtctcgtgaattgctggaggtggtagagcccgaggttctccaagacagcctggacgttatccagctgctacccgtcgtgctgaactcgctcacgcctgcttctccaacggaagtaccttttatgcactggaggaaaaacatgttagcatttttactcacctgggaaaagctaaaaagaaggggtagaggacggaaagaaggcgaggaggaccagaggagaaaagaagagggggaggagaaaaaaggtaagaagataaagacccatcacgcccccgggtcaacagcatgttag

SEQ ID NO: 126156 - DNA, 288 bp, Artificial Sequence
  Description of Artificial Sequence: Synthetic coding sequence
atcgctgaaatcgagaagtatcaagaggtagaggaagaccaggacccctcatgtccacgtctctccagagaactactcgctgagaaggaaccagaggtgcttcaggatagcttggatcgctggtattccaccccctcgggatacctggagctgccagacctcgggcaaccttaccggtctgcagtatactcactggaggagcagtatttagggctcgctctggatgtggataagattgaaaagtatcaggaagtagaggaagatcaggatcctagctgtcctaggtag

SEQ ID NO: 126157 - DNA, 234 bp, Artificial Sequence
  Description of Artificial Sequence: Synthetic coding sequence
atggacgaaatcgaaaagtaccaagaagtagaggaggaccaggacccttcttgccctcgattaagccgggagttgctcgcagagaaagagcccgaggttttgcaggatagcctcgacagatgctatagtaccccgagtggctaccttgaattgcccgatctgggtcagccctaccgctcagcagtgtatagtctggaagagcagtatctgggcctggccctcgatgtagattag

SEQ ID NO: 126158 - DNA, 2784 bp, Artificial Sequence
  Description of Artificial Sequence: Synthetic coding sequence
taagacctgattaaatccatgctgaggaatgaaagacagttcaaggaagagaagttggccgagcagttaaagcaggctgaggaactccgacagtacaaagtgttagtgcacgcccaagagcgagagctgacccagcttcgcgagaagctgcgcgagggtcgcgacgctagtcggagcctgaatgaacatctgcaagccctcctgacacctgacgaacccgataagtctcaaggacaagatctccaggaacagctcgcagagggctgccgcttagcacagcaccttgtccagaagctctctccagagaacgataatgacgatgacgaggacgtacaagtggaagtggcagagaaagtacaaaaatcatccgctccaagagagatgcaaaaagctgaggagaaggaagtgccagaagatagccttgaggagtgtgcaatcacctgcagtaactcacacggaccatatgattccaaccagccgcaccgcaagacaaagatcacatttgaggaggataaggtggacagcacacttattggatctagcagccacgtggagtgggaggatgccgtgcacatcatccctgaaaatgaatcagatgacgaagaagaagaggagaaaggaccggtcagtcccaggaacctgcaggagagtgaagaggaagaggtacctcaagagagttgggatgaggggtacagcacgctgtctattcctcccgagatgctcgcgagttataaatcatattccagcaccttccacagcctcgaggaacagcaggtgtgtatggccgttgacatcgggcggcaccggtgggatcaggttaaaaaggaggatcacgaagcaactggaccgcggctctcccgagaacttctcgatgagaagggcccagaggtgctccaagacagcctcgataggtgttattcaacaccatcgggctgtcttgagctcactgactcttgccagccatacaggagcgccttctatgttttagagcagcagcgggtgggtctcgcagtgaatatggatgaaatagaaaaataccaggaggtggaggaggaccaggatccgtcctgtcctcgccttagccgggagctgctggatgaaaaggaacccgaagttctacaggatagtctggggagatgctactccaccccatcaggttatttagaactcccagatttaggacagccttactcatccgccgtgtactctctcgaggagcagtacctgggtctggcattggacgtcgacagaattaaaaaagatcaggaggaggaggaggatcagggacccccctgcccgcgcttaagtcgggaactccttgaggttgtagagcccgaggtcctccaagatagtctggacagatgctatagcacaccctctagttgcctggagcaaccagactcatgccagccatacggctctagcttctacgcactggaggaaaagcatgtgggcttctctctcgacgtgggcgaaatagagaagaagggaaagggtaaaaaacggagaggccggagatcaaagaaggagcggcggagaggcaggaaggaaggcgaagaagaccagaacccaccgtgccctcggctgagtagggagttgctggatgagaaggggccagaagtcttgcaagattctttggacagatgctacagcacccccagtggatgtcttgaacttaccgactcatgccagccttatcgcagcgccttttatatactcgagcagcagcgcgtcggccttgctgttgatatggacgagatcgaaaagtaccaggaggtggaggaggaccaggatccctcttgccctagattatccggcgaactcctagatgaaaaagagcccgaggtgctgcaggaatcactggatagatgctactccaccccaagcggctgcctcgaactgacagattcctgccagccctatcgaagtgctttctacattctcgaacagcagcgggttggcctggccgtcgacatggatgagatcgaaaagtatcaggaggtggaggaggatcaagatcctagctgcccacgtctcagcagggagctccttgacgagaaagagcccgaagtactccaggattcgctgggccgctgttactcaactcctagtgggtatttagagctgcctgatctgggacaaccctacagttccgcagtatactccctggaggagcagtacctgggactggctcttgacgtcgatagaatcaagaaggaccaggaggaggaagaagatcaagggcccccttgtccaagactctccagggaactgctcgaggttgtggagcccgaggtgcttcaagacagcctggacagatgctacagtacccccagctcatgcctggagcagccggactcttgccaaccatacggaagtagtttttatgccctagaagaaaaacacgtaggtttctccctcgatgttggtgaaattgagaaaaagggcaaaggtaagaaacgtcgaggccgacggagcaaaaaggaaagaaggcggggacgcaaagaaggcgaggaggaccagaatccgccatgtcctaggctgaatagtatgctgatggaggtggaggagcccgaggtccttcaggactcacttgacatctgctattctacaccatcaatgtatttcgagctgcccgacagttttcagcactatagaagcgtattctatagtttcgaagaagagcacattagcttcgccctgtatgttgataatagatttttcacgctgactgtcactagcctgcacctggtgtttcagatgggcgtgattttcccacagtag

SEQ ID NO: 126159 - DNA, 2766 bp, Artificial Sequence
  Description of Artificial Sequence: Synthetic coding sequence
atgctgcggaatgaacgtcaattcaaagaggaaaagctggccgaacaacttaaacaggccgaggagttgcgccaatacaaggttctggtgcatgcccaggaaagggaactgacgcaattgcgggagaaactcagagaaggtagggacgcttcccgttccctaaacgaacacctccaagctttgctaacacctgacgagccagacaagtcacaaggacaagaccttcaggagcagctcgctgaagggtgtagactggcacagcatcttgtgcagaaactgagccccgaaaatgacaatgatgatgacgaggacgtgcaagtcgaagtcgcagagaaggtacagaaatccagcgcaccaagagaaatgcagaaggccgaagagaaggaagtacccgaggacagcctggaggagtgcgccattacttgcagcaacagccacggaccctatgacagcaatcagccacacaggaaaaccaagataacattcgaggaagacaaagtggactctaccctaatcggatcgtccagccatgtcgaatgggaggatgccgttcacatcattccagagaacgagagtgacgacgaagaagaggaagaaaaggggcctgtgtctccccggaatcttcaggagtcggaagaagaggaagtaccacaggaatcctgggacgagggctattcaacgctctccataccacctgaaatgctggcatcgtacaagagttacagcagtacatttcactctctggaggagcaacaggtctgtatggccgtagacataggacgccacagatgggatcaggtcaagaaggaggaccatgaggccacaggccccagactgtcaagggaactgcttgatgagaaggggcccgaagtgttacaggattccttggacagatgctactcaacaccatctggttgcctggaactcaccgattcttgtcagccataccggagtgctttctatgttctggagcagcagcgggttggcttagcagtgaatatggatgagattgagaagtatcaggaagtcgaggaggaccaggatccttcgtgcccgcgtctatctcgggagttattagacgagaaagaaccggaggtgctgcaagatagtcttgggcggtgctattcaacccctagcggctatctcgagcttcctgatctggggcagccatatagctctgccgtgtactctctggaagaacaatacctgggcctggccctcgatgttgataggattaaaaaggatcaagaggaggaggaggaccaaggaccaccttgtcccaggctcagccgagaattgctcgaagtcgtcgaaccagaagttctacaagattctctggacagatgttactcgaccccttctagctgcttagaacagcccgactcctgccaaccatatggctcaagcttctacgctctggaagaaaagcacgtgggcttttctcttgatgtgggcgaaatcgagaaaaagggaaaaggcaagaaacgcaggggaagacgatcaaagaaagaacgccggaggggccgaaaggaaggagaagaggatcagaaccctccctgccccaggctcagccgcgagttgcttgacgagaaggggccagaagtcctgcaggacagcttggatagatgctacagcactccatctggctgcctcgaactgaccgattcctgccagccctacagaagtgctttctacattcttgagcaacagagggtgggtctcgccgtggatatggatgagattgaaaagtatcaagaggtggaggaagatcaagacccaagttgtccacgtctcagtggggagctgctggacgaaaaagagcctgaagtcctgcaggaaagtctcgacaggtgctattcaacccccagtggctgtctggagctgactgattcatgccagccataccggtcggctttttacattttggaacagcaacgggtaggcttagcagtggacatggacgaaatcgagaaatatcaggaggttgaagaagaccaggatccaagctgccctcggctctctagagagttattggacgagaaagagcccgaagtgctgcaggattctctgggtaggtgttattctactccgtctggatacctggaactccctgacttggggcagccctattcaagtgctgtgtactccctggaggagcagtatctcggattagccctggacgtggaccgcatcaaaaaggatcaggaggaggaggaagaccagggccctccctgcccccgcctttcccgcgagcttcttgaagtggtggagcctgaggtacttcaggactcgctggatagatgctactcaactcccagcagttgtttagagcagcccgacagctgccaaccttatggtagcagtttttatgccttagaggagaagcatgttgggttctctctagatgtgggcgaaattgagaagaaaggaaaaggaaagaaacgccgagggcgccgttcaaagaaggagcgaaggcgggggagaaaagagggcgaagaagaccagaaccccccttgccctagacttaactccatgctgatggaggtcgaggagccggaagtcttgcaggattctcttgacatctgttattctaccccatcaatgtatttcgagctgcccgatagttttcagcattaccgatcagtgttctattctttcgaggaagagcatatcagcttcgcactgtatgttgacaatagattttttaccctgacagtgactagtcttcaccttgtgttccagatgggagtgatatttccgcagtag

SEQ ID NO: 126160 - DNA, 810 bp, Artificial Sequence
  Description of Artificial Sequence: Synthetic coding sequence
atggatgagatcgaaaaataccaggaggtcgaagaagatcaggacccctcttgccctagactctctcgggagctcttagatgaaaaggaacccgaagttctacaagactcattgggcaggtgctacagcacaccgagcgggtacctggagttaccagacctgggacagccttactcctccgcagtatattccttggaggagcaatatctgggcctcgcccttgacgtcgacaggataaaaaaggatcaggaggaggaggaagaccaagggccaccgtgcccccgcctgtcccgggagctgctggaggtggttgaacctgaggtcctgcaggactccctcgacagatgctactccaccccgagctcttgcctggagcagcccgactcttgccagccctacgggagttcattctacgccctcgaggaaaaacacgtggggttctccctggacgtgggtgaaatcgaaaagaagggaaagggcaaaaagcgcagaggacgtaggagcaagaaggagagaaggcgcggcaggaaggagggagaggaggaccaaaaccccccatgtccacgattgaatagcatgctgatggaagtggaagaaccagaggtactccaggatagcctggacatatgctatagcacccctagtatgtacttcgagttgcccgactcttttcagcattacaggagcgtgttctatagctttgaagaggaacatattagtttcgcactctacgtggataacagatttttcactctgactgtaacatcattgcacctggtgttccaaatgggggtgatcttcccacagtag

SEQ ID NO: 126161 - DNA, 1539 bp, Artificial Sequence
  Description of Artificial Sequence: Synthetic coding sequence
taatacgaggaatgtaaagacttgattaaatccatgttgagaaatgagaggcagtttaaagaggagaagttagcagagcaactaaagcaggccgaagagttgagacagtataaagttctggtccacgcccaggagagagaacttacacaactgagagaaaagctgagggagggaagagatgcgagcagatcactgaacgaacatctccaagccctgctcactcccgatgaaccagacaaaagtcaggggcaggatctgcaagagcaattggctgaggggtgccggcttgcccagcacctggtgcagaagctctcccccgagaacgacaacgatgacgacgaggatgtgcaggtggaagtcgccgagaaggtgcagaaaagctctgccccccgggaaatgcagaaggctgaggagaaggaggtccctgaagactccctcgaagaatgcgctatcacatgcagtaactctcacggcccttatgactccaatcaaccacaccgtaaaactaaaataacctttgaggaggataaggtggacagtacgctgattggcagcagttcacatgtggagtgggaggacgccgtgcatataattccagagaatgagagtgatgatgaggaggaagaagaaaagggtcctgtctccccacgcaatctgcaagagtctgaagaagaggaggtgcctcaggagtcttgggacgagggatactctaccctttctatccctcccgagatgcttgcatcttacaaatcttacagctcaaccttccactctctcgaggagcagcaggtgtgcatggctgtggatattggtagacatcggtgggatcaggtgaaaaaagaagaccatgaggccacagggccacgcctctcacgcgagctgctggatgaaaaggggccagaagtcttacaagactcactggatagatgctattccactccctccggctgcctggaattgaccgattcctgccaaccttaccgatccgccttctacgtgctggagcagcagagagttgggctcgccgtgaacatggatgagatagagaaataccaggaagtggaggaggatcaagatccgagctgtccacggttgtcccgcgagttactggacgagaaggagcctgaagtgttgcaggattccctggggagatgttacagcacgccatccggctacttggagttgcctgacctgggtcagccctacagttccgctgtctactccctcgaagaacagtatctcgggctcgctctagacgtggataggatcaagaaggaccaggaggaagaggaagaccaggggcccccctgcccacggctgagccgggaactgctggaggttgtcgaacctgaagtcctccaggattccctagaccgctgctactccactccgagcagctgtcttgaacaaccagattcttgtcagccttacggaagtagtttctatgccctagaggaaaagcacgtggggttttcattggatgttggcgaaatcgagaagaaggggaagggtaagaagagaagaggacgccggtcttag

SEQ ID NO: 126162 - DNA, 567 bp, Artificial Sequence
  Description of Artificial Sequence: Synthetic coding sequence
atggacgagatcgaaaagtatcaggaggtggaggaggatcaggatccctcctgtccaagactatcgcgggagcttctggacgaaaaggagcctgaagtgctgcaggatagcctggggcggtgttattcaactccctccggatatcttgaattacctgatttgggccagccctacagctctgcagtgtatagcctggaggaacagtaccttggactggcactcgacgtggatagaatcaaaaaggatcaggaggaggaagaagatcaggggcccccctgtccacggctgagtcgtgaactgctcgaagtcgttgagccagaagtgctgcaggactcattggataggtgctattccactcctagcagctgtctggagcagcctgacagttgtcagccttacggatcttcattctatgcccttgaggaaaaacatgtgggcttcagtttggatgtgggcgaaattgaaaagaaaggaaagggaaagaaaagacgtgggcgaaggtcaaagaaagagaggcggcggggccggaaagagggcgaggaagaccagaaccccccctgcccctag

SEQ ID NO: 126163 - DNA, 1539 bp, Artificial Sequence
  Description of Artificial Sequence: Synthetic coding sequence
taatacgaggagtgtaaagatcttattaagagtatgttgcggaacgagcggcagtttaaggaagaaaagctggccgaacagttgaaacaggccgaggaactccggcagtataaggtactcgtgcatgctcaggagcgcgagctgacccagctgagggagaagctgcgtgaaggtagagatgcatctagatccctgaatgagcacctgcaggcattactcacgccagacgagcccgataaatcacaggggcaggacctccaggaacaactggcagaaggttgccggctcgcacagcacctggtgcagaaactctcaccagagaacgacaacgatgacgacgaagacgttcaggtggaggtggcagaaaaggtgcagaagagcagcgcccctcgagagatgcagaaagccgaagagaaggaggttcccgaggattccctggaggagtgcgcaatcacctgcagtaattcccacggaccatacgactcaaaccagcctcaccgaaaaacaaagataacattcgaggaggataaagttgattcgactctgattggcagttcaagtcacgttgagtgggaagatgccgtgcacatcatacccgaaaacgaatccgacgacgaagaagaggaggaaaaggggcccgtttccccgcggaaccttcaggaaagtgaagaggaggaggtcccccaggaatcttgggacgagggatactccaccctatctattccacctgagatgctcgcatcctacaaatcctattcctcgaccttccacagtctcgaggagcagcaggtgtgcatggctgtggacattggccgacacaggtgggaccaggtgaagaaggaggatcacgaggctaccgggcctcgcttgagtcgggagctgttagatgaaaagggtcctgaggtgctccaggatagcctggatcggtgttatagtactcccagcgggtgcctggagctcactgatagttgtcagccttatcgaagtgccttctacgtgctcgagcagcagagagtgggacttgccgtgaacatggacgagattgaaaaataccaagaggtcgaggaagatcaggatcctagctgcccaagactgagtcgggagctgctagacgaaaaggaacccgaggtgctgcaagatagtctgggacggtgttattccactccatctgggtacctggagctgcctgaccttggccagccttactcctcagccgtgtattctctcgaggagcagtatctgggattggcactcgacgttgaccgcatcaagaaggaccaggaagaggaagaagaccagggacccccatgccctagattgagcagggagctgctggaagtcgtggaaccagaggttcttcaagattctctggaccgctgctactcaacacccagctcctgcctggagcagcctgactcctgccagccttatggttcatctttctacgcgttggaagaaaaacacgttgggttttctctggacgtaggcgagattgagaaaaaggggaagggaaagaagagacgaggccgacggtcgtag

SEQ ID NO: 126164 - DNA, 1539 bp, Artificial Sequence
  Description of Artificial Sequence: Synthetic coding sequence
taatacgaggaatgcaaggacctaataaaatccatgctgcgcaatgaacggcaatttaaggaagaaaagttggcagaacagctgaagcaagccgaagagctccgtcagtataaagtacttgtgcacgcccaagaacgggaactaactcaattgcgggaaaaacttagggagggccgagacgcgagccgcagcttaaacgagcacctgcaggccttacttaccccagatgaacctgacaagagtcagggccaggatctgcaggaacaacttgctgagggttgccgcctcgcacagcatttggtacaaaagctttccccagagaacgacaacgatgatgacgaggatgtgcaggtggaagtggctgaaaaggttcagaagagttctgctcctcgggagatgcaaaaggccgaggagaaggaggtgccagaggattccctagaggagtgtgcaatcacctgcagcaacagccacggcccatacgattcaaatcagcctcaccggaaaactaaaattacatttgaggaggacaaggtggacagcacactgataggctccagcagccacgtggaatgggaggacgctgtgcatatcattccagaaaatgaaagcgatgacgaagaggaggaggagaaaggtcctgtatccccaaggaatctgcaagagtcagaggaggaagaggtaccccaggagagctgggatgaggggtatagtactctcagtattccgccagaaatgctcgcgagctacaagtcttattctagcaccttccactctctcgaagaacagcaggtgtgtatggcagtggacatcggccgtcatcgctgggaccaggtgaagaaagaagatcacgaggcaacgggcccacgtcttagccgggaactgctggatgagaaaggcccagaggtgctccaggatagcctagataggtgctactccacccccagtgggtgcctggagttgacagatagttgtcaaccctatcgcagtgcattttacgtcctcgaacagcaacgagttgggctggcagtgaacatggacgagatcgagaagtaccaggaggtggaagaggaccaagacccaagctgtccacggctcagccgagaacttctggatgaaaaggaacctgaggtcttgcaggactcactcggtcggtgctatagtaccccatccgggtacctggaactcccggacctaggccagccctactcaagcgcagtttattcactcgaggagcagtacttaggtttggctttggacgtggatcggatcaagaaagaccaggaagaagaggaggaccagggccctccatgtcccagactctccagagagctgctggaagtggtggagccagaagtgctgcaggatagccttgatcgttgttactccaccccgagttcgtgcctagagcagccagattcgtgccagccatatgggtcctctttctatgctctggaggagaagcacgtaggctttagcctcgatgtgggtgagatcgagaagaaggggaagggaaagaagagaagagggcgtagatcatag

SEQ ID NO: 126165 - DNA, 753 bp, Artificial Sequence
  Description of Artificial Sequence: Synthetic coding sequence
gaaattgaaaagtatcaagaagtggaggaggatcaggatccatcctgtccaagactgtcgcgtgagctcctagatgagaaagagcctgaggtgctgcaggatagccttggccggtgttatagcactccgagcgggtacttggaattaccagatctcgggcagccttacagcagcgccgtctactccctcgaagaacagtatctaggactagccctggacgttgatagaatcaagaaagatcaggaagaggaagaagaccagggaccgccttgtccgaggctatccagagagcttctcgaagtggtggagcctgaagtcctacaagacagtctggataggtgctattccactccttctagctgtctggaacagcctgattcctgccagccatatggctcctccttctatgctctggaagaaaagcatgtaggatttagcctggacgtaggcgagattgagaagaaggggaagggcaagaagaggagagggcgccgatccaaaaaagagcgtcgcaggggacgcaaggaaggagaggaagaccagaatccaccttgcccccgcttgagtggagaattgttggacgagaaggagccggaggtcctgcaggagtccctcgacagatgctactccaccccctctggatgtctggagttaactgatagctgccagccatatcgatcagctttttatatattggaacagcaaagggtgggcctagccgtggatatggatggagaatatttgtccatgtag

SEQ ID NO: 126166 - DNA, 1539 bp, Artificial Sequence
  Description of Artificial Sequence: Synthetic coding sequence
tgatatgaggaatgtaaggatctgattaagtcgatgttaaggaatgagaggcagtttaaggaggagaaactggccgaacagttaaaacaagccgaggaactacggcagtacaaggtgctggtccacgcacaggagagagagctgacccagcttagggaaaagttacgggaggggcgggacgctagcaggagtctcaacgaacatctgcaagccctgctgactcctgacgaacctgacaagtcacagggccaggacctccaggaacagctggctgagggctgcagactcgcacagcatcttgtacaaaagctctcacctgagaatgacaatgacgatgacgaagacgtccaggtcgaggtggcggaaaaagtgcagaaaagtagtgctccgcgcgaaatgcagaaagctgaggagaaggaagtgcccgaagatagcttagaagagtgtgcaattacatgttcaaacagccatgggccttacgatagtaaccagccgcatcgaaaaacaaaaatcacttttgaagaggataaggttgacagtaccctaattggctcaagcagtcacgtggagtgggaagatgctgtgcatatcatcccagagaacgaaagcgacgacgaggaggaggaagagaaggggcccgtcagtccgcgcaatcttcaggagtcggaagaggaagaagtgccccaagaatcttgggacgagggatacagcacattgtctatcccacctgaaatgttagcttcatataaatcctactcatcaaccttccacagtttggaagaacagcaagtatgtatggctgtagatatcgggcggcacagatgggaccaggtcaagaaagaagatcacgaggctaccggtcctagactgtccagggagctgctggacgagaagggccccgaagtgttgcaggacagtctagatcgatgctactcaacacccagtggctgtctggagctaacagattcctgccaaccctatcggtccgcattctatgttcttgaacagcaacgagtcggcctagctgtcaatatggatgaaattgagaaataccaggaagtggaagaggaccaggacccctcctgcccacggctgtcccgtgaactgcttgatgagaaagaacccgaggtcctgcaagactcactgggaagatgctattctacaccttctggctacctggaattacccgacctcggccagccctactcctcagccgtgtatagtctggaagaacagtatctagggcttgctcttgacgtcgatcgcattaaaaaagatcaagaggaagaagaagatcaaggccctccatgcccccgattgagtcgcgaactgctggaggttgtcgagccagaagtgctgcaggactcccttgaccgctgctactcaactccctcttcctgtctggagcaacctgattcttgtcaaccctatggatcctcattctacgcattggaagaaaaacacgtagggttttccctcgatgtcggggaaatcgagaagaagggaaaaggtaagaagaggaggggccggagaagctag

SEQ ID NO: 126167 - DNA, 1539 bp, Artificial Sequence
  Description of Artificial Sequence: Synthetic coding sequence
taatacgaagagtgtaaggatctcatcaaaagcatgttacggaatgagcgccagtttaaagaggagaagcttgctgagcagctaaagcaagcagaagagctacgccagtacaaagtgctagtgcacgcacaggagcgtgaactaactcaactcagggaaaagctgcgggagggtagggacgcaagccgttcccttaatgagcacttgcaggcactgctaaccccagatgaacctgataagtcacagggccaagacttgcaagaacagttggcagagggatgcagattggcccaacatcttgtgcagaaactgagccccgagaacgacaatgatgacgacgaagacgtgcaggtggaggtagccgagaaggtccagaagagtagcgctcctagagagatgcaaaaagcggaagagaaagaggtgcccgaggatagtctagaagagtgtgccattacgtgcagtaactcccacggtccgtacgacagtaatcagccccacaggaagacgaagatcacctttgaggaggataaggttgatagtactctgatcggatcttcaagccacgttgagtgggaagatgctgtgcatataattcctgagaatgaaagcgacgacgaagaggaggaggaaaaggggcctgtgagtcccagaaacctgcaggagagcgaagaggaggaggtaccacaagaatcatgggatgaggggtactccaccctctctataccaccggagatgcttgctagctataaatcttattcaagtaccttccatagcttagaggaacagcaggtgtgtatggcagtcgatataggtagacataggtgggatcaggtaaagaaagaggatcacgaggctacaggccccagactttcccgggagctgcttgatgaaaaggggcccgaggtgcttcaggatagcctggacaggtgttattccacaccctctggttgtttagagctcacagactcctgccaaccttaccgttccgctttctatgtgttggagcagcaaagggtcggtctggccgtaaacatggacgaaatcgagaagtaccaagaggtagaagaggaccaggatccctcctgcccgcgcctatcccgagaactcctagatgaaaaggaacccgaggtgcttcaggacagcctcggccgctgctactctaccccaagcggctacctggagctgccggatctgggccagccctactcttctgccgtgtatagtctcgaggagcagtatctcggactggctctggatgtggaccgcatcaaaaaggaccaggaagaagaagaggaccaaggccctccttgtccaagactgtctcgtgaattgctcgaggtggttgagcccgaggtgttacaggatagtctcgacaggtgctactccacaccttctagctgtctggagcagccggatagttgccagccctacggttctagcttctacgcattggaggagaagcacgtggggtttagcctggacgtcggtgaaatagaaaagaaaggcaaaggcaagaagaggagaggacggcggagctag

SEQ ID NO: 126168 - DNA, 1539 bp, Artificial Sequence
  Description of Artificial Sequence: Synthetic coding sequence
tgatacgaagagtgtaaagatctgattaaatcaatgttgcggaacgaaagacagttcaaagaggagaaacttgccgaacaacttaaacaggccgaggagttgcggcaatataaagtgctagtgcatgcgcaggagcgagagcttacccagctgcgtgagaaactgcgtgaaggacgcgacgcctccagatctttgaatgaacaccttcaggccctgcttacacccgatgagcctgacaaatctcagggccaggatctccaggagcaactggcggagggatgcagacttgctcagcacctcgtacaaaagctgtcccccgaaaacgacaatgacgacgacgaggacgtgcaggtggaagtggccgagaaggtacagaaaagttcagcgcctagggaaatgcaaaaagccgaggaaaaggaggtgccagaagatagcttggaggaatgtgctatcacttgtagcaactcccacgggccctacgactccaaccagcctcatcgcaaaacaaagatcacatttgaagaagacaaggtcgactctacgctcatcggctcctcgtcccacgtcgagtgggaggatgcggtgcacattataccggaaaacgaatccgacgacgaagaggaagaggagaaaggacctgtcagccctcggaatctccaagaatctgaggaggaagaagttccccaagaatcctgggatgagggctactccacattatctatccctcccgagatgctggcttcctacaagtcgtactctagcactttccactctctggaggaacagcaggtttgtatggcagtagacatcggtagacataggtgggaccaggtgaagaaagaggaccatgaggccacgggaccgaggttgtcccgggagctgctggacgagaaaggccccgaagtcctacaggactccctggaccggtgctactctactccgtctggatgtcttgagctgaccgattcatgtcagccatacaggagcgctttttatgtgctggagcagcagagggtgggcctcgccgtcaacatggacgagatcgaaaaataccaagaggtggaggaagaccaggacccatcttgccctcgactttccagggaactgctggatgagaaagagcccgaggtgctgcaggactccttgggtcgttgctacagtacccctagcggatacttggagctgcccgatctggggcaaccatattcctcagccgtttattccctggaggagcagtacttgggtctcgccctggatgtcgataggatcaagaaggaccaggaagaggaagaggaccaaggccccccttgtccccggctatcacgcgagctgctggaagtggttgaacccgaggtgttgcaggactccctggatcgatgctactccactcctagcagttgtctggagcagccggactcatgtcagccctatggcagctcattctacgctctggaggagaaacatgttggtttctccctcgacgtgggtgagatagagaaaaagggcaaagggaagaagcgaagggggagaaggagctag

SEQ ID NO: 126169 - DNA, 1539 bp, Artificial Sequence
  Description of Artificial Sequence: Synthetic coding sequence
taatacgaggagtgcaaagatctaattaaatccatgctacgcaacgagagacagttcaaggaggagaagctcgccgaacaactcaaacaggccgaggaactccggcaatacaaagtcctagtgcatgcacaggagcgcgaactgacacagttgcgcgaaaagctgagagagggaagagatgcatcacggtcgctcaacgagcatctgcaagcactactgaccccagacgagcccgataaatcccagggtcaggacctccaggagcagctcgctgagggatgcagattagcgcagcacctggtgcagaagttaagccctgaaaacgacaatgatgacgacgaggatgtgcaggtcgaggtagctgaaaaagtgcagaagtcctccgcacctagggaaatgcaaaaggccgaagagaaagaggtgccagaggattccctagaggaatgcgccatcacgtgctctaacagccacgggccctacgattctaatcaaccccataggaagactaagattacctttgaggaagataaagtcgacagtaccctgatcggatcatcgagtcacgtagaatgggaagatgcagtgcatattatccctgagaatgaatcagatgacgaggaggaagaggagaagggccccgtgtcacctcgcaacctgcaggagtcagaggaagaggaggtcccgcaggaaagctgggacgaggggtattccacactctcgatcccccctgaaatgttggcatcctacaagtcttatagctcaacattccatagtctggaagagcagcaagtctgtatggctgtggacattggcagacaccgatgggaccaagtcaaaaaagaagatcatgaggccactggaccacgtctcagtagggagctcctcgatgagaaggggcctgaagtcctgcaggactcactggaccgctgctatagtacaccttctggctgcctcgaacttacagactcatgtcagccctaccgtagcgccttctacgtgcttgagcaacaacgggtcggccttgctgtaaacatggatgaaattgaaaagtaccaagaagtcgaagaagatcaagatcccagctgtccccgactctctcgggagctccttgatgagaaggagcccgaagtgctgcaggattcgttgggcaggtgttattctaccccatctggatacctggaattgcctgacctgggccagccttactcatcagcggtatacagtctcgaggaacaatatctgggcctggccctggacgtggaccggattaagaaggaccaggaggaagaagaggaccagggccctccatgccctcggctcagccgtgaactgttggaggtggtggaacccgaggtgcttcaggactccctagatcgttgttacagcacgcctagcagctgcctagagcagccagattcctgtcagccctacggcagttccttctatgctctggaggagaagcacgtaggtttctctctggacgtgggggaaatagagaagaaaggaaaaggaaagaagcgcagaggacgaagatcctag

SEQ ID NO: 126170 - DNA, 2013 bp, Artificial Sequence
  Description of Artificial Sequence: Synthetic coding sequence
atggtggtttctgccgggcccctgtcaagcgaaaaagccgagatgaacatcctggaaattaacgagaagttacggccacaactggcggagaaaaaacagcaatttcgcaacctgaaagaaaaatgcttcctgacacagttagccggcttcctggccaatcgacaaaagaaatataaatacgaggagtgcaaggaccttatcaagttcatgcttcgtaacgagcgacagtttaaagaggagaaactcgccgaacagctcaagcaggcagaggaactgcgccagtacaaagtactcgtgcacgctcaggagagagaactgacccagcttagggagaagttgcgagaagggagggatgcgtccagaagtctgaatgaacacctgcaagctttgcttaccccagacgagccagataaaagtcaagggcaggaccttcaggaacagttagccgagggctgcagactgactcagcacctggtccagaagctcagtccggagaatgacaacgacgacgatgaggacgtccaggtggaggttgccgagaaggttcagaagtcctctgcccccagggaaatgcagaaagctgaggaaaaggaggtgcctgaggattcgctggaagaatgcgccattacatgttcaaactctcacggcccctatgacagcaaccagcctcacaagaaaaccaaaatcacattcgaggaagataaagtcgactccactctgatcggaagctctagtcatgtggaatgggaagatgccgttcatattatacccgaaaatgagtcagacgacgaagaagaagaagagaagggccccgtaagcccgcggaatttgcaggaatcagaggaagaggaggtgccccaggagagctgggatgaaggatactcaacactgtccatccctcccgaaatgctggcttcttatcaatcgtactcttctacttttcacagcctcgaggagcagcaggtctgtatggccgtagacatcgggagacatagatgggaccaagtaaaaaaagaagatcaggaggcaaccggccccagactctccagagagctgctggacgaaaaggagccagaagtcctccaagacagtttggatcggtgctatagtacaccgagcggatgcctcgagctgaccgatagctgtcagccataccgatccgctttttacgtcctcgagcagcaacgggttggacttgccatagatatggacgaaatcgaaaaataccaggaggtcgaggaggaccaggacccctcctgtccccgcctctcacgcgaattgctggacgagaaggagccggaggtgctccaggactccctggatcggtgttacagtactccctctgactatctcgagctgccagatcttggccagccatacagctccgccgtgtactccctggaagaacagtacctgggactagcactggatgtagataggatcaaaaaagaccaagaggaggaagaggatcagggaccaccgtgcccacgtctgagtagggaattgcttgaagtggttgagcctgaggtgctgcaggattctctcgaccgatgctattcaacaccctcttcctgcctggaacagccggattcctgtcagccttatggatccagcttctacgcactggaagagaaacacgtgggcttctccctggacgtgggcgagatcgagaagaaaggcaaggggaaaaagcgccgggggaggagatccaagaaaaagcggagaagaggaagaaaagaaggcgaagacgacaacccgccttgccctaggctatacggagtgctaatggaagtggaagaaccggaggttttgcaagacagtttggatcgttgttattccaccccttccatgtactttgagcagcccgactcctttcagcactaccgctctgttttctactcctttgaggaagagcatattagttttgcgctctatgtggacaatcgcttcttcactctaactgtcacctcactacatctcgtattccagatgggggtgatctttccacagtag

SEQ ID NO: 126171 - DNA, 2013 bp, Artificial Sequence
  Description of Artificial Sequence: Synthetic coding sequence
atggttgtctcagccggcccattatcatctgagaaggctgaaatgaatatcctggaaatcaacgagaagttaaggccacagctggctgaaaagaagcagcagttccgcaatctgaaggaaaaatgcttcctgacacagctggctgggtttttggcaaataggcagaaaaaatacaagtacgaagaatgcaaagatctcatcaagttcatgctgcgaaatgagcgacagttcaaagaggagaaattggccgaacagctcaaacaggccgaggagcttcggcagtataaagtgctggtccacgcacaggaacgcgaattgacccagcttcgcgagaaacttcgagagggaagggacgcctccaggtcactcaacgaacatttacaggcattactgacacctgatgaacccgacaagtcacagggccaggatctgcaagagcagcttgccgagggttgcaggctgacgcaacacttggttcagaaactttcccctgagaacgacaatgatgatgacgaagacgtccaggtggaagtcgctgagaaggttcagaagtcttcggccccacgagagatgcagaaggccgaagagaaagaagtcccagaagacagtctggaagagtgtgccatcacatgcagcaacagccacgggccctacgattcaaatcaacctcacaaaaaaacaaagatcacctttgaggaagataaggtagacagcactctgatcggatctagttcccacgtggaatgggaggacgcagttcatattatccctgagaatgaaagcgatgacgaagaagaggaggagaagggacctgtttcaccacggaatctccaagagagcgaagaggaggaagtaccgcaggaatcctgggacgaaggctattccactctatctattccacccgaaatgctagcttcttatcagagttactcatcaacgttccattctcttgaagagcaacaagtgtgtatggccgtcgatatcggtagacacagatgggaccaggtaaagaaggaagaccaggaggcgacagggccacgactgagccgtgaactgttagacgagaaggagccagaagtccttcaggactcccttgaccgctgctactccactccctccgggtgcttagaactgacagactcttgtcagccttacaggtccgcattctacgttttggagcagcagcgtgtcggactggccatcgacatggatgagattgagaagtaccaagaagtggaggaagatcaggacccaagttgtccccgcttatccagagaactcctggacgagaaagagcctgaggtcctccaagactcactggacaggtgctacagcactccctccgactaccttgaattgccagatctcggacagccatatagctcggctgtttactctctagaggagcaatacctagggttagccttggatgtggacagaattaagaaagaccaagaggaggaagaggaccagggacctccctgccctaggctctcacgagaactgctggaggtggtggagcccgaggtgttgcaagatagtctcgatagatgctattcaaccccaagctcatgcctggaacagcccgactcttgtcagccgtacggatcctcattttacgcattggaagaaaagcatgtaggattcagcctcgatgtgggcgagatcgagaagaagggaaagggcaagaaaaggagaggccgcagaagtaaaaagaagcgcaggaggggtaggaaagaaggcgaggatgataatccgccctgccccaggctgtatggtgtattgatggaggtggaggagccagaagtgctacaggattctttagaccgctgctactccacaccttccatgtacttcgaacaacctgactccttccagcattaccggtcggtgttttactctttcgaagaggagcacatttccttcgccctgtacgttgataaccgcttcttcaccttgacggttacctccctgcacctggtgtttcagatgggagtaatatttcctcaatag

SEQ ID NO: 126172 - DNA, 2013 bp, Artificial Sequence
  Description of Artificial Sequence: Synthetic coding sequence
atggtcgtctccgccggtcctttatcatctgaaaaggccgagatgaacatccttgagattaacgaaaagctgcggccccaactcgccgagaagaaacagcagtttcggaatttgaaagagaagtgtttcctcacgcagctcgccggctttttggccaaccgtcagaagaaatacaaatacgaggagtgtaaggacctgattaaatttatgttgaggaatgagagacagtttaaggaggagaagctggcggagcagcttaagcaagctgaagagttgaggcaatataaggtactcgtgcacgcccaggagcgtgagctaacacagctcagagagaagctacgcgagggcagagacgctagccgatcccttaatgagcatctgcaagcactgttaaccccggacgaaccggacaagagccaggggcaggatttacaggaacagctggctgaagggtgccgtcttacacagcatctagtccagaagctgtcgcccgaaaacgataacgacgacgacgaggatgtgcaggtggaagttgccgaaaaggttcagaaatcaagtgcacctagagagatgcagaaggcggaagaaaaggaggtgcctgaagattccctagaagaatgcgccataacctgttctaattcacacggcccttacgactctaaccaaccccacaagaagacaaagattacattcgaggaggataaggtggactcaacgcttataggttcctcgagccacgtggagtgggaggacgccgtgcacataattcctgagaatgagagtgatgacgaggaagaggaggagaagggcccagtgagccctaggaatcttcaggagtcagaggaggaggaggtcccacaggaatcctgggacgagggatactctacacttagcataccgcccgagatgctagcctcataccagtcctactctagcacattccatagtctggaggaacagcaggtttgtatggctgtggatatcggccggcatcggtgggatcaggtaaaaaaagaggatcaggaagccacgggaccaaggttgtcccgggagctgttggacgaaaaggagcctgaagttctgcaggactcattagaccgttgttacagtaccccttccggctgtctggagttgacagacagttgtcagccttacaggagcgcattttatgtcctcgagcagcagcgcgtagggctagcaatcgatatggatgagatcgagaaataccaggaggtggaggaggaccaggatcccagttgtcccaggctaagccgagagctgttagacgaaaaggagccggaagtacttcaagattcactcgacagatgctacagtaccccttctgattatctggaattgcccgatcttggtcagccttacagctcggccgtgtactctctcgaggagcaatacctgggtcttgccctagatgttgatcgtatcaagaaggatcaggaagaagaggaggatcagggccccccatgccctagactttcccgggagctgctggaggtcgtggaaccagaagtccttcaggatagtctggataggtattattccaccccaagcagttgtttagaacagcccgattcttgtcagccttatggatcttcgttctatgcattagaggagaagcatgtgggctttagcctggatgtgggcgaaatcgagaagaagggtaaaggaaaaaagaggcgtggacgccgcagcaagaaaaagaggcggagaggcaggaaagaaggtgaggatgacaatcccccttgtccgaggctgaacggtgtgctcatggaagtggaagagccggaagttctccaggattcactcgacaggtgctatagcactcagtcaatgtactttgagctaccggacagcttccagcactatagaagtgttttctattctttcgaagaggaacatatttctttcgccctctacgtcgataatcgttttttcactctgactgtcacatccctccatctcgtgtttcagatgggtgtgattttcccccagtag

SEQ ID NO: 126173 - DNA, 2013 bp, Artificial Sequence
  Description of Artificial Sequence: Synthetic coding sequence
atggtggtctcagcgggcccactttcgagtgagaaggctgagatgaacattttggagatcaatgagaaactgaggccacagttggccgaaaagaaacagcagtttcgcaacctgaaggaaaaatgtttcctcacccagcttgcaggatttttggccaatcggcagaagaaatataagtatgaagagtgtaaagacctgataaaattcatgctccgcaacgaacgccagttcaaagaggaaaagctcgccgagcaacttaaacaggcagaggagctgaggcagtataaagtgctcgtgcatgcccaggaaagggagctgacacagcttcgggagaagcttcgcgaaggtcgtgatgctagtaggtcacttaatgagcatctgcaggcactcttgacgcccgatgagcctgacaagagtcaaggccaggacttacaggaacagttggcggagggttgcagattaacccaacatttagtccagaaactaagtccagagaacgataacgatgacgatgaggatgtgcaggtagaggtcgctgaaaaggtgcagaagtcatctgctcccagagaaatgcagaaagccgaggagaaagaagtcccagaggacagcctggaagaatgtgcgatcacttgtagcaactcacacggcccgtacgactctaaccagccccacaaaaagaccaagatcaccttcgaggaggacaaagtggactcaaccttgattggcagcagtagtcatgttgagtgggaggatgccgtgcacatcatcccagaaaatgagagcgatgatgaagaggaggaggagaagggcccagtgagtcccagaaatctgcaggaaagcgaagaggaagaggtcccccaggagagttgggatgaaggatattctaccctgtcaataccacctgagatgttggcctcttatcaatcatacagttccactttccattctctggaggaacaacaagtttgtatggccgtcgatatcggcaggcaccgttgggaccaagtgaagaaggaagaccaggaagccacaggcccaagacttagccgcgagcttcttgacgagaaggagcccgaggtcctgcaagactccctagacaggtgctattccactccatctggctgccttgaacttacagattcctgccagccctatcggagcgccttttacgtgctcgagcaacagagagtggggctcgccattgacatggacgagattgagaagtaccaagaagtcgaggaagaccaagacccaagctgccccagactatccagggagcttctggacgagaaggaacctgaggtactacaagacagcctggatcggtgctatagtacaccttcagattacttggaactacctgatctgggccaaccatactctagtgcggtgtactccctggaagaacaatatttgggactcgccctggatgttgaccggatcaagaaggaccaggaagaggaggaagaccagggccccccttgtcctaggctgtcccgagagctgctagaagtggtcgagcccgaagtactccaggacagtttggatcggtactacagcacgcctagctcgtgtctggaacagcctgactcctgtcaaccctacggatcctccttttacgccctggaagagaaacacgtgggcttttcactcgacgtgggcgagattgagaaaaagggcaagggaaaaaaacgccgcgggcgtaggtcgaagaagaaacgtagacggggacgcaaggagggagaggacgacaaccctccttgtcctcgccttaacggtgttctgatggaggtcgaagaaccggaggtgctgcaggactccctggaccgttgctactcaacacagtccatgtattttgagttgccggactcattccagcattatagatccgttttctactcatttgaggaagagcacattagttttgcgctgtacgtcgacaatcgatttttcactcttaccgtgacctcccttcatctggtattccagatgggcgtcatcttccctcaatag

SEQ ID NO: 126174 - DNA, 2526 bp, Artificial Sequence
  Description of Artificial Sequence: Synthetic coding sequence
atggtggtatccgcgggcccctggtcaagcgagaaagccgagatgaacatactcgaaattaacgagaaactccgaccacagcttgctgaaaacaaacaacaattcggtaatcttaaagaaagatgttttgtgacccagcttgcgggctttcttgcaaaccagcagaaaaaatacaactacgaggaatgtaaggacctaattaagttcatgctgcgcaacgagcggcagttcaaagaggagaagctggcggaacagctcaaacaggctgaagagctgcgacagtacaaggtgttagttcatagtcaggagcgcgaactaacccaacttagggagaagctcagggagggccgagatgcaagccgctcacttaacgaacatctgcaggcgctgcttactttggatgaacctgataaatctcagggccaagacctccaggagcagcttgctgagggatgcagactcgctcagcatctggtgcagaagctgtctcctgagaatgacgaagatgaggatgaggacgtgcaggtcgaggaggctgagaaggtccaaaaatcctctgcccctagggaagtccagaaaacagaagagtctaaggtcccagaagacagcctcgaagagtgcgcaattacttgctccaattcacacggaccatgtgactctaatcaaccccacaaaaacattaagattactttcgaggaagatgaggtgaattctacattggtggtcgatagagaatcaagtcacgatgaatgccaagatgcactgaatattctccccgttcccggccccacatcatctgctacgaatgtaagcatggtagtgtcggctgggccactgagctcagagaaagcggagatgaatatcctggagatcaacgagaagctgcatcctcaactggcagagaagaagcaacagttccgcaatttgaaagaacgttgttttgtgacccagttagctggtttcttggccaaccagcagaagaaatacaagtacgaagagtgtaaggacctgattaagtccatgctccggaacgagcggcagttcaaagaagagaagttagccgagcaacttaagcaggcagaagaactccgccagtacaaggttctagttcacgcgcaggagagggaattgacccagctgagagaaaaactgagggagggtagagacgcgtctcgatctcttaatgaacaccttcaggccctgcttacaccggacgagcccgacaagagtcaaggccaggacctccaggaacagctggcagaggggtgccgtctcgctcagcacctagtccagaagctcagccctgaaaacgataacgacgacgacgaggacgtgcaggttgaactagctgagaaggttcagaagtcttctgctccacgggagatgcagaaggctgaagagaaagaggtccccgaagatagccaagaagagtgcgccattacatactctaactcacacggtccatatgactcgaaccaacctcaccgcaagaccaaaatcaccttcgaggaggataaagtagatagcaccttgatcggcagctcctcccacgtagagtgggaggatgctgtccatattatacctgagaatgaaagtgacgacgaagaggaggaagagaagggcccggtgagtccacggaatttacaagaaagcgaggaagaggaagtcccgcaggagagttgggatgagggctattcaactctgagtatccctcctgagatgctggcaagttaccaaagttattctagcacctttcactcgctggaggagcagcaggtctgcatggcagtggacattggcagacatcgatgggaccaggtaaagaaagaagatcaggaagctaccggacctcgcttgtcacgcgaactcttggatgagaaaggacctgaggtgctgcaggactcactagatcgttgctattccacccctagcggctgcctggagctcacagatagttgccagccatatcgctcagccttttacgtcctggagcagcaacgagttggtttggcagtggacatggatgagatcgaaaaatatcaggaagtggaggaggaccaggacccttcctgtccccgtctcagcagagagctcctggatgaaaaggaaccagaggtgctgcaagactcattggatcgctgctatagcactccttctgggtatctcgagctcccagatttggggcagccctatagcagtgcggtctacagcctcgaagaacagtatctcggactggctctcgatgtcgaccgtactaaaaaagatcaggaggaggaggaggaccagggccccccatgccctcggttgagccgggagctgctggaagtggtcgaaccggaggtgttgcaggattctttggatcgatgctattctaccccatcgtcctgtctggagcagccagactcatgtcagccttatgggtctagtttttacgccctcgaggagaaacatgtgggcttttctctggacgtaggtgagatcgagaagaaaggaaagggcaagaagaggcggggcaggcggtcttag

SEQ ID NO: 126175 - DNA, 13866 bp, Artificial Sequence
  Description of Artificial Sequence: Synthetic coding sequence
atggtcgtttcagctggaccttggagcagcgaaaaagccgagatgaacattttggagattaacgaaaagctgagacctcagttagccgagaacaaacagcagttcggtaacctgaaagaaagatgttttgtgacacagctggcaggattcttggctaaccagcagaagaaatataattatgaagagtgtaaggacctgatcaaattcatgctccgaaacgagcgtcagttcaaagaggaaaaacttgcggagcagttaaagcaggctgaggaattgaggcagtacaaggttcttgtccactcccaggagagggaactgacccagctgcgggagaaactccgggagggtagagacgcctcccgttccctgaacgagcatctgcaggcactgctcacgcttgacgagccggacaagtcccagggccaggatctacaggagcaactcgcagagggctgtcgactcgctcagcatctggtacagaagctaagccccgaaaacgacgaagatgaagatgaagatgtgcaggtggaagaggctgagaaggtccaaaagtcatccgcccctagagaagtccagaaaaccgaggaaagcaaagtgccagaagactcgctcgaagagtgcgccataacctgttctaactctcacggaccgtgtgatagcaaccagccccacaaaaatatcaaaatcacattcgaagaggacgaggtcaactccactctggtggtggaccgtgaaagctcacacgacgaatgtcaggacgcacttaatatcctaccagtgcctggccctacctcctcggccaccaatgtctcaatggtagtttctgcaggtccgctgagcagcgaaaaggccgagatgaatattctcgaaatcaacgagaagttgcacccccagctcgcagaaaagaagcaacaatttaggaacctcaaagaacgctgctttgtgacccagctggcgggctttttggccaaccaacaaaagaagtataagtatgaggaatgcaaagacctgataaaatctatgctgcggaacgagcgccagttcaaagaggaaaaacttgcagaacagctgaaacaagccgaagagctcaggcagtacaaggtgctggttcatgctcaggaaagagagttgacccaactcagggaaaagttacgcgagggaagggatgctagcagaagcctcaatgagcacctgcaggcactgctcaccccagacgaaccagacaagtctcagggtcaggacctgcaggaacagctggcagagggctgtcgcctggcacaacatctcgtccagaagctgtcgcctgagaacgacaatgatgatgacgaggacgtgcaggtggagctggcagaaaaggtgcagaaatcttctgctccacgtgagatgcaaaaggccgaggagaaagaagtccctgaagacagccaggaggaatgcgcgataacatactcaaattcacatggaccatacgatagtaaccagccacataggaaaaccaagatcacctttgaagaggataaggtggacagtacgctaatcggctcatcatctcacgtggaatgggaagatgccgtccatatcatccccgaaaatgagagtgacgacgaggaggaggaagaaaaaggtcccgtgtccccaaggaacctacaggaaagcgaagaggaggaggttccacaagagtcatgggatgagggttactctactctgtccattcctcctgagatgctggcatcttatcagtcttattcttctaccttccactctctcgaagagcagcaggtgtgtatggcggtcgacataggtcggcaccgatgggatcaggtcaaaaaggaagatcaagaagcgaccggtccaaggctctcccgggagctgcttgacgaaaagggtcccgaggttctgcaggatagtctggatcgatgttactccacacctagtgggtgtcttgaattaactgactcctgtcagccgtaccgctctgcgttttatgtgctcgagcagcagcgcattggtctagctgtggacatggacgaaattgaaaagtaccaagaagtggaggaggaccaggatccatcgtgccctcgcctgagccgggagctgctggacgagaaggagcccgaagtcctgcaggactctctggatagatgctactccactccatcaggatacttagaattgccagatctaggacagccatattcttctgcagtttattcactggaagagcaatatcttgggttggcactagatgtagacaggactaaaaaagatcaggaagaggaggaggatcagggtccaccctgccccagactgagtagggaattactcgaggtggtcgagcctgaggttttgcaggactcccttgaccgttgctattccaccccctctagttgccttgaacagcctgactcgtgtcagccgtatgggtccagcttttacgccctggaagaaaagcacgtggggttcagccttgatgtgggggagatagagaagaaaggcaagggaaaaaaaaggcgcggcagacggtctaagaaggagaggcggaggggaaggaaggagggggaggaagaccaaaacccaccatgcccaaggcttagtagggaactactggacgaaaagggcccagaggtgctgcaggattctctggaccgcagctacagcacacccagcggatgcttagagctaaccgatagttgtcaaccttacaggagcgctttctatgtcctggaacagcagagggtggggctggctgtggacatggacgagattgaaaagtaccaggaggtagaggaagatcaggatcctagctgtccgagactgtctcgtgaattacttgatgaaaaggaacccgaggtcctgcaagattccctcgaccgttgttactctacgcccagcggatatctggaactgcctgatcttggccaaccctattccagtgcagtatatagcctggaagaacagtatctgggcctggcactcgacgtagatcgtactaagaaagatcaagaagaggaggaagaccagggcccgccttgtccccggctgtcacgggagctgcttgaagtagtggagcccgaagtccttcaggactcattagacagatgttattcaaccccttcctcttgcctggagcaacccgacagttgtcagccctacgggtcgagtttttatgctctggaagaaaagcacgtgggattttccttggatgtgggggagattgagaagaaaggcaaaggcaagaagaggaggggtagacgaagcaaaaaagagcggcgccgaggccgcaaagaaggtgaggaagaccaaaatcctccctgtcctcgactgtcaagagagcttctagatgagaaggggcccgaggttctccaggatagcctcgatcggtgttattccaccccttccggttgtttggaacttaccgattcatgccagccataccgcagcgccttctacgtactggaacagcagcgagtcggactggcagtcgacatggacgagatagaaaagtaccaagaggtggaggaggaccaagacccatcatgccctcggctatcgagggaactgttagacgaaaaagagcccgaagttctacaggacagcctggaccgatgctactccacaccatctgggtatctggaattacccgacctgggacaaccgtattcaagtgccgtttactccctggaggagcagtacttaggtctcgcactggatgtcgacagaactaagaaggaccaggaagaagaagaggatcagggccccccatgtcctaggctttcaagagagctgctggaggtggtggagcctgaggtgctgcaagattctctggataggtgttatagcaccccttcatcttgcctggagcaacctgactcctgtcagccatacgggtcaagtttctacgcactggaggagaaacacgtgggtttcagcttggatgtgggagaaatcgaaaagaaggggaaggggaagaagcggagggggaggagaagtaaaaaggaaaggcggcggggccgaaaggagggggaagaggaccagaatcctccatgtcctagactatcccgggagctcttggatgagaaggggccggaggtgttgcaggacagtttggaccggtcgtactctaccccatcgggctgcttagaactgactgattcttgtcagccttataggagcgctttctacgtattagaacagcagcgggtgggtttagccgtggacatggatgaaatcgaaaaataccaggaagttgaagaagatcaggacccaagctgccctagactgagtagggaacttctggacgaaaaagagccagaggtattacaggatagtctagatcgttgttattccacgcccagcggctacctggaattgcctgatttgggacaaccctatagttcagccgtgtattctctcgaagagcagtacctgggtttagctctggatgtcgaccgtaccaagaaagatcaggaagaggaagaggatcaggggcccccttgtccaaggttaagcagagagttgctcgaagtggtagagccggaggttctgcaggactctctcgacagatgttactccacgccctctagctgccttgaacaacctgacagctgtcagccctacggcagctctttctatgcacttgaggagaagcacgtagggttctctctggatgtgggcgaaatcgaaaaaaaagggaagggcaagaagagacgcggccggagatcaaagaaggaacgccggagagggaggaaggaaggagaagaagaccagaaccctccttgcccaagactgtctagagaactactagatgaaaagggcccagaggtgctgcaggactcactcgatagatgctactctacaccctccggttgcctggagttaaccgatagctgtcagccatatcggagtgccttttacgtgctggagcagcagcgggtcggactcgctgttgatatggatgaaattgagaagtatcaggaagttgaggaagaccaggatccttcttgcccccgcctgagtagagagctgttagatgagaaggagcctgaagtgctgcaggacagtctcgatcgctgttactctacgccctccgggtacctcgaattgcctgatctaggtcagccatacagtagcgctgtgtatagcttggaggaacagtatttgggtctcgccctcgacgttgataggaccaaaaaagaccaagaggaggaggaagatcaaggccccccgtgtccccgactttctcgcgagctcctggaggtggtggaacctgaagtgctgcaggatagcctggacaggtgttactcgacaccatctagctgcctggagcagcccgatagttgtcagccctatggatctagtttctatgccttggaggagaagcacgtgggcttctccctggatgtgggcgaaatcgaaaaaaaggggaaaggcaaaaagaggcgaggccgccggagtaaaaaagagcggcgccgaggacggaaggagggggaggaagaccaaaatcccccttgtccaaggctgtctagagagctgctcgatgagaaagggcctgaagtgctccaagactccctggaccggtcctactcaaccccgagcggatgcctcgaactgactgacagctgtcaaccctacaggtcggccttctatgtgctggaacagcagagggtgggcctggccgtcgatatggacgaaattgagaaatatcaggaagtggaggaagaccaagatccttcttgcccccgactaagtcgggagttgcttgacgaaaaggaaccagaagtgctgcaggatagtttggaccgctgttacagcaccccatccggctatctcgaactaccagacctgggccagccctactcaagcgcagtatattcactggaggagcagtacctcggactggctttagacgtggaccgtacgaaaaaagaccaggaggaagaagaggaccaggggcccccatgcccgagactgtcccgggaactattggaagtggtggaacccgaagtccttcaggacagtcttgatcgatgctacagcacgccttcttcatgtttagaacagcctgactcttgtcagccatacgggtcgagcttctacgccctggaagaaaaacatgtcggcttttcgttggacgtgggagagatcgaaaagaagggcaagggcaaaaagcgtagggggaggaggtcaaaaaaggagagacggcgcggacgcaaggagggtgaagaggaccagaaccctccatgcccccgcctctcccgggagctcctcgatgagaaaggtcccgaggtcctgcaggatagcctcgaccggtcatatagcacaccttccgggtgtctagaactcactgactcctgccagccgtacaggtctgctttctacgttttggagcagcaaagagtcggcctggctgttgacatggacgagatcgagaaataccaggaagttgaagaggaccaggacccatcgtgtccccggttgtcccgggaactgctagatgaaaaggagccggaagtgctacaagacagccttgatcggtgttactctacccctagcggctatcttgagctacccgacctcgggcaaccttacagctctgccgtttatagcctcgaagagcagtatttaggtctggccctggacgtggatcgtacgaaaaaggaccaagaagaagaggaagatcaaggccccccttgtccccgtctcagccgcgaactcttggaggttgtggaaccagaggtattacaggacagcttggacagatgttactcgacgcccagcagctgcctcgagcagcctgatagctgtcagccgtatgggagtagtttctatgcactggaggaaaaacatgtcggcttctcattggatgtcggcgaaatcgaaaaaaaaggcaagggaaagaagagacgcggccgccgcagcaaaaaggagaggcggagaggtcggaaagaaggagaggaggaccagaacccaccgtgtcccagattgtctagagaacttctagatgagaagggaccggaggtgctgcaagatagcctggacaggagttactcaacacctagtggatgtctggaactaaccgacagctgccagccataccgcagcgccttctatgtcctggaacaacagagagtgggattggcagtcgacatggacgagattgaaaagtaccaggaagttgaagaggatcaggatccgagttgtccccggctgagtcgcgagctgctcgatgagaaggagcccgaggtccttcaggacagcctggaccggtgctacagtacaccctcgggctatcttgaattgccagacttgggacagccgtatagctcggccgtgtattcgctcgaagaacaatatctgggcctcgccctcgatgtggatagaactaagaaggaccaggaggaggaagaagaccaaggaccgccctgccccaggttgagtcgcgagctgttggaggtcgtcgaaccagaagtgctgcaagattcactcgatagatgctacagcactccctcctcctgcctggagcagccagactcttgtcaaccgtatggcagcagtttctacgccctggaggagaaacacgtggggttcagtctggatgtgggtgaaatcgagaagaaagggaagggaaagaagcgacggggccgaaggagtaaaaaggagcggcgacgtgggcggaaagaaggggaggaagaccagaatcccccatgtccccggctgtccagagaactcctggacgagaaaggccctgaggtgctgcaggacagcttggacaggtcgtacagcaccccctcaggctgcctggaacttaccgacagttgtcagccctaccggagcgctttctacgtgctcgagcagcagagggtgggcctggctgtcgacatggacgaaattgaaaaataccaggaggtggaagaggatcaggatccctcctgcccacggttgagcagagagctcctcgacgaaaaggagcccgaggtgttacaggacagcttggatcggtgttatagcacaccttctggctacctcgagctgcccgatcttggccagccttactccagcgccgtatacagtctagaagagcagtacctcggtctcgccttggatgtagacagaacaaagaaagaccaagaggaggaagaggatcagggacctccgtgcccaaggctctcacgcgagctgcttgaagtagttgaaccggaggtcctccaggacagtctggaccgatgttactcgactccatcttcatgtctagagcaacctgacagttgccagccctacggctcctctttttacgcactcgaagagaagcacgtggggtttagtttagatgttggcgagattgaaaaaaagggtaagggtaagaagcggagaggccgccgatcaaagaaggagcgtagacgggggcgtaaggagggagaggaagaccagaatccgccctgccctagactctctcgagagctactcgatgaaaaagagccagaggtactgcaggactcactagatcggtgctatagcaccccttcaggctatctcgagcttcccgatctcggccaaccctatagctcggccgtgtactcactcgaagagcaatatcttgggcttgctttggacgtggatcggacaaagaaagatcaggaagaggaggaggaccaggggcctccatgcccaaggctctcacgggagcttcttgaggtcgtggagccagaggtcctccaagacagtctggacaggtgctattccaccccctcttcttgtctggagcaacccgacagttgtcagccctatgggtcctcattctatgctctggaagagaagcatgttggcttcagtctggacgtcggcgagattgagaagaaaggcaagggaaaaaagaggcgcggcagacgctccaagaaggagcggcgaagaggacgcaaggagggggaagaagatcagaaccctccctgtcccaggctgtcaagagagctcctggatgaaaaagagccagaagttctgcaggactctctcgaccgatgctattcaacacccagcggatatttggagttaccagatctgggtcagccgtattcctctgctgtatacagtctcgaggaacaatacctaggcttagccctagacgtagacaggactaagaaagaccaggaggaggaggaagaccagggacccccatgtcctagactgagtcgtgaactgttggaagtggtcgaacccgaagttttgcaggacagcctcgacagatgctacagtaccccgtcttcctgcctggagcaacccgatagttgccagccttatggtagtagcttttatgccctggaggagaagcacgtgggcttttctcttgacgtaggagaaatcgaaaagaagggcaaggggaaaaaaaggaggggacgacggagcaagaaggagcggcggaggggcaggaaagaaggagaagaagatcagaaccctccctgtcctcggttgtctcgcgagttgttggacgagaaggagcccgaagttcttcaggactcgttggaccggtgttattctacgccttctggttacctggagctgccagatctggggcaaccttattcaagcgcagtgtattcactcgaggagcagtaccttgggctggccttagatgtggacaggacaaagaaagaccaggaggaagaggaagaccagggccccccctgcccacggctttctagggagctgctggaagtggtggaacctgaggtcctgcaggactccctggatcgctgctactccacaccctctagctgtctggagcagcccgacagctgtcagccttatggctctagtttctacgcgctcgaagaaaagcacgtgggcttcagcctcgacgtcggggagatcgaaaaaaaaggcaagggtaaaaagaggagaggacgtcggtctaaaaaggagcgcaggcgggggcgcaaagagggcgaggaagaccagaaccccccttgcccacgcttgtctagggaactgctcgacgagaagggccccgaagtgttgcaggatagccttgacaggtgctattccacaccatccggatgtctggagctaaccgattcttgtcaaccatatagatcagctttttacgtgttggaacaacagcgggttggactggccgtggacatggacgagattgaaaagtaccaggaggtcgaggaagatcaggacccttcatgcccacggttatctagggagctgttagacgagaaggaaccagaggtcctgcaggatagtttagaccgttgttattctactccaagcggctatcttgagctcccagatttggggcagccatactctagcgccgtctattctcttgaggaacaatacctcggcctggcgcttgatgtggaccgaacgaagaaggatcaagaagaagaagaggaccagggtcctccgtgtccccgactgtcacgagaactgctggaagtcgtggagccagaggtcttgcaagattccttggataggtgctattctaccccatcttcttgtctcgaacaacccgatagttgtcaaccctatggatcaagtttttatgcactggaagagaaacacgtaggtttcagcctcgatgtaggagaaatcgagaagaagggtaagggaaaaaaaaggaggggcaggaggtctaaaaaagaacgacggcgcggccgaaaggagggtgaagaggaccagaatcccccttgtcctcgactgagccgggaactgctcgacgaaaaaggccctgaggtgttgcaggactcattagatagatgctacagcacccctagcggatgcctggaactgaccgactcttgtcaaccttataggtctgccttctacgtgttggaacagcagcgcgttggcttggccgtggatatggatgagattgaaaagtaccaggaagtagaggaagatcaggatcccagctgtcccaggctctctcgggagctattggacgaaaaagagccagaagtgttgcaggactccctggacaggtgctactctactccttcaggctacctcgagctgcccgatctgggacagccctattcaagtgcggtttactccctggaggaacagtatctggggttggctctcgatgtggatcggacaaaaaaggatcaggaagaggaggaagatcaagggcctccctgtcctcgactgtcacgcgagctgcttgaagtggtggaacccgaggtcctccaggattcattggaccggtgttattcaactcccagttcctgcttggagcagccagacagttgccagccatacggctcctccttttacgcgttggaggagaaacatgtgggtttctcgctcgacgtcggagagatcgagaaaaaaggcaagggaaaaaaaagaaggggccgccggtccaagaaagagagacggagagggcgcaaagagggagaagaggaccagaatcccccttgtcctcggctttcgcgtgagctcttggatgaaaaaggcccagaggtgctccaggactcactggaccggtgttattctacaccctccggctgtctcgaacttacagattcgtgccaaccatacagatccgccttttacgtgttagagcagcaacgcgttggtctggcagttgatatggatgaaattgaaaagtatcaggaggtggaagaggaccaggacccgtcgtgccccaggttgtcccgggagctgctggacgagaaagagccagaagtactgcaggactcactcgatagatgttactccactccctcaggatacttggagctgcctgatctcggacagccctattcaagtgccgtttactcgctggaagaacaatacttgggccttgccctcgatgtggatcgcaccaaaaaggatcaggaggaggaagaagaccaaggcccaccctgcccccggctgtccagagagctgctggaggtggtcgagcccgaggtcttgcaagatagtcttgatcgatgctactccactccctcatcatgcctggagcagcctgacagttgtcaaccctatgggagtagcttctatgcacttgaagagaaacatgttggattctccttggatgtcggggaaatcgagaagaagggtaaaggaaaaaagaggcgcggacggcgctccaaaaaggagcgcagacggggcagaaaggagggtgaagaggatcagaccccgccctgtcctagactgtccagggagctcttggacgagaagggacctgaggttctacaggattctctagacaggtgttattcaacccctagcggatgcctggagctgacagatagctgccagccctaccgctccgcattttacgtacttgaacagcagcgggtcggcctcgccgttgacatggacgaaatagagaaatatcaggaggttgaggaagatcaggatccaagctgcccacggctttctagggagctactggatgaaaaagagccggaagtcctgcaggatagtctcgatcgttgctattctactccaagcggataccttgagttgcccgacctaggtcaaccctacagcagtgccgtctattcactggaggagcaatacctaggtttagcactggacgtagacagaacaaagaaggatcaggaggaggaagaagaccaagggcctccttgtcccaggctgagtagagagctccttgaggtggtcgaacccgaggtgctgcaggattctctggacagatgctactctaccccttccagctgtctggagcaacccgattcttgccagccgtacgggagctctttttatgcactagaagaaaagcatgtgggctttagcctggacgtcggcgaaatagagaaaaaaggtaaaggcaaaaagcgcagaggaagacggagtaagaaagaaagaagacgggggaggaaagaaggtgaagaagaccagaatccgccctgtcctcggttgtcccgtgagctgttagacgagaagggaccagaggtgctgcaggattcgcttgacagatgttactctacaccatctgggtgcctggaactcacggattcttgtcagccttatcgcagtgctttttacgtgctcgaacagcagagagtcggattagcagtggatatggacgagattgaaaaataccaggaggtggaagaggaccaagacccctcttgcccaagactatctcgggagcttctcgacgaaaaggaacccgaggttctgcaggacagtctggatcgctgctactccacccccagcggctatttggagcttcccgatctgggccaaccgtatagcagtgccgtctattctctcgaggagcagtacttagggctggcactcgacgtcgacaggacaaaaaaggatcaggaggaggaagaggaccagggaccaccctgcccccgtctgtctagggagttgctcgaggtggtcgaacccgaagttctccaagacagccttgacaggtgttacagcacaccctcatcttgcctggagcagcctgattcatgtcagccttatggaagtagtttctatgcccttgaagaaaaacatgtaggcttttctctagacgttggggagatcgagaaaaaaggcaagggcaaaaagcgtagagggcgacgttctaagaaaaagcgaagacggggccgcaaagagggggaagaagaccagaacccaccttgccctcgactgaacggcgttctgatggaggtggaggaacctgaagtgctccaggactccctcgacgggtgctatagcaccccatctatgtacttcgaattgcccgacagctttcaacactatcgatcagtattctactcttttgaggagcagcacatctcttttgctctgtatgtggataataggtttttcaccctcacagttacgtctctccacctcgtattccaaatgggggttattttcccccagtag

SEQ ID NO: 126176 - DNA, 780 bp, Artificial Sequence
  Description of Artificial Sequence: Synthetic coding sequence
atggttgtctctgctgggccctggtccagcgagaaggctgaaatgaacatactggaaatcaacgaaaagttaagaccgcagctggccgaaaataaacagcagtttggtaacctgaaggaacggtgctttgtcacacaactcgcaggttttctcgctaatcagcagaagaagtataattatgaggaatgcaaggatctgatcaagttcatgctccggaatgagaggcaatttaaggaagagaaacttgcagagcagcttaaacaggccgaagaactcaggcagtataaggtgctcgtgcatagtcaggagcgagagctgacacagttacgcgaaaagctgcgcgaggggagagacgcttctagaagcctcaacgaacacctccaggccctcctaacactggacgagcccgataagtctcagggccaggatctgcaagagcagctggctgagggatgtaggctcgcccagcacctggtccagaaactgagtcctgaaaatgatgaggacgaggacgaggacgtgcaggtggaggaggctgagaaggtgcagaaaagcagcgcccctagagaagtccagaaaaccgaagagtctaaggtgcctgaagacagtctggaggaatgcgccattacatgtagcaacagtcatgggccttgcgacagcaaccagccccacaaaaatatcaaaattacctttgaggaagatgaagtcaatagtacactcgtggttgatcgggagagctcccatgatgagtgtcaggatgctctaaacatcttgccctag

SEQ ID NO: 126177 - DNA, 456 bp, Artificial Sequence
  Description of Artificial Sequence: Synthetic coding sequence
ctgtccagagaactcttagaagtcgttgaacctgaagtccttcaggattctttagaccggtgttacagtacccctagttcatgcctagaacagcccgattcatgccagccatacggcagctcattttacgctctcgaagagaagcatgtggggttttccctcgacgtgggcgagattgaaaaaaaggggaagggaaagaaacggagaggaaggaggtccaagaaagagagacgccggggccggaaggaaggagaggaagaccagaccccgccatgccctcgcctctccagggaattgctcgacgaaaaggggcccgaggtgttacaagacagcttggataggtgttattccacccccagcggttgtctagaacttacggactcttgccagccctacaggtcagccttctacgtgttagagcagcagagggtgggcctggctgtagacatggactag

SEQ ID NO: 126178 - DNA, 456 bp, Artificial Sequence
  Description of Artificial Sequence: Synthetic coding sequence
ttgtcccgcgagctcttggaagtggtcgaacccgaggtgctccaggacagccttgatagatgctattccaccccttcgtcgtgcctggaacagccagattcgtgtcagccttacgggtcgagtttctacgcgttggaagagaagcacgtgggtttctcactcgatgtgggcgagattgagaaaaaggggaaaggcaaaaaacgacgcggccgcagatcaaaaaaggaacgccggagaggaaggaaggaaggggaggaggatcagaatcctccctgcccccgcctctctcgggagctcctggacgaaaaaggccccgaagtgctccaggacagcctcgatagatgttactctactccaagcggatgtctggagctcaccgattcttgccagccatacagaagtgctttctatgtgctggagcagcagagggtgggattagccgtggacatggattag

SEQ ID NO: 126179 - DNA, 456 bp, Artificial Sequence
  Description of Artificial Sequence: Synthetic coding sequence
ctctcgcgcgaactgctcgaagtggtcgaacccgaggttctccaggatagcctggacaggtgctacagtaccccctcatcctgtctcgagcaaccggattcttgccagccgtatggatcgagcttctatgcgctcgaggaaaagcatgtcgggttttccttagacgtcggggaaatcgagaagaagggaaaggggaaaaaaaggaggggccgaaggagtaagaaggaacggcggcgcgggaggaaggaaggcgaagaagatcagaatccaccatgcccacggctgtcaagagagcttctggatgaaaaggggcccgaagtgttacaggattcacttgataggagctacagtactcccagtggctgcctggagctcacagacagttgtcaaccgtaccggtctgccttctatgtcctggagcaacaacgtgtcggcctcgccgtggacatggattag

SEQ ID NO: 126180 - DNA, 456 bp, Artificial Sequence
  Description of Artificial Sequence: Synthetic coding sequence
ctttctagagaacttctggaggtggtggagcccgaagtcctgcaggattccctggataggtgctattcgaccccatcctcatgtctggagcagccggatagttgccagccttatggcagctccttttacgctctggaggagaagcatgtaggcttcagcctcgacgtgggcgagatagagaagaagggaaagggaaagaagcgtcggggccggcgttctaaaaaggaacggcgcaggggcaggaaagaaggcgaggaggatcagaacccgccctgtccacggctgagtagagaactgttggacgagaagggccccgaggtgctgcaggattccctcgatagatgctactccactccctcaggatgcctagagcttacggactcttgccagccttatcgctctgctttttacgtcctggaacagcagcgggtcggacttgctgtggatatggattag

SEQ ID NO: 126181 - DNA, 2016 bp, Artificial Sequence
  Description of Artificial Sequence: Synthetic coding sequence
atggttgtgtctgccggccccctttctagtgaaaaggccgagatgaatatattagagatcaacgagaagttgcatccacaattagccgagaagaagcagcagtttcggaatctgaaggaacgatgttttgttactcaacttgctggattcctggctaaccaacagaagaagtataagtatgaagagtgcaaggacctcatcaaatcaatgctgcgcaatgaacggcagtttaaagaggaaaaacttgccgaacaactgaaacaagcagaagagctcaggcagtataaagtgctagtgcatgcacaggaacgagagctgacacagctgcgggaaaagctacgggaaggacgggatgccagtcggtcccttaacgagcatcttcaggccctcttgacgcccgacgaacccgacaaatcgcagggtcaggatttacaggagcagctcgctgaggggtgccgcctcgctcagcacctagtacagaaattgtctcctgagaacgacaacgacgacgacgaagacgtgcaggtggagctcgctgagaaagtgcagaagtcgtctgcgcccagggaaatgcagaaggcggaggagaaagaagttccggaggacagccaggaggaatgcgccatcacatattcaaactcgcatgggccatacgactctaatcagccacatagaaagacaaaaattacctttgaggaggacaaagttgactccacactgataggctcttcctcacacgtggaatgggaggatgccgtgcacatcattccggaaaacgagtctgacgacgaagaggaggaggaaaagggacctgtcagcccgcgcaacttgcaggaatcagaagaagaggaagttccccaggaaagttgggatgaaggttatagtacattaagcatcccccctgagatgctggcctcctaccagtcctattcctccacctttcattcactcgaagaacagcaggtatgcatggcagtggatatcggccgacataggtgggaccaggtgaagaaggaggatcaggaagccacaggccctcgtctatccagggaactgttagacgagaaaggcccggaagtgctccaggatagccttgataggtgctatagcacccctagcgggtgcctcgagctcacagatagctgccagccatatcggagcgctttttatgtcctggagcaacagcgggtgggtcttgccgtggacatggatgagatcgaaaagtaccaggaagtggaagaggaccaagatccctcctgcccccgactcagcagagagttgctggacgaaaaggagcctgaggtgctgcaagattcactggatcggtgttattcaactccatcagggtacctggaactccccgatctgggccaaccttactcttcagcggtgtatagccttgaggaacaatatctaggccttgccctggacgtcgaccgaacaaagaaggatcaggaggaagaagaagaccagggacctccatgccctcgcctgtcccgggagctgcttgaggtcgtcgagcctgaggtactgcaggacagcctggaccgttgctacagtaccccatcatcgtgtcttgagcagccggacagctgtcagccctacgggtctagtttctacgctcttgaagagaaacacgtcggtttcagtttggacgttggagaaattgagaagaagggtaaagggaagaaacgccgtggccggcggtcgaaaaaaaagagaaggagaggccgcaaagagggagaggaggaccagaaccccccgtgccctagacttaacggcgtgctgatggaggttgaagagccagaggtattacaggactcattggatggatgttattcaactccaagcatgtactttgagctgcccgattccttccagcactaccggtccgtgttctattcgtttgaggagcagcacataagctttgctctctatgttgataaccggttctttaccttgaccgtcacatccctgcatctggtgtttcaaatgggagtgatctttccacagtag

SEQ ID NO: 126182 - DNA, 474 bp, Artificial Sequence
  Description of Artificial Sequence: Synthetic coding sequence
ctgtccagagagctccttgaggttgtggagcccgaggtgctgcaagattcactcgataggtgctacagcacaccttcctcctgtctagaacagcctgacagctgccagccgtacggctcatccttctacgcattggaggaaaaacatgtagggttctctcttgatgtaggtgaaatagaaaagaaaggaaagggcaaaaaaagaagagggaggcgatccaagaaggagcggaggcggggacgaaaggaaggagaagaagaccagaaccctccttgcccgcgcctttcccgggaactgttggacgagaagggccccgaagtgctgcaggacagtttggaccggtgttattccaccccgtcaggatgcctggaactaactgactcctgccagccctaccgctctgcattttacgtattagagcagcagcgcgtgggcctggccgtcgatatggatggtgagtacctaagcatgtag

SEQ ID NO: 126183 - DNA, 681 bp, Artificial Sequence
  Description of Artificial Sequence: Synthetic coding sequence
ctctctcgtgagctactggaggtggtggaaccggaagttctccaggattccttggatcggtgttattccacgccaagttcctgcttagaacaaccagacagttgtcagccctatggatcgtccttttatgccctcgaggagaaacacgtaggcttttctctggatgtgggagaaattgagaagaagggcaaaggtaagaagaggcgaggacgtagaagtaagaaggagagacggcgggggcgcaaagaaggagaggaagaccagaatccgccctgccctcggctttctcgggaactcctggacgaaaagggccccgaagttctgcaagactccctggatagatgttactcaactccaagcgggtgtcttgagctcacagatagctgccagccctatcgctctgccttctacgtccttgagcaacagagagtaggcctcgcagtagacatggacgagatcgagaagtatcaggaggtagaagaagatcaagatcccagctgcccccggctgtctagagaactgctcgacgagaaagaacccgaggtattgcaggattcgctcgatagatgttactctactccaagcggctacctggagcttcccgatttaggacagccatactcgtctgccgtgtactcactggaggagcagtatctgggccttgcgctggatgtagactag

SEQ ID NO: 126184 - DNA, 810 bp, Artificial Sequence
  Description of Artificial Sequence: Synthetic coding sequence
atggatgaaattgagaaatatcaggaggtcgaagaggatcaggacccctcatgtccccggctgagtagggagctgctggatgaaaaggaaccagaggttctccaagattcccttgaccgctgctactcaacaccatctggctacttggagctgcctgaccttggacaaccatactcctccgccgtgtattccctggaggagcagtacctggggctagcgctggatgtagatcgaacaaagaaagaccaagaggaagaggaagatcagggtcctccctgtccacgattatctagggagctcctggaagtggttgaaccagaggtgctgcaagacagtttggatcgctgctactcaaccccatcatcgtgtttggagcagccagattcatgccaaccctacggctcgtcattctacgccctcgaagagaaacacgtcgggtttagtctggatgtcggtgagatagagaagaagggtaagggcaaaaagaggcgaggccggagaagcaagaagaaaaggcgacgtggtaggaaggagggtgaggaggaccagaacccgccctgccctcggcttaatggcgtgctgatggaggtcgaggaaccagaagttctgcaggactcccttgatggctgctactcaactcctagtatgtacttcgagttgcccgatagcttccagcattatcggagtgtcttttactcctttgaggaacaacacatttcattcgccctctatgtcgataacagattcttcaccctgacggtcaccagcttgcatctagtgttccaaatgggcgtgattttccctcagtag

SEQ ID NO: 126185 - DNA, 474 bp, Artificial Sequence
  Description of Artificial Sequence: Synthetic coding sequence
ctgagtcgcgagttactggaggtggtggagccggaggtgctgcaggacagtctggaccgatgttattcgacgccttcttcctgtctggagcaaccagactcctgtcagccctatggttcttctttttatgcgctggaagaaaagcatgtgggattctctttggacgtgggggaaatcgagaagaaaggaaagggaaaaaagaggcgcggaagaagaagtaagaaggaacggagacgggggagaaaagagggtgaagaagatcagaatcccccgtgccctcgtttaagccgagaattactggatgagaagggcccggaagtactgcaggactccttggaccgatgttattccactccatccggttgtttggaactcactgatagctgccagccctatagatctgcattttatgtgttagagcagcagagagtgggcctggcggtggatatggatggcgagtatcttagtatgtag

SEQ ID NO: 126186 - DNA, 525 bp, Artificial Sequence
  Description of Artificial Sequence: Synthetic coding sequence
cttagccgggaactgctggaggtagtggagccagaggtcttgcaagattcactggaccgatgctacagtaccccaagtagctgtctggaacaaccggattcatgccagccttatggaagcagtttttatgctcttgaggaaaagcacgttggattcagtctggacgtgggagagattgagaagaagggtaagggaaaaaaaaggagagggaggcgttctaagaaaaagagacggagaggaaggaaagagggcgaggaggaccagaatcccccatgtccaaggttaaacggcgtcctcatggaagtcgaggaacctgaagtgctgcaggactccttggatggatgctacagtacgcctagcatgtattttgagctgccagatagttttcagcattaccgtagcgtcttttatagtttcgaggagcagcatatctcatttgctctatatgtcgacaaccggttttttacgctgactgtaacctccctgcacctggtttttcagatgggagtgatcttcccccagtag

SEQ ID NO: 126187 - DNA, 456 bp, Artificial Sequence
  Description of Artificial Sequence: Synthetic coding sequence
ctgtctagggagctgttggaggtcgtggaacctgaagtgctgcaggattccctcgaccgctgttatagcacaccaagttcgtgtcttgaacagccagattcctgtcagccatacggatcttctttttacgccctggaggagaagcacgttgggtttagtcttgatgtgggcgagattgagaaaaaaggaaaaggtaaaaaaagacgggggagacgctcaaaaaaagagcgcagacgcggtaggaaagagggggaggaggatcagaacccaccatgcccaagactaagtcgagagctgctggacgaaaaaggtccagaagttctacaggacagtcttgaccggagttacagcactcctagtggatgcttagagctgacagactcttgccagccctataggtcagcattttacgttctggagcagcagcgcgtcggactggcagttgacatggattag

SEQ ID NO: 126188 - DNA, 759 bp, Artificial Sequence
  Description of Artificial Sequence: Synthetic coding sequence
atggatgaaatcgagaagtaccaggaggtcgaagaggaccaggacccatcctgccccagactgtcacgggaattgctggatgagaaagagccggaagttcttcaggactctctggatcgctgctacagcacgccctcaggctatctggaacttccagaccttgggcaaccttactctagcgcagtgtactctctcgaggaacagtacctcggattagctctcgatgttgaccgtactaagaaggaccaggaggaagaggaagatcagggaccaccatgtcctagactttctcgcgagctattagaggtcgtagaacctgaggtgttacaggatagtctggatcggtgttacagtacacccagtagctgcctagagcagccagatagttgccagccctacggatcttccttctatgcactcgaagagaaacatgtaggtttcagccttgacgtaggtgagatcgaaaagaaaggaaaggggaagaagaggcgtggtcggagaagcaagaaagaacggcgaagagggcggaaagagggagaggaagaccaaaatcctccctgccctcggctgagcagggaattgctggacgagaaaggtccagaagttcttcaggatagcctggaccgatgctattctactccttcaggatgtctagagctgacagattcttgccaaccttaccggagtgccttttacgtcctcgagcagcagcgagtggggctcgccgtggatatggacggcgagtatctatcgatgtag

SEQ ID NO: 126189 - DNA, 1734 bp, Artificial Sequence
  Description of Artificial Sequence: Synthetic coding sequence
atggtagtctctgctggcccatggagcggagaaaaggccgagatgaacatcttggagataaacaagaagagccgacctcagctcgccgagaataaacagcaattccgtaacctcaaacaaaaatgcttggtgactcaggtcgcttactttctcgctaacaggcagaataactacgactacgaggattgcaaagatctgattaagagcatgctacgcgatgaaaggctccttacagaggagaaactggcagaagagctgggtcaggctgaggagcttcgccagtacaaggtgctggttcactctcaggaacgagagctcacacagctacgggagaaactgcaggaaggcagggatgccagtcgctccctaaaccagcacctgcaggccctgctaactcctgatgagcccgataattcccaagggcgcgacttgagggagcagctggccgagggttgccgcttggcacaacacctggtacaaaagctgtctcccgagaacgacgacgatgaggatgaagacgtgaaggtggaagaggcagagaaggtccaggaactctatgccccccgggaggttcagaaagccgaggagaaagaagtgccagaggattctctggaagagtgtgccataacatgtagcaattcccaccacccctgcgagtccaaccagccctacggtaatacaaggatcacctttgaggaagatcaggtagacagcactctgatcgacagctcttcacatgatgagtggctggatgccgtttgtattattccagagaacgagtccgatcacgagcaagaggaagagaaagggcccgtttcccctcggaatttgcaggaatccgaggaggaggaagcgccacaggaaagttgggatgaaggcgattggactctttcaataccgcccgacatgagcgcgagctatcaatcggataggtcaacctttcattctgttgaggaacagcaagtgggcctggcactggacatcggcaggcattggtgtgaccaggtcaagaaggaggatcaggaggccacaagccctcggctgagcagagagctgctcgatgaaaaggagcccgaggtactgcaggatagcctcgatcgattttattctaccccattcgagtacttggagctgcctgacctctgccaaccctatcgcagcgacttttactctctccaggaacagcacctcgggctcgctctcgatcttgacaggatgaagaaagaccaggaagaagaagaagatcaaggtcccccttgtccgagactctcccgggagctacctgaggtcgtggagccagaggacctgcaggacagtctcgataggtggtactcaactcccttttcctatcccgagctgccagatagctgccaaccctatggcagttgcttctactccttagaggaagaacacgtgggatttagcctggatgtagatgaaatcgagaaataccaggaaggcgaagaagaccaaaaaccgccatgcccacgcctgaatgaggtcttaatggaggccgaagaacccgaggtgctgcaggattccctagatcgttgctactcaacgactagcacctacttccagctgcacgcgtcttttcagcagtaccgcagtgccttctattccttcgaggagcaggatgtttccttggctctcgacgtggacaatcgtttcttcacgttaacggttatccggcaccatttagcgttccagatgggagtaatttttccacactag

SEQ ID NO: 126190 - DNA, 1902 bp, Artificial Sequence
  Description of Artificial Sequence: Synthetic coding sequence
atgccattaacccctactgtccagggcttccaatggaccctacgaggccccgatgtggaaacgagccctttcggagcacctagagctgcatcccacggtgtaggcaggcatcaagaattgcgggaccctactgtgcccggtccaaccagcagtgccaccaatgtgagcatggttgtgtctgctggcccctggtcaggggagaaagctgaaatgaacatcttggagataaataagaagtctaggccccagctggctgagaataagcagcagtttcgcaatctgaagcagaagtgtctcgtgacccaggtggcctactttctagccaataggcagaataactatgactatgaggattgcaaggatctgattaagtcgatgctaagggacgagcgcttgcttaccgaggagaaactggctgaggaactgggtcaggcagaagagcttagacaatacaaggtactcgttcacagccaggaacgggagctgacacagctgcgggaaaaactccaggaggggagagacgcaagccgttccctgaaccagcacttgcaagcccttctgacacctgacgagccagacaattcgcaagggcgcgatctgagggaacagctggctgagggatgtcgcttggcacagcacctcgtgcaaaagctgtcccctgagaacgacgatgacgaggatgaagacgttaaggtcgaggaagcagagaaggtgcaggagctgtatgccccccgcgaggttcagaaagcagaggagaaagaggtcccagaagattccctcgaggaatgcgcgatcacttgtagtaactcacatcacccttgtgagagcaaccaaccttacgggaacacccgcatcactttcgaagaggaccaagttgattctaccctaatcgactcaagcagccacgatgagtggctcgatgcggtgtgcataattcctgaaaacgaaagcgatcatgagcaagaggaggaaaaaggccccgtgagccccaggaacctccaagagagtgaggaagaagaggccccacaggagtcatgggacgagggagattggacattgtcgataccacctgatatgtctgcctcctaccaatccgataggtctactttccactctgttgaagagcagcaggttggcttggccttggacatagggagacattggtgtgaccaggtgaaaaaagaggaccaggaagccacatcgcctcggctgtcccgcgagctcctggacgagaaagagcccgaggtcttgcaagattctctagatcgattttactctactcccttcgagtatttagaactgcctgatttgtgtcagccatatcgtagcgacttctattcgcttcaagagcagcatctgggactggctttggacctcgatcgaatgaagaaagatcaggaagaagaagaagaccagggccctccttgtccccggctttcccgcgaacttccagaggtggttgaacccgaagacctgcaggatagtctggataggtggtattctactccctttagctatccagagctccccgattcctgccagccctacggcagttgcttctatagcctggaagaggagcacgtgggttttagtctggacgtggatgaaatcgagaaatatcaggaaggagaggaggatcagaaaccgccctgtccccggctgaatgaggtcttgatggaagcggaagagcctgaggtcctccaggactcattggatagatgctatagcactacatccacctatttccaattgcatgcttcattccagcagtatcgttccgccttctactctttcgaagaacaggacgtgtctctggcactcgacgtggacaataggttcttcactctgactgtgatcaggcatcaccttgcctttcagatgggggtcatcttcccacactag

SEQ ID NO: 126191 - DNA, 1866 bp, Artificial Sequence
  Description of Artificial Sequence: Synthetic coding sequence
atgccccttaccccaaccgtgcaaggctttcaatggactctgagaggacctgatgtggagaccagtcctttcggtgcccccagggcagcatcccacggggtgggccggcaccaggaactgcgcgaccccaccgtgccgggcccaacctcgtcagctaccaatgtgagcatggttgtgtccgcagggccgtggtcaggagagaaggctgaaatgaacatccttgaaataaacaaaaaatccagaccccaattggcagagaacaaacagcaatttagaaatctgaaacagaagtgccttgtgacccaggtggcttacttccttgctaaccgacaaaacaattatgattatgaggattgcaaggatctaattaagtccatgctgcgcgatgagaggcttctcacagaggagaaacttgctgaggagttaggtcaagccgaggagcttcggcagtacaaagtgctcgtgcacagccaggagcgcgaacttacgcagctgcgcgagaagctacaagaaggccgggatgcgagccgatctcttaaccagcacttgcaagcgctactgactcctgacgagcctgacaattcacaggggagagatctgcgcgagcagcttgctgaaggatgcaggctcgcacagcatctcgtgcagaagctcagccccgagaatgatgacgatgaggacgaagatgttaaagtcgaagaagcagagaaggtccaggagctctacgcaccccgggaggtgcagaaggccgaggagaaggaggtgccggaggattcactggaggagtgtgcgatcacttgttcaaactcacatcacccatgtgagagcaaccagccttacgggaatactagaattacattcgaggaagaccaagtagacagtacccttattgattcttccagccatgatgaatggctggatgcagtgtgtatcatacctgagaatgagagcgatcacgagcaagaggaggaaaaaggacctgtgtcgcccagatcaagtggacgcttctgctgccttatcagcgtcggctacattttctgtcatccttgccccgcatggctgattaggaatctccaggaaagtgaggaagaggaggctccacaggagtcgtgggatgagggccattggtgcgaccaagtaaagaaggaggatcaagaggccacgtccccccgactgagccgtgaactactcgatgagaaagagccagaagtcctgcaggacagcttggatagattctactccaccccattcgagtacctagagttacccgatctatgccagccatatcgttcagacttctatagcttacaggaacaacatctcggccttgccctcgacctggatagaatgaagaaagatcaggaggaggaggaggaccaaggaccaccatgccccagactatcgcgcgaactaccagaggtggtggaaccagaagatctccaggattcgttagaccggtggtatagcaccccattcagttatcctgagctgcccgacagttgtcaaccatacggctcttgtttctacagcctggaagaggagcacgtcggcttctctctggacgttgacgaaattgagaagtaccaggaaggggaggaggatcagaagcccccgtgcccgcgcctcaatgaagtgctgatggaagccgaggagccagaagtcctccaggactctttagatcgttgttacagcaccacgagtacgtacttccaattacacgcatctttccagcagtacagaagcgcgttctactcttttgaggagcaggacgtttcattggctctggacgtggataatcgtttcttcacgctgaccgttatcaggcatcacctcgccttccagatgggagtgatattcccccattag

SEQ ID NO: 126192 - DNA, 1062 bp, Artificial Sequence
  Description of Artificial Sequence: Synthetic coding sequence
atggtagtctcagcaggtccctggagtggggaaaaggcggaaatgaatattctggagatcaataagaagtcccggcctcagctggccgagaataaacagcagtttagaaatctgaagcagaagtgcttagtcactcaggtggcatacttcctggccaatcgccagaataactacgattatgaagactgtaaggatctgatcaagtccatgctgagggatgaaagactgttgaccgaggagaaattagctgaggagttgggccaggctgaggagctgcggcaatataaagttttagtccacagccaagaacgcgagctgactcagttaagggagaagctccaagaaggaagagacgcaagtcgatcattgaaccagcacctgcaagccctgctcacgcctgatgaaccagacaattcacagggacgcgacctccgagaacagctggcggagggctgcagactggctcagcacttagttcagaagctgtccccggaaaatgatgacgatgaggacgaagacgtgaaagtggaggaagccgaaaaggttcaagaattgtatgctccacgagaagtgcagaaagccgaggagaaagaggtgcctgaggactccttagaggaatgcgctataacctgcagtaactcccaccacccgtgcgagtcaaatcagccctacggcaataccagaatcacgtttgaagaggatcaggtggatagcactctgattgacagctcctctcatgacgagtggctggatgcagtgtgtattattccggagaacgagagtgatcatgagcaggaggaggaaaagggtcccgtttctcctaggaatctccaggaatcagaggaggaggaggctccccaggagagttgggatgagggcgattggactctttccatcccgcccgatatgtccgcgtcataccaatcagaccgctctactttccattctgtggaggagcagcaggtgggcctggccctggatattggaaggcactggtgtgaccaggaaaagggtggccctcggggccataagtcacaggcccagcaaggcgcggcgggatag

SEQ ID NO: 126193 - DNA, 1668 bp, Artificial Sequence
  Description of Artificial Sequence: Synthetic coding sequence
atggtcgtgagcgctggaccgtggtccggtgagaaagccgagatgaatatactcgaaattaacaagaaatctaggccccagcttgccgaaaataagcagcagttccgaaatttgaaacaaaaatgtctagtaacccaggtcgcttatttcctagccaaccgacagaataactatgactatgaggattgcaaagacttaataaaatccatgcttcgagatgaaagattgctcacagaagaaaaactggccgaggagctaggtcaggccgaggaactgcggcagtacaaagtgctggtgcatagccaggaacgggaactaacccagctgcgggagaagctgcaggaaggaagagacgcatcgcgcagtcttaatcaacatctgcaggccttactgacacctgacgagccagataatagtcagggaagggacctccgagagcaactggctgaaggctgccgactcgctcagcacctggtgcagaagctttcgccagaaaatgatgacgatgaagatgaagacgtcaaagtggaggaggctgaaaaagtgcaggagctctatgcaccacgcgaggtccagaaagccgaagagaaggaggttcccgaggactcactggaagaatgcgcaatcacctgttctaactctcatcacccgtgtgagagtaatcagccttatgggaacactagaataacttttgaggaggaccaggttgactcgactctcatcgattcttcctctcacgacgagtggcttgatgcagtgtgcatcatcccagaaaacgagtccgaccacgaacaggaagaagagaagggtcctgtgtctcctaggaacctccaggaaagcgaagaagaagaggcaccacaggaaagttgggatgaaggagactggacactgagtattccaccggacatgtctgcttcctaccagagcgaccgtagtacattccactctgtcgaggagcagcaggtgggactagccctggacatcggaaggcattggtgtgaccaggtcaaaaaagaagatcaagaggcaacttctccgcggctctctcgggagttgctagatgagaaagagcccgaggttctccaggactcactggatcgcttctactccactccttttgaatacctcgaactgcctgatctgtgtcaaccgtataggagcgatttttacagcttacaagaacagcacttaggcctggccttagatctggatcggatgaagaaagatcaggaggaggaagaggatcaggggcccccttgtccccgactgagcagagagctgccagaggttgtggagcccgaggacctccaagattcactggaccgctggtactcgacaccttttagttacccggagcttcctgattcgtgtcagccctatggctcgtgcttctattcccttgaagaggagcacgtgggcttctctctagacgtcgacgaaatcgaaaaataccaagagggagaggaagaccagaaacctccctgtcctcgacttaacgaagttctgatggaggccgaggaacctgaagtactccaggatagccttgaccgctgctatagtaccaccagtacatattttcagctccacgcatcattccagcagtacaggagcgccttctacagtttcgaggagcaggatgtaagcctggcactagacgtcgacaactag

SEQ ID NO: 126194 - DNA, 1692 bp, Artificial Sequence
  Description of Artificial Sequence: Synthetic coding sequence
atgcctctcactcctaccgtgcaggggtttcagtggactctccgggggcccgacgtcgagacatccccctttggagctccacgagccgcttcacatggcgtgggacggcaccaggagcttagagatcccaccgattatgaggattgcaaggacctgatcaaaagtatgctgcgggatgaacgccttttgacagaggagaagctcgcagaggagctagggcaggccgaagagctgcgccagtacaaggtgcttgtgcatagccaggagcgcgagctgactcagttacgcgaaaaactgcaggaggggcgtgacgcaagcaggagtctgaatcagcatttgcaggcgctgctcacgcctgatgaaccggataacagtcaggggagagatttaagagagcagctggccgagggctgccgccttgcccagcacctggttcagaagctgagcccagaaaacgacgatgacgaggacgaggacgttaaggtcgaagaagctgagaaagtgcaagaactctatgccccacgggaggtacagaaagccgaggagaaagaggtgcccgaggactccctggaggagtgtgcgattacatgtagcaactcacaccacccgtgtgaaagtaaccagccctatgggaatacccgcataactttcgaagaggaccaggtcgactccaccctcatagactctagttctcatgacgagtggctggatgccgtgtgcattattcccgagaacgaatcggaccacgagcaggaggaggagaagggccctgtgtcacctcgaaatcttcaggagtctgaggaggaggaggccccccaggaatcttgggacgaaggcgattggacactctccatccctcccgacatgtctgctagctatcagagcgatcggtcaactttccactctgtagaagagcagcaagtcggtctggctttggatatcggtcgacactggtgtgaccaggtgaaaaaggaagaccaggaggctacaagtccacgtctcagtcgcgaactccttgacgaaaaagaacctgaagttctgcaggattccctggatagattctatagtacccctttcgaatacctggagctcccagacctctgtcagccctaccggtcagacttttactccctccaagagcaacacttgggccttgccctggatctcgacagaatgaagaaagatcaggaagaggaagaggaccagggaccaccctgcccaaggctgtctcgggagctgccggaggtagtagagcccgaagacctgcaggactcgctggacagatggtacagcacaccctttagctaccccgagcttccagatagttgccagccttacggctcctgcttctatagcctggaggaagagcacgtaggcttctcattagatgttgacgagattgagaaatatcaggagggggaggaagatcagaaacccccgtgtcctagactgaacgaggtcttgatggaggccgaagagcccgaggtcctgcaggatagtttggacagatgttatagtaccacttcaacatatttccagttacacgccagtttccagcaataccgatccgccttttactcgtttgaagagcaggacgtaagtctcgccttggatgttgataacagattctttaccctgaccgtgattaggcatcatttagcttttcagatgggagtaatctttccccactag

SEQ ID NO: 126195 - DNA, 1917 bp, Artificial Sequence
  Description of Artificial Sequence: Synthetic coding sequence
atggtagttagcgcagatcccctgagcagcgagcgcgcagagatgaatatcttagaaattaatcaggagctgcgttcccaactggcagagtcaaaccagcagtttagggatttgaaagaaaaatttctcatcactcaagcgaccgcctacagcttggcaaatcagctgaagaagtataagtgcgaggagtataaagatatcatagattccgttttgcgtgatgagcttcagagcatggaaaagctggctgaaaagttaaggcaagctgaggaactccgccaatacaaggccctggtccactctcaggctaaggagctgacccagctgcgagagaaactgagagaagggcgcgacgccagccggtggcttaacaagcacctgaaaaccctgctgacgccagatgatccggataagtcgcagggacaggatctaagggagcagctggcggaaggccacagattagccgagcacctagtccataaattgagccccgaaaatgacgaggacgaggatgaggatgaggacgataaagatgaggaggtggagaaggttcaggaatctcccgcccctcgagaagtgcagaagacagaggaaaaggaggttcctcaagactcactcgaggagtgtgccgtgacttgctccaacagtcataacccaagtaatagcaaccagcctcacaggtcaaccaagatcaccttcaaggaacatgaagtggactcggctctagtggttgaatcagagcaccctcacgatgaggaggaagaggctttgaacattccccccgagaaccaaaacgatcatgaagaggaggagggcaaggcgccagttcctcctagacaccatgataagagtaattcctatcggcaccgggaggtgtcctttttggctctggacgagcagaaggtgtgcagcgcacaggacgtggcacgggactacagcaacccaaaatgggatgaaaccagcctgggatttctggaaaagcagagtgacctggaggaggtcaagggccaggagaccgtggcaccaaggttgagcagggggcccctcagagttgacaagcacgagatcccgcaggaaagcctggacggctgttgcctgacgcccagcatccttccagatttgacccccagttatcacccatactggtctacgttgtactcttttgaggataagcaggtttcgctggctctggtagataagattaagaaagatcaggaagagatcgaagatcaatctcctccctgccctagactttctcaggagctccccgaagtgaaggagcaggaggttcccgaggactccgtgaacgaagtctacctcacaccatctgtacatcacgatgtgtcagactgccaccagccttactccagcactctttcatccctggaggatcagctggcttgcagcgccctggacgttgctagccccacagaagctgcctgtccacagggaacatggagtggagacctgtcacaccaccagtctgaggttcaggtctctcaggcccagctggagccttcgaccctagtgcccagctgcctgaggctccagctggaccaaggctttcattgtggaaatggcctggctcagagaggcctatcgtcgacaacctgttctttctctgccaatgccgattccggcaaccagtggcctttccaggaacttgtgttagagccttcactcggtatgaagaaccccccacaactcgaagatgatgcactggagggtagcgccagtaatacgcagggacgtcaggtgacggggagaattagagcgagtcttgtgctcattctgaaaactatccgtaggcgactgcctttctccaaatggcggcttgccttccggtttgcaggaccccatgcagaaagtgccgagataccaaataccgcggggcgaactcagagaatggccggttag

SEQ ID NO: 126196 - DNA, 1917 bp, Artificial Sequence
  Description of Artificial Sequence: Synthetic coding sequence
atggtagtgtcagcggatccgctgagttccgagcgtgctgagatgaacatcttggagattaaccaggaactgaggagccagttggccgagtccaaccaacagtttcgtgatcttaaagaaaagtttctgatcacccaggccacggcgtattctctcgccaatcagctgaagaaatacaagtgtgaagaatataaagacatcatcgattccgtcttaagggacgaactgcagagtatggaaaagcttgcagaaaagctccggcaggcggaagagcttcgacaatacaaggctttagtccattctcaggccaaggaattgacccaacttcgggagaagctgcgggaaggacgagatgcttcacgctggctgaacaaacacttaaagactctcctgacacccgacgatcctgataagtcacaaggtcaggatcttagagagcaacttgccgaaggtcacaggctcgcagagcatctagtgcacaagctatcaccagaaaatgatgaggatgaggatgaggacgaagatgataaggatgaggaagtggagaaggtgcaggagagccccgccccccgagaagtacagaagaccgaagagaaagaggtccctcaggactcactggaagaatgcgcggtgacttgctcaaatagtcacaacccgtcaaattctaaccaaccccatcggtcaacaaaaatcaccttcaaagaacacgaagttgattcagccctcgttgtggagagcgaacatcctcacgacgaggaagaagaggccctcaacatcccacccgagaatcagaatgaccacgaagaagaggaaggtaaagcacccgtaccgccaaggcaccacgacaaaagtaacagctaccgccaccgggaggtgtcatttctcgccctggacgagcaaaaagtgtgttcagctcaggatgtcgccagagattatagtaacccgaagtgggatgaaactagcctaggattcctggaaaagcagagcgacctcgaggaggtgaagggccaagagactgtggccccccgcctctctcgaggaccacttcgtgtggacaagcacgagataccgcaggagtccctcgacggttgttgcttaactccttccatcctccccgatctgacgcctagctaccacccttattggtccacactttactctttcgaggataagcaagtgtccttggctttggtggacaagattaagaaagaccaggaggagattgaggatcaatcccccccttgcccgcggctgtctcaggaactgcccgaggtaaaagagcaggaagtaccggaagactcagttaacgaggtctaccttaccccttcagttcaccacgacgttagcgactgtcaccaaccatactcgagcactctttcctcacttgaggaccagcttgcttgcagtgctcttgatgttgctagtcctacagaggcagcctgtccgcagggcacatggtcaggtgatctgtctcatcatcaatccgaggttcaggtctcgcaggctcagctggagccgagcacactggtcccttcatgtttaagactgcagcttgaccagggattccattgcggcaatgggctcgctcagcgcggcctgtcctccaccacatgcagtttctccgccaatgccgactcaggcaatcagtggccgttccaggagctggttctggagcccagcctgggtatgaagaaccctccccagttggaggatgatgccctggagggctcagcctctaacacccagggcagacaggtgaccggtcgcatacgggctagcctcgtgttaattctcaagacaattcgccgacgcctgccattcagcaagtggcggctcgcattccggtttgcaggaccacatgccgaatcagcagaaattcccaacacagcggggaggacacagcggatggccggctag

SEQ ID NO: 126197 - DNA, 1722 bp, Artificial Sequence
  Description of Artificial Sequence: Synthetic coding sequence
atggtggtcagcgctgaccccctgagctccgagagagctgagatgaacatactggagataaatcaggagctccggagccagctcgctgagagtaaccagcagttccgggacctgaaagagaagtttctgatcacacaggcaactgcctactccttggctaatcaattgaagaagtacaaatgcgaagagtacaaggatatcatcgattctgtcctgcgggacgagctgcaatccatggaaaaattggcagagaagctcagacaggcagaggagttacggcagtacaaagcgctggtccattctcaggccaaggagctcacacaactgcgggagaagctacgggagggacgcgatgcttcccggtggttgaacaagcacctgaagactcttctcacgccagatgatcccgacaaatctcagggccaggacttaagagaacaattggcagaggggcacaggctggcagagcatctcgttcacaaactctccccggagaatgatgaggacgaagatgaagacgaagatgacaaggatgaggaagtagagaaggtgcaggaaagccctgcacctcgcgaggtgcagaaaaccgaggaaaaagaggtgcctcaagactcactggaagaatgcgccgtcacgtgctctaattctcataacccctcgaacagcaaccagccccatcgcagcacaaagataaccttcaaagagcacgaagttgacagcgcattggttgtggaatctgaacaccctcacgacgaagaggaagaggccctcaatattcctcctgaaaatcaaaacgatcatgaagaggaggaaggaaaggcacccgtcccaccccgtaaccggcagagtctggaaccaggcgagctgacaaatttgcgggactttctgatttcccctgtcgtgtctcacgtcgcaaatcctggccaccacgacaagagcaatagttaccgacatcgggaagtttctttcctcgctttggatgaacagaaagtgtgtagcgctcaggacgtggctcgcgactactcaaatccaaagtgggatgagactagccttggcttcctggagaagcagtccgatctggaggaggtgaaaggacaagagacagtggccccaagactgtctagaggtcctttgcgggtggataaacacgagattccccaggagtccctggacggttgttgcctgacccctagcattctgccggaccttactccatcttaccacccatactggagtacactgtattctttcgaagataagcaagtgagccttgccctagtcgataaaatcaaaaaggaccaggaggagattgaagatcagtctcccccctgcccacgcctaagccaggaactcccagaagtaaaagagcaagaggtgcctgaagattcagtgaacgaagtgtacctgacccctagcgtgcatcacgacgtttctgattgccaccaaccttattcttcaaccctgagctctctggaggaccaacttgcatgtagtgctctcgacgtggcctctcctaccgaggctgcatgcccccagggtacctggtcgggagatctttcacaccatcagtctgaggtgcaagtcagtcaggcccaactggaaccaagcactcttgtccccagctgcttgaggcttcagcttgaccagggcttccactgtggaaatggcttggcacagagaggcctgtcctcgactacttgctctttctctgccaacgcatag

SEQ ID NO: 126198 - DNA, 372 bp, Artificial Sequence
  Description of Artificial Sequence: Synthetic coding sequence
atggtggtctcggctgaccccctttcgagtgaacgcgcagaaatgaacatcctcgaaattaaccaagaactgaggagtcagctggcggagtctaatcagcagttccgcgacctgaaggaaaagttccttattacacaagctactgcgtactcactcgctaatcagttgaagaagtacagctgtttgaaatatcgaaaccacttgcccccagagcgatgtagacgtttaaaaaagcgcaaaagcctccggacccattggcgaaacgtgctatccctggtgcagatcgtgactaccctgcttactcccacttctctcacgggcgcgccgaagagccacctcaggaacacaaaatccaccttgctttggctctag

SEQ ID NO: 126199 - DNA, 2004 bp, Artificial Sequence
  Description of Artificial Sequence: Synthetic coding sequence
atggtagtttcagccgaccccctatcgtccgagcgggctgagatgaacatcctggagattaaccaagaactccgaagccagttagctgagtccaatcagcaattccgcgacctcaaggaaaagtttttaataacgcaggccaccgcatattccttggccaatcaactcaaaaaatacaagtgtgaagaatacaaagacatcattgactctgtattgcgggacgagctgcagtcaatggaaaaattggctgagaagctcaggcaagctgaggagttacgccagtacaaagccctggtccacagtcaggccaaggaactgacccagctgcgagaaaaacttcgcgagggaagggacgcttcccgttggctgaataaacaccttaaaaccctcttgacacccgacgatcctgataagagccaggggcaggatcttagggagcagctggccgaaggccaccgtctggctgaacacctagttcataagttatcaccagagaatgacgaagacgaggacgaggatgaagatgacaaagatgaggaggtggaaaaagtccaggagtcccccgcacctagagaggtgcagaagacagaagaaaaggaggtgccccaggacagcctagaggaatgtgccgtcacttgttctaatagtcacaatccatccaattctaaccagccacataggtcaactaaaatcacgttcaaagaacacgaagttgactccgcccttgtggtcgagtctgagcacccacacgacgaggaagaggaggccctcaacatccctcccgagaaccagaatgaccatgaggaggaagagggcaaggcccctgttccaccacgaaatcgccagtccttagagccaggagagctgacaaatttacgtgattttctgatttccccagtggtctcccatgtcgccaaccccgggcaccatgacaagtcaaattcctacagacatagggaggtcagcttcctcgccctagatgagcagaaagtgtgttccgcccaagatgtcgcccgtgactattccaaccctaagtgggatgaaacctcacttggcttcttggaaaaacagtctgacctggaggaggtgaagggccaggagacagtggctcccaggctgagccgtggacctttacgagtcgataagcatgagatcccgcaggagagcctggatgggtgttgcctgacacccagcattcttcccgacctcacaccttcgtaccacccttattggtctactttatattcttttgaggacaaacaggtttccctagctttggtggataaaatcaagaaggaccaggaggaaatcgaggatcaaagccctccctgccctcgactgtcccaggagcttcctgaggtgaaagaacaggaggttcctgaggactccgtgaatgaggtataccttacgccgtccgtgcaccatgacgtcagcgactgccatcagccttactccagcaccctatcttcacttgaggaccagcttgcatgttcggctttggatgtcgcgagccccacagaagccgcctgtccgcagggaacttggtccggcgacctgtctcaccatcggtcggaagttcagatttcccaggcacagctagaaccatccaccctcgtgccttcttgtctccgactgcagctcgaccagggctttcactgtggtaatggcttagcccaaaggggtttgtcaagtaccacgtgctccttttccgcgaatgccgatagcggaaaccagtggccctttcaggagctggttctggaaccttcactcggcatgaagaacccccctcagctggaggacgacgctctcgaaggatctgcttccaatacacagggtaggcaggttaccgggaggattcgggcatctcttgtcctgattctcaagaccattcggcggcgacttccctttagcaagtggcgcttagccttccgcttcgcgggacctcatgcggaatcggccgagatcccaaatacagcagagagaatgcaaagaatgattggatag

SEQ ID NO: 126200 - DNA, 1722 bp, Artificial Sequence
  Description of Artificial Sequence: Synthetic coding sequence
atggtcgtgtccgccgacccactgagctctgaacgcgctgaaatgaatatattagaaatcaaccaggagctgcggagtcagctggcggagagtaaccagcagtttagagatctgaaggagaaatttttaatcacccaagccaccgcgtactccttggccaatcagctgaagaaatataaatgtgaggagtacaaggacattatagactccgtcctgcgtgatgagcttcagagcatggaaaagcttgccgaaaagcttcgccaagctgaggaactaagacagtataaggctctggtgcattcacaggcgaaggagttgacccagctgcgtgagaagcttcgcgagggccgtgacgcttctcgctggctaaacaaacacctgaagactctactcacacccgacgacccagataaatcccagggccaagacctccgcgaacagctcgcggaggggcatcgtttggccgagcatctggtacacaagctgagcccagaaaatgatgaggatgaggatgaggatgaagacgataaggatgaggaagtggaaaaagtgcaggagtccccagcccccagagaggtgcagaaaactgaagaaaaggaggtgccccaggattcactggaggaatgcgccgttacttgttctaacagccacaatccctcaaatagtaaccagccacatagatctacaaaaattacatttaaagaacatgaagtggactccgcattggtcgtggaatctgagcacccacacgatgaggaagaggaagcgctgaacattccgcccgagaaccaaaacgaccacgaagaggaggaaggcaaagcacctgtccctcctcgcaatagacagagcctggagccaggggagctgactaatttacgggatttcctgatttcgccagttgtgtctcacgtggccaaccccgggcaccatgataagtccaatagctataggcatagggaggttagttttctggctctggacgagcagaaagtgtgcagcgcccaggatgtggcgcgagattattccaatcctaagtgggacgagacaagcctcggcttcctggagaaacagtctgatttagaggaggtcaaagggcaggaaaccgtcgctccccgtctgagtcggggtcctcttcgggtggataaacacgaaataccccaggaaagtttggacggatgttgcttgactcccagcatcctccccgatttgactcccagttatcacccttattggtccaccctttactcattcgaggacaagcaggtctcgttagcattggtcgataaaataaaaaaagatcaggaggaaatagaggaccagtcgcctccctgccccaggttgtctcaggagctgcctgaggttaaagaacaggaggtcccagaagactctgtgaacgaagtgtatctgaccccctctgtccatcatgacgtgagtgactgtcaccagccttatagctccactctgtctagcctggaggatcagctcgcatgcagcgcactggacgtggcgtctcccaccgaagccgcttgtccacagggcacgtggtcaggggatttaagccaccatcgaagcgaggtgcagatatcacaggcgcagctggagccttccacccttgtgccctcctgtcttcgccttcagcttgaccagggcttccattgcggaaatgggctggctcagcgggggttgagctccaccacttgttccttcagcgccaatgcctag

SEQ ID NO: 126201 - DNA, 1917 bp, Artificial Sequence
  Description of Artificial Sequence: Synthetic coding sequence
atggtcgtgtctgcagatcccctgtcttccgagagagccgagatgaatatactagagatcaatcaggagctccggagccagctggccgaatctaaccagcagtttagagaccttaaggagaaattcttgattacccaggctactgcatacagtctggccaaccagctgaagaagtataagtgcgaggagtacaaagatatcatagatagcgtcctgagggacgagctccagagtatggagaagctggccgaaaagctgcggcaggcggaggagctccgccagtacaaggcccttgtccacagccaggcgaaggaactgacccagctgagggagaagctgagggaggggcgagatgcttctaggtggttgaacaagcatttaaagactctgctcacccctgacgaccccgataaatcccagggacaggacctgcgagagcagctggctgagggtcacagactagcagaacatctggtgcataagctgtcaccggagaacgatgaagatgaggacgaagatgaggacgataaggacgaggaagtcgagaaagtccaggaatcaccagcgccccgcgaggtacaaaaaactgaggaaaaggaggtgccgcaggactctctggaggagtgcgccgttacatgttcgaactcacacaacccaagcaattccaatcagccacacaggagcacaaagataaccttcaaagagcatgaggtggactctgcccttgtcgttgaaagcgagcaccctcacgatgaggaagaggaagcgttaaatattcctcccgagaatcaaaacgatcatgaagaggaagaaggaaaagctccggtgcccccacggcaccatgataagtcgaattcctatcggcaccgagaggtcagtttcctggcattagacgaacagaaggtgtgttccgcacaggacgtggctcgggactactcaaatcccaagtgggatgagacttccctcggtttcttggaaaaacagtcagacttagaggaggtaaaaggccaggaaaccgtggcccctcggctgagtagaggccccctgagggtcgataagcacgagattcctcaggaatcactggatggatgctgcctcaccccctctattctgcctgatttaaccccatcgtatcacccttattggtcaacactttattcattcgaggataaacaggtgagtcttgcccttgtcgataagatcaagaaagaccaggaagaaattgaggatcagagtccaccctgtcctcgtcttagtcaagagctgcccgaggtaaaggaacaggaggtcccagaggactccgttaatgaggtatacctgaccccttcggtgcaccacgacgtctccgactgccaccagccttacagtagcactctctcctccctcgaagaccagctcgcctgcagtgcccttgacgttgcgtcccctacagaagccgcttgtccacagggtacctggagcggcgaccttagccaccatagatcagaggtacagatttcccaggctcagctggagccttcgactctagtgccgtcatgtcttcgcttgcaacttgaccaggggttccactgcggtaacggcctagcacagcgcggtctgtcgagcactacatgctctttcagcgctaacgccgatagcggcaatcagtggcctttccaggaactggtgctggagccgtctctgggtatgaagaatcccccacagctcgaggatgacgcgctagaaggatcagccagcaacacacagggacgccaggttacaggccgaatcagggcttcactagttctaatattgaaaacgatcaggcgccggctgccattctccaaatggagacttgcctttcggttcgcggggccacacgcagagagcgctgagattccaaataccgccgaacgaatgcagcgcatgatcgggtag

SEQ ID NO: 126202 - DNA, 1917 bp, Artificial Sequence
  Description of Artificial Sequence: Synthetic coding sequence
atggtcgttagcgccgacccactgtcttcagagcgggcagagatgaacatcttggagattaaccaggaacttagaagccagctggctgaatcaaaccagcagttcagagatttgaaggagaagtttttaataacccaggcaactgcctactcattggccaaccagctgaagaagtataaatgtgaagagtacaaagatatcatcgattctgtgctgcgcgatgaactgcagtccatggagaagctggctgaaaagctcaggcaggcagaggaactgagacaatacaaggcactcgtccattctcaggcaaaggaactaacccaattaagagagaaactgagagaaggtagggacgcctcgcggtggctcaacaagcaccttaagaccctcctcacccccgatgaccctgataaatcccaaggacaagacctacgtgagcagttagccgaaggacaccgcttggctgaacatcttgtccataagctgagtcccgaaaacgacgaggacgaggatgaagacgaagatgacaaagatgaagaggtcgaaaaggtccaggaatcaccagcccccagggaggttcaaaaaaccgaagagaaagaggtcccccaggatagcttagaagagtgcgctgtcacctgcagcaacagccataaccccagcaactcaaatcagccgcatcgctctacaaaaattacctttaaagagcatgaggttgacagcgctctggttgtcgagagcgagcatcctcacgatgaagaggaagaggccttgaatattcctccagagaaccagaacgatcatgaggaggaagagggaaaagctcctgtacccccccggcaccatgacaagtccaactcatatcggcaccgggaggtcagcttcctcgcactagacgaacagaaggtctgctcagctcaagatgtagcccgggattattcaaaccctaagtgggacgagactagtcttggattcctcgaaaagcaatccgatcttgaagaggtaaagggccaggagaccgtggccccacgtctatctaggggtcccctgagagtagataagcacgagatccctcaagaatctctcgatggttgctgtctgacgccgtccatcctcccggacctaacaccaagctaccatccttactggtctacattatatagcttcgaagataaacaggtgagtctggccctggtggataagatcaaaaaagaccaagaagagattgaggaccaaagcccgccttgtccccggctgtcacaggagcttcctgaggtgaaagagcaggaggtgcctgaggacagtgttaacgaggtgtatctgacacccagtgtgcatcatgatgtcagtgactgtcatcaaccctactcatctactctaagctctttggaggaccaattagcgtgtagtgcactagacgttgcctcccccaccgaggctgcgtgccctcaaggcacttggtccggagaccttagccaccatcgatcagaggtgcaaatttctcaggctcagctagaaccaagcacactggtaccaagttgcctccgtttacagttggatcaggggttccactgcggtaacggactcgcccaacgagggctgagctccacaacttgttccttttctgcaaatgctgacagtggaaaccagtggccctttcaagaactcgtactggaaccgagcctcgggatgaaaaacccaccacaactggaagacgacgcactagaggggtcagctagtaatacacaagggagacaggtgacgggaagaatccgcgcttccctggtactcattctgaagaccattcggcgcagactgccttttagcaagtggcggctggcatttcgcttcgcgggcccccacgcggagtccgcagaaatacccaatactgccgagcgcatgcagagaatgataggttag

SEQ ID NO: 126203 - DNA, 624 bp, Artificial Sequence
  Description of Artificial Sequence: Synthetic coding sequence
atgctcgccagctacaagagttattccagtaccttccatagcctggaggagcagcaggtgtgtatggctgtggatatcggcaggcatcgctgggaccaggtgaagaaagaagaccaggaggccaccgggccgcggctctctagagagctcctggacgaaaagggccctgaagttttacaggactccctgtaccgctgttattccaccccaagtggctgtctcgagcttacagactcttgccagccgtaccgatctgcattttatgtgttagagcagcagcgtgttggacttgcggtggatatggatgaaattgagaaataccaggaggtggaagaagatcaggggcgctgggaagaagaccagaaccctccctgcccccggttgaatggtgtgcttatggaagtcgaagagccagaggtcctacaggacagtctcgatgggtgctattccactccctcaatgtactttgagttaccagactcttttcagcactatagaagcgtcttttattccttcgaagagcagcacatttcctttgcactgtacgtcgataacagattcttcactctgaccgtgaccagtttgcacctggtgtttcagatggaggtgatcttcccacagtag

SEQ ID NO: 126204 - DNA, 1830 bp, Artificial Sequence
  Description of Artificial Sequence: Synthetic coding sequence
cctgtgcccggaccgaccagttctgctaccaacgtatctatggtggtgtcagcggggccactgtcctcagaaaaggccgagatgaacattcttgagattaacgagaagctgaggccacagctggccgagaagaagcagcagtttcgcaatctcaaagagaagtgctttctgactcaacttagcgggttcctggcaaatcaacagaataaatataagtacgaggagtgtaaggacctgatcaaattcatgctgaggaatgaacgccaattcaaggaagaaaagttggctgaacagctaaagcaggcagaagagctccgacagtataaggttctcgtgcacgcccaggaacgggagctgacacaactcagggagaagctgagagagggaagagatgccagtcggagtctaaacgaacacttgcaagccctcttgaccccagacgaacccgacaaatctcaaggtcaggatctgcaggagcagcttgctgagggatgccgcctagctcagcacttggtccagaagctttcgccagagaatgacaatgatgacaatgaggatgtacaggtggaggtagcagagaaggtgcagaagagttctgcccctagagagatgcagaaagcagaggagaaggaggtgcctgaagacagccttgaagaatgcgcaataacctatagtaattctcacggcccctacgactccaatcagccccacaggaaaaccaagataacttttgaagaagacaaagtggacagcactctgatcggttcgagttcccacgttgaacgcgaggacgctgtgcacatcattccagagaacgaatctgatgatgaggaagaggaggagaagggccctgtgagccctagaaatttacaggagtcagaagaggaagaagtcccacaggaatcctgggacgagggctattcaacaccttccattcctccggagatgctggcttcgtacaagtcttacagttctacattccatagtctggaggagcagcaggtttgcatggccgtcgacatagggcggcaccgctgggatcaggtaaagaaagaggaccaggaggcaactggtccaagactcagcagggagctgctcgatgagaagggacccgaggtgctacaagactccttatacaggtgctacagcaccccatcaggatatctggaattgcccgaccttgggcaaccctactcatctgcagtgtactctcttgaagagcagtacctcggcctagcactagaccttgatcgcatcaagaaggaccaagaagaagaagaagatcagggacctccttgtccccgcctctccagggaattgcttgaggtcgtggaaccagaagtcctgcaggacagtctggaccgatgctattcaacaccctctagctgcctggagcagcctgactcctgccagccttacggcagcagcttctatgctctcgaggagaagcacgtgggattttcccttgacgtgggcgagatagagaagaaggggaaagggaagaagcgcaggggccggcgcagcaagaaggagcgccgaagaggacgcaaagaaggagaggaggaccagaacccgccctgtccgcgcttgaatggggtgttgatggaagttgaggagcccgaggtgttacaggattctctggacggttgttatagtactccttccatgtattttgagctccccgattcctttcaacactaccgctccgtgttctatagcttcgaagagcagcatatctcctttgctctgtatgtagataatagattcttcacactcacggtgaccagtctacaccttgtgtttcagatggaggtaatttttcctcaatag

SEQ ID NO: 126205 - DNA, 2052 bp, Artificial Sequence
  Description of Artificial Sequence: Synthetic coding sequence
tgacccgggccgacttcttccgctacgaacgtgtccatggtggtaagcgctgggcctctgtcatctgagaaggctgaaatgaatatcctcgaaattaatgaaaagctgcggccacagctcgccgagaaaaagcagcagttcaggaacctcaaagagaaatgctttctgacccaactaagcgggtttctggcaaatcagcagaataaatataagtatgaagagtgcaaggatttgatcaagtttatgcttagaaacgaaaggcagtttaaggaagagaaactggccgaacagctgaaacaggcagaggaacttagacagtacaaagtgctggtgcatgcacaggagcgcgagttgacccagctaagggaaaaattgcgggagggacgggatgcttcccgtagcttgaacgagcacctgcaggcactcctaacacctgatgagcctgacaagtcacagggccaggatctgcaggagcagctggctgaaggatgccgactcgcccaacatctggtgcagaagctgtcacctgagaacgacaacgacgacaatgaggacgttcaggtggaagtggccgagaaagtgcagaagtcttccgctcccagggagatgcagaaggctgaggagaaggaagtgcccgaggattccctcgaagagtgtgccatcacctatagtaacagccacggtccgtatgactctaaccagccccacagaaagacaaagatcaccttcgaggaagataaggtggatagtacactcattggctccagtagtcacgtcgagcgggaggacgctgtacacataatcccggaaaatgaaagcgacgacgaggaggaagaagagaaaggacctgtctccccccggaacctacaggagtccgaggaagaggaagttccacaggagtcctgggacgaggggtactctacgccgtctattccgccagagatgctggcttcctacaaatcctactcaagcacttttcactccctggaagagcagcaggtctgtatggccgttgacattggtagacaccgctgggatcaggttaagaaggaggatcaggaggcaacaggtccccgcctgagtcgcgagctgctggacgagaaaggccctgaagtcctccaagactcattatatagatgttatagcacaccctccggctgtttggaactaactgacagttgccagccctaccgctctgctttctacgttctcgaacagcagagagtcggcctggccgtcgacatggatgaaattgagaagtatcaagaggtggaggaggatcaggaccctagctgtccaagacttagtagagaactcctcgacgagaaggagcctgaggttcttcaagacagcctcggtagatggtatagcactccttcaggttaccttgagttgcctgacctgggccagccatattcctcagcagtctactctctggaagagcagtacctgggccttgcccttgacctggataggattaaaaaagaccaggaggaagaagaggaccagggcccgccatgccctcggctgtcccgcgagctgttggaagtcgtggaacccgaggtcctgcaggatagcctggataggtgttactcaacaccgtcaagctgcctggagcagccggactcttgccagccgtacggctctagtttctatgccctcgaggaaaagcacgttggtttttctcttgatgttggggagatcgaaaagaaggggaaagggaagaaacgcagagggaggcgaagcaagaaagaacgcaggcgagggaggaaggaaggcgaggaggatcagaatccaccttgtccaagattgaatggcgtgctgatggaggttgaggagccagaagttctgcaggattccctagacggatgctactctaccccaagcatgtatttcgaactacctgactcattccagcactaccgaagcgtgttttactcgtttgaagaacaacacatcagttttgcactgtatgtggacaatcggtttttcactctgacagtgaccagcctacacctggtcttccagatggaagtaatcttccctcagtag

SEQ ID NO: 126206 - DNA, 1824 bp, Artificial Sequence
  Description of Artificial Sequence: Synthetic coding sequence
ccggttccgggtcctacctccagcgccaccaatgtgagcatggtggtctcagccggacccctgagctcagaaaaggcagaaatgaacatcttagaaataaatgagaagttgaggcctcagctagcagaaaagaagcagcaattcagaaatttgaaggagaaatgttttttgactcaactttccgggtttttagccaaccagcagaacaagtacaagtacgaggaatgtaaggatctgattaaattcatgttgcgtaacgagaggcaattcaaagaagaaaaactcgcggagcaactcaaacaggcggaggagttaagacagtacaaggtcctcgtgcatgcacaggaacgtgagctcacccagctgcgtgaaaagttaagggagggcagggatgcctcacggtcccttaacgagcatttgcaggccttgcttacccctgatgaaccggacaagtctcagggccaggatctgcaggaacagctggcagagggctgccgcctggcacagcaccttgtgcagaagctctcacccgagaacgacaatgacgacaacgaagatgtccaggttgaggtagccgagaaagttcagaaaagttctgctcctagagagatgcagaaagctgaggagaaagaggtcccagaggactccctggaggagtgtgcaatcacatatagtaatagccatggaccatacgactcaaatcagcctcatcggaaaacaaaaattacatttgaggaggataaggtcgactccacactgattggctcttcgagtcatgtcgagagagaggacgctgtgcacattataccggaaaacgagagcgacgatgaggaggaggaggagaagggccctgttagccctaggaacctgcaagagagcgaagaggaagaggtcccacaggaatcatgggacgaaggctattcgacccctagcataccacctgaaatgctcgcctcttacaagtcttacagttctacatttcactctttagaggaacagcaggtatgcatggctgtcgacatcggacggcatagatgggaccaagtgaagaaggaggaccaggaagccaccggacctagactgagccgggagctgctggacgaaaaaggtccagaggtgctgcaggactctctgtacagatgctattccacaccctccggatgcttggagctgaccgattcctgtcagccctaccggtctgccttttacgtgctggagcaacagcgcgtgggcctcgccgtggacatggacgaaattgagaaatatcaggaggttgaggaggaccaggacccatcctgtccacgcctcagtagagagctgttggacgagaaagagccagaggtcctgcaagacagtctcggccgctggtattcaaccccatccggataccttgagctacccgatttgggtcagccatacagctctgccgtctatagcttggaggaacagtacctcggcttggcgctggacttggatcgcatcaagaaggatcaagaggaggaggaggatcagggccctccctgtcctagactctccagggagctgctggaagttgtcgaaccggaggttcttcaagattctcttgacgttatccaattgctaccggtggtactgaacagtctcacaccagcatctccaatggaagtgcccttcatgcattggcgcaaaaatatgttggcttttctgttaacctgggaaaaactgaagcgcagaggacggggccgcaaagagggcgaggaggaccagcgtcggaaggaagagggggaggaaaagaagggtaagaagattaagacccaccatgcacctgggagtaccgcctgttag

SEQ ID NO: 126207 - DNA, 396 bp, Artificial Sequence
  Description of Artificial Sequence: Synthetic coding sequence
atggcagatgttgtagtagggaaagataagggaggcgagcagaggctcatctcactgcccctgtctagaatacgcgtaatcatgaaaagttccccagaggttagttctatcaatcaagaggccctcgttctcaccgctaaagctactgaactattcgtgcagtgtctggctacttactcttatcgacatggatctggcaaagaaaaaaaagtgttgacttatagcgatctggcgaacaccgcacagcagtccgagacgttccaattcctggcggacatcctgcctaagaaaattctggcctcaaagtaccttaagatgctgaaggaggaaaaacgggaagaggacgaggagaatgataatgacaacgaatcggaccacgacgaagccgactcctag

SEQ ID NO: 126208 - DNA, 582 bp, Artificial Sequence
  Description of Artificial Sequence: Synthetic coding sequence
atgggaaaacagaacagcaagttgcgaccagaagttatgcaagacctgctggagtccaccgacttcacggagcatgaaatacaggaatggtacaagggctttctgagagactgcccatccggccatctgtcaatggaagaatttaagaaaatctacggaaatttcttcccatacggagacgcttctaagtttgccgagcatgtgtttaggacctttgacgccaatggagatgggaccattgactttagagagtttattatagcgctgtctgtcacatcaagaggcaaactggagcagaaactcaaatgggccttcagcatgtatgatctggacggtaatggttacataagcaaagccgagatgctggagatagtccaggccatctataaaatggtatccagtgtgatgaaaatgcctgaggatgaatcaactcccgaaaagcgcacagagaagatctttcgtcaaatggacacaaatcgggacggtaaactttctctggaggaattcattagaggagctaaaagcgaccctagcatcgtccgactgcttcagtgtgatcccagctccgctggtcagttctag

SEQ ID NO: 126209 - DNA, 582 bp, Artificial Sequence
  Description of Artificial Sequence: Synthetic coding sequence
atgggcaagcagaactccaagctccgcccagaagtcatgcaggaccttcttgagtcaaccgattttaccgagcatgagattcaggaatggtacaagggtttccttcgcgattgtcctagcgggcacctctcgatggaagagtttaagaagatttacggcaacttcttcccctatggcgacgcaagcaaattcgctgagcacgtgttccgcacttttgacgccaacggtgacggaaccatcgacttccgcgagttcatcatcgccctctccgtgacgagtagggggaagctcgagcagaaactcaaatgggctttttcaatgtacgacctcgatggcaatggctatatctcgaaggctgagatgttggaaatcgttcaggctatatataagatggtgagcagcgtgatgaagatgccggaggacgagagtacacctgagaagaggacagaaaagatttttcgacaaatggataccaatcgcgatggcaaactgagtctcgaggagttcattaggggagccaagtcggatcccagcatcgtacgcttgctacagtgtgacccttcctccgcaggacagttctag

SEQ ID NO: 126210 - DNA, 582 bp, Artificial Sequence
  Description of Artificial Sequence: Synthetic coding sequence
atgggaaagcaaaattccaagttgcggcctgaagtgatgcaagatctcctcgagagcacggatttcacagaacacgaaattcaggagtggtataagggctttcttcgagattgccctagcggccatcttagtatggaggagtttaaaaagatctacgggaactttttcccctatggagacgcgagcaagtttgcagagcatgtctttcgcacattcgatgccaatggagacggcacaatcgacttccgcgagttcatcatcgcactgtctgtcactagcagaggtaagctggaacaaaaactgaagtgggcttttagcatgtacgatctagacggaaatggatacatctcaaaagccgaaatgctggagatcgtgcaggccatctacaagatggtgtcaagcgtgatgaagatgcctgaagatgaatccaccccggaaaagaggactgagaaaatcttccggcagatggatactaatagggacggaaagctgtccctggaagagtttattagaggggccaagagcgatcccagtatagttcgactcctccaatgcgacccgtcgtcagccgggcagttctag

SEQ ID NO: 126211 - DNA, 582 bp, Artificial Sequence
  Description of Artificial Sequence: Synthetic coding sequence
atgggtaaacaaaatagtaagttgaggccagaggtgatgcaagacctgttggaatccacagattttaccgaacacgagatacaggaatggtataagggctttctgcgggattgtccctctgggcacctgagcatggaagaatttaagaaaatttacggaaatttcttcccatacggagacgcctccaaattcgccgagcacgtcttccgtacctttgatgctaacggcgacggcaccattgatttccgggaatttattatcgcactttctgtcacgtcccgaggaaagttagaacagaaactgaagtgggcttttagcatgtacgacctggacggaaatggatacatctcgaaggctgagatgctggaaatcgtgcaggctatatacaagatggtgagctctgtcatgaagatgccggaggatgaatctacacccgagaagcggacagagaaaattttcaggcagatggatactaatcgtgatgggaagctgagtttagaagagttcatccgcggcgccaagagtgacccttcaatagtgcgccttctgcagtgtgacccatccagcgctggacagttttag

SEQ ID NO: 126212 - DNA, 3966 bp, Artificial Sequence
  Description of Artificial Sequence: Synthetic coding sequence
atgggcgccccattcgtgtgggcactgggcctgctgatgctgcagatgctactgtttgtagctggtgaacagggaactcaagatattaccgatgcgtctgagcgcgggctgcatatgcagaagttgggctcaggttccgtccaggccgccctggcagagctcgtggccctgccatgtcttttcaccctacagccccggccttcagccgctcgggacgcgcccagaatcaagtggaccaaggtgcgaactgcaagtgggcagcggcaggacctgcctattctggttgcaaaggacaatgttgttagggtggctaagtcgtggcaggggcgcgtttcacttccaagttacccccgccggagggctaacgcgactctgctgctggggccactgagagcatctgattcgggcctgtatcggtgccaggtggtcagggggattgaagatgagcaggatctggttcctctggaggttaccggtgttgtattccattaccggagtgcaagagaccggtacgccttgacttttgcagaggctcaagaagcttgccgactgtccagtgccatcatcgctgccccacgacatctgcaggccgcctttgaagatgggtttgacaattgtgatgccggctggctgtctgaccggaccgtacgctaccccattacgcagagccgtcccggatgctacggcgatagaagcagccttcctggtgtgcggtcatacggccgccgcaatccgcaggaactgtatgacgtctattgctttgctcgggagctgggtggggaggtattctatgtgggcccagcaaggagattgaccctggccggggctagggctcagtgccggcgccagggggcagctctcgcttccgttgggcagctgcatttggcctggcacgagggcctagatcagtgcgaccccggctggctcgccgacgggtccgtcaggtacccaattcagacaccgaggagacggtgtggtggtcccgcccccggcgtgcgcacagtgtataggttcgccaaccgcacaggtttccctagcccagccgagaggttcgatgcatactgcttccgggcccaccatcccacaagtcagcatggagacctggagacccctagctcaggagatgagggggagattctgagcgctgagggaccacccgttagggagttagaaccaaccttagaggaggaggaggttgtgactcctgatttccaggagcctctcgtgagctccggcgaagaggagacccttatcctcgaagaaaaacaggagagccaacagaccttgtcccccaccccgggggaccctatgctcgcttcttggcccactggcgaggtgtggttgagcacagtcgccccctccccttctgacatgggcgccggcactgctgccagctcacatacagaagtggccccaacagaccccatgccaagacgtcgcggcagatttaaaggtttgaacgggagatatttccagcagcaagaacccgagcctgggttgcaaggcggcatggaggcgagtgcacaacctcccacaagcgaagcagctgtcaaccagatggagccccctcttgctatggccgtgactgaaatgttggggtctgggcagtctaggagcccttgggccgacttgacaaatgaggtggatatgccgggtgccggcagcgccggaggaaaatcctcacccgagccttggctttggccacccacaatggttccaccctccataagtggacactcacgcgcaccggtgctagaattggagaaagccgagggcccgagcgctcgtcccgcaacccccgacctcttctggagtcctttagaggccacagtgtctgctccgtcacccgcaccctgggaagccttccccgttgcaacttctccagatctgccaatgatggccatgctgagggggccaaaagagtggatgctgccacatcccaccccaatcagcactgaggccaatcgagtggaggctcatggtgaggcaactgccaccgcaccaccgtcccctgctgcggaaactaaagtttacagcttgccccttagccttacccccactggtcagggaggggaggcaatgcccactactcccgagtcaccccgcgctgactttagagagacaggggagacatcccctgctcaggtgaacaaggctgagcattcatcatcatccccctggccctcggtgaaccgtaacgttgccgtggggttcgttcctacggagaccgccaccgagcctaccggattgagaggcatcccagggtctgagtccggagtcttcgacaccgccgagtcgcctacgtctggtctccaggccacagtggatgaagtgcaagacccctggccctccgtttactccaagggtctggatgcttcaagtcctagtgcgcccctcgggtcgcctggcgtattcttggtacccaaagttacacctaatctggagccttgggttgcaaccgacgagggtcctacagtgaacccgatggattcaaccgtgactccagcaccatctgacgcaagtgggatttgggagcctggatctcaggtgtttgaggaggctgagtccacaaccctctcacctcaagtggcactcgacacttccatagtgactcccctaactactctggaacagggtgataaggtcggcgttccagccatgagcaccctgggctccagcagctcccagcctcatcccgagcctgaagatcaggtagagacccaggggacctcaggagccagcgttcctccccatcagagtagtcctctgggtaagcccgcggtaccgccgggcacaccaactgctgcctctgtgggcgagagtgcttctgtgtcctccggagagcccaccgtcccgtgggatccatcatcgactctacttccagtcacactggggattgaagattttgagcttgaagtgctagccggcagccccggagtggagtccttttgggaagaggtggcatcaggcgaggagcctgcactgcccggaacgccaatgaatgctggcgccgaagaggtgcactccgatccgtgcgagaataatccttgtctgcatggtggaacctgtaacgccaatggtacaatgtatggatgctcatgcgaccagggatttgccggtgagaactgcgaaatagacatagatgattgcctgtgttcaccttgtgaaaacggtggaacctgcattgatgaggttaacggattcgtctgcctgtgtctaccgagctatggaggcagcttctgcgaaaaagacactgaagggtgcgatagagggtggcacaagttccagggtcattgttataggtatttcgcccataggagggcgtgggaagatgcagaaaaggattgtcggcggagaagcgggcatctaaccagcgttcactcaccagaggagcactcattcattaattctttcgggcatgagaatacgtggattggcttgaacgataggatcgtcgagcgcgatttccaatggacagataatacaggacttcaatttgagaactggagggagaatcagcccgacaactttttcgcgggtggcgaagattgtgtggtgatggtggcccacgaatctggccgctggaatgatgtcccctgcaactacaacctcccctacgtctgcaaaaaaggaacggttctgtgcggtccaccacccgccgtcgagaatgcttcccttatcggcgcacggaaagccaaatataatgttcatgctacagtgcggtatcaatgtaatgaaggtttcgctcagcaccatgtagccactatccgttgccggtctaatggaaaatgggaccgccctcagatcgtgtgtaccaaaccccgccggtctcaccggatgagaagacaccatcaccaccatcaacatcaccatcagcaccaccatcataaaagtcggaaggaaagacgcaagcataagaaacaccccacagaagactgggagaaagacgaaggtaacttttgctag

SEQ ID NO: 126213 - DNA, 2319 bp, Artificial Sequence
  Description of Artificial Sequence: Synthetic coding sequence
atgccaggtgctggatccgcaggcggcaagtcgagccctgagccatggctatggcctcctacaatggtcccaccctctataagtggccattcgagggcacccgtgcttgaactggagaaggccgaaggaccctccgcgagacctgccacgcccgacctgttctggagcccacttgaggccacagtgagcgcaccatccccagcaccttgggaggcctttcccgtcgccactagccctgatcttcccatgatggccatgctgaggggccctaaagaatggatgttgcctcacccaactccgatctccacagaggccaatagggtagaagcccatggcgaagcgacagcgactgcccccccaagccccgctgcagagactaaagtctactccctgccgctgtccttaactcctactggacagggaggagaggcaatgccaactactcccgaatctccgcgagcagacttcagggagacaggggaaacctcccccgcacaggtaaacaaggcggaacattcatctagcagcccctggccctccgtcaacaggaatgtggccgtggggtttgtgccaaccgagactgctacagaacctacagggctgagaggcatccctggatctgaaagcggggttttcgacactgctgagagccctacctcaggcctgcaggcaaccgtggacgaagttcaagatccttggccatcagtctattcgaaagggctcgatgcctcatcccccagtgctccactgggctcccccggggtgttcttagtgccaaaggtgactcctaatttggaaccttgggtcgccactgacgaaggccccaccgtcaacccaatggacagtactgttactccagcgcccagcgacgcaagcggtatttgggaacctggatctcaggtgttcgaggaagcggagtctacaacgttgtcccctcaagtggccctcgatactagcattgtgaccccgctcacaaccctggaacaaggagataaggtcggagtacctgctatgagcactctggggagtagctcctctcagccccatcccgagccagaagaccaggtggagacccagggcacgtccggcgctagcgtgccaccccatcagtcctcacccctgggaaagcctgccgtaccacccggaactcccacagcagcatccgtgggggagagcgcatccgtgtctagcggagagcccacagtcccctgggatcctagttccactctcctgcctgtgacgcttggaatagaggatttcgaacttgaggtgctggctgggtcaccaggagtggagtcgttttgggaggaggtcgccagcggagaggaacctgccctacccggtacaccaatgaacgccggcgccgaggaggtgcacagcgatccctgcgaaaacaatccgtgtctgcacgggggcacttgcaatgcgaatgggactatgtacggttgctcctgcgaccaaggctttgctggggagaattgcgagatcgatatcgatgattgcctgtgtagtccgtgcgaaaacggagggacgtgcatagacgaagtaaacggcttcgtctgtctgtgcctcccctcctacggcgggtctttttgcgagaaggataccgaaggctgtgaccggggctggcataagtttcagggtcactgctatcgttactttgcccatcgcagagcatgggaggacgccgagaaagattgcaggcggaggtcaggtcacctgaccagcgtgcattcccctgaagaacattcctttatcaattccttcggtcatgagaacacatggatcggactgaatgaccggatcgtcgaaagggatttccaatggaccgataacacagggctgcagtttgagaactggagagaaaaccagcctgataatttctttgctggtggcgaagactgcgtggtcatggtggcccacgagtctggccggtggaatgatgttccttgtaattataaccttccctatgtttgcaagaagggcacagtcctgtgtggacccccccccgcagtcgaaaacgcaagtctgattggtgcacggaaggccaagtacaacgtacatgccaccgtccgctaccagtgtaatgaaggtttcgcacagcatcatgtcgcgaccattcggtgtcgttccaacggaaagtgggatcggcctcagattgtttgcactaagccaaggaggtcccatcgtatgaggcggcatcatcatcatcaccagcaccaccaccagcaccaccatcataagagtcgtaaggaacggcgcaagcacaagaagcatccgacagaagattgggagaaagatgagggcaacttctgctag

SEQ ID NO: 126214 - DNA, 4008 bp, Artificial Sequence
  Description of Artificial Sequence: Synthetic coding sequence
cgtccaccaagagacgcttccgagctgggtgctaggtccaggatgggggccccttttgtttgggcactgggcctgctgatgcttcagatgctcctgtttgtggctggggaacagggcacccaggatatcacagacgcctctgaacgggggctccatatgcagaaacttggctcggggagtgtgcaggctgccctcgcggaattggttgcccttccctgcctgttcactctgcaaccgcggccctcggcggcacgcgacgcccctcgtataaaatggacaaaggtgcgaaccgcgagtggacaaaggcaggatttacccatccttgtcgccaaagataatgtggtcagggttgctaaatcatggcagggcagggtgtccctgccatcctatcctagacgtcgggctaatgcaaccctgttacttggcccattgagagccagcgatagcgggctctataggtgtcaggtggttaggggaattgaggacgagcaggatctggtccctctggaggtaacaggtgttgtctttcactacaggtctgcacgtgatcgttacgccctgacctttgcggaagctcaggaggcctgcaggcttagcagcgctatcatcgctgctcctagacaccttcaggccgcgttcgaggatgggttcgacaactgtgacgctgggtggctctctgatcggacagttagataccctattacccagagccgcccaggatgttacggagacaggagttcgctgcccggcgtgaggtcatacggcagaaggaatccacaagaactgtacgacgtctactgtttcgccagggagctgggtggcgaagtcttctatgtgggcccagccagaaggttgaccctcgcgggggctcgcgctcagtgtaggaggcaaggcgcagccctggcatctgtaggccaactgcacctggcttggcatgagggactcgaccagtgcgatcctggttggctggccgacggatcagtaagataccccatccagacaccccgtagacggtgcggaggccctgcaccgggcgtgagaaccgtctataggttcgcaaacaggacagggtttccctctcctgcagaacggtttgatgcctattgcttcagggcccaccaccccacctcacagcatggggacctggagactccaagctccggagatgagggggagattctgtccgcagagggcccgcctgtgcgtgaactggagcccaccctggaagaagaggaggtggtgactcctgactttcaggagccgctagtcagctctggcgaggaggaaacactgatcttggaggagaaacaggaaagccagcaaactcttagcccgacgccaggagatcccatgcttgcttcctggccgaccggagaggtgtggctgtcaaccgtggcccccagtccctcggatatgggggccggaaccgctgccagctcacacaccgaggtcgcccctaccgatcctatgccaaggcggaggggccgcttcaagggtctgaacggtaggtactttcagcagcaagaaccagagccggggctgcaaggcggtatggaggctagtgcgcaacctccaacttcagaggcagctgtgaaccagatggaaccccctttggccatggccgtaaccgaaatgctcggttcagggcagagccgcagtccgtgggctgacctgaccaatgaagtggacatgccaggtgcaggaagcgccggagggaagtcaagtccggagccctggctgtggccccctactatggtcccgccatctatctctggccattctcgggctccagtgctagaattagaaaaggccgaaggcccttccgcccgaccagccacgccagacttgttttggagccccttggaagctaccgtgtccgcaccctctcctgcaccatgggaggcattcccagttgccacttccccagatctgccaatgatggcaatgctgcgagggccaaaggaatggatgctgccacatcccactcccatcagcactgaggccaaccgggtcgaggctcatggcgaagccacagcaaccgcacccccctccccggccgctgaaacaaaggtgtattccctgccactgtccctcaccccgacaggtcaggggggggaagcgatgcccacaactcccgagtcgccaagggcggacttcagggaaacgggagaaacaagccccgcacaggtcaacaaagcagaacacagttcttcctccccatggccatctgtcaatcgcaatgtggccgtggggttcgtccctacagagactgcaactgaaccaacagggctacgcggaatcccaggctccgaatcaggcgtgtttgataccgcggagagcccaaccagcggtctgcaagcgacggtggatgaggtccaggatccatggccttcagtctactcaaaagggctagacgcttcctctccaagcgctccgctcgggtcacctggtgtttttctagttccaaaagtcactccaaacctcgagccatgggtcgccactgacgagggtcccaccgtcaatcctatggattcaacagtgacccccgcaccctctgacgcctccggtatttgggagccaggcagccaagtcttcgaggaggctgagagtaccacgctgtctccccaggttgcccttgacaccagcatcgttacacctctcactacactggagcagggcgataaagtgggtgttccagccatgagcacactagggagctcttcctcacaaccccatccggagcccgaggatcaggtggaaacacaaggtacttcaggcgcatccgtaccccctcaccagtcttcccccttgggtaagcctgcagttccacctggtacccctactgcggccagcgtgggggagagcgcgtcagtgtcctctggggagccgacagtcccctgggacccaagctctaccctgctgccagtgactctggggatcgaggatttcgagcttgaagttctagctggaagccccggagtggagtccttctgggaggaagttgcgtccggtgaggagcctgccctacctgggactcctatgaacgccggtgccgaggaggtgcattcggatccctgtgagaataatccctgcttgcacggaggcacatgtaatgccaatggcaccatgtatggatgctcctgcgaccaaggcttcgctggtgaaaattgtgagattgacatcgacgattgcctgtgttctccttgtgaaaatggcgggacttgtatcgacgaggtgaatggattcgtttgcctgtgtctcccatcgtacggaggtagcttctgtgagaaggatactgaaggttgcgatcggggctggcataagtttcagggccattgctatagatactttgcccaccgcagagcatgggaggacgcagagaaagactgcagacgcaggtcaggccacctaacgtctgtgcactcccctgaggagcacagttttataaattctttcggccacgagaatacctggattgggttgaatgaccgcatcgtggaacgagactttcagtggaccgataacaccggcctacaatttgagaattggcgggagaaccagcccgacaacttctttgccggcggggaagattgtgtagtcatggtagcccatgagtccggcagatggaacgacgtgccatgcaattacaacttgccatatgtttgtaaaaagggcacagtgctatgcggtcctccaccagcagttgagaatgccagcctgatcggcgcacgtaaggctaagtacaatgtgcatgctacagtgcgctaccagtgtaatgaagggtttgcacagcaccacgttgccacgatccgttgtcgatccaacggtaaatgggatagaccacaaatcgtgtgcaccaagcctcgccgatctcatcgcatgcggcggcaccatcaccaccatcagcaccaccaccagcaccatcatcacaagagccggaaagagcgtagaaagcacaagaagcaccccacagaggattgggagaaggatgaagggaatttttgctag

SEQ ID NO: 126215 - DNA, 2190 bp, Artificial Sequence
  Description of Artificial Sequence: Synthetic coding sequence
atgagttgctgtgacttagcagccgctggacagctcggtaaagcaagtattatggcctctgattgtgaaccagctctcaaccaagccgagggaagaaatcctactcttgagcgctaccttggggcccttagggaggcaaaaaacgatagcgagcagtttgccgcattgctgttggtgacaaaggccgtcaaggccggagacatagacgccaaaactcgtagaaggatctttgacgcagtcggcttcacctttccaaatcgcctgctcacgaccaaggaggctcctgatggctgccctgaccatgtgctgagggccctaggggtggcgttgttggcatgcttctgcagtgaccctgaacttgccgctcacccccaagtgttaaacaagattcccattctgagtaccttcctaacagcacgaggagatccagatgatgccgctaggagatctatgatcgacgatacctaccagtgtctcactgctgttgcagggacaccgagaggcccaagacaccttatcgcgggtgggactgtgtcagccctgtgccaggcttatcttggccacgggtatgggtttgatcaggcccttgccctgcttgtcggtctgttggccgccgccgagacccaatgttggaaggaagcagagcctgatctgctggctgttttaagagggctctctgaagactttcaaaaagctgaagacgcctccaagtttgagctctgccaattgcttcctcttttcttgccacctacaactgtaccacccgaatgctaccgcgacctgcaagcagggcttgcccggatactggggtccaagctttcatcctggcagcggaacccagctctgaaactcgctgcgcggttggctcacgcatgcggttctgactggatacctgccggttcatcaggttctaaattcctcgccttgctggtaaacctggcctgtgtggaagtccgcctagccttggaggagacagggactgaggtgaaagaagatgttgtgacagcatgttacgcactaatggagctcggaattcaggagtgtactcgctgtgaacagagccttctgaaggaaccacaaaaagtacagctggtatccgtgatgaaagaagccattggagctgtgatccattacctcctccaagtgggatctgagaagcagaaggaaccattcgtcttcgcaagcgtgcggatactgggtgcgtggctggctgaagagacaagctcactgcgcaaggaggtttgtcaactcctgccgttcttagtccgctatgccaaaacattgtatgaggaagccgaagaagcaaatgacctgagccagcaggtcgccaacctcgccatttccccgactaccccaggacccacctggccgggggatgccctgaggctgttactgccaggatggtgccacctaactgtggaggatggccctagggaaatcttgatcaaagagggcgctccttcgctcctatgtaaatactttctccagcaatgggagctgacatcaccagggcacgacacatccgtgctgcctgacagtgttgagatcggattgcagacatgttgtcacatcttcctgaacctggttgttacagcccctgggctgataaaaagagatgcgtgcttcacatctctgatgaacactttgatgacttctctgcccgcgttggtccagcaacaggggcgcctcctgctggctgccaacgtggctacactgggactgctgatggcgcgtctgctgagcaccagtcctgcactccaaggtacacctgctagtagaggttttttcgctgccgccattctgtttctgtctcagtctcacgttgccagggcgacccctggcagcgatcaagccgtcctagccctctcacctgagtacgagggaatttgggcagacctgcaggagttatggttcttgggcatgcaggcattcaccgggtgtgtgcctttacttccgtggctggctccagccgccctgcgctccagatggccacaggagctgctacagcttctgggatcggtgagccctaactctgtgaaacctgagatggttgccgcctatcaaggggtcctggtggagcttgcaagggctaatcgcctgtgccgcgaggctatgcggctccaagccggcgaggaaacagcgtcgcactatcgcatggcagccctagagcagtgtctgtcagaaccgtag

SEQ ID NO: 126216 - DNA, 2190 bp, Artificial Sequence
  Description of Artificial Sequence: Synthetic coding sequence
atgtcctgctgtgacttggctgcagccggccaactggggaaagcaagcatcatggcgtccgattgtgagccggccttgaaccaagccgaagggcgcaatcccaccctagaacgttatctgggcgctctgcgcgaagcgaagaacgattctgagcaattcgccgcacttctcttggtaaccaaggccgtgaaagccggagatatcgatgcaaaaactcgaagaaggatctttgatgcggtgggattcacattcccaaacagactgcttacaaccaaggaggcacccgatgggtgccccgatcacgtcctgagagcgctgggagttgctctacttgcttgcttctgtagcgatcccgaactcgctgcacatccccaagtccttaacaaaatccccatcctcagcaccttcctgactgccaggggcgatcccgacgacgccgccaggagaagcatgattgatgacacgtaccaatgcctcacagccgtcgcaggaaccccccgaggccctcgccatctcattgctggcggtaccgtgtcagctctctgccaggcataccttggccacggctatgggtttgatcaggctctggctctgcttgtgggccttctggctgccgccgaaacccagtgctggaaggaggcggagcctgatttgctcgccgtattgcggggcttatccgaggacttccagaaggctgaggatgcctccaagttcgaactgtgtcaactgctccccttgttcctcccaccaacaacagtccctccagagtgctatagggacttgcaggcaggtctggcccgtatcctcggctctaaattgagtagctggcaacgcaaccccgcattgaaacttgccgcccgcttagctcacgcctgcggctcagattggatcccggctggctcaagcggaagtaagttcttggctctgctcgttaaccttgcttgcgtggaagtgagactggcattggaggagaccggaaccgaggttaaagaagatgtcgtcaccgcgtgctatgcactgatggaattaggaatccaggagtgtacaagatgcgaacagtccctgctgaaggaaccacagaaagttcagctagtgagtgtgatgaaggaggcgatcggcgcggtaatacattacttgctgcaggttggtagcgagaaacagaaggagccattcgtttttgcttcagttcggattttaggcgcatggctggcagaggagacatcgtccctccgcaaagaggtgtgtcagctgctgcctttcctggttagatacgcaaagaccctgtatgaagaagccgaggaagcaaatgacctgagtcaacaggtagcgaacttggcaatcagcccaaccacccctgggccaacttggccaggcgatgccttgaggttgttactgccaggatggtgtcatctaaccgtagaggacgggcccagagagatcctgataaaggaaggggcacctagtctgctctgcaagtatttcctgcagcagtgggaattgacctcacctggccacgatacgtctgtcctgcctgacagtgttgagattggtcttcagacgtgctgccatattttcctcaatctggtcgtgaccgctcccgggcttattaagagggacgcatgcttcacctccttaatgaacaccttaatgacgtcactgccagctctggtccagcagcaaggcagactgttgctggccgctaacgtggccaccttaggactcctcatggctcgactgttgagcacgagcccagccttgcaggggacgcctgcatcgagagggttcttcgcagccgcaattttgttcctgtctcagtcccacgtggccagagcgacacctggaagcgaccaagccgtgctggcgctttctcccgagtatgaaggtatttgggctgacctgcaggaactgtggttccttgggatgcaggcatttaccggatgtgtgccactcctaccgtggctggcacccgctgcactgcgatcacgttggcctcaggaactcctgcagctgctcgggtcggtatcccccaactccgtgaaaccagagatggtagcggcctaccaaggagtcctggtcgaactggcccgagctaatcgactttgccgagaggcaatgcgcctgcaggccggcgaggaaactgccagccactacaggatggccgccctggagcagtgcctgtcagaaccctag

SEQ ID NO: 126217 - DNA, 2139 bp, Artificial Sequence
  Description of Artificial Sequence: Synthetic coding sequence
atggccagcgactgtgagcccgccctaaaccaagcagaggggagaaatcctacgttggaaaggtacctgggggcactccgcgaggctaagaacgactccgagcagttcgccgctctgctgctggtcacaaaggcagtgaaagccggggatatcgacgcaaagactcggaggcgtattttcgacgccgtgggcttcacttttcccaaccggctgctgaccacaaaggaagcaccggacggctgtcccgaccacgtcctgcgagccctgggagtcgccctgctggcctgtttctgctccgacccagagctggctgctcatccacaggtgctcaacaagattcctatcctgtcaacctttctgacagcacgcggtgatcccgacgacgccgccagacgaagtatgattgatgacacataccaatgcttgaccgccgtcgccggaactcctcgcgggcctcgccacctgattgcgggcggtacggtgtccgcactgtgccaggcttacttagggcatggttatggcttcgatcaagctttagcactgttggttggacttctggccgcggccgaaacacagtgctggaaagaggccgagccggacctgcttgcagtcctgcgtggcctgtccgaggattttcagaaggccgaagacgctagcaagttcgagctgtgccagctactgccgttgtttctgccacccacaacagtgccaccggagtgttaccgtgacctgcaggccggactggcacgtatcctggggtccaaactgagtagctggcagcgaaatccagcacttaaactggcagctcgactggcccacgcttgcgggtctgattggattcccgcaggcagctctggatcgaaatttctcgcactgttagtcaatctggcctgtgtggaggtccgactggccctcgaagaaacaggaaccgaagtcaaggaggacgttgtgacagcatgttacgcgctgatggaactcgggattcaggaatgcacccgatgcgaacagagtctgttaaaggagccgcagaaggtgcagctggtgtcggttatgaaagaggccataggtgccgtgatacattacctgctgcaggttggaagcgaaaagcagaaggagccattcgtgtttgcctctgtgaggatcctgggtgcctggttagccgaggagacttctagcctgcgcaaggaggtgtgccagctactgccctttctcgtaagatacgccaaaacattgtacgaagaagccgaagaggctaatgatcttagccagcaggtggccaacttagccattagcccgaccacacccggccctacatggcctggggatgccctgaggctgctgctacccgggtggtgtcatctcacagtggaagacggaccaagagagatcctgataaaggagggcgctccttccctcttgtgcaaatattttctccagcaatgggagctgacttccccgggtcatgatacatcggttttgccagattccgtggaaataggtttacagacctgttgtcacatttttctaaaccttgtggtcactgctccaggacttattaaaagggacgcatgcttcacctcactgatgaacactctgatgacatcactgcccgctctggtacaacagcaggggaggctcctcctcgccgctaacgtggcaaccttggggctgctgatggctaggttgctgtccacgtcgccagccctgcagggtacgccagcctctcgtggattctttgcagcggccatcctgtttttaagccagtcacacgtcgcccgcgcaacaccagggagtgaccaggcagttctagcactatccccagagtacgaaggaatttgggctgacctgcaagagttatggttcttgggaatgcaggcctttaccggatgtgtacctctcctgccatggctggcgccagcggccctacgctcccggtggccacaggaacttctgcaactgctgggatcagtgtctccaaatagtgtcaagccagaaatggttgccgcctaccagggcgtccttgtggaactggctcgggccaatcgattgtgtcgggaagctatgcgactgcaggcaggtgaagagacggcctcccactatcgcatggccgccttggagcagtgtctgagcgaaccttag

SEQ ID NO: 126218 - DNA, 531 bp, Artificial Sequence
  Description of Artificial Sequence: Synthetic coding sequence
atgccgcatagtttcagatacctcgccgcccttcagggcacaccagcctcacggggcttctttgccgctgctatcctctttcttagtcagtcccacgtagcacgagcgacgccaggatctgaccaggctgtgttggctctttccccagagtatgaaggaatttgggcagatctgcaggaactatggtttctaggcatgcaggcattcaccggatgtgtgcccctactgccttggctggcgcctgcagccctccgctctcgttggcctcaggaactacttcaattattgggatcacagccacagctctgccaggcacgcgacggcgggcgacttagtggttgtcccgggggtgcgggcgccggtcagcctgctgtacccggcggacacgaggctgctggcggaaggggcgatggacagccactgcctcacgggtgtcttggcgccgtgcctgtcagagcactccgcggggtccacagaggccagacgcaaggaagggccgaacgggagggcggtcgaagacatttgccctag

SEQ ID NO: 126219 - DNA, 582 bp, Artificial Sequence
  Description of Artificial Sequence: Synthetic coding sequence
tagagcagtttaaggaaggaggtctgtcagctactacccttcttggtgcgttacgcgaagacactgtacgaagaggcagaagaagctaatgacctgagccaacaggtcgcgaacttagcaatctccccaaccacaccaggccccacctggccgggggacgccctgcggctgctactaccagggtggtgccatctcacggtggaagatggacctcgcgaaattctcataaaggagggtgcccctagcctcctatgtaagtatttcctccagcagtgggagcttacctcccctgggcatgatacttcggtgttgcctgacagtgtggagatcggcctgcagacttgctgccacatcttcttgaacttagtggtcacagctcccggcctgataaagagggatgcttgctttacgtccctcatgaacaccttaatgaccagtttaccagctcttgttcaacagcaaggcagactcctgcttgctgccaatgtcgcgaccctgggcctgctgatggcacggctgctctcaacctccccgggttccatttcttctcagttgccaggagctgaacacatgccatgctag

SEQ ID NO: 126220 - DNA, 735 bp, Artificial Sequence
  Description of Artificial Sequence: Synthetic coding sequence
atggcatctgattgcgagcccgctctgaatcaggccgaggggaggaatccaaccctggagcggtatctgggcgctctgcgggaggcaaaaaatgactcagaacagtttgctgccctcttactggtgaccaaagcggtgaaggctggcgatatagatgcaaagacaagacggcgcatcttcgacgctgttgggttcaccttcccaaaccgcctgctaactactaaagaggcccccgacggttgccctgaccacgttctccgagctctgggagtcgcactccttgcttgcttctgcagcgatcccgagttggccgcacacccccaagtcttaaacaagatacccattctgtcgacatttctgaccgcacgcggggacccggacgacgccgcaagacggagcatgatcgacgacacttaccagtgtctgacagcagttgcgggaacaccccgcggacctcggcacctgatcgccggaggaacagtctccgccttatgccaggcatacctcggccatggctatggctttgatcaagccctcgcacttctggtgggcctcctggctgccgcagagacccagtgttggaaagaagccgagcccgacttgctggcagtgctgaggggcctcagtgaggattttcagaaggctgaggacgcatctaaattcgagctgtgccagctgctgcctctcttcttgccccccaccaccgtaccaccagaatgctaccgggatctctag

SEQ ID NO: 126221 - DNA, 1791 bp, Artificial Sequence
  Description of Artificial Sequence: Synthetic coding sequence
atggagccggagctggccgcccagaagcagccacggcctcggaggcggagccgacgcgcctccgggctgagcacagagggagccactgggccaagtgccgatacgtcaggttctgagctggatggaagatgttcgttgagacggggctccagcttcacattcctcacgccagggccaaattgggacttcactctgaagaggaagagacgggaaaaggatgatgatgtcgtctccctgagctctctggacctgaaggagccatctaataagcgagtgcgcccactggcgcgggttacttctctggcgaatctgatcagtccagttaggaacggtgccgtgcgacgtttcggacagacaattcagtcttttaccctgagaggagatcatcgatcacctgcctccgctcagaagttttcctctcgaagcacagtaccaactcctgccaagcgacggtctagcgccctctggtcagagatgttggatatcacaatgaaagaaagcctaacaacccgggagattcgccgccaggaagcaatttatgaaatgtctaggggggagcaggatctcatcgaggatctgaagctcgcccgcaaagcctaccacgaccccatgctcaaactcagcataatgtcagaagaggagctcacacacatctttggcgacctggacagttacatccctttgcacgaagacttactgactagaattggtgaagcaactaagccagatggtactgtcgagcagattggtcacatcctggtctcctggttgcctaggctcaatgcgtaccggggttactgttccaaccagctggctgcaaaggcgctccttgatcagaagaagcaagatccccgggttcaggacttcctgcagcggtgtttggagtctcctttttccagaaaattggatctgtggtcttttcttgacattcctcgctctagactggtgaagtatcccttgctgctcaaggaaatactaaagcataccccaaaagagcatccagatgtccagttacttgaggatgccatcttgattatccagggtgtcttatcagatatcaaccttaagaaaggtgaaagtgaatgtcaatattacatcgacaagctggagtaccttgatgaaaaacagagagatcccagaattgaggcgagcaaagtgctcctgtgccacggggagcttcggtctaaaagcggacataagctgtacattttcctctttcaggacatcctggttctgacgcgccccgtcaccagaaacgagcggcactcctaccaagtgtatcgtcagcctattccagtacaggagctggttctggaggacctgcaggacggagatgtccggatgggcggttctttccgtggcgcgtttagcaatagcgagaaagccaaaaatatttttcgaatcaggttccatgacccaagccctgcccagtcccacacattgcaggctaacgacgttttccataagcaacagtggttcaactgtattcgggctgcaatcgcaccatttcagagcgctggatcgcccccggagctgcaaggcctgcccgaactccacgaggagtgcgaaggcaaccatcccagcgcaagaaaactgaccgcccagcggcgagcaagtacagtatcaagtgttacacaggtggaagtggacgagaacgcctatcggtgcggcagcggcatgcagatggcagaggattcaaaatctctgaaaactcaccagacacagcctggcatccgcagagcccgcgataaagccttatccgggggaaaaagaaaggaaacgttggtttag

SEQ ID NO: 126222 - DNA, 483 bp, Artificial Sequence
  Description of Artificial Sequence: Synthetic coding sequence
atggtggcccacgacgaaacgggcggcctactacccatcaagaggactattagagttctggatgtgaataatcagtccttcagggagcaggaggaacttacacacatcttcggagacctggatagctatattcctctacacgaggatttactcacacggattggggaagcaaccaaacccgacggcactgtggaacagatcggccacatacttgtaagttggctccccagactcaatgcataccgggggtattgctccaatcagctggcagccaaggcgctgctggaccaaaagaagcaggacccacgagtccaggactttctgcaacgctgcctggagagcccattcagcaggaagctggatctctggtcctttctggacatccctaggtcacggttagtcaagtatcccctcctgctgaaagaaattctgaagcacactcccaaggagcacccggacgtacagctgcttgaagacgcttag

SEQ ID NO: 126223 - DNA, 1629 bp, Artificial Sequence
  Description of Artificial Sequence: Synthetic coding sequence
atggttgcacacgacgagactggtgggctcctccctattaagcgcaccattcgcgtccttgatgtgaacaatcagagctttcgggaacaagaggaaccttccaacaagcgtgtgcgacccctggccagagttacgtcactcgccaacctaatttctcctgtgagaaatggtgccgtgcggaggtttgggcagaccattcaaagtttcaccctccgcggggatcacagatctccagcttctgctcaaaagttttcatctagatctacagtgcccacccctgcaaagagacgaagttctgccctttggtctgaaatgctcgacattacgatgaaagagtcccttactaccagagaaattaggcggcaggaagccatctacgaaatgagcagaggggaacaggatctgattgaggaccttaaactcgctcggaaggcctatcatgatcccatgctgaaattgtctatcatgagtgaagaggaactgacccacattttcggggacttggattcttacattccactgcatgaggatctgctgacccgaatcggcgaggcgactaagcctgatggcactgtggaacagattgggcacattctagtaagctggctgccacgcctgaatgcttacagagggtattgctctaaccaactggctgccaaagcgctcctcgatcaaaagaagcaggacccccgggtgcaggatttcctgcagcgatgtctggaatcaccgttttcaagaaagctggacctgtggagtttccttgacattcccaggagcaggctggtcaagtatccactgttactgaaggaaatactgaaacatacaccgaaagaacacccagacgtgcagctgctggaagacgctatcctcatcattcagggagttctcagtgatatcaacctgaaaaaaggggagagtgagtgtcaatattacatcgacaaattagaatacctcgacgagaagcagagagaccccaggatcgaagcgtccaaagtacttctgtgtcatggagagctccgttccaaatctggtcacaagctgtatattttcttgttccaggatattctcgtcttaactcgccccgttactagaaatgagcgtcattcataccaggtttaccgccagccaatccccgtgcaggagctcgtgctggaggaccttcaggatggcgatgtgcgcatgggagggtcattccgaggcgcgtttagcaattccgaaaaggcaaaaaacattttcaggattcgctttcatgatcccagccccgcacagtctcacacactgcaggctaacgatgttttccataaacaacagtggtttaattgtatacgggccgctattgcccctttccaaagtgccggatctcctccagagttacaggggctccctgagctccatgaagagtgcgaaggcaatcacccttctgcccgcaagttgaccgctcaaagacgggcctccacagtctccagtgtgacgcaagtcgaagtggacgaaaacgcttaccgctgcggctctggaatgcaaatggccgaggactcgaaatccctgaaaacgcatcagactcagccgggtatcaggagagcacgagacaaggccctctcaggcggtaagcgtaaggaaactcttgtgtag

SEQ ID NO: 126224 - DNA, 483 bp, Artificial Sequence
  Description of Artificial Sequence: Synthetic coding sequence
atggtggcacacgacgaaactgggggcttgttgcctataaaaaggaccattcgagtcctcgacgttaacaaccagtctttccgggagcaagaggaactcacccacatcttcggtgatcttgactcttacattcctttacacgaggatctcctgacgaggatcggggaggcgacaaagccggacggaacggtggagcaaataggccatatactggtgagttggctccccaggctgaatgcctatcggggctactgcagcaaccaacttgcggctaaggccctgttggaccagaagaagcaggatccgagggtccaggacttcctccagcgatgtctggagtcacctttcagccgcaagctggacctgtggagcttcctcgacataccccgaagtcgtctcgtcaagtatcctcttcttcttaaggagattctgaaacacacccctaaagaacaccccgacgttcaattgctggaagacgcttag

SEQ ID NO: 126225 - DNA, 1248 bp, Artificial Sequence
  Description of Artificial Sequence: Synthetic coding sequence
atgtcccgcggagagcaggatctgatcgaggatcttaagctggcccgaaaggcctatcatgacccaatgctcaagctgtctatcatgagcgaagaagagctaactcacatatttggggatctggactcttacatccctctccacgaagacctactcactcgcatcggagaggcgacaaagccagacggaacggttgagcagatcggacatattctggtgtcttggctgcccaggctgaatgcttacagaggttactgcagtaatcagctggccgctaaagcattgcttgatcagaagaagcaggaccccagggttcaggactttctccaaaggtgcttagaatcacccttcagcagaaagctggacctgtggtcatttctggatattcctcgatctaggcttgtgaagtatcccctgttgttaaaagaaattctgaagcatacccctaaagagcaccctgatgtccaactgctggaagacgctatactgatcattcagggggtccttagcgacatcaatctcaagaaaggcgagtcagagtgtcagtattacatagataagctcgagtacctcgacgagaaacagcgtgatcccagaattgaggcttcaaaggtcctcctctgccatggagaattgcggtcaaagagtggacacaaactctatattttcctattccaggacattctcgtgctgactcgtcctgtgacccggaatgagcggcattcctatcaggtgtatcgccagcctattccggtgcaggaacttgtgttggaggacctgcaggacggagatgttcggatgggaggctccttccggggcgccttcagcaactccgagaaggccaaaaacatctttaggatccgttttcacgaccctagcccggcccagagtcacactctccaggcaaacgacgtgttccataagcaacaatggtttaattgcatcagagccgccatagctcccttccaaagcgccggtagccctccagagctgcagggactcccggaacttcatgaggagtgtgaggggaaccaccccagtgcacggaaactgaccgcacaaagaagggccagtacagtcagtagcgtcactcaggttgaagttgacgagaacgcctatagatgcggctcaggcatgcagatggccgaagatagtaagagccttaagacccatcagacacagcctgggattagacgagctcgcgataaggccctcagcgggggcaagcgcaaggagacccttgtgtag

SEQ ID NO: 126226 - DNA, 3063 bp, Artificial Sequence
  Description of Artificial Sequence: Synthetic coding sequence
atgatgtctttcggaggtgctgacgcactgctcggcgctccctttgctccgctgcatggaggcggctcactgcattatgccttggcgcgcaaagggggcgccggcggtactcgaagcgccgcaggatctagctcaggtttccactcctggacccgtaccagcgtatcttctgtttccgcctccccatctagatttcggggcgccggggccgccagctctaccgattctctcgataccctgagcaacggccctgagggatgtatggtggctgtggccaccagtagatccgagaaagagcagctccaggctcttaacgacaggtttgccggctatatcgacaaggtccggcagcttgaagcacacaaccgctccctggaaggggaagccgccgcactgagacagcagcaggccggcagatcagcaatgggcgagttgtacgagcgagaagttagggaaatgagaggagccgtccttaggttaggagcggctcgggggcagcttagactagagcaggagcatctgcttgaggatatcgcgcacgttagacaacgactggacgacgaagctcgacagcgagaagaagcagaggctgccgctagagcactggcccgattcgctcaggaggcagaggccgcccgggttgacctccaaaaaaaagcccaggcccttcaggaagaatgcggctatttaagacggcatcatcaggaggaggttggcgaactactggggcaaatccaaggttcaggagccgctcaagcgcagatgcaggctgaaacacgtgatgcactgaaatgcgatgtgactagcgctctgagggagatcagggcacagctggagggccacgctgtgcagtctactctccaatccgaggaatggttccgggtccgcctcgatagactctcagaagccgccaaagtgaacactgacgctatgagaagtgcccaggaggagattacagaataccgccggcagctccaggctcggacaacagagctggaggccttaaagagcacgaaggacagcctggagcgacagcgttcggagctggaagaccggcatcaggccgacatagccagttaccaggaggcaatccagcaacttgacgcggagcttaggaacactaagtgggaaatggctgctcaactccgcgaatatcaggacctccttaacgtgaagatggcactggacatcgagattgctgcttaccgtaagctgctagagggcgaggagtgtaggatcggtttcgggcctatcccattcagcctgccagagggccttccaaagatcccctcagtcagtacccacataaaggtgaaatccgaagaaaagattaaagttgtggagaaatccgaaaaggagactgtgatcgtcgaagaacaaacagaagagacccaggtgacggaggaagtgaccgaggaagaggaaaaagaggccaaagaagaggaggggaaggaggaggagggtggggaggaggaagaggctgagggcggcgaggaggagacaaaaagcccccctgccgaggaagcagcctcccctgagaaggaagccaagagccctgtgaaggaggaggccaagtcaccggctgaagctaaatcgccagagaaggaagaagcaaaaagtcctgccgaggtcaaatcacctgagaaggccaaaagccccgcgaaggaagaagccaaatccccccccgaggccaaaagcccagagaaggaggaggcaaaatcgcccgccgaggtaaagtcccccgagaaggcaaaaagccctgcaaaggaagaggctaaaagcccagctgaggcaaagagtccagagaaggccaagtcgcctgtgaaagaggaagccaaatcgccggctgaggcaaagagccccgttaaggaggaagccaaatctcccgctgaggtgaagagccctgagaaggcaaagtcacccacaaaagaggaggcaaaaagcccggagaaggccaaaagtccagaaaaagaagaggccaagtccccagagaaggcaaagtcccctgtgaaagccgaggcgaaatccccagagaaggccaagagccccgtgaaagccgaggctaaatcccctgagaaggccaagagccctgtgaaggaagaggctaaatctcccgagaaagccaagtcaccagtgaaggaggaggccaagtctccagaaaaggccaaaagtccagtcaaggaagaggccaagaccccagaaaaggccaagtcacccgtgaaagaagaggcgaaatcaccagaaaaagcaaagagtcctgaaaaagccaaaacattggacgtcaaatccccagaggcaaagacccccgcgaaggaagaagcacgttctccagcagacaagttcccagagaaggccaagtcccccgtgaaggaggaggtgaagagtccagagaaggccaagtcacctctgaaggaggacgccaaggcccctgagaaagaaatcccaaaaaaggaggaagtgaaatcacccgtaaaagaggaagagaagccacaagaagtgaaggtgaaggaaccgccaaagaaagcggaggaagagaaagccccagccactcccaaaaccgaagaaaagaaagatagtaagaaggaggaggcacctaagaaagaagcacccaagcctaaagtcgaagaaaaaaaagaacccgctgtggagaagcctaaggagtccaaagttgaagccaagaaagaagaagccgaagataagaaaaaagtccccaccccagaaaaagaagcccctgcgaaagtcgaggtcaaagaggatgctaagcctaaagaaaagactgaagtggccaaaaaagagccggatgacgcaaaagcgaaagaaccctcaaaaccagctgagaagaaggaggcagcccctgaaaagaaagacacaaaagaggagaaggcgaaaaaacccgaggaaaaacccaaaactgaggcaaaagccaaggaggacgacaaaacactctccaaagaaccctctaagcccaaagcggaaaaggcggaaaagagcagtagtaccgatcagaaggattcaaagcctccggaaaaggccacagaggacaaggccgctaaaggcaagtag

SEQ ID NO: 126227 - DNA, 2916 bp, Artificial Sequence
  Description of Artificial Sequence: Synthetic coding sequence
atgatgagctttggtggagctgatgcactgttgggggctccattcgccccattgcatggcggcgggtccctgcactatgccttagctcggaagggaggcgctggggggacccgcagcgctgcgggcagcagctccgggttccacagctggactagaacttctgtttcatccgtcagtgcaagcccttctcgatttagaggcgcgggagccgccagttcgaccgactctcttgacactctgtcaaatgggcccgaagggtgcatggtggcagtggctacttctcgatccgagaaggaacaacttcaagccttgaacgacagattcgcaggctacattgacaaagtacgtcagctggaggcgcataacagaagcctcgagggcgaagctgctgctctcaggcagcagcaggctggcagatcagccatgggtgaattatacgagcgcgaggttagagagatgcgtggggccgtgttacgcctgggtgcggctcgggggcagctccgcctggagcaggaacatctgctagaggacatcgcacacgtgcgtcagcggctggatgacgaggcccggcaacgagaagaggcagaggctgccgcccgggctttggctcgattcgcgcaggaagccgaggcagcaagggttgacttacagaaaaaggctcaagcccttcaggaggaatgcggatacctgaggagacaccaccaggaggaggtcggagagttattggggcagatccagggctcaggtgccgcccaagcccagatgcaggccgagacacgcgacgccctgaagtgtgatgtgacatctgcccttcgggaaatccgagcacagctggagggacatgccgtccagtccacattacagtccgaggagtggtttcgcgtaaggctggataggttgtctgaagccgccaaggttaatactgacgcaatgcgttccgcccaggaagagattacagagtatcggcggcaactccaggctcgcacgacagagctggaggctctcaaaagcaccaaggactctttggagaggcagagatccgagctggaggacagacatcaagcagatatcgcatcttaccaggaagccatccaacagctagatgccgagttgaggaacacaaagtgggagatggccgcacagctaagggagtaccaggacctgttaaatgtcaagatggctctcgatatcgagatcgcagcttaccggaaactcttggaaggtgaggagtgccggattggcttcggtcccattcctttcagtttgccggagggcctgcctaaaattccaagcgtgtcgacccatattaaggtgaaatcagaagagaagatcaaagtcgtcgagaaatcagagaaggaaaccgtgatagtggaagagcagacagaggagactcaggtgacggaggaagtcaccgaggaagaggaaaaggaagcaaaggaagaggagggtaaggaggaagaagggggcgaagaagaagaagccgagggcggggaggaggagacgaaatccccaccggcagaagaggccgccagtccggagaaggaagctaaatcccccgttaaggaggaggccaagtcccccgctgaggctaagtctcctgaaaaggaagaggctaaatctccagcggaggtgaaatctcccgagaaggccaagagtccggctaaagaggaggccaaatctccccccgaggccaagagtcccgaaaaagaggaggccaagagtccagccgaggtcaagtcaccggaaaaagcgaagtcgccagcgaaagaggaggctaaaagcccagctgaggcaaagagtcctgagaaagcaaaatctcccgttaaggaagaggcaaagtcacccgctgaagccaaatcaccagtgaaggaagaggccaagagccccgccgaggtaaaatcacctgagaaggccaagagccctaccaaagaagaggccaagtctcccgagaaggccaagagcccagagaaagaggaggctaaatcacccgaaaaggcaaaaagccccgtgaaggccgaagccaagagccccgagaaagccaagagccctgttaaggccgaagctaaaagcccagaaaaggctaagtcaccggtcaaagaagaagctaagtctccggaaaaggctaagagccctgtgaaagaagaggccaagtcccctgagaaagctaagtctcctgttaaggaggaagccaagacccccgagaaggctaagagccccgttaaagaggaggcaaagtcacctgagaaagctaagtctccgttaaaagaagacgccaaagcccccgaaaaggagattcctaagaaagaagaggtgaaatcacccgtgaaagaggaagaaaaaccacaggaagtaaaggttaaggaaccccccaagaaggccgaagaggagaaggctcctgctactcccaaaactgaggagaagaaggattcaaagaaggaggaggccccaaagaaggaggcaccgaaaccaaaggtagaggagaaaaaagagcctgcagtggaaaagcccaaggagtccaaggtagaggcaaagaaggaggaggcagaggacaaaaagaaggtgcctacgcccgaaaaggaggctccagcaaaagttgaggtgaaggaagatgctaagcctaaagaaaaaaccgaagtagctaaaaaagagccagacgacgctaaagcgaaggagcccagcaagcctgccgagaagaaggaagccgcgcccgaaaagaaagatactaaggaggaaaaagccaagaaacccgaggagaaaccaaagactgaagccaaggctaaagaagatgataaaactttatccaaagaaccgtcaaaacctaaagctgagaaagccgaaaagtcatccagcaccgaccagaaggattctaaaccgccagagaaggctactgaagacaaggcagccaagggcaaatag

SEQ ID NO: 126228 - DNA, 930 bp, Artificial Sequence
  Description of Artificial Sequence: Synthetic coding sequence
atggatgataaggcatttaccaaggaactcgaccagtgggtggagcaactgaacgagtgtaaacagcttaacgaaaaccaggtgaggaccttatgtgagaaggccaaagaaatcctcacaaaagaatcaaacgtgcaggaagtgcgctgcccggtgacagtgtgcggggacgttcacggacagtttcatgacctgatggagctcttccgcatcgggggcaaaagccccgacactaactatctattcatgggggactacgtcgatcggggctactatagcgttgagactgtcaccctgctggtcgcgctcaaggtgcggtaccccgaacgcattacaatcctccgcggcaaccacgagagcagacagatcactcaggtgtatgggttctacgatgagtgtctccgaaaatatggaaacgctaacgtgtggaagtactttacagacttattcgactacctcccgttaacagctctagtggatggccagatcttttgcctacatggtgggctgagcccctccattgacacacttgaccatatccgggccctggatagattgcaggaggtaccacacgagggacccatgtgcgacctgctctggtccgatcctgacgaccggggggggtggggtattagtccaagaggcgctggatacacattcggtcaagatatcagtgaaaccttcaaccacgccaacggcctgacactagtttcaagggcacatcaactggtgatggagggttataattggtgccatgatagaaacgtcgttactattttttccgctccgaactattgctatcgatgtggaaaccaagccgctatcatggagctcgatgacaccttaaagtacagttttctgcagtttgaccctgctccccggaggggagagccccacgtaactcgccgaacacccgattactttctctag

SEQ ID NO: 126229 - DNA, 1623 bp, Artificial Sequence
  Description of Artificial Sequence: Synthetic coding sequence
atggcacgccaccttcgagagtatcaggacctgctgaacgtcaaaatggccttagatattgagatcgcagcctacaggaagctcctcgagggcgaagagacccgctttagcacttttgcaggtagcataacaggtcccctctacacccatcggcccccaatcactatttcttcgaaaatccagaagcctaaggtcgaggcacctaaactgaaggtccagcacaagttcgtggaagagattattgaagagaccaaggtggaagacgaaaaatcggagatggaggaagcccttacagccattacggaggaattggccgtgtccatgaaggaggagaaaaaggaggccgcagaggaaaaggaggaggaacctgaggcagaggaagaggaggtggctgcaaagaaatctccagtgaaagccaccgcaccggaggtaaaggaagaggagggggagaaggaggaagaagagggtcaagaagaggaagaggaagaggatgagggagccaaatcggaccaggcagaagaaggaggctccgaaaaggaagggtcctcagagaaagaggagggggagcaggaggagggggaaaccgaggccgaagccgaaggagaggaagctgaggcaaaagaggagaagaaggtagaggaaaaaagcgaggaagtcgccactaaagaggaactggttgcagacgcaaaggtcgaaaagcccgagaaggctaagagccctgtaccgaagagtcccgtagaggaaaagggcaagtcacccgtccccaagagtcctgtggaagagaaaggaaagtctcccgttccgaaaagccctgtggaggaaaagggcaagagcccggtgccaaagtcaccagttgaggagaaggggaaatcacctgtgagcaagtccccggtcgaggagaaagctaagtctccggtccctaagagcccagtcgaggaagctaaatcaaaagcagaggtcggaaagggtgaacagaaagaagaggaggagaaagaagtgaaagaggcacctaaagaggagaaagtagaaaagaaggaggagaaacctaaggacgtaccagaaaagaaaaaagcggagtctcctgtgaaggaggaagctgtggctgaggtggtgaccatcacaaaatcagtgaaagtccacctcgagaaagagaccaaggaggagggcaagcccttacagcaagagaaagaaaaggagaaggctggtggcgagggggggagcgaagaagagggaagtgataagggcgctaagggttctcgcaaagaagatatcgccgtaaacggcgaggtcgagggcaaagaagaggtggagcaggaaacaaaagagaagggcagcggcagagaggaggagaagggcgtcgtaactaatggcttggacctgtctccggcagacgaaaagaaagggggggataagtccgaggaaaaggtcgtggtgacaaagacagtggaaaaaattacttccgagggaggcgacggtgcaacaaagtacattaccaagtctgtgacggttacccaaaaagtggaggaacacgaagaaactttcgaagagaaactggtgtcaacgaaaaaggttgagaaagtcacgtcccacgcgatcgtgaaagaagtcacccagtcagactag

SEQ ID NO: 126230 - DNA, 2634 bp, Artificial Sequence
  Description of Artificial Sequence: Synthetic coding sequence
atgagttacaccctggattcactcgggaacccaagtgcctataggcgcgtgactgagacacgctcctctttctcgagagtttctgggagtccatcaagcgggtttaggtcgcagtcatggagtagaggatccccaagtactgtcagtagctcgtataagaggtctatgctggcacctcggcttgcgtattctagtgcgatgctgtcctccgccgaatcatctcttgatttctctcagagcagttccctcctgaatggggggtcaggacccggcggagattataagctctcacggagcaacgagaaagagcaactgcagggtcttaacgacagattcgcaggttatattgaaaaggtccattacctggagcagcaaaataaagaaatagaagctgagatccaggctctgcgccagaaacaggccagccatgcccagttgggggatgcctatgaccaagaaataagagaacttcgggcaacactagagatggtgaaccatgagaaggctcaggtccagctggattctgaccacctggaggaggacatacacaggttgaaggagcgatttgaagaagaggcaaggctgcgcgatgacaccgaggccgcaattagagccctccgcaaggacattgaagaagcgtctcttgtcaaggttgaactggacaagaaagtgcagtctctccaagacgaggtggctttcctgcgctcgaatcacgaggaggaagtggcagatctgctggcacagatacaggctagccatataacggtagagagaaaggactatctgaagaccgacattagcaccgccctgaaagaaattcgcagccaattagaaagccattcagatcagaacatgcatcaagcagaagagtggtttaaatgccgctacgctaagctgacagaggccgctgagcagaataaagaagcaatcagatcagcaaaagaagaaatcgccgaatatcggaggcagctgcagagcaagtctatagagctggagtcagtgagaggaaccaaggagtctctcgagcggcagctgtccgatatcgaagaacgccacaaccacgatctttcttcctaccaggacacaattcaacaactcgaaaatgagctacgggggaccaaatgggagatggccagacacctgagggaataccaagacctgctcaatgtgaaaatggctctagacattgagattgccgcatatcgtaaacttctggagggggaagagacgcgcttctccaccttcgccggttcgattacagggcctctttatactcataggccacctattaccatctcttccaaaatccagaaaccaaaggtggaggcccctaaacttaaggttcagcataagttcgtggaagaaataatcgaagagacaaaggttgaagatgaaaagagtgaaatggaggaagctttgactgccattacagaagagttggcagtgtcaatgaaagaggagaaaaaggaggccgccgaggaaaaggaggaggaacccgaggctgaggaggaggaggttgccgccaagaaatccccagtcaaagctactgctcctgaggtgaaggaggaggaaggggagaaagaggaggaagaggggcaggaggaggaggaggaggaagacgagggcgctaagtccgaccaggcagaagagggtgggtcagaaaaggaaggatcatctgaaaaggaggagggggaacaagaagagggggagacagaggcggaagccgagggcgaagaggccgaggcgaaagaggagaagaaagtggaagaaaagtctgaggaagtcgctacaaaagaagagctggtcgccgacgctaaggtggagaaaccggagaaggccaagagtccggtccccaagagcccggtggaagaaaaaggaaaatccccagtgtctaagtcaccggtcgaggagaaggcaaaatctcccgtgccaaagtcaccagtcgaagaggccaaatccaaggccgaggttggtaaaggcgaacagaaagaggaagaggagaaagaggtgaaggaggctcccaaggaggagaaggtggagaagaaagaagagaaacccaaggatgtccccgaaaagaagaaagcggaaagcccagtaaaggaagaggctgtcgctgaagttgtgactataaccaagtccgtgaaggtacacttggagaaagaaactaaagaagaaggcaagcccctgcagcaagagaaggagaaagaaaaggctggtggtgaaggaggatccgaggaagagggttctgataagggcgccaagggctctagaaaggaagatattgccgttaacggggaggtcgaagggaaagaagaggtagagcaggagaccaaagaaaagggttctgggcgcgaggaagagaaaggtgtagtaacaaatggcctggacctgtcacctgccgacgagaaaaagggaggcgacaagagcgaggagaaagtcgttgtgactaagactgtagagaagattacatctgaaggcggggacggagcgacgaagtacatcaccaagagcgtcactgtgacccagaaggtggaagaacacgaggagacttttgaggaaaaactcgtaagcaccaagaaagtggagaaggtgacctcgcatgctatcgtgaaggaggtgacacagtctgactag

SEQ ID NO: 126231 - DNA, 1071 bp, Artificial Sequence
  Description of Artificial Sequence: Synthetic coding sequence
atgaccaagagctactccgagtccggtctgatgggtgagccacagccacagggtccccctagttggacggatgaatgcctttcctcgcaggacgaagagcatgaggccgacaagaaggaagatgaccttgagacaatgaatgccgaggaggattcactaagaaatggaggagaggaggaggacgaggacgaagacctggaagaagaggaggaagaagaagaggaggatgatgaccagaagcctaagagaagaggtcctaagaagaagaaaatgactaaagctaggctagagagatttaaattacgcagaatgaaagcaaatgcgagggaacgcaaccgtatgcatggactgaacgccgcattagacaatctccggaaggtcgtgccatgttatagtaagacacaaaaattatccaagatcgaaaccctacggctggcgaaaaattacatctgggcactttccgagatcctccgttccggaaagagtcctgatcttgtctcattcgtgcaaacattgtgcaagggtctaagccaacccaccacaaaccttgtagcaggctgtctacagctcaatccgagaacattcctccccgaacagaaccaggacatgcctccacacctgcccacagcttcggcctctttccccgtacatccgtattcgtaccagtcccctggcctaccgtcacctccatatggtactatggattcatcgcacgtcttccatgtgaaacctccaccacacgcttactccgcggccttggagccattctttgagtctccgctgacggactgtactagcccatcattcgacggccctctgtcccctcctctctcaatcaatgggaacttttcttttaaacacgaacccagcgcggaatttgagaagaattatgcattcaccatgcattatcccgcagctaccctggccggcgcgcagagtcacggaagtatcttcagcggaaccgccgcacccaggtgcgaaatcccgattgacaacattatgagcttcgactcacactcacatcatgagcgggttatgtctgcccaacttaatgcgatttttcacgactag

SEQ ID NO: 126232 - DNA, 1149 bp, Artificial Sequence
  Description of Artificial Sequence: Synthetic coding sequence
atgttgacacgcttgttcagcgaacctgggctcttgagtgatgtccccaagtttgcttcttggggcgacggggaagatgacgagccgagaagcgataagggcgatgcccccccccctccacctccggccccaggacctggtgcccctggcccagcgcgagccgctaagcccgtgccactgcggggagaggagggcacggaggccactttggcggaggtgaaagaggagggcgagctcggaggcgaagaggaagaagaggaggaggaggaggagggactcgacgaggcggaaggagagagaccaaaaaagcgggggcccaaaaagaggaagatgaccaaagctcggctggagcgctccaaactgaggcggcagaaggctaatgcaagggagcgcaaccggatgcacgatcttaatgcagcactggacaatctgcgcaaagtcgtgccgtgttatagtaagacgcagaaactgtctaagattgagaccttgaggctagccaagaactacatatgggctttgtctgagatattgagatcaggaaagcgaccagatctggtgtcctatgtgcaaacgctgtgcaaggggctcagccagcctaccacaaacctggtcgccggatgtctgcagttgaactccaggaactttctcacagagcagggcgccgacggagccggaaggttccacggaagcggcgggccctttgcaatgcacccgtacccctatccatgtagccgtttagccggagctcagtgccaggccgcaggcggcctggggggcggggctgcccatgctttgcgtacacacggctactgtgcagcttacgagactctctacgcggccgcaggtggtgggggcgcctcacccgactataactcaagcgagtacgagggccccctgtctccacctctgtgtctgaacggcaacttcagtctcaagcaggatagttctcctgaccacgaaaaatcatatcactattccatgcattattctgctttacccggctcaaggcctacaggccacgggctggtgttcggctctagtgccgtgcgcggaggagtccacagtgagaatctgctgagttacgacatgcacctgcaccacgaccgcggcccgatgtacgaggagctcaatgcttttttccataattag

SEQ ID NO: 126233 - DNA, 996 bp, Artificial Sequence
  Description of Artificial Sequence: Synthetic coding sequence
atgtctaaaacgtttgtcaaaagcaaagagatgggcgagctcgtcaacaccccctcctggatggataagggcctaggctctcagaacgaggttaaggaggaggaatcaagaccaggcacatacggcatgctcagctctctgacagaagaacacgatagcatagaagaagaggaagaggaagaagaagatggggaaaagcccaaacgcaggggacctaaaaagaagaagatgactaaggcccggttggagcggttcagagcgcgtcgagtaaaagccaacgcgcgcgaacgaactaggatgcacgggctgaatgatgccctcgacaatctgcggagagtcatgccctgttacagcaagacacaaaaactgtccaaaatagagacgctccgcctcgcacgcaactatatatgggccctctccgaagtgcttgaaacaggacagactcccgaagggaagggatttgtggagatgctctgtaagggtttgtcccagcccacctccaaccttgtggctgggtgcctccaactgggcccacagtctgtgctcctagagaaacatgaggacaagtcaccaatctgtgattcagcaatttccgttcacaactttaattaccaaagcccaggattaccgtcacccccctacggacatatggagactcatctgctgcatctcaaaccccaagtgtttaaatccctgggagaatccagttttgggtcgcacctgccagattgctcaacgcccccctatgaaggcccactaacccctcctctgagcatctccggaaatttcagccttaagcaggacgggtcacccgatttggaaaaatcctattcattcatgccacactacccatcaagttcattgagtagcggtcatgtacactcaactcctttccaagccggtacacctcgctatgacgtgcccatcgacatgtcctatgacagctatccgcaccacggaatcggtacgcaactgaacacggtgtttacggagtag

SEQ ID NO: 126234 - DNA, 1014 bp, Artificial Sequence
  Description of Artificial Sequence: Synthetic coding sequence
atgctaacccttcccttcgatgagtcagtcgtgatgccagagtctcagatgtgtcggaagttcagcagagagtgcgaagatcagaaacagattaagaagcccgagtccttttctaagcagattgttttgcgggggaaatccataaagcgagctcccggcgaagaaacagagaaagaggaggaggaagaagacagagaggaagaggacgagaatggtctgccaaggagacggggactgcgcaaaaagaagactactaagcttcgattggaacgagtgaagttccgtcgtcaggaggctaacgcccgtgaacgaaatagaatgcacggacttaatgatgcccttgacaacttgcgaaaggtcgtgccctgttattctaaaacacagaaattgtccaaaatagaaaccctcagactggccaagaactacatttgggcactgtctgagattctacgcattggaaagaggccagacctgcttactttcgtgcagaatttatgtaaggggctcagtcagcctactacaaatctggtggcaggttgcctccaactgaatgctcggtcgttcctgatgggtcaggggggagaggccgcccaccatactaggtcgccttactccaccttttaccccccctatcattctcccgaactgaccacccctcctggtcacgggactttagacaatagtaagtcaatgaaaccatacaactattgcagcgcttacgaatccttttacgagtccacttcgcctgagtgcgcctcgccccaattcgaaggacccctgtcaccccctcctatcaattacaacggcattttttctctgaagcaggaggagacattggattacggcaagaattataactacggaatgcactactgcgccgtgccccctagaggccccctggggcagggcgccatgttcagattaccgactgatagtcattttccctatgatctgcacctgaggtctcagtccctgactatgcaagatgaactcaatgcagtgttccataattag

SEQ ID NO: 126235 - DNA, 714 bp, Artificial Sequence
  Description of Artificial Sequence: Synthetic coding sequence
atgcctgccagacttgaaacatgcattagcgatctggactgcgcgtccagtagcggctctgatctgagcgggttcctgaccgacgaagaagactgcgcacgcctccagcaggctgccagcgcatctggacccccagcccctgcccgcaggggtgctcctaacattagtagggcctctgaagtgcctggggcacaagatgacgaacaggagagaaggcgaaggcgcggacgaacccgcgtcagaagcgaggcgctgctacacagtctgagacgttcccgtcgcgtgaaggccaacgatcgtgagaggaatcgcatgcacaatctgaatgcagcgttagacgccctgcgatccgtgctcccatccttcccagatgatactaagctcaccaaaattgaaaccctgagatttgcttacaactacatttgggccctggcggaaacactcagactcgcggaccagggtctgccgggggggggtgcgagggagcggctgctgcccccacagtgtgtgccctgcttaccaggaccccctagccccgcgtccgacgccgaatcgtgggggagtggcgcggctgctgccagcccgttaagcgatccttcttcccccgccgcttcagaagacttcacctataggcccggggatcccgttttttcctttccgtccttacctaaggatctcctacatactaccccctgctttatcccgtaccattag

SEQ ID NO: 126236 - DNA, 645 bp, Artificial Sequence
  Description of Artificial Sequence: Synthetic coding sequence
atgacaccacagccaagtggcgcgccaaccgtccaagttacaagggaaaccgagcgatcattccctagggccagcgaagacgaggtcacatgtccgactagcgctcccccttcacccactcgcacgcggggcaattgtgcagaggcggaggaaggaggttgtcggggcgctccacgtaagctgagggctcgccgagggggccgaagcaggcctaagagtgagctcgcgctctccaagcagagaaggagtcgtaggaaaaaggctaatgaccgagaaagaaatcggatgcataacttaaactccgcattggacgcgctgagaggggtgttgcctacctttcccgacgacgccaaattgactaagatcgaaacactgaggtttgctcataattacatttgggcgcttacccagaccctgcgtattgcggaccactctctgtacgccctcgaaccacccgcaccccactgcggcgagctgggctcacccggcgggagccccggggattgggggtctctctactcaccggtgagtcaggccggctccctttctcccgccgcatccctcgaagagcgtcctggcctgttgggggctactttctccgcatgcttgtcgcctgggtccttggccttcagcgacttcctgtag

SEQ ID NO: 126237 - DNA, 456 bp, Artificial Sequence
  Description of Artificial Sequence: Synthetic coding sequence
atggaacgtcccgaaccggagcttatccggcagtcatggcgtgcagtgtctcgctcaccactggagcatggaacggtgctgtttgcaagactcttcgctttagaacctgatctgctcccacttttccagtataattgcaggcagtttagcagccccgaggactgtctcagctccccggagtttctggaccacataaggaaggtgatgctggtaattgacgctgcagtgaccaatgttgaggacctttctagcttggaggaatatttggcctctttggggcggaagcaccgcgctgtgggggtgaagctgagttccttttcaaccgtgggcgaatcactgctgtatatgctagaaaagtgcttagggcccgctttcactcccgccacccgtgcagcatggagtcagctctatggagccgtggtgcaggccatgtcccgcggctgggatggagagtag

SEQ ID NO: 126238 - DNA, 237 bp, Artificial Sequence
  Description of Artificial Sequence: Synthetic coding sequence
atggactgctgcacagagaatgcatgctctaaaccggacgacgatatccttgatataccccttgatgacccaggagcgaatgccgccgctgcaaaaatccaggctagcttccggggacatatggcccggaaaaagatcaagagcggggagcgcggccgaaaggggccgggaccaggcgggccgggtggagccggcgtggcccgggggggagccgggggcgggcccagtggggattag

SEQ ID NO: 126239 - DNA, 237 bp, Artificial Sequence
  Description of Artificial Sequence: Synthetic coding sequence
atggattgttgtacagagaatgcctgctcaaaacctgacgacgacattctggacatccctctggatgatcccggagccaatgcagccgctgccaagatccaggcttcttttcgcggtcacatggcccgaaaaaagattaaaagcggagagagaggtcggaaggggcctggccctggcgggccgggaggcgccggagtcgcaaggggaggtgcgggcggcgggcctagtggtgattag

SEQ ID NO: 126240 - DNA, 237 bp, Artificial Sequence
  Description of Artificial Sequence: Synthetic coding sequence
atggactgttgcaccgagaatgcttgctccaaaccagatgatgacatactagacatcccactggacgatcctggtgctaacgctgctgccgcaaaaatccaagcctcattccgtggacatatggcaagaaagaagattaagagtggagaaagaggacgcaaaggacctgggcccgggggcccagggggtgcaggcgttgctcgtgggggtgcaggcggagggccatccggagattag

SEQ ID NO: 126241 - DNA, 936 bp, Artificial Sequence
  Description of Artificial Sequence: Synthetic coding sequence
atggctgcattaggagtgctcgagagcgacctgccctctgctgtgacattgcttaaaaacctgcaggaacaggtgatggccgttactgcccaagtaaagagccttactcagaaggttcaagcaggggcctatcccactgaaaaaggactgtctttccttgaagtgaaagaccaacttcttctgatgtatctaatggacttaactcatctgatccttgataaggctagcggcgggagccttcagggccatgatgcagtgctgaggctggtcgagatcaggacagtattggagaagttgagaccactcgatcagaagttaaagtatcagattgacaaactgatcaaaacggccgtgacggggagcctgtctgagaacgatcctctcaggtttaaaccccatccctctaatatgatgagcaaattgtcctcggaagacgaggaggaagacgaagccgaggatgaccagtctgaggctagcggaaaaaagagcgttaagggcgtgtctaaaaagtacgtacccccaaggttggttcccgtacattacgacgagactgaagccgagagggagaaaaagagactagaaagagcgaagaggcgcgccctaagctcgtcagtgattcgggaacttaaggaacaatacagcgacgcccccgaggagatcagggacgcgcgtcaccctcatgtgactcgtcagtcccaggaagaccagcacaggatcaattatgaagagtccatgatggtacggctgtccgtcagcaagagagaaaaaggccggaggaagagggccaacgtcatgagctcgcaactccactctctcacgcatttcagtgatatctcagcgttgacagggggcaccgttcatctggatgaagaccaaaatccaattaagaagcgaaagaagatcccacagaaggggaggaagaagaaaggacagtag

SEQ ID NO: 126242 - DNA, 948 bp, Artificial Sequence
  Description of Artificial Sequence: Synthetic coding sequence
atggctgctttgggtgtgttagagtccgacctcccctccgccgtaactcttctgaagaatttgcaagagcaggtcatggcggtaaccgcgcaggtcaagtccctgactcagaaggtgcaagctggagcttaccctaccgaaaaagggctttcgttcctggaggtaaaggaccaactcctcctgatgtacctgatggacctgacccacctcattctggacaaggcgtcaggcggatcattgcagggacatgatgccgtgctccgactggtggagatacggacagtcctcgagaaactcaggcctctagaccagaaactcaagtatcaaatcgacaagctgattaagacggctgtgacagggagcctatcagaaaatgatcctctgcggttcaagccacatcctagcaacatgatgtccaagctgtcctccgaggatgaggaggaagatgaggcagaagacgaccaatcggaagcatccggaaagaaatccgtaaagggagtctctaagaaatacgtgccccctcggctcgtccctgtgcactacgatgagaccgaggccgaaagagagaagaagcgcctcgaacgagcaaagaggcgggcccttagttcatcggtgatacgggagctgaaggagcagtatagcgacgcccctgaggaaatccgggacgcccgtcatccccacgtgactagacagagtcaggaggaccaacatcgcatcaactacgaagagagcatgatggtgcgcctctcagtttctaaacgcgagaagggcagacggaaacgggctaacgtcatgtcgtctcagcttcactctcttacacacttctcggatatttccgccctcactgggggtacggtccaccttgacgaggatcaaaaccctattaagaagcggaaaaaaatcccccagaagggaaggaagaagaaggggttcagacggcgcaggtag

SEQ ID NO: 126243 - DNA, 2472 bp, Artificial Sequence
  Description of Artificial Sequence: Synthetic coding sequence
atggcattgcctcgctgtacctggcctaattacgtctggcgtgcggtgatggcctgtctggtgcatagaggcttgggcgcgcctcttacactgtgcatgctcggatgtctgctccaggcaggccatgtcctgagtcagaagttggatgatgtggaccccctggtggccaccaatttcgggaaaataagaggtataaaaaaggaattaaacaatgagatcctagggcccgtaatacaattcctcggtgtcccctacgctgcaccccccacaggtgaaaggcgttttcaaccaccagagccaccatctccatggtccgatattaggaacgccacccagtttgccccagtctgtccacagaacatcatcgacggccggctgccggaggtcatgctccctgtgtggttcaccaataatttggacgtggtgagttcctatgtgcaggaccagagcgaagattgcttgtacttgaatatatacgttccaacggaggatgatatccgagattctggtgggccaaagccagtgatggtgtacatacatggcggatcttatatggaaggcaccggcaatctgtatgacgggagcgtgctcgcgtcatacggcaacgttattgtgataaccgttaattatcggctgggcgtccttggtttcttgtcaacaggggatcaggccgcgaaggggaattatggtttgctggacctgattcaagctctgcgctggaccagcgaaaacatagggtttttcgggggcgacccacttcgaatcactgtcttcggtagcggcgccggggggtcatgtgtgaatctactgacactgagccattacagcgaagggaaccgctggagcaacagtactaaaggtctttttcagcgagcaatcgctcagagcggcactgccctgtccagttgggccgtgtcttttcagccggccaaatacgcgcgaatgctcgcgacgaaggtaggatgcaatgtgtccgatactgtagaacttgtggagtgcctccagaaaaagccatataaggagctggttgaccaagacatccagcctgcaagataccatattgcattcggaccggtgatcgacggggatgttattcccgatgatccgcagatccttatggaacaaggtgaattcttgaactacgacatcatgttaggggtcaatcagggtgagggcctgaaattcgtcgagaacatagtggacagtgatgacggaatttctgccagcgattttgatttcgctgtcagcaatttcgtcgacaatttgtacggctaccccgagggtaaagatgtgctcagagaaacaattaagttcatgtacactgattgggcagatagacataatcctgaaacacggcgaaagaccctgctggccctgtttactgatcaccagtgggtggctcccgcagtggccaccgccgatctgcatagcaacttcggctcaccaacttatttttatgccttctatcatcactgccagacagatcaagtgcctgcatgggctgatgcggcacacggcgatgaagttccttatgttcttggaataccgatgatcggacctactgagctgtttccctgcaattttagcaagaacgatgtaatgctctcagctgtggtcatgacatactggacaaacttcgccaagaccggtgacccaaatcagccagtgccccaggatacaaaattcatccatacaaagcctaatcgctttgaagaagtggcctggactagatatagccagaaggaccagctgtacctgcacatcggtttgaagcccagggtaaaagaacattatcgtgccaacaaggtaaatttatggctggagttggtcccccacctgcacaatctgaatgacatctcccaatatacgtccactaccaccaaggtgccgtctacagacattacctttagacctacgaggaagaactcagtcccagtcacctccgccttcccaaccgcaaagcaggacgaccccaagcagcagccatctcccttttcagtggaccagagggattatagtactgagctcagtgtcacaattgccgtcggcgcctctcttctgttcttaaacatcctggcctttgctgcactctattataagaaagataagagaagacacgacgtgcatcggagatgcagcccacaaagaacaactacaaacgatttgacgcatgcccaagaagaggagatcatgagtctacaaatgaagcacaccgacctggaccatgaatgcgagtcaattcacccacatgaggtagtattgagaactgcttgcccccccgactataccttagcaatgagacgatcacccgacgatgtgccactgatgacacctaacacgatcactatgatcccgaacacaatacccgggatacagccactgcatacattcaacacctttacaggtggccagaataacaccttgccccatccacacccacatcctcattcacatagcacaacacgcgtgtag

SEQ ID NO: 126244 - DNA, 2592 bp, Artificial Sequence
  Description of Artificial Sequence: Synthetic coding sequence
atggctttacccaggtgcacgtggcccaactacgtgtggagggctgtgatggcttgcttagtgcacagaggcctgggggccccgctaactctctgcatgcttggctgtctgttgcaagcaggacacgtgctctcccagaagctggacgatgtggatcccctggtcgccaccaattttgggaagatcagagggatcaaaaaggaactgaataacgagattctgggtcccgtcatacaatttctcggggttccttacgccgcaccacctacaggcgagagacgtttccagcccccagaacccccaagcccttggagcgacatccgaaacgctacccagttcgccccagtttgccctcaaaacataatcgatggaaggctcccagaggtgatgttgccagtttggttcaccaataatcttgacgtggtttcatcttacgtgcaagaccagagtgaagactgtctgtacctgaatatctatgtgccgactgaagacgtaaagcggatctctaaggaatgtgcacgcaaacctggcaaaaagatctgtcggaagggcggaccactaacgaagaaacagacagacgaccttggggataacgacggagctgaggatgaggatatacgagactctggaggacccaaacccgttatggtgtatatccatggaggctcatatatggaaggaacagggaacctgtacgacggctctgttttggcaagctatgggaatgtgattgttattaccgtgaattaccgcctgggcgtcctgggttttcttagcacgggcgatcaggccgctaaaggcaattacggattactggaccttatccaggccctgcgttggaccagtgagaacatcgggtttttcggcggcgacccactccgcataaccgtcttcggtagcggcgccgggggcagctgtgtgaatttgctcacactgtctcactatagtgaaggcaatcggtggagcaactccacaaagggtctcttccaacgagccattgctcaatccggaacagctctgtccagctgggcagttagttttcagccagctaaatacgcccgcatgctggccacaaaggtcggctgcaatgtatccgacacggttgagctggttgagtgcctacaaaaaaagccctacaaagagttagtcgaccaagacatacagcctgctcgctatcatatagccttcggtccagttattgatggcgatgttattccggacgacccccaaatcttgatggaacagggcgaatttttgaactacgatataatgctcggcgttaatcagggagagggtctcaaatttgtggaaaacatcgtggattcagatgatggaatttctgctagtgattttgatttcgctgtgagtaatttcgtggacaacctgtatgggtatccggagggaaaggatgtacttcgggaaaccataaaatttatgtatactgactgggccgaccgccataatcccgagacacgaaggaagactctgctggccctgttcactgaccaccaatgggtggcccccgctgtggcaaccgctgacctgcacagcaatttcggttccccaacctacttctatgctttctatcatcattgtcaaactgaccaagtgcccgcatgggctgatgccgcacatggtgatgaggtcccttacgtgcttggcatacctatgattgggcctaccgagctctttccctgtaatttttcaaagaatgacgtgatgctgtctgcggtggtgatgacatactggacaaatttcgccaagactggtgaccccaatcagcccgttccacaggacaccaagttcattcacacaaaacctaaccggtttgaagaagtggcctggacgcggtattcccaaaaggatcagctatacctgcatatcgggctcaagccacgtgtaaaggaacactatcgagcaaataaagtcaacctgtggctggagcttgtgccacacctgcataacctgaacgatattagccagtacacctctaccactactaaagtgccctccaccgacattactttcagacctacccggaaaaactccgtccccgtcacgtcagccttccccacagcaaagcaggacgaccctaagcaacagccctcacccttctcggtggaccagagggactactcaaccgagcttagcgtgactatcgcggtgggcgccagccttcttttcctgaatattctggcattcgcggcgttgtattacaaaaaggataagaggcgtcacgacgtccaccgacggtgcagtcctcaacggaccaccaccaatgaccttactcatgcccaggaggaagaaattatgagtctgcaaatgaaacacactgaccttgaccacgaatgtgagtccatccatccgcatgaagtggtcttgcgcactgcatgtccacccgactatacgttggcaatgcgaagatccccagacgacgtgcctttgatgaccccaaataccataacgatgatcccaaacacaatccccggtatccaacctttgcatacgtttaacactttcactggcggacagaacaataccttaccccatccccatccacacccccactctcatagcacgacacgagtgtag

SEQ ID NO: 126245 - DNA, 33 bp, Artificial Sequence
  Description of Artificial Sequence: Synthetic coding sequence
atggctctcccacgatgcacttggccaaattag

SEQ ID NO: 126246 - DNA, 42 bp, Artificial Sequence
  Description of Artificial Sequence: Synthetic coding sequence
atggcactgcctaggtgtacctggcccaattacgtatggtag

SEQ ID NO: 126247 - DNA, 2472 bp, Artificial Sequence
  Description of Artificial Sequence: Synthetic coding sequence
atggccctgccccgctgtacctggccaaactatgtgtggagagccgtaatggcctgtctggtgcatagggggctcggtgcgcccctcaccctgtgcatgctgggctgtctcctgcaagctgggcacgtgctgtcgcagaagcttgacgacgtagacccccttgttgccacaaacttcggaaaaatcagaggtatcaaaaaggaactcaataacgagatactgggccccgttattcagtttctcggggtcccttacgccgcccctcccaccggcgagcgtagatttcagcctcccgaacctccttctccgtggtccgatatcaggaacgcaacccagtttgcgcctgtatgcccacaaaacatcatagatggcagactcccagaggttatgttgccggtctggtttaccaataacctggatgtagtgagctcatatgtgcaggaccaaagcgaggactgcctctacttaaacatttacgtaccaaccgaagatgatatcagggatagcggcggcccaaaacccgtcatggtctacatccacgggggttcttatatggagggcacgggcaatctgtatgacggcagtgtgctggccagctacggcaatgtgatcgtgatcactgtgaactaccgcctgggcgtgttagggttcctatccacgggggatcaggcagcaaagggaaattacgggctactggacctgatccaggcactgcgatggaccagcgagaacattggattcttcggcggagatccgctcagaattaccgtctttgggagtggggcggggggaagctgtgtgaacctgctgaccctgtcgcattacagcgaaggtaatagatggtctaatagtactaagggactgttccaacgggcgattgcccagagtggaaccgcccttagttcttgggctgtgtcttttcagcccgccaaatatgctcgcatgttagcaaccaaagtagggtgcaatgttagtgataccgtggaacttgttgagtgcctgcagaagaagccctataaggaactagtggaccaggacatccaacctgctaggtatcacattgcctttggccccgtaattgacggagatgtgattccggatgatccccagattctgatggaacagggcgagttcttgaactacgatattatgctgggagtgaaccagggcgaggggttgaagtttgtagagaacattgttgactcggatgatggaataagcgctagcgactttgactttgctgtcagcaattttgtcgataacctttatggatatccggaggggaaagatgtcctgagggagaccatcaagttcatgtacaccgactgggcggatagacacaaccccgagaccaggcggaagacccttctcgccctgtttactgatcaccagtgggtagcccccgcagtggcgacggccgatctgcactccaacttcgggtcccctacatatttttacgcattctaccatcattgccagaccgaccaagttccggcctgggcggatgctgcccatggcgacgaagtcccatatgttttgggcataccaatgattggccccacagagctcttcccttgcaatttctcaaagaatgatgtcatgctcagcgccgttgtgatgacctactggacgaattttgctaagaccggagacccaaaccaacccgtcccacaggataccaagttcatacataccaagcccaatcgtttcgaggaggtcgcatggacacgctacagtcaaaaggaccagctgtacctgcacatcgggctgaaaccccgagttaaggagcactacagggcaaacaaggtaaacctttggctggagttggtgcctcatctccacaacctcaacgacatttcacaatacacctctacaactactaaggtgccttcaactgatatcacttttcgtcctactaggaaaaattcagttcccgtgactagtgcatttcctaccgctaagcaggacgaccctaagcagcaaccctcgccatttagcgtggatcagagggattactctacggagctcagtgttaccatagcagtcggtgcctcactgcttttcttaaatattctcgcgtttgccgcattgtactacaagaaagacaagcgcaggcatgacgtgcatcggaggtgctccccccagcgtaccactaccaacgatctcacccatgcccaggaggaggaaatcatgtctttacagatgaaacacaccgacttggatcacgaatgcgagtctatccacccacacgaggtagtgctcaggaccgcttgtccgcccgattacactcttgcaatgagacggtcccccgatgatgtccccctgatgacgccgaacacaatcacaatgatccctaacaccataccgggtattcagccgctgcacacttttaacacttttacaggaggacaaaacaacacacttccacatccccaccctcacccccactctcacagtactactcgggtgtag

SEQ ID NO: 126248 - DNA, 2472 bp, Artificial Sequence
  Description of Artificial Sequence: Synthetic coding sequence
atggctctgcctcgctgcacctggcccaattatgtttggagggccgttatggcatgtctggtccacagaggtctaggcgcccctctaacgctgtgcatgcttggctgtcttctgcaggccggccatgtgctcagtcagaagctagacgacgttgatcctctagtcgctaccaacttcggcaagatccgcgggataaaaaaggagcttaataacgagatcctgggccctgtgatccaatttctcggggttccttatgcggcccctccaacgggcgagcgccgctttcagcccccagagcctccatcaccatggtctgacatccgcaacgccactcagttcgcacccgtgtgtccacaaaacattatcgatggacggctcccagaagttatgctgcccgtctggttcactaataatctcgacgttgtgtctagttatgtacaggatcaatccgaggactgtttatatctcaacatttacgtgcccacagaggatgacattcgagactcgggaggtccaaaacccgtgatggtttacatccatggaggctcctatatggaaggaacaggaaatttatatgatggaagcgtgctggcgagctacggaaatgtgatcgttattactgtaaattatcgactgggtgtcttggggttcctgtccaccggagatcaggcagcaaaggggaattacggcctgctggacctcatccaggcccttcgttggacttctgagaacatcggttttttcgggggcgatcccttaagaatcaccgtattcggctcgggagcaggggggagttgcgtgaacctgctgactctgtcacactactcggaggggaataggtggtccaacagtaccaaaggtttatttcagcgagcaatcgctcagtctggaaccgccctttcatcttgggctgtgagcttccagcccgcaaagtacgctaggatgttagcaacgaaagttggatgtaatgtgtctgataccgtggaattggtcgagtgcctgcagaagaagccatacaaagagttggtggatcaggacattcagcctgcacgctatcatattgcgttcggacctgtgattgacggagatgttatccccgacgatccacagatcctcatggaacagggggaatttctgaattacgacattatgctcggagtgaaccaaggcgagggcctcaagttcgttgaaaatattgttgattcagacgacggtattagcgcatcagacttcgattttgccgtgtccaattttgtcgacaacctgtacggctacccggagggcaaggatgtcctgcgcgaaacaatcaagtttatgtacaccgactgggccgatcggcataacccagagactcgaagaaagactctgctagccctcttcacagaccaccagtgggtcgctcctgcggtggcaaccgctgatctacatagcaatttcggtagccctacctacttctacgcgttttaccaccactgccagaccgaccaagttccagcctgggctgatgctgcccatggcgatgaggttccttatgtgcttggtatccccatgatcgggccaacggaactctttccatgcaacttctcaaaaaatgatgttatgctgtccgccgtggtcatgacgtactggacaaattttgccaaaactggggatcctaaccagccggtcccacaggacactaagtttattcatacaaagccgaacagattcgaagaagtcgcctggactcgctactcacagaaagaccagctgtaccttcacattggtctaaaaccccgtgtaaaagaacattacagggctaataaagtgaacctgtggctggagctggtgccccacttgcacaatctaaacgacatctcgcagtatacaagcaccacaaccaaagtacctagcactgacattacatttcggccaacgaggaagaacagcgtccccgttacatctgcattcccaactgcaaagcaagatgacccaaaacaacagccctcaccttttagcgtggaccagcgcgattatagcacagagctctctgtgaccatcgctgtgggtgcgtccctgcttttcctgaatatcttggccttcgccgccttgtactataagaaagataaacgccgccacgatgtccacagacgttgttctcctcaaaggaccaccacaaacgacctaacccatgctcaggaggaagagataatgtctctgcaaatgaaacatacagacctcgaccatgaatgcgaatctattcatccgcacgaagttgtgctgcggacagcctgccctcccgactacaccctggctatgagaagatcccctgatgacgtccctctgatgaccccgaacacaattacaatgattcccaataccatccctggcatccagcctctgcatacgtttaacaccttcacaggcggccagaataataccctgcctcacccacatccccaccctcacagtcactctactactagagtttag

SEQ ID NO: 126249 - DNA, 2508 bp, Artificial Sequence
  Description of Artificial Sequence: Synthetic coding sequence
atgtggctccttgccctttgtctggtgggtcttgccggcgcacagcggggaggggggggtcctgggggaggagcaccaggcggacctggcctggggctcggatcgctgggtgaggagagattccccgtagtgaatactgcatacggccgtgtcagaggagttcgcagagagctcaacaatgagattctcggacccgtcgtgcagttcctgggcgtaccatatgccaccccgccgctcggagcccgcagattccagccccccgaggctccggcatcttggccaggggtccgcaacgccacaaccctgccccctgcctgcccacaaaacctgcatggcgctctacccgcgattatgctaccagtgtggtttactgacaacttagaagcagctgctacttacgtgcagaaccaaagcgaggactgcctttacttgaacctatacgtacccactgaagacggcccgctcacaaagaaacgggacgaggcaactctaaatcctcccgatactgacatacgggaccctggaaaaaagcccgtcatgctattcttgcacggaggctcctacatggagggtaccggcaatatgttcgacgggagtgtgctcgccgcttatggaaacgtgatcgtggcaaccctgaattaccgccttggtgttctgggatttctcagtaccggcgatcaggcggcaaagggtaattatggcttgttagaccaaattcaggcactgcgctggttatcggagaacattgcccactttggaggggacccagaaaggattacaatctttggttccggcgctggcgcttcctgcgtaaacttgcttattctgtcacaccacagcgaaggactattccagaaagccattgcccaatcaggtacagcaatcagcagctggagtgttaactaccagcccctgaagtatacacggctactggcagctaaggtcggttgcgatcgagaggattcggctgaggccgtggagtgcctcagacgcaaaccaagccgggaactggtggatcaagatgtacaacctgccagataccatatagcttttggccccgttgttgatggagacgtcgtgccggatgatcccgagatcttaatgcagcagggagaatttctgaactatgatatgcttattggagtgaaccaaggagagggccttaagtttgttgaggactcagccgaaagcgaagatggagttagcgcctctgcctttgattttaccgtgagcaactttgttgataacctgtacggataccctgaaggcaaagacgtactcagggagaccattaagtttatgtacaccgactgggctgatagagataatggcgaaatgcgtaggaagaccttactggctttgttcaccgaccaccaatgggtggctcccgccgtggccaccgctaagctccacgctgattaccaaagccccgtgtacttctacactttctatcaccattgtcaggcagagggtagacccgagtgggccgatgccgcacatggggatgaactgccctatgtattcggcgtccccatggtgggggctactgatctcttcccctgcaacttttcaaaaaacgacgtcatgctgtctgcagttgtcatgacttattggaccaatttcgcaaaaacgggggatcctaatcagcccgtgcctcaggacactaagtttatccacacaaaacccaacaggttcgaggaagtggtctggagtaaattcaattcaaaggaaaaacagtacctccacattggcctcaagccccgcgttcgggataattatcgagcgaacaaagtggcgttctggctggagttagttccccaccttcacaaccttcatacagagttgtttactactacaactcgtctccccccttacgcgactcgttggcccccacggccaccagcaggagctcccggcacgcggagacccccacctcccgctactttacctcccgagccagaacctgagcccggtcccagagcatacgaccggttccctggcgactcaagggactactccacagaactgagtgtcacagttgcagtgggagccagtttattatttctcaatattctggcatttgccgcgctgtactacaaaagggatcgccgtcaggaactgcgttgtaggcgtctgtcgcctccgggtggctccggcagcggggtccctggtggtgggcctctcctgcccgctgccggcagggaactgccgccagaggaggagcttgtcagcctgcagctcaagcgcggcggtggcgtgggcgcagacccggcagaggccttgagacctgcctgccccccagactacaccttggccttacgaagggcaccagatgacgtgccgcttttagctccaggggccctgactctgctgccctccggactgggtccacccccccctccgcctcctcctagcttgcatcctttcggtccctttccccccccgccgcccaccgcaacatcacacaacaacacactgccgcacccacactctactactcgagtatag

SEQ ID NO: 126250 - DNA, 2547 bp, Artificial Sequence
  Description of Artificial Sequence: Synthetic coding sequence
atgtggcttcgcctcggcccaccctcactgagcctgagccctaagcctacggtggggagatctctgtgcctgactttatggttcctcagcttagccctgcgtgctagtacacaagctcccgctccaacagtgaatacacattttggaaaactgcgcggtgcaagagtgcccctcccctcagaaatcctcggccccgtggaccagtatctcggggtgccttacgccgcccctcctattggggaaaaaaggttcctgccacctgaaccacccccctcctggtccggtatccggaacgcgacacattttccaccggtgtgtcctcagaatatacacaccgcggtgcccgaggtcatgctccccgtctggttcacggccaacctcgatatcgtggcgacttacatacaggagcccaatgaagactgcctctatctcaatgtgtatgtacctaccgaggacgtgaagcggattagtaaagagtgcgccagaaaacctaacaaaaaaatttgtaggaagggaggtagcggcgccaagaagcaaggggaagacctggctgacaacgacggagacgaagatgaggatatacgagacagcggcgcaaaaccagtcatggtctacatccacggcgggagctacatggagggaaccggcaacatgatcgatgggtctattttagcaagctacggaaatgtgatcgtcatcaccctgaactacagagtcggggttctgggtttcctgagcacaggcgaccaagccgcaaagggcaattacggcctcctcgatcagatccaggcactcagatgggtgtccgagaatatcgcattctttggaggcgatccacgaaggattaccgtttttggcagtggaattggcgcttcttgtgtaagcctgctgaccctgtcccatcattccgagggattatttcagcgtgctattatccagagcggcagcgccttaagctcctgggccgttaactaccaaccagtgaagtatacaagtctgttggcggacaaggtgggatgtaacgttctagacacagttgatatggtggactgcctgcgccagaagagcgcgaaggaactggtggaacaagatattcagccagctaggtatcacgtcgcttttggtccggtaatcgacggcgacgtaattccagacgacccagaaatcctgatggagcagggggagttcctgaattacgacattatgctgggagttaatcagggagagggcctgaagtttgttgaaggcgtggttgaccccgaggatggagtgtctggaacagacttcgactatagcgtgtccaactttgtggacaatttatacggttatcctgaagggaaagacacactccgcgaaactataaaattcatgtataccgactgggcagatagagataatcccgagactaggagaaaaaccctcgtggctctttttactgatcaccagtgggttgagccatccgtggtcactgctgacctacacgcaagatacgggtcccccacctatttctacgccttctatcatcactgccagtccctgatgaaacccgcctggtctgatgctgctcatggggacgaagtgccctacgtgtttggggttcctatggtcgggcctaccgacttgttcccttgcaacttctctaagaacgatgtgatgctcagcgccgttgttatgacctactggacaaattttgctaaaacgggggacccaaacaagcctgtaccccaggacaccaagttcatacacactaaggctaaccggttcgaggaagtggcctggagcaaatacaatcctcgcgaccagttatatctccacatcggactgaagccgagagtgcgcgaccactaccgggccaccaaagtcgctttttggaagcatctggtgccccacctgtataacctacacgacatgtttcactacacctcgactactaccaaggttcccccacccgataccacccattcttcacatatcactagacgccctaatggcaagacctggtcaacaaagagacccgctatctccccagcctactcaaacgagaacgctcaaggatcatggaacggcgaccaggatgctggacccctgctggtagagaaccctagggattattccactgaactgtctgtcaccattgccgtgggcgccagtttacttttcttaaatgttctggcctttgccgccttatactaccgcaaagacaaacgcaggcaagagccactgagacagcccagtccacaacgtggtgctggtgcacccgaattaggcgcagctcctgaagaagaacttgcagcactgcagctcggaccaacacaccacgagtgtgaagctggacccccacatgataccctgcgccttaccgctctgcccgactacacactgacgctacgccggtctccagatgatatcccacttatgactcccaacacaattacaatgatcccaaactccctagtgggtctgcaaactctgcatccatataacaccttcgcggcaggattcaattctaccggattaccccatagccactctactaccagagtgtag

SEQ ID NO: 126251 - DNA, 2487 bp, Artificial Sequence
  Description of Artificial Sequence: Synthetic coding sequence
atgtggctccgcctggggcccccttcgctctccctttctcccaaacctactgtggggaggagcctttgtctgacgctgtggtttctgtcacttgcattgcgcgcttccactcaagctcccgccccaactgtgaatacacacttcggaaaattgaggggcgcgcgcgtgcccctgccgagcgaaattctcggacccgtggaccaatacctgggcgtgccatatgctgccccccctatcggcgagaagcgattcctccctccagagccacctcccagctggtccggtatcagaaacgcgacacactttccccccgtgtgccctcagaatatccacaccgccgtgcccgaggtgatgctaccagtgtggtttactgctaacctggatattgtggccacatacatacaggagcctaatgaggattgtctctatctcaacgtctacgttcccaccgaggacgggtccggcgctaaaaagcagggagaggatctcgccgacaacgatggggacgaggatgaagacatccgcgactctggagcgaaacctgtaatggtctacattcatggcggatcatacatggagggaacggggaatatgatagacggaagtatccttgcgtcctacggcaatgtgattgtgattaccctaaactacagagtgggcgttttgggttttttgagtaccggggaccaggccgcaaaaggaaattatggattactcgatcagatacaggctctgaggtgggtgtcagagaatatcgcattcttcggaggcgatccccggaggattacagtgttcggctcaggaatcggtgcttcctgtgtctcactcctgacccttagtcatcatagcgagggattgttccaacgggccatcatccagagtggtagcgccctgtcttcctgggccgtcaactatcagcctgtgaaatatacaagtctgctggctgacaaggttgggtgcaatgtattagacaccgttgatatggtggactgcctgcgccaaaagagcgcaaaggaactggtggaacaagatattcagccagctcgttaccacgtggccttcggcccggtcatcgacggggacgtgattccagatgacccagaaattctaatggagcagggggagttccttaactatgacatcatgctgggcgtgaatcagggcgaaggtctgaaatttgttgaaggtgtggtcgacccagaggatggagtgtcgggaactgacttcgactacagtgtgagcaacttcgtcgataacctgtatggataccctgagggcaaagacacactgcgagagaccatcaagttcatgtatacggattgggctgaccgagataatccagaaacacgccgaaagacactggttgccctattcaccgatcatcagtgggtggagcccagcgtggtgacagccgacctgcatgcccgctatgggagccctacttacttctatgccttttaccatcattgtcagtccctgatgaaacctgcttggtcggacgctgctcacggggatgaagttccatatgtgttcggggtgcctatggtcggcccaacagatctgttcccctgtaattttagcaaaaacgatgtgatgcttagcgctgttgtcatgacatactggaccaactttgccaaaaccggcgatcccaataagcctgtccctcaggacacaaaatttattcacacaaaggccaatcgattcgaagaggtggcatggtctaagtacaatcctagagaccagctgtatctgcatatcggccttaagccacgtgtgagggaccattatcgcgcaactaaagtggctttctggaagcacctcgtgccacatttatataatctgcacgacatgttccactacactagtaccacgaccaaagtgccgccgccggacaccactcatagctctcatattacccgtcgaccgaacgggaagacctggtccacaaagcggcccgctatttcacccgcttattccaacgagaacgctcagggctcatggaacggcgatcaggatgctggccccttattggtggaaaatcccagggactacagcactgaactgtcagtcaccatcgcagtgggtgcctccctcctttttctgaatgttttggcgttcgccgcgctgtactatcgcaaggataaaagaaggcaggagcccctccggcagccctccccacaacgtggcgccggggctccagagttaggcgctgcccccgaggaggaacttgctgcactgcagttgggcccaacccaccacgagtgtgaggctggtcctccacatgatacattaaggttaactgcgttgcccgactacaccctgacccttagacggtctcccgacgacattcccctgatgacaccaaatactatcactatgattccaaactcgctcgtggggctccagactctgcatccctacaacacatttgccgcgggattcaacagcactggcttaccgcattctcactccacaactagagtgtag

SEQ ID NO: 126252 - DNA, 1542 bp, Artificial Sequence
  Description of Artificial Sequence: Synthetic coding sequence
atgtggctacgtctcggcccaccaagcttgtcattgtctcccaagcctactgtgggtaggtccctgtgtcttaccctgtggttcctaagtctcgcccttagggcttcaacgcaagcacccgccccaacggtgaacacgcattttggcaagcttcgaggtgcacgggtccctctcccttcagagatactcggacctgtagaccaatatcttggtgtgccctacgcagctcctccaatcggtgaaaagcggtttctgccccccgagcctcctccctcttggtctggaatccgcaacgctacacactttccacccgtgtgtccccaaaacatccacaccgccgttcccgaagtgatgttgccagtctggttcacagctaatctggacattgtggctacatacatccaagagccgaatgaggactgtctatatctgaacgtctatgtgccgaccgaagatgacattcgcgacagcggagccaaacctgtcatggtgtatatccatgggggttcgtacatggaaggcaccggcaatatgattgacgggtctatcctggcgagttatgggaacgtgatcgtgatcacactgaattatagagtgggagtgctagggtttttgtctaccggagatcaggctgctaaaggtaattatggccttctggaccaaattcaggctttacggtgggtctcagagaatatagccttctttggtggagatccccgccgcatcacagtatttggaagcggaatcggcgcctcttgcgtgagtcttttgactctgtcccaccactccgaggggctatttcagcgcgctattatccagtccggctcggcattgagctcctgggctgtgaactatcaaccagttaaatacaccagtctcctcgcagacaaggtggggtgcaacgtgctggacacagtagacatggtggactgtcttagacagaaatccgctaaggagcttgttgagcaggacatccaacctgcccggtaccacgttgctttcggacccgtgatcgacggcgacgtaattcctgatgacccagagattctcatggagcaaggagagttcctcaattacgatataatgctcggtgtgaaccagggcgaaggcttgaaatttgtcgagggtgtagtggacccagaggacggagtcagcggcaccgacttcgattactcagtttccaacttcgtggacaatttgtacggctatcctgaaggcaaagatacgctgcgggaaactattaagtttatgtataccgactgggctgatcgcgataaccctgaaacacgcaggaagacgcttgtcgccctgtttactgaccatcaatgggtggaacctagcgttgtgacagcggatctgcatgccagatacggcagtcccacctacttttatgccttctaccaccactgtcaaagccttatgaaacccgcttggtctgacgccgcccacggagacgaggtaccatacgtgttcggggtccctatggtggggccaaccgacttgtttccctgtaatttcagcaagaatgacgtgatgctgtag

SEQ ID NO: 126253 - DNA, 2427 bp, Artificial Sequence
  Description of Artificial Sequence: Synthetic coding sequence
atgtggcttcgtcttggcccaccatctctgtccctaagcccaaagccgacagtgggcaggtctctctgtctgacactgtggtttctcagtttggcactgcgcgcctctactcaggctccagcacctacagtgaacacccatttcgggaagctaagaggggctagggtccccttgccaagtgaaattctaggccccgttgatcagtacctgggggtgccctacgcagcacccccgattggcgagaaacggttcctgccccctgagccccctccgtcttggagcgggattagaaacgcaacgcattttccaccagtgtgcccacaaaacatacacaccgctgtcccggaggtcatgttgcccgtgtggttcacggcaaatctggacatcgtggccacgtacattcaagagcccaacgaggactgtctgtacctgaatgtgtacgtgccaactgaggacgacatccgcgactctggggccaagcctgtgatggtgtacattcatggcgggtcgtatatggagggtaccgggaatatgattgacggcagcatcctggctagttacggaaatgttatcgtcatcacacttaactaccgggtgggagtgctcggcttcctgtcaactggcgaccaagccgcaaagggaaattatggcctgcttgaccagatccaggcgctccggtgggtatctgagaatatcgccttctttggaggtgacccaagacggattaccgtgttcggctcagggatcggcgcttcctgtgtcagcctgctgacactctctcatcactcagagggtctgttccagcgcgcgattattcagtccggatccgcactgagctcttgggcagtaaactatcagcctgtaaagtatacttccctgctggccgataaggtgggctgtaacgtgttggacacagtggatatggtcgactgtctcaggcagaaatccgccaaggaattagtagaacaggacatacagcctgcccgctaccatgtggctttcgggcccgttattgatggcgatgtaataccggatgaccccgagattctgatggaacagggcgagttcctgaactacgacattatgctgggtgttaaccagggcgagggactgaaatttgttgaaggggttgttgacccagaggacggggtgagcggtacagacttcgactactccgtctcaaacttcgtcgacaacctgtatggatacccagaaggaaaggatacacttagagagacaatcaagttcatgtacaccgactgggccgacagagacaacccggaaactagacgcaagacattagtcgctctcttcactgaccatcagtgggtggaaccatcagtggtgacagcagacctgcacgccaggtatggcagccccacctacttctacgccttctatcatcactgccagtccctgatgaagccagcttggtccgacgcggctcacggcgatgaagttccctatgtatttggggtgccaatggtgggccctactgacctgtttccttgtaatttctcaaaaaatgatgtgatgctgtcagctgtagtcatgacatactggacaaattttgctaagaccggtgacccaaataaacctgttccccaggacacgaaatttatccacaccaaagcaaataggttcgaggaagtagcctggagcaagtacaacccacgggaccagttatacctgcatatcggccttaaacccagggtgagggatcactatcgcgcaaccaaggtagcgttctggaagcacctggttccacacttatataacttacatgacatgttccactatactagcacaaccactaaagtcccaccccccgataccactcacagttcacatattactcggcggccaaatggcaagacctggtcaacaaagagacccgcaatatctccagcatattccaatgaaaacgcccaaggctcttggaacggcgatcaggacgcaggcccactcctggttgagaacccacgggattactcaaccgagttaagtgtcaccatcgccgtgggggcctctctcttgttcctgaatgttctcgccttcgccgccctgtactatagaaaagacaagcggcggcaagagcctctaaggcaaccctctcctcaacggggagccggggcacccgaactaggcgctgcacctgaggaggaactggcggcactccaactgggaccgacccaccatgagtgcgaagcgggacctccccacgatacattgaggctgaccgccctcccggactacacattgacgctgaggagatcaccggacgacattcccttaatgacgccaaacaccatcaccatgattcctaatagtctcgtcggtttacagacgcttcatccatataacactttcgccgccggcttcaactcgacaggcctcccacactcacactccactactcgagtgtag

SEQ ID NO: 126254 - DNA, 1056 bp, Artificial Sequence
  Description of Artificial Sequence: Synthetic coding sequence
atgctgcccgtgtggttcactgcaaatctggatatcgtcgcaacttatatccaagaacctaatgaagactgcttatacctaaatgtttacgtacctaccgaagacggatctggggcaaagaaacagggcgaagatttagccgacaacgacggagatgaggacgaagacattagagattccggagctaaacccgtgatggtctacatccacgggggaagctacatggaaggaactggtaatatgatcgacggttcaattctggcgagttatggtaacgtcattgttataacactgaattacagagtcggggttcttggttttcttagtaccggcgaccaagctgccaaaggcaattatgggctgctggaccagatccaggcattacgatgggtctctgaaaacattgctttcttcggaggagaccccagacgtatcaccgtgttcggatcgggcattggcgcatcctgcgtgtcactccttacactcagtcaccactccgaaggattgttccaacgggccatcatccagagcggctcggcactcagcagctgggccgtgaattatcagcctgttaaatacacaagtctccttgcagacaaggtgggttgtaatgtactagacacagtggacatggttgattgcctccgccagaagagcgctaaagagctggttgagcaagatattcagccagcgcggtaccacgtcgcattcgggccagtcatcgatggagatgtgattccggatgaccccgaaattctgatggaacagggagagttcctgaactatgatattatgttgggggtgaatcagggagaaggattgaaattcgtggaaggggttgtcgaccccgaagatggagtctcaggaaccgactttgactatagcgtctctatcctttggacgatctgcatggcaattctcagagtccggaccccatgtgaacgccccagcagttcctgcatccagacggggcaaaccgtgacaaccttgcgacccgcagttaaacactggtggcactctagtttgacaacaagcggctggagtccacagtggtag

SEQ ID NO: 126255 - DNA, 771 bp, Artificial Sequence
  Description of Artificial Sequence: Synthetic coding sequence
atgcttagaccccagggactgctgtggctccctctgctgttcacatcagtgtgtgtcatgttgaactcgaatgtgctactgtggattacggctttggccataaaattcaccctaatcgatagtcaggcccagtaccccgttgtgaataccaattatggaaagattcaaggactacgaacccccctgcctagcgagattcttggccctgtggagcagtatcttggcgtgccctatgcttccccgcccacgggtgagcggagattccagccacctgagtcgccgagctcttggactggcatccgaaatgccacacagttctcagcagtatgtcctcagcacctcgacgaacgcttcctgctgcacgacatgctgcctatctggttcaccacatcgttggacaccctgatgacctacgtccaggatcagaacgaggattgcttgtacctgaacatctatgtccccatggaggatggtacaaatattaagcgaaatgccgatgacattactagtaatgatcacggagaggacaaggatatccacgaacaaaactcgaaaaaacccgtaatggtttacattcatggagggagctatatggaggggacgggaaacatgattgatggctcaatcctggccagctacggtaacgtcattgtgatcactatcaattaccggctgggcattcttgggatgcaggaggctaggctctgcggctcctcaaaaatgttcaactatttcaagagcccatttaccaatctgattaattttttctag

SEQ ID NO: 126256 - DNA, 2451 bp, Artificial Sequence
  Description of Artificial Sequence: Synthetic coding sequence
atgctgagaccccagggcttactgtggttacccctcttatttaccagtgtctgcgtgatgctcaacagtaatgttctcctatggatcaccgctttggccattaaatttacgctgatcgacagccaagctcaatatcccgtggtaaacacaaactatggcaagattcagggactgcggaccccacttccctctgagatcctcgggccggtggagcaatacctcggcgttccatatgcatctcctcctactggtgagcggcggttccagcctcctgaaagccccagttcttggaccgggatacgaaatgccacacagttcagcgccgtatgtcctcaacacttagatgagcgtttcctgctgcatgatatgctgcccatatggttcacgaccagcctggatactctgatgacctacgtgcaagaccagaatgaagattgcctttatctcaacatatacgtgcccatggaggatgacattcacgaacagaattccaaaaaacccgtgatggtttacatccatgggggctcatatatggaggggaccggtaacatgatcgacggcagcatccttgcttcatacgggaacgtcatcgtgataaccatcaactatcgtcttggtatcttgggcttcctgagcaccggcgatcaggccgcaaaggggaactacggactgctcgatcagatacaggccctgagatggatagaggaaaacgtgggtgcgttcggaggcgaccccaaacgggtaaccatcttcggaagtggggcgggcgcctcctgcgtgtcattactgacgttgtcacactactcagaaggcctgttccagaaagcaatcattcaatctgggactgcactttctagctgggccgttaactaccagccagccaagtatacacgaatactggccgacaaggtggggtgtaatatgcttgataccacagacatggtggagtgcctcaaaaataagaattataaggagctgatccagcagacaattacccctgctacctatcacattgctttcgggcctgtgattgacggcgacgtcattcctgatgaccctcagatacttatggagcagggcgagttcttaaattatgatattatgctgggggtgaatcagggggaaggcctgaagttcgtcgatggaattgtggacaatgaggacggtgtcacacctaatgactttgattttagcgtgtctaacttcgttgacaatctgtacgggtatcccgagggaaaagatacactgagagagacaatcaagtttatgtataccgactgggccgacaaggaaaatcctgaaacaagaagaaagaccctcgtcgctctgtttaccgatcaccagtgggtggccccagcggtggccacggccgacttacacgcccagtatggctcccccacatacttttacgccttctaccaccactgtcagtctgagatgaagccttcctgggccgattctgcacacggggatgaggttccctacgtcttcggcatcccaatgatcggacctacggaactgttcagctgcaacttttccaaaaatgacgtgatgctttctgctgtcgtgatgacttattggactaactttgctaaaacgggagatccaaatcagcccgtgccccaggatactaagttcattcacactaaaccaaatcgcttcgaagaagtggcttggagcaaatataacccaaaggatcagctgtacttgcacataggactgaaacctcgcgtgcgcgatcattaccgcgcaactaaggtggcattctggctcgaactggtgccccatcttcataacctaaacgagatcttccagtacgtctctactaccaccaaggtaccaccccctgatatgaccagctttccgtacgggacccgaagaagcccagcaaagatatggccgaccaccaagcggcccgcaattactcccgctaataatccaaagcactccaaagatcctcacaaaaccgggcctgaagacaccaccgtcctgatagaaacaaagcgggattattccacagaactgtctgtaacgattgcagtgggggctagccttctgttcctgaacattctagcttttgccgctctatactacaaaaaggacaagaggcggcatgagacccacagacatcccagcccgcaaaggaacacgactaacgatatcacccatattcagaacgaggagataatgagtctgcaaatgaaacaactggagcacgaccatgagtgcgagtccttgcaggctcacgacaccctccgactaacgtgtccccctgattataccctcactctgagacggtccccggacgatatcccattcatgacacccaacacaattactatgattcccaacacgcttatgggcatgcaacccctccatactttcaagaccttttctggtggtcaaaactcaacaaacttgcctcatggacattctacaacaagggtgtag

SEQ ID NO: 126257 - DNA, 2451 bp, Artificial Sequence
  Description of Artificial Sequence: Synthetic coding sequence
atgctgcgacctcagggactgctgtggctgcctctgctgttcacaagcgtctgcgtaatgcttaacagtaacgttctgctgtggattaccgcactggccatcaaatttaccctgattgatagccaggcacagtaccccgtggttaatactaattatggtaaaattcagggccttcgcacccccctgccatctgagatcctcgggcctgtcgaacagtatttgggcgtaccttatgcatccccccccacgggagagagaagattccaaccgcccgagtcccccagtagctggacagggattcgcaacgctacccagtttagtgcagtctgtccccaacatctggacgagagattccttctgcacgatatgctaccgatatggtttacaaccagtctggacacgttgatgacgtacgttcaggatcagaatgaggattgcctttacctgaatatctacgtccccatggaagacgatatccatgaacagaatagcaaaaagcccgtgatggtttacattcatggtggatcctacatggaaggaaccggaaacatgatcgatgggtctatcctggcttcctatggtaacgttatcgttattacaattaattaccgcctgggtatcctcggattcctgtccactggcgatcaggctgcaaaagggaattacggactgcttgatcagatacaggccctcaggtggattgaggagaacgtgggggcctttggaggagaccccaagagagttacaatttttggctctggagcgggagcctcatgtgtttccctgttaaccctttctcactactctgagggattgttccagaaggccatcatccagtcaggcactgctttgagtagctgggccgtgaattatcagcctgctaagtataccaggatcttagccgacaaagtagggtgtaatatgcttgatactacagacatggtggaatgcctgaaaaacaaaaactataaggagttaatccagcaaactattaccccagctacataccacattgcctttggacccgtgatcgacggtgacgtcatccctgatgacccacagatcctgatggaacagggagagttcctcaactacgacatcatgctgggagtgaaccagggggaggggctgaagttcgtggatggcattgtggataacgaagacggtgtgactcccaacgacttcgacttttccgtctctaactttgtggacaatctctacggctatcccgagggcaaggataccctccgcgaaactatcaagttcatgtatactgattgggctgataaagaaaatccagagacaaggaggaagactctggttgcgctgtttacggaccaccagtgggttgcaccagccgtggctacagccgatctccatgcccaatatgggagccccacttatttttatgcattttaccaccattgccaatctgaaatgaaaccaagctgggcggactctgcacatggggacgaggtaccgtacgtattcgggatcccaatgatagggcccaccgagctgtttagctgcaattttagcaaaaatgatgtgatgctatctgccgtggtaatgacatactggacaaacttcgccaaaacgggagacccaaatcagccagtgccgcaggatacaaagtttattcacaccaaacccaacaggttcgaagaggtcgcctggtctaagtacaatcccaaggatcagttatacctgcatataggcctgaaaccacgcgtcagggatcactatcgtgccacgaaagttgcattttggctggagctggtgccacacctgcacaacctgaacgaaatcttccaatacgtttctaccactacaaaggtgcctccgcccgatatgaccagcttcccatatgggacaaggaggagtcccgctaagatctggcctacaaccaaacgccccgccataacacccgcaaataaccctaagcactctaaagacccccataaaacaggacccgaggacactactgtgctcatcgaaacaaagcgtgactacagcactgagctgagtgtgactattgcagtaggagctagccttttatttctaaacattctcgcctttgcggcgctttactacaagaaagacaagcggcgccacgagactcatcggcatcccagtcctcagaggaatactaccaatgacatcacccacatacagaacgaagaaattatgtctctgcagatgaagcagctggagcacgatcacgaatgtgaaagcctgcaggcacacgatactctccgcctgacctgccctccagattatactctcacactcaggcggagtccagacgacatcccctttatgaccccaaatactataaccatgatcccaaacaccctgatgggaatgcagccgttacacaccttcaaaactttcagcggcgggcagaattcaactaatcttccgcacggacattctacaaccagagtgtag

SEQ ID NO: 126258 - DNA, 2622 bp, Artificial Sequence
  Description of Artificial Sequence: Synthetic coding sequence
atgctcagaccccaggggctcctatggctgccactgctctttactagcgtgtgtgttatgttaaacagcaacgtactcttgtggataactgcattagccatcaagttcacgctaatcgactctcaggctcagtaccctgtggtgaatacaaactacgggaaaatccaagggctgcgcactccccttccaagcgagatcctcgggccagtggaacagtacctgggtgtgccatacgcttcgccaccaactggagaacgacgctttcagccgccggaaagcccttctagttggacaggcataaggaatgcgacccagttctcagccgtgtgtccacagcacttagacgaaagattcttgttgcatgatatgttaccgatttggttcactacatcattagatactttgatgacttacgtccaggaccagaatgaagactgcctgtatcttaacatctacgttcctatggaggacggtaccaacattaagcggaatgcggacgacatcacatccaatgaccatggtgaggacaaagatatccatgagcagaactctaagaaaccagtgatggtttacatccacggggggagttatatggaaggcaccggaaacatgatagacggtagcattctggctagctatggtaacgtgatcgtaattacgattaactatagacttggcattctggcccagaatacactggcccacgggaactgcaagcaccgctgtcaactgcacctacaagccccacgggactgtaaatctgcctatccgtttcgcaatgaggatgaaatccgtggcttcctgtcgaccggcgaccaggcagcaaaggggaattacggattgctcgatcagatccaagcactgcgttggatcgaggagaatgtcggggcctttggtggcgaccctaaacgggtgacaatttttggaagcggcgccggagcctcctgcgtatccctcttgaccctgtctcactattccgagggcctctttcagaaggcaataatacagtctggcactgctctgtcgagctgggcggtaaactaccaacccgctaaatatacgcgtattttggcggataaggtcgggtgtaatatgctagacactaccgatatggtggaatgtttaaaaaacaaaaactacaaagagttaatccagcagactatcacacccgccacctatcacattgcttttgggcccgtcattgacggagatgttattcccgatgatccccagattctgatggagcaaggagagttcctgaactacgatattatgttaggcgtgaatcagggagaaggcctgaaattcgtggacggcatagtggataacgaggacggagtaacccccaatgacttcgacttttccgtgagtaacttcgtggataatctgtacggctaccctgaaggtaaggataccctgcgcgagaccataaaatttatgtacacagattgggccgacaaggaaaatcctgagacgcggagaaaaaccctggttgcactctttactgaccaccagtgggttgcgcccgcagtggctacagcagatctgcacgcgcaatatggctcaccaacctacttctatgccttctaccaccactgtcagtccgagatgaaaccgtcttgggcagattcggcacacggcgacgaggtaccttacgtgtttggtatcccaatgattggccccactgagcttttctcctgcaacttctctaaaaatgacgttatgctgagcgccgtcgtcatgacatattggacaaacttcgccaagacgggggacccaaaccagccggtccctcaagatacaaaatttattcacactaaacccaacaggtttgaggaggtagcttggagcaagtacaatcccaaagatcagctgtatctccatatcggactcaaaccgcgtgtgagggaccattacagggcaacaaaggtggctttctggttagagctcgttccccatctgcataacttgaatgagatatttcaatacgtatctactactactaaggtccccccaccagatatgacctcctttccatacggtacacggagaagcccggcaaagatttggcctactactaaacggcctgcaattacaccagcgaacaaccccaaacactcgaaggatcctcacaagacgggaccagaggacaccactgttttgattgaaactaagcgcgattacagtacagagctgagcgtgactatcgccgttggtgcctcactgctgtttttaaacatcctagcattcgcagcactctattataaaaaagacaagcgaaggcacgaaactcacaggcatccaagtccccagcgcaataccactaatgatatcacgcatatccagaacgaagaaatcatgtcattacagatgaagcagttagagcacgaccacgaatgtgagtctctgcaggctcacgatactctgcggttgacatgtccacctgattacacgcttacactgagacgatctcccgacgacattccttttatgacccctaatactatcaccatgattccaaatacactaatgggaatgcagccactgcacactttcaagaccttcagcgggggccaaaatagcactaatcttccacacggccattcgacgaccagggtttag

SEQ ID NO: 126259 - DNA, 1947 bp, Artificial Sequence
  Description of Artificial Sequence: Synthetic coding sequence
atggtgtacattcacggtggttcatatatggagggaaccgggaacatgattgatgggagtatccttgccagctatggtaatgtgatcgtgatcacgatcaactatcgacttggcattttgggtttcttgtccaccggcgaccaggcagctaagggaaactacggcctcttagatcagatacaggccctgagatggatagaggaaaacgtcggagcctttgggggagacccaaaacgcgtaacaatctttggtagtggagccggcgcaagctgtgtcagcctgctgacactcagccactattccgaaggactgttccagaaagcaattatccagagcggcacggcactatcttcatgggctgtgaactaccagcccgcaaagtatacacggatcctggccgataaggtaggttgcaatatgttggacaccactgatatggtggagtgtctgaagaacaaaaactacaaagaactcattcagcagactattaccccagctacgtaccatatagcttttggccccgtaatcgacggcgatgtgattcccgatgacccgcagatcctgatggaacagggcgaattcttgaattatgatataatgctaggtgtaaaccagggagaaggcctaaaattcgtagatggaatagtggataacgaagacggagtcacaccaaatgacttcgactttagcgtcagcaacttcgtcgataacctttatgggtatcccgaagggaaagatactctgagggaaacaattaaattcatgtacaccgactgggctgacaaagagaatcctgagacgagacgtaagaccctcgtggccctgttcacagaccaccaatgggttgcacccgcagtggctacggccgacctgcacgctcagtatgggtccccaacctacttttacgccttctaccatcattgtcagtctgagatgaagccaagttgggccgattctgctcacggagacgaggtaccgtacgttttcggtatacccatgatcggacctacagagctcttcagctgtaactttagtaagaacgatgttatgttgagtgccgtggttatgacatactggaccaatttcgccaagaccggagaccctaatcaacccgtgccccaggacactaaattcattcacaccaagcccaatcggttcgaggaggtggcctggagcaagtataacccaaaggatcagctctatctgcatatcggcctgaagccccgtgttagggatcattatcgtgccacgaaggtggccttttggctggagctggtgccgcaccttcataacctcaacgaaatctttcagtatgtaagtaccacaacaaaggtgcctcctcccgatatgaccagtttcccatatgggacacgacgatcgcccgctaagatttggcctacgacgaagaggcccgctatcacaccggccaataaccccaagcacagtaaagatccccataagacaggtcccgaagacactacagttttgattgaaactaaacgagactactccacggagttgtcagtgactattgctgttggcgccagcctattgttccttaacatcctggcctttgctgctctgtattataaaaaggacaagcggcggcatgagactcatagacatccctctccacagaggaatacgaccaatgatattacgcatatacagaacgaagaaatcatgagcctgcagatgaagcagctggaacacgatcacgagtgcgagtcattgcaagcgcacgacaccctccgtctgacatgtccaccggactacacgctgactctcagaagatcacccgatgacatcccttttatgactccaaacaccatcaccatgatccccaacacactcatgggcatgcagccgctccacaccttcaaaaccttttcaggtggacagaacagtacaaatctcccccacggtcactccaccaccagggtgtag

SEQ ID NO: 126260 - DNA, 711 bp, Artificial Sequence
  Description of Artificial Sequence: Synthetic coding sequence
tagaattcaaatgtactgctatggatcaccgctctcgcaattaagtttacactgatcgacagccaagcacagtacccggtggttaacacaaattatggcaaaattcagggcctccgaacacctcttccatccgagatcctggggcctgtggagcagtacctgggcgtaccctacgctagtcctcctacaggcgaacggcgattccaaccccccgagtctccatcgtcctggaccgggattagaaacgcaacacaattcagcgctgtgtgcccgcaacacctggacgaaagattcttgttacatgacatgttgcctatatggttcaccacctcactcgacactcttatgacttacgtgcaggatcagaatgaggactgcctctatctgaatatctatgtgccaatggaagacggtaccaacataaaacgcaacgcagacgatatcactagtaacgatcacggcgaggacaaagacatccatgaacagaattctaaaaaacccgttatggtctacatccacggtgggtcctatatggaagggaccgggaacatgattgatggcagcatcctggcctcctatgggaacgttattgtgatcaccatcaattatcgcctggggattctgggaatgcaggaagcaagactctgcggatcaagtaagatgtttaattactttaagtccccctttaccaatctgattaatttcttttag

SEQ ID NO: 126261 - DNA, 2511 bp, Artificial Sequence
  Description of Artificial Sequence: Synthetic coding sequence
atgctccggccccagggtctcctgtggcttcccctgctctttacttccgtatgcgttatgttgaacagtaacgtgctcctctggattaccgcactagcgataaaattcactctgatagactctcaggcccagtatcctgtggtcaatacaaattatggcaagatccaagggctaagaacccccttgcctagcgaaatcctggggcctgtcgagcagtatctgggagtgccttacgcgagcccgcctacaggcgagcggagatttcagccacccgagtccccttccagttggacggggatccggaatgccacgcaatttagcgctgtttgcccacagcatctcgacgagagatttctcctccatgacatgttgccgatatggttcactacatccttggatacactgatgacatacgtccaagaccagaatgaagactgcctctatctgaacatttacgttccgatggaagatggcaccaacattaaacgcaatgccgacgacatcacgagcaatgaccatggagaagacaaagacattcatgagcagaattctaagaagcccgtgatggtgtatatccacgggggctcatatatggaaggtactgggaatatgattgacggtagcattctggcctcatacggaaacgtcattgtgataaccattaactatagacttgggatccttggctttctctcaactggcgaccaggctgccaaagggaactacggtttgctcgatcagattcaagcgctgcggtggattgaagaaaacgtgggagccttcggaggagacccaaaacgagtcacgatctttggcagcggtgcaggcgcaagctgcgtcagcttgctgaccctcagtcactatagtgagggcctctttcagaaggcgattatccagtcaggaacagccctgtcctcctgggcagtgaattatcaaccagccaagtacactcggattctagccgacaaagtgggctgtaacatgctagatactactgatatggtagaatgtctcaagaataagaattacaaggaattaattcagcaaacaatcacccccgccacatatcacattgcctttggaccagttattgacggcgacgtgattccagacgaccctcagatattgatggaacagggagaattcctgaattacgacataatgcttggagtgaatcaaggtgaagggttaaaattcgtcgacgggattgtggacaatgaagacggcgtgactcctaacgactttgatttctctgtgtccaacttcgtcgacaacctgtatggataccccgagggcaaagataccctccgtgagaccattaaattcatgtacacagattgggctgacaaggagaatcctgagacacgacgcaaaactctggtggcactgtttaccgatcaccagtgggtggcgcccgcggtggcaaccgccgacttgcatgcacaatacggtagcccaacatatttctatgccttttaccatcactgtcagagcgaaatgaagccgtcatgggccgattctgcgcacggagatgaggtcccttacgtattcggcatacctatgatcggccctactgagttattctcatgcaatttcagcaaaaatgatgtgatgctgtccgcggtggtgatgacttactggaccaattttgcgaagaccggtgaccctaaccagcccgtacctcaagacaccaagttcatccataccaagcctaatcgctttgaggaagtggcctggagcaaatacaaccccaaggatcagctgtatctgcacattgggctcaagccccgggtccgagaccattacagggctactaaggtggccttctggctcgagctggtgccacatttacacaatttgaacgaaatcttccaatacgtgagtacaactacaaaagttcccccccctgatatgacgagctttccttacggaacaagacggtctcccgccaaaatctggccaacaaccaagcgtcccgcaatcaccccagcaaataaccccaaacatagcaaagatccccacaaaaccgggcccgaggacacgaccgtgctcatcgagaccaaacgggactactccacagagctctccgtcacaattgcagtgggcgcctcccttctcttcctaaatattctggctttcgccgcactgtactacaagaaggataagcgcagacatgaaactcacagacacccctcaccccaacgaaatactactaatgacatcacccacatccagaatgaagaaattatgtcacttcagatgaaacagctggaacacgatcatgaatgtgagtctctccaagctcacgacacactcaggttgacctgcccacctgattatactctgacactgagaagaagccctgacgatattccattcatgacaccgaacacaatcacaatgatccctaatactcttatgggaatgcagcctctgcatactttcaagacttttagtgggggccaaaattctaccaatctcccccatggccactctacaacgcgcgtgtag

SEQ ID NO: 126262 - DNA, 1824 bp, Artificial Sequence
  Description of Artificial Sequence: Synthetic coding sequence
atgatcgccaggtgtttactggctgtgcgcagtctcaggagggtgggtggctctaggatcctattgagaatgacgctggggcgggaggttatgagtcctctccaggccatgtcaagctatacagtcgccggaaggaatgtactgagatgggacctttccccggaacagataaaaaccagaaccgaggaactgatcgtgcaaacgaaacaggtctatgacgcagtagggatgctggggatagaggaagtgacatatgagaattgcttacaggccctggctgacgtcgaggtgaaatacattgtagaacgcacaatgcttgactttccacaacacgtgtccagtgacaaggaggtccgtgccgcgagtaccgaagccgacaaacgcctgtctagatttgatatagaaatgtcgatgcgcggggacatcttcgaacgcatcgttcatctacaggaaacgtgtgatctcggaaaaatcaagcctgaagctagacgttacttggaaaaatccatcaaaatgggaaaacggaatggactccatttgcctgagcaagtgcagaatgagataaagtccatgaagaaacgcatgtcagaactgtgtattgacttcaataagaacttgaatgaggacgatacattcctggtgttcagtaaagctgagttaggtgccctcccagacgattttatcgacagtttagagaagaccgacgacgataagtacaagataaccttaaaatatccccactacttcccggtcatgaaaaagtgctgtattccagagactcgaagaaggatggaaatggcgttcaacactcgctgcaaggaagaaaacaccatcattctacagcagcttcttcccctccgtaccaaggtcgctaagctgctagggtactcaactcacgctgattttgtattagagatgaatacagccaagtccacatcccgcgttacggcctttttagacgatctgtctcagaaactgaagcccttgggagaagcagaacgtgagtttattttgaatctcaagaagaaagaatgcaaggataggggtttcgagtacgacggaaagatcaatgcgtgggacctttactattacatgacccagaccgaggaactgaagtactctatagaccaggaattcttaaaggagtactttccaatcgaggtcgtgacggaagggcttctcaacacttatcaagaattactggggctgagcttcgaacagatgactgacgcccacgtgtggaataaaagtgtcacactgtatacagtcaaggataaggccactggggaggtgctcggacagttctacctagacctctatccgagagaggggaaatacaatcatgctgcctgcttcgggctgcaacctggctgtctgctgcctgatggatctagaatgatggctgtggcggcacttgttgtcaacttctctcagccggtcgctggtagaccaagcttactgcgccacgacgaggtacgaacatactttcacgagttcggacacgtgatgcaccaaatttgcgcacaaactgactttgcacggttctcagggacaaatgttgaaaccgattttgtggaagtgccatctcagatgctcgagaattgggtatgggatgtagatagtctcaggcgactgtctaagcactacaaggacgggtctccaatcgctgacgatctgctggagaagctggtggcgagtcgccttgtcaacaccggactcctcacactgaggcagatcgtgctctctaaggtggatcagtcattgcacactaataccagtcttgacgccgcctccaacatgcctaatacggcgcagaagtactag

SEQ ID NO: 126263 - DNA, 2115 bp, Artificial Sequence
  Description of Artificial Sequence: Synthetic coding sequence
atgattgcgagatgtctcctcgcagtacgctctttgcgtagggtgggaggatccagaatcctgttgcgtatgactttggggcgtgaagttatgtctccactgcaggccatgtcctcatatactgtcgcagggaggaatgtcctgcgatgggatctcagccctgaacagataaagacaagaaccgaagaactaattgtccagaccaagcaagtatacgacgccgtgggtatgctgggtattgaggaggttacgtacgagaactgtctccaggctcttgctgacgttgaagtcaaatacattgttgaacgcaccatgcttgacttcccccagcacgtctcttccgataaagaggtacgggcagcgagtacagaagccgacaaacgtcttagccgctttgacatagagatgtccatgaggggtgatatctttgaacgcatcgtccacttgcaggagacctgtgacctaggtaaaatcaagccagaagctcggcgctacttagagaagtccattaaaatgggcaaaagaaacggattgcacctcccggagcaggtgcagaatgaaattaagagtatgaaaaaacgcatgtccgaactctgcatcgacttcaataagaatctgaatgaggacgacacgtttctggtgttttccaaagctgagcttggcgccttacctgatgacttcatcgacagcctggagaaaaccgatgacgacaaatacaaaatcaccctgaagtacccgcactactttccagtgatgaagaagtgttgtataccagagacccgccgccgaatggaaatggcttttaatacccggtgcaaggaggaaaacacaataattcttcagcagctgctccctctgcggacaaaggtggctaagctgctaggatattccacgcatgcggatttcgtcttggaaatgaataccgctaagtccacctcgagggtgacagcattcctcgatgaccttagccaaaagctcaaaccactaggggaggccgaacgtgagttcatactcaacttaaagaaaaaagaatgtaaggaccggggcttcgaatatgatgggaagatcaacgcatgggacctgtattactacatgacacagaccgaagagctcaaatatagtattgaccaggagttcctgaaagagtactttccaatcgaagtggtgactgagggattactgaatacctatcaagagctgctcggtctgtcattcgagcagatgaccgatgcccatgtgtggaataagagcgttacgctttacaccgtaaaagacaaggctacgggcgaggtgttggggcagttttacctcgacttgtacccacgggagggcaagtacaatcacgctgcatgttttggtctccaacccgggtgcctgctgccagacggaagcagaatgatggctgtggcagccctggtagtgaacttctctcaaccggtggctggacgcccatcccttctgagacatgacgaagttagaacctactttcacgaatttggtcatgtaatgcaccaaatctgtgcccaaaccgactttgccaggtttagtggtacaaacgtggaaaccgactttgtcgaggtgccctctcagatgttagaaaactgggtgtgggacgtcgactccctacggcggctgtccaaacattacaaggacgggagtcctatcgccgacgatctgctcgagaagctagtggccagcagacttgtcaatactggcctcctgactctgcggcagatcgtcctgtcgaaagtggaccagagtctccacactaacacttctcttgatgccgcgtcagagtacgcgaaatactgtagcgaaatcctgggagtggctgccacacctgggacaaatatgccagcaacattcggccacctagcaggcggatatgacgggcagtactatgggtatctgtggtctgaggttttctcgatggatatgttttattcgtgttttaagaaagaagggatcatgaacccagaagtcggcatgaaataccgcaatctcatactgaagccaggggggagcttggatggcatggacatgctgcacaactttctaaagcgggagccaaatcagaaagcattcctcatgagcagaggcctgcacgcaccctag

SEQ ID NO: 126264 - DNA, 1803 bp, Artificial Sequence
  Description of Artificial Sequence: Synthetic coding sequence
atgctagacttcccccagcacgtatcaagtgataaagaagtgagagccgcttctactgaggccgataagcgactttcccgattcgatatagaaatgagtatgcgcggcgatatattcgagcgaatagtgcacctacaggaaacctgtgatcttgggaaaattaaacccgaagccaggcggtatctggaaaaatccatcaaaatggggaaacggaacggcctgcacctgcctgagcaagtgcagaacgagatcaaatccatgaaaaaaagaatgtcggagctgtgtatcgatttcaacaaaaatctgaacgaagacgacacttttctcgtgttcagcaaagccgagctcggcgccctgccggacgatttcattgacagcctagagaaaacggacgacgataagtataagatcacactcaaatatccccactacttccctgttatgaaaaagtgttgtatcccagagacccgcaggcgtatggaaatggcattcaatacgcgctgcaaagaagagaacacgattatcctacagcagcttcttccactgaggactaaagtggcaaaactgctgggatattcaacacacgctgacttcgtgcttgagatgaatacagctaagtccacctcaagggtgaccgctttcctggatgatctttcgcagaaactcaagcctctcggggaagccgagagagaattcattctgaatctcaaaaaaaaggagtgcaaagacagagggtttgagtatgacgggaaaattaatgcatgggacctgtactattacatgacacaaacagaggaacttaaatattcaattgatcaggagttcctaaaggagtatttcccaatcgaggtcgtgactgagggcctcctgaacacctatcaggaacttcttgggctgagttttgaacagatgaccgatgcccacgtgtggaacaaatccgttaccctgtacacggttaaggataaagccacaggcgaagtgctgggccagttctacctggatctctatccacgagagggcaagtacaatcatgccgcgtgctttggcctgcaacccggttgtctcctgcctgatggaagccgtatgatggccgtagcagcactggttgtgaacttttcccagcctgtagccggtagaccctctctccttaggcatgacgaagtcagaacgtattttcatgaattcggccacgttatgcaccaaatctgtgctcagacagattttgcccgcttttcaggcacgaacgttgagacggattttgtggaggtcccttcacagatgctggagaactgggtctgggatgtggatagtctgcgtagactgtcgaaacactacaaggatggctcaccaattgctgatgatctgttggagaagctggtagctagtcgcctcgtgaatacaggactactgactctgcggcagatagtcctctcaaaagtcgatcaatcattgcataccaatacctccttagacgcagccagtgaatacgctaaatactgtagtgagattctcggcgtggctgcgactcctggcactaatatgcccgctacgtttggccatctggccggcggttacgatggacaatattacggctacctgtggagcgaggtctttagtatggacatgttctactcatgtttcaaaaaggagggcatcatgaatcctgaggttggaatgaaatatcgtaacttaatattgaaaccaggaggatctcttgatggtatggatatgctccacaacttcctgaaacgagaacctaatcagaaagcttttctcatgtctagagggctccacgcgccctag

SEQ ID NO: 126265 - DNA, 366 bp, Artificial Sequence
  Description of Artificial Sequence: Synthetic coding sequence
atggctcgtagagctggaggggcacgcatgttcgggtcactgcttctgtttgcactgctggccgctggagtggcccccctgtcttgggacctccctgaaccacgttcccgcgcctcaaagattagggtgcattcccgcgggaacctatgggccacggggcattttatgggaaaaaaaagtctagaaccatcttctccatcccctctcgggaccgcacctcatactagcctgcgggaccagcgcctgcagttgagccacgaccttctcgggattctgcttctcaagaaagctctgggcgtgagccttagcaggccagcgccacaaattcagtatcggcggcttttggtgcagatccttcaaaaatag

SEQ ID NO: 126266 - DNA, 465 bp, Artificial Sequence
  Description of Artificial Sequence: Synthetic coding sequence
atggctcggcgagcaggaggggctagaatgtttggcagcttgctgctgttcgctctgttggccgcgggagtggcccctctctcctgggacctaccagaaccccggtcgagggcgagcaaaatcagagtccactcccgcggtaacctctgggctaccgggcacttcatggggaaaaaaagccttgagccaagctcgccatctcctctgggaacggctcctcatacttccctaagagaccaacgactccagctaagtcacgacctccttggcattctgctccttaagaaggccttgggtgtttcactgtcacgtcccgctccacaaatccaggaagcagctgggacaaacactgcggagatgacccctatcatgggccagacccagcagcggggcttggactgtgcccaccccggaaaagtgctgaacgggaccctgcttatggctccttccggatgtaaatcctag

SEQ ID NO: 126267 - DNA, 1173 bp, Artificial Sequence
  Description of Artificial Sequence: Synthetic coding sequence
atgccgtcaaagtctctcagcaatctgtccgtaacaactggcgcaaatgagagcggctctgtccccgaaggttgggaacgcgatttccttcccgccagtgacggcaccactacagagctggtcatcaggtgtgttattccctcactctacctgttgatcataacagtggggctgctcggaaacatcatgctagtcaagatttttattactaattcagccatgaggtcggtgccaaacatctttatctccaacctcgctgcgggcgatctgctgctgctcctaacctgcgtgccagtagacgcctctcggtacttctttgatgaatggatgttcggaaaggttggatgcaaactgatcccagtcatacaactcacctctgtgggagtgagtgtattcaccctgaccgctctgagcgcagatcggtacagagcgatcgtgaatccaatggatatgcagaccagcggcgcactgctgagaacatgcgtaaaggccatgggcatctgggtcgtatccgttttgttggcagtgcctgaagctgtgttctccgaagtggcccggatttcttccctcgataacagctctttcaccgcgtgtataccttacccccagactgatgaactgcaccccaagatacactctgtgttaattttccttgtgtactttctgatccctctggccatcatctccatttattactatcacatcgctaaaacactcatcaagagcgcacacaacctccctggagagtataacgagcacactaagaaacagatggaaacaagaaagcgattagcaaaaattgtgctggtgtttgtggggtgcttcattttttgttggttccccaatcacatcctgtatatgtatcgctcattcaattacaacgaaatcgacccttcactgggccatatgattgttaccttagtggcacgggtactcagctttggaaatagttgcgtaaatcctttcgccttgtaccttctctcagaaagctttaggcgccatttcaattctcagctgtgctgcggccgcaaatcgtatcaggaacgcggaacttcttacctcctgagctccagtgctgtgagaatgacttcactgaaatctaatgccaagaatatggtgactaatagcgtgctgctcaatgggcactcaatgaaacaggaaatggccctatag

SEQ ID NO: 126268 - DNA, 1281 bp, Artificial Sequence
  Description of Artificial Sequence: Synthetic coding sequence
atgactcccctgtgcttaaactgcagtgtcctgccgggggacttgtatcctggaggagctcgcaaccctatggcctgcaatggctctgctgccaggggtcacttcgaccctgaggacttgaacttaacggacgaggccctccgtctcaagtatctgggtccccaacagactgagctcttcatgccaatctgcgctacctatctgctgatcttcgtcgttggcgcggtgggtaacgggctgacctgcctcgtgatcctgcggcataaagccatgagaactcccacaaattactacttgttcagcctcgcggtgagtgacctcttagtcctccttgttggattgccactagagctgtacgaaatgtggcataattatcccttcttgctgggcgtgggcggatgttattttcgtacgctgctattcgaaatggtctgtctcgcctcagtattgaacgtgacagctctcagcgtggagagatatgtggcggtggttcatcctctccaggccagatcgatggtaacacgggcccatgtgcgtagagtgttgggagccgtttggggacttgccatgctgtgcagcctgcctaatacctctctacatggaattcggcaactgcatgttccttgtagaggccctgtacccgattccgctgtgtgcatgttagttagaccccgcgcactctacaatatggtagtccaaacgacggcgctgctgttcttctgtctaccaatggcaattatgagcgttctgtatttactcataggactccggctgagacgggagaggctcctactcatgcaggaagctaaaggtcgaggttcggcagccgcacgcagtaggtacacctgccgcctccagcagcacgatagaggaaggcggcaggtgactaagatgttattcgtgttggtggtggtgttcggtatctgctgggccccgtttcacgccgatagggtcatgtggtccgtggtatcacaatggaccgacggactgcatttagcctttcagcacgtccatgtgatcagcggcatattcttctacctaggaagcgcagcgaatcctgtgctctacagtctaatgagctctcgctttagagagaccttccaggaggcactctgcctcggggcttgctgccaccgattgaggcccagacacagcagccatagtctttctaggatgactaccggatcaacgctttgcgacgtggggtccctcgggtcctgggtccaccccctggccggtaatgacggccctgaggcacagcaggaaaccgacccctcctag

SEQ ID NO: 126269 - DNA, 1248 bp, Artificial Sequence
  Description of Artificial Sequence: Synthetic coding sequence
atgtctggtatggagaagttgcagaacgcttcttggatctaccagcaaaagctcgaagaccctttccagaaacacctgaacagtaccgaagagtatctagcattcctctgcggtccgagacggtcccacttctttctgccagtcagcgtagtctatgtgcccattttcgttgtaggggttattgggaatgttttggtctgtttagtcatcctccagcaccaagccatgaaaacccctactaattactacctgttcagcctggctgtaagcgatcttctagtgctgcttctcggcatgcctcttgaggtgtacgaaatgtggagaaattatcctttcctgtttggccctgtgggatgttatttcaagactgccctgttcgagacagtatgttttgcaagtatcctttcaattaccactgtgtccgttgaaagatatgtagcgatactccacccattcagagccaagctgcagagcacccggcggcgcgcactaaggatcttgggtatcgtgtggggatttagtgttcttttttccctcccaaacacatcaatccacggcatcaagttccactattttcccaacggttccctcgtgcccggctcagccacgtgcactgtgataaagcccatgtggatatacaacttcataatccaggtgacctcttttttattctacctgcttcccatgacggttatatccgtcctctattatcttatggcgctcaggctcaagaaggacaagtctctggaagccgatgagggcaacgcaaatattcagcgtccatgccgcaagagcgtcaacaagatgctgtttgtgctcgttctggtgttcgcgatctgttgggcccctttccatatagaccgtctcttcttcagcttcgtagaagagtggagcgaatcactggccgctgtcttcaacctggtgcacgtcgtctccggagtcttcttttatctatctagcgccgttaaccccatcatctacaacctgctgtctcggcggtttcaggctgcctttcagaacgtgatctccagttttcacaaacaatggcacagccagcacgacccacagctgccccctgcacagcggaatatctttctcacagaatgtcatttcgtggaactgaccgaagacatcggacctcagtttccgtgtcaatcttctatgcacaactcgcatttgccagccgctctctccagtgaacagatgtctcgtacaaactatcagagttttcactttaataaaacttag

SEQ ID NO: 126270 - DNA, 5625 bp, Artificial Sequence
  Description of Artificial Sequence: Synthetic coding sequence
atgcttgggtctagcgtaaagtccgtgcagcctgaggtagagctgagtagcggtggcggagacgagggcgcagacgagcctcgcggtgccggcagaaaggccgcagctgccgacggccgtggcatgctccccaagagagcgaaagcccccggcgggggcggcgggatggcaaaggcttctgctgccgagctaaaagtttttaagagcgggtccgtcgattctcgcgtcccaggcggtccacccgcgagcaacttgcggaaacagaagagtctgaccaacctgagtttcctcaccgactccgaaaagaaacttcagctgtacgaaccggagtggtcagacgacatggcaaaggctccgaaaggcctgggtaaagttggctccaaagggcgcgaagcccctctgatgagtaaaactttatctaagtcggaacattctctttttcaggccaaaggcagtccagccggcggagccaaaactcctctggcccccttggcgccgaaccttggaaaaccttccagaataccgaggggcccctacgcagaggtcaagcccctctcaaaggccccagaggctgccgtgagcgaagacggtaagagtgatgatgagctgctatcatctaaagcaaaggcccagaagagtagcggccccgtgccatccgccaaggggcaagaagaacgcgcctttttgaaggtggatcccgaactcgtggttactgtgctaggtgacctggaacagttactgttctctcaaatgttggatcctgaatctcagagaaagcgcacggttcagaacgtgctcgacctacggcagaatttagaggaaaccatgagttccctcagaggctctcaggtcacccacagttctctcgagatgacctgctacgactcagatgacgccaatccaagaagcgtttcatccttgagcaatcgctcctctcctctgtcctggcgctacgggcagtccagtcctaggcttcaggcaggcgatgctccatccgtcgggggttcctgcaggagcgaagggactccagcctggtatatgcatggggagcgcgcccactacagccatacaatgcccatgcggtccccgtctaaactctcacacatctcaagattagaactcgtggagagcctggacagtgacgaagtggatttgaagtctggctacatgagcgacagcgacttaatggggaaaacaatgacagaagacgatgatattaccacaggctgggatgaatcttcgtcaatttcctcgggattatctgacgcaagcgataacctttcaagcgaggagttcaacgcctcgtcctcgctcaactctctgccgagtacccccaccgctagcaggcgtaactcaaccattgtcctaagaactgatagtgaaaagaggtcactggccgagagcggtctgtcttggttttccgaaagcgaggagaaggccccaaagaagttggaatacgactctggatctctgaagatggaacccgggacatctaaatggcggagagaaaggccagagagctgcgacgacagttctaaaggcggggaattaaagaagcctatctctttgggccaccccggtagcttaaaaaaaggcaagactccacccgtagccgtcacctctcctatcacccacacggcccagagtgcgctgaaagtcgccggcaaacccgaaggaaaggcaactgataagggcaagctcgctgtgaaaaacacaggactgcagcggtcttcctcagacgctggacgggaccgtctatcagacgcaaagaagcctccatctggcattgcacggccctctacgagtgggagttttggctataaaaagccacctccagccacaggcacagccactgtcatgcaaaccggcggttctgcaacgttatcgaagattcaaaaaagttctggtattcctgtgaagcccgttaacggaaggaagacgtcacttgatgtcagtaactccgctgagccaggattcttggcacccggcgcacggtcgaacatccagtaccgctcgctgcccagaccagcaaaaagctccagcatgagtgtgacaggagggcgcgggggccctcgccccgtatcctcaagcattgatccatctctcctgagtaccaaacagggaggactgacccccagtcgcttaaaggaacccactaaggtcgcatcaggtcgaacaaccccagcccccgtgaaccagacggatcgcgagaaggaaaaggcgaaggccaaagccgtggccctggactctgacaatattagcctcaaatctatcgggagcccagagtcaacgcccaagaaccaagcttcacatcccacggcgacaaaactggcagaactgcctcctacccctctgcgggcgacggctaaatcgtttgtaaaaccgcctagcctggctaacctcgataaagtgaattccaacagcctcgatctgccctcgagttccgacactacccacgcctccaaagtgcccgatctccatgcgacgtcttctgctagtggtgggccactgccgtcctgtttcaccccttctccagctcctattttaaatattaacagcgcatcattttctcagggacttgaactaatgtcaggcttctctgtccctaaggagacacggatgtatcccaagctgtctggcttacatagaagcatggagtcactgcagatgccaatgtccctgcccagtgcattccccagttcaacgcccgtaccaacccctcccgctcctcctgccgctcccacagaagaggagactgaggagctgacatggagtggttccccgcgggcgggccaacttgattccaatcagagagacaggaatacattgccaaagaagggcctgaggtaccaactccagtcacaagaagaaaccaaggagcgtcggcatagtcatacaataggaggactgcctgagagcgacgatcagtccgagctcccatcccccccggcgctcccaatgtccctgtctgctaagggtcagctgaccaacattgtttcccccaccgccgccacgacgccccgcattactcggtcgaattctatccccacccatgaagccgctttcgagttgtacagtggctctcagatggggagcacactgtcccttgcagagcggccaaaggggatgattcggagcggcagctttcgcgatccaaccgatgatgtgcatggatcggtactgtcgcttgcctcctctgcttcctcaacctacagctccgccgaggagagaatgcagtctgagcagattagaaaactccggcgtgaactggagtcatcccaagagaaggttgcaactttaacttcccagctgtccgcaaatgccaatttggttgctgccttcgaacagtcactagtaaacatgacatccaggctgagacatctagctgagacggcagaggagaaagacaccgaattgctggatctgcgggaaacaattgattttcttaaaaaaaagaacagcgaggcccaagccgtgattcagggggccctaaatgcctccgaaacaactccaaaggagttaagaattaagagacaaaattcatccgatagcatcagctccctgaactcgattacttcccacagtagcatcgggtcgtcaaaagatgctgatgccaagaaaaaaaagaagaagtcttggctgcgctcatctttcaataaagcatttagtattaagaagggcccgaagtctgccagttcttacagcgatatcgaagaaattgccactcctgattcaagcgctcctagctcacctaagctccagcatggaagcaccgagactgcgtcaccctccattaaatccagcacgagctctagtgtcggcacagatgtcactgaagggcctgcccacccagcaccgcacacgcgactgttccacgccaatgaagaggaggaacctgagaagaaagaggtcagcgagctgagatccgagctgtgggaaaaagagatgaagctgaccgacattaggctcgaggctttgaatagcgcacaccagcttgaccaactgagggagaccatgcacaatatgcagctggaagtcgacctgcttaaagcagagaatgacagactgaaagtcgccccgggcccatcttcagggtctactccagggcaggtgccaggctcatctgctcttagctctcctcggagatcacttggcctggcactaacacacagtttcggaccaagccttgccgacacggacctttctcccatggatggcatcagcacgtgcggtcctaaggaggaagttaccctgcgcgtggtggttcgtatgccacctcagcacatcattaaaggagacttgaagcagcaggagttcttcctgggctgtagtaaggtctccggcaaggtcgattggaaaatgctggatgaggctgtgtttcaggtctttaaggactacataagtaagatggatcctgcttccaccctcggcctctccactgagagcatccatggctattcaataagtcatgttaaacgggttctggatgcggaacctcctgagatgcccccgtgccggcggggtgtgaataatatctcagtgagtctcaagggcttgaaagagaagtgtgtggattccctggtgtttgagaccctgattcctaagccgatgatgcagcactatatcagcctacttctcaagcatcgacggctagtgctgtccgggccttctggcaccggaaagacgtacctgaccaaccggttggcagagtacctggtggagcgctctggacgcgaagtgactgaaggaatcgtgagtacctttaatatgcatcagcagtcatgtaaggacctgcagctatatctgtccaatctcgccaatcagatcgatagggaaactggaatcggtgatgtacccctcgtgatcttactggacgatttgtccgaggccggcagtattagtgaattagtgaacggtgcactgacatgcaagtaccacaagtgcccatatattattggcactactaatcagccggtgaaaatgacgccgaatcatggccttcatctgagtttcaggatgttgacctttagcaacaacgtggaacccgccaacggttttctggtgcgctatctcagaaggaaactggtggagtccgactccgatattaacgccaataaagaggagttgctaagggtgcttgactgggtgcctaagctttggtaccacttgcatacattcctcgagaaacatagtacgtctgacttcctaataggaccttgctttttcctaagctgccctattggaatagaagactttcggacttggttcatcgacctctggaataattctattatcccctatctacaagagggcgccaaggatggaattaaagtgcatggccagaaggccgcatgggaggatcccgtcgagtgggttcgcgatacactaccatggccctctgcccagcaggaccaaagcaagctctatcacctgcctccaccaacagtgggccctcattcgattgctagccctcctgaggaccggaccgttaaggatagcacgcccagtagcttggatagcgacccactgatggctatgctcctcaaactgcaggaggcagccaattacatagaatcgccggaccgcgaaaccattcttgaccccaatctccaagctacactgtag

SEQ ID NO: 126271 - DNA, 5634 bp, Artificial Sequence
  Description of Artificial Sequence: Synthetic coding sequence
atgctgggttcttctgtcaaatccgtacagcccgaggtggagcttagtagcggaggaggtgacgaaggcgcggacgaacctagaggggcaggccgcaaagccgcagccgctgatggcagggggatgttgcccaagcgtgctaaggctcctgggggtggtggcggcatggctaaggcctccgctgccgagctgaaggtatttaagtctgggtccgttgattcacgcgtgcccggcggtccccccgcatcaaacctgcgaaaacagaagagccttacgaacctgtctttcttaactgacagcgagaaaaagttacaactgtacgagccggagtggagtgacgacatggcaaaggctcctaaagggcttgggaaggtagggagcaaaggaagggaggctccactcatgtccaaaactctctcaaagtccgagcacagcttgttccaggccaaagggagccctgcgggaggcgccaaaactcccctggcaccactggccccgaacctggggaagcctagtcggatcccaagaggcccttatgcagaagttaagccgctgagcaaggcccccgaagccgctgtgtccgaggacgggaagagcgatgatgagctgctctcttccaaggcaaaggcccagaagtcctccggtcctgtgccgtctgcgaagggacaggaggagcgtgcgttcctgaaagtggatcccgagcttgtggtgaccgtactgggggatcttgagcagttactgttcagccagatgcttgatcccgaatcacagaggaaaagaactgtgcaaaatgtattggatctgcggcagaacctggaggagacaatgagttccctcaggggatctcaggtgacacactcctcactcgagatgacttgttatgatagtgacgacgcaaacccgcggtcagtctcaagtttgtcaaatcggtctagtcccctatcatggcggtatggccagtcttctccccgattgcaagcaggggacgctccctctgtcggggggagttgtagatcagaaggaacccccgcttggtatatgcacggggagagggcacactatagtcacactatgccgatgaggagtccctccaaactgagccacatcagtcggctcgaactggtggaaagccttgattctgacgaggttgatttgaagtccggctacatgtcagacagtgatttaatggggaagactatgactgaagacgacgacattactactggctgggacgaatcttccagcatcagctccggcttgagcgatgcctctgataaccttagcagtgaggaatttaatgcatcttcctcactgaattcgttacccagtacacctaccgcaagtcgccggaatagtaccatagtcttgcggacggacagcgagaaacgtagcttggcggaaagcggacttagctggttctcagaaagcgaggaaaaggcacctaagaagctggaatatgacagtgggagcctgaagatggaacctggaacgagcaaatggagaagggagcgacctgaatcctgcgacgactcatctaagggcggcgagctcaaaaaaccaatctcattgggtcaccccggcagtcttaagaaggggaaaacgcctcccgtcgctgtgacgtcccctattacacacactgcccagagtgcactcaaggttgccggcaaaccggaaggaaaggccaccgacaaagggaagctcgcagttaagaacactggcctccagcggagcagctctgacgccggccgggatcgcctcagtgatgctaagaagccgccatccggcatcgctagaccatccacttctggttccttcgggtacaagaagcctccaccagctacggggacagctactgtcatgcagactggggggagtgccaccctgagtaaaatccaaaaatcgtccggcatcccggtcaagcctgtcaatggtcgaaaaacctccctggatgtctccaattccgctgagccgggctttttggcccccggcgcccgctcaaacattcagtaccgttccctaccgcggcctgcaaaatccagctctatgtcggtgacgggaggcaggggcggccctcgaccagtttctagctcaatcgaccccagcctactctctaccaaacagggcggcttgacaccaagccgcctgaaggagcctactaaggtcgcttcgggtaggactactcccgcccccgttaaccagacagaccgagaaaaggagaaagccaaggctaaagcagttgccctggattccgacaatatctcactcaagtcgattggttcgcccgaatccacgcctaagaaccaagcctcacacccaaccgcgacgaagctggcggagctgccacccaccccactgcgagcaaccgctaagtcgttcgtaaagcctccatccttggccaacctagacaaggttaattctaattcacttgacctccccagctcatctgacaccacccacgctagcaaggtaccagatctgcatgccacatcttctgcctccgggggccccctcccttcatgctttactcctagtccagccccaatcctcaatatcaactcagcttcattttcccagggactcgagttaatgtccggcttctctgtacccaaagaaacacgcatgtacccaaaactatccggcttgcacagatccatggaatctttgcaaatgccaatgtccctgccttccgccttcccaagctctaccccagtgccaacgccaccagcccctccagcagccccgacagaagaggagacagaagaactgacttggagcggctccccccgggcaggccagctggatagcaaccagcgggatcggaatacactgcctaagaaggggctgcgctatcaactgcaatcccaggaggagacaaaggagcgaagacacagtcacacaatcggcggccttccagagtcagacgaccagagcgagctgccaagccccccggctctgccaatgtctctcagcgctaaaggccaactgactaacattgttagtcctacggctgcaaccacaccccgaatcacccggagcaattctatccctacccatgaggcagccttcgagttatattcaggctcacagatgggttccaccctgtccctggctgaacggcccaaagggatgatccgctccggatcattcagagacccaacggacgacgtgcacgggagcgtgctttcccttgccagctcggcctcaagcacgtattcgtctgcagaagagagaatgcagtctgagcagatccgtaagcttcggagggaattagaatcgagccaggaaaaggtggccaccctgaccagtcagttgtccgctaatgccaatctggtcgctgcttttgagcaatcactcgtgaacatgacttcccgcctgcgacatttggccgaaacagccgaggagaaagatacggaactgctcgatctgagggagacaattgactttctgaagaaaaagaattcagaggcccaggccgtgatccagggggccttgaacgccagcgagaccacccctaaggaattgagaattaaacgacagaactcatcagactctatcagcagcctgaactccatcacttcccacagttccatcggatcgagcaaagacgccgatgcgaagaaaaagaaaaaaaaatcttgggtctatgaattgcggagctcttttaacaaggctttttctattaagaaggggcccaagtctgccagttcttacagcgacatcgaagagatcgcgactcccgatagctccgccccgtcgtccccaaagctccagcatggctccacagaaactgcaagcccctctatcaaaagcagtacatctagttcagttggcacagacgtcaccgaaggacctgcccatcctgcgccccacactagattgtttcacgccaatgaggaggaagaaccagagaaaaaagaagtgagtgaattgcggagtgagctttgggagaaagagatgaagcttactgacattagacttgaggcactaaactcggcccaccagctggaccaactgagagagacgatgcataatatgcagctcgaggtggacttactcaaagccgagaatgataggctgaaggtggcgccaggaccctcctcaggctccacgccagggcaggtgccggggtcctctgctcttagcagccctagacgttctctcggactggcactgacccacagcttcgggccaagccttgccgacaccgacctgagtcccatggacggcattagcacatgtgggcccaaagaggaagtgaccctacgggtcgtggttagaatgcccccacagcatattattaagggtgacctcaagcagcaggagtttttcctcggctgcagcaaggtgtccgggaaggtcgattggaaaatgctcgacgaagccgtgtttcaagtttttaaagactatatttcaaagatggaccctgcctcaactctggggcttagcacggagagcatccatggatacagcatttctcatgtgaagagagtgctggacgcagaacctccagaaatgccaccatgcaggcggggcgtgaacaatatctctgtatctttaaaaggcctgaaagagaagtgcgttgatagtctggtgtttgagactctgatcccaaagcctatgatgcagcattacatctccctgctgcttaaacatcgcagattggtgctgtcgggcccaagtggaaccgggaaaacctatctgaccaataggttggccgagtatcttgtcgaacgctcaggccgggaggtgactgagggcatcgtgtctacattcaacatgcaccagcagtcttgcaaggatctgcagctgtacttgagcaacctcgctaaccagatcgaccgggagactggcatcggagacgtgcctctggtgatcctgctggatgacttatcagaagctggctctatctccgagctggtcaatggcgccctcacttgcaagtaccacaagtgtccctacatcattgggaccaccaatcagcctgtgaaaatgacccccaaccacggactgcatttgagcttcaggatgctgactttttccaataatgtagagccagctaacggcttcctcgtccgctacttgcggagaaagcttgtggaatcagatagcgatataaatgctaataaggaggaactgctccgagtcttagactgggtcccgaaactgtggtaccatctgcatacattccttgaaaagcacagtaccagcgattttctcataggaccgtgtttttttctctcctgcccgatcggcattgaagatttcaggacatggttcattgatctgtggaataattctatcattccctacctgcaagaaggtgccaaggacggaatcaaagtccacggtcaaaaggccgcctgggaggaccccgtcgaatgggttcgagatacattaccttggccctccgcccagcaggatcaaagcaaactgtatcatctcccgccgcctacggtgggtccacatagcatcgcctccccaccggaggacaggactgtaaaagattcaacgccctcgtctctggacagtgatcccctgatggcgatgctcctcaaactccaggaagcagcaaactatatcgaatcaccagatcgtgaaactatcctggatccgaacctgcaggctacactgtag

SEQ ID NO: 126272 - DNA, 5610 bp, Artificial Sequence
  Description of Artificial Sequence: Synthetic coding sequence
atgttgggctctagcgttaaatccgtccaacccgaggtggagctctcctctgggggtggggatgagggcgccgacgagccaaggggtgccggacgcaaagcagcagccgctgatggccgaggcatgcttccgaaaagggcgaaggcacctggtggcgggggtggaatggcaaaggcatcagccgccgaacttaaagtgtttaagagtggctccgttgactctcgggtacccggagggccgcctgccagtaatcttcgaaagcaaaagtccctcactaatctctcctttctgacagacagtgaaaagaaattgcagttgtatgagcccgagtggagcgatgatatggctaaggctcccaaaggccttggcaaggtagggtcaaagggtagagaagcacccctcatgtctaaaactctctccaaatctgagcatagtctttttcaggccaaggggagtccggccggcggagctaaaacacctctggcccctctcgccccaaacctgggaaaaccgagtcgcataccaaggggaccatacgcagaggtgaagccgttatccaaggcacctgaagccgcagtgtccgaagacggaaagagtgacgatgagttgctgtcttcaaaggccaaggcccagaaatcatccggccctgtgccttctgccaaggggcaggaggaacgcgctttcctgaaggtcgatcccgagctggtcgtcacagtactgggcgatttggaacaactgctgttctcacagatgttagatccggagagccagcgcaaacgcactgttcaaaatgtacttgatctgcgccagaatctggaggaaactatgagttccctcagaggaagccaggttacacattcctcactggagatgacatgttatgattccgacgatgcaaatccccgctccgtctctagcctttctaataggagttcaccattgtcatggcgatatggccagagttcccctaggcttcaggcaggtgatgcacctagtgtgggtgggtcttgtagaagcgaagggacccccgcatggtatatgcatggagagagggcacactattcccacacgatgcccatgcgttcccctagtaagctatcccacatttctagactggagttagtggaaagcctggactccgacgaggttgacctgaagagcggatatatgtcagactctgatctaatgggcaaaactatgaccgaggatgatgacatcaccacagggtgggacgaatcgtcaagcatttcttctggcctgagcgacgcttccgacaaccttagctccgaagagtttaacgcctcctcctccctcaattctctgccatcaacgcccacagcctcacggagaaactcgaccatcgttctccggaccgatagtgaaaaacgcagcctggctgaaagcggtcttagttggttctccgaatcagaagagaaagcacctaaaaagctcgagtacgacagcggttcgctgaaaatggagccagggacttcgaaatggcgccgtgagcgcccggagtcgtgcgatgatagctctaaagggggcgagttaaagaaaccaatcagtcttgggcatcccggcagcttaaaaaaaggcaaaacacctcccgtcgcggtgacctcccctataactcacactgcccagtctgccttgaaagtcgcaggcaaacccgagggaaaagcgaccgacaagggcaaactggctgtgaagaataccggtttgcagcgttcttcttcggatgctggaagggatcgtttgagcgacgccaaaaagcctccctctggcattgccagaccttcaacctctgggagcttcggctataagaaaccgccaccagctactggcacggcgacagttatgcagaccgggggatctgccaccctcagcaaaattcagaagagcagcgggattcctgtcaaaccagtgaacggtagaaagaccagcctggatgtgtcaaattctgcagagcccggctttttggctcctggtgcaaggtctaatattcaataccgtagcctgcccaggcccgcaaaaagctctagtatgtcagtgaccggcggccggggcggacctagacctgtgtcctcatctatagacccttctctgctgtccacaaaacagggagggctgaccccttcacggctgaaagagccaacaaaggtggccagcggacggaccacaccggctcccgtgaaccagacggatcgagagaaggagaaggctaaagctaaggctgtggcccttgacagtgataacatcagcctcaagagcatcggttcacctgagtccactcctaagaatcaggccagtcaccccaccgcaaccaaactcgcagagctgcctccaacccctcttagagctacagctaaatcgtttgtgaaaccccctagcctggcaaatttagacaaggttaattctaattcccttgaccttccctcatcttcggatactacccacgcttctaaggtcccagaccttcatgccacatcctcagcctcagggggccctcttccctcttgctttacaccttccccagccccaatcctgaatattaattctgcgagcttctctcaaggactcgagttgatgagcggtttcagcgtgcctaaagaaacaagaatgtatcccaagttaagtggcctccacagatccatggaatctctccagatgccgatgtcactgccatctgcgtttcccagcagcacccccgtgcctaccccgccagcgcctcccgcagcacccacggaggaggagacagaggaattgacatggtcaggttcaccaagggccggtcagctggactccaaccagagagatagaaacaccctgcccaaaaaaggcctgagatatcaactacaatcccaggaggagaccaaagagcgccgccatagccatactatcggaggactgccggaaagcgacgaccagagtgagctgccttccccgcctgctctaccaatgtcactctctgctaaaggtcaattaactaacatagtgtcccctacggccgccactaccccgagaatcacaagatcgaactcaattcctacacacgaagctgcatttgagctttatagcggatcccagatgggcagtacccttagcctcgcagagcgccccaaaggcatgattcgatccggatcatttcgagaccccactgacgacgtccatggcagtgtgctgtccctcgcctcttcggcttccagtacgtattcgtctcaaattcgcaaacttaggcgtgaactcgaatcatctcaggaaaaggtggcgacgctgacttcccagttatctgcaaatgccaacttagtggccgcctttgaacagtcactggtgaatatgaccagcagactccggcaccttgccgagactgccgaagagaaagacactgagctgctggacctccgtgaaacaatagatttcttgaagaagaagaattcagaggcccaagccgtgatacaaggggccctgaatgcgtccgagactacaccaaaagaactcagaataaagcgccagaattcttccgatagtatttctagcttaaattcaatcacttcccattccagtattggcagctctaaggatgcagatgctaaaaagaagaagaaaaaaagctgggtttatgagctccggtcctcatttaacaaggcgttcagtatcaagaagggaccgaaaagtgcttcctcctactctgacatcgaggaaatcgccacccccgactcttctgcgccttcatctcctaagttgcaacacggatctacagagactgcttccccttcaatcaaaagtagtaccagctccagcgtaggaactgacgtcacggaaggcccagcgcatcctgctccgcacacaaggctgttccacgccaacgaagaggaggagcccgaaaaaaaagaggtcagtgaactgcgcagtgagctgtgggagaaagagatgaaactaactgacatccggctagaggcacttaactccgcgcatcagctggaccaacttagggaaacaatgcacaatatgcagctagaggtagatctcttgaaggccgagaatgaccggctcaaggtggctcccggacctagctccggatcaacaccaggacaggtccctggctcgtctgcactatccagtcctagacggagcttaggccttgcccttactcacagttttgggccctccctcgccgacactgacctcagccctatggacggcatcagcacttgcgggcccaaggaagaggtgactctccgggtggttgtgagaatgcccccccaacacattatcaagggagatctgaagcaacaggaattcttcttggggtgctccaaagtctcaggcaaggtggactggaagatgttagatgaggccgtcttccaggtatttaaagattatatttctaagatggatccagcatcaaccctgggtctatcaacagaatccatccacggttatagtatctcccatgtgaagcgcgtgctggatgccgaaccccctgaaatgcccccatgccgcaggggggtgaataatatctctgtgtccctcaaaggcttaaaggagaagtgtgttgactctctcgtttttgagactctgatacccaagcctatgatgcagcactacatctccctattactcaaacaccggcgactcgtattaagtgggccaagcggcacgggtaagacatacctaacgaatcgtctggcagagtacctcgttgagcgaagcggacgcgaggtcactgagggcattgtgtcaacgtttaatatgcaccagcagagttgtaaagatctacagctgtacctgtccaaccttgctaatcagattgaccgggaaacaggcattggcgacgtgccactagtgatattactagacgatttgtcagaggcggggagtatctctgagttagtcaatggggctctgacttgtaagtatcacaaatgtccctatattatcgggactacgaaccagccagtcaagatgacacctaaccacggactccacctatccttcagaatgctgacattctctaacaacgttgaaccagcaaatgggtttctggtccgatacctgaggagaaaactggttgagagtgactccgatattaatgcaaacaaagaggagctcctcagagtgctcgattgggtaccgaagctgtggtaccacctccacacgtttctcgagaaacactcaacctcagatttcctgatcggcccttgtttttttttaagttgccctatcggtattgaggatttccgtacctggttcatcgacctctggaataatagcattattccctatctacaggagggcgccaaagacggcattaaggtccatggccaaaaagcggcatgggaggaccccgtggagtgggtacgggatactttgccctggcctagcgctcagcaggatcagtcgaagctttaccatctcccacctccaaccgtggggccccattcgatcgcatctcccccagaggatcgtacggtgaaagattccacaccttcctcactcgattctgaccccttgatggccatgttgctcaagctgcaggaggcggcaaactacatcgagtccccggatcgggaaaccatcctagaccctaacttacaggccaccctctag

SEQ ID NO: 126273 - DNA, 5454 bp, Artificial Sequence
  Description of Artificial Sequence: Synthetic coding sequence
atgttgggatctagtgtcaaaagtgtccagcctgaggtggaactgtcttcagggggcggtgatgagggagcggacgagcctcggggagctggcaggaaagccgctgcggcagatggtcgtggtatgcttccaaagagggccaaggcacccgggggagggggaggtatggcgaaagcgtctgctgcagagttgaaggtgtttaagagcggcagcgtggacagcagggtgcctgggggtccaccagcaagtaatctgagaaagcagaaatccctgacaaatctaagttttctcacagacagtgaaaagaaattacagctatatgaacccgagtggagcgatgacatggccaaagctccaaagggacttggcaaagttggctcaaagggccgggaagcccctcttatgagcaagactcttagtaagtccgagcatagcctgttccaggccaagggatcccccgctggaggcgccaaaacccctctcgcccccctggcacccaacctgggtaagccttcccggataccgcggggaccttacgcggaggttaaacctttatcaaaggcgcctgaagccgctgtaagtgaggatggtaaatctgacgacgaattactcagctccaaagcaaaggcccagaagagttctggaccagtgccttccgcgaagggccaggaggagagggcattcctcaaagtagaccccgagctggtggtcaccgtgctgggtgatctcgagcagttgttgttttctcagatgttggacccagagtcccagcggaaaagaactgtgcagaatgttctcgatctgagacagaacctcgaggagacaatgtcatccttgagagggtcccaggtaactcattccagcttggagatgacatgctacgactctgatgacgcaaatccgaggagcgtgtcgagcctgtccaaccggtcttcaccactctcttggcgctacggacagtcaagtcccaggctccaggctggggatgctccatctgtcggcggaagttgccgttccgaagggactcccgcgtggtatatgcatggcgaacgtgcgcattactcccataccatgcccatgcgaagcccatctaagctttcgcacataagccggctagagctggtggagtctctggattcagacgaagtagatctgaaatccgggtacatgagtgattccgatcttatgggcaagaccatgaccgaagacgatgatattacaaccggttgggacgagagtagctctatttctagcggactgagcgacgcatcagataaccttagcagtgaagagttcaacgcctcctcatctctaaacagtcttcctagcacacctaccgcctctagaagaaattccaccatcgtcctgcggactgactccgaaaagcgctccctggccgagtcaggcctgtcgtggttttccgagagcgaggagaaagctccaaaaaaactggagtacgacagtggcagccttaagatggaacctggaacgagcaagtggagaagagaacgccctgaatcctgtgatgactcctcaaagggcggggaattaaagaagccaatatctctgggacatccaggcagcttgaagaagggcaagaccccacccgtggccgttacatccccaattacacataccgcccagtccgctctcaaggtagccggaaagcctgaggggaaggccaccgataagggcaagctcgcagttaaaaacaccggcctccagcgcagttcttcagatgctggccgagatcgactcagtgatgcgaagaaacccccctcagggatcgcccgaccaagtacatctggatcattcggctataagaagccgcctccagcaactggaaccgctaccgtcatgcaaaccggtggatccgcgactttgtccaagatccagaaatcttccggcatccctgtcaaaccggtcaacggccggaagacttcattagacgtgtctaattcggccgagccgggattcctcgccccaggcgcacggtccaacatccagtataggtctctgccgagacctgccaagagctcctcgatgagtgtcacaggcggacggggtggacctcgacccgtctcgtcttccatagaccctagtctgctctctaccaagcaggggggactgaccccaagtcgtctaaaggagcccacaaaggtggcctctggccggactacccctgcccctgtcaaccaaactgaccgcgagaaggaaaaagcgaaagctaaagcagtcgcgctggactcggataacatctccttaaaaagtatcggatctcccgaatccaccccgaaaaatcaggcaagtcacccaacagctaccaagctcgccgagctccccccaactccgctgagggctaccgcaaagtcatttgtgaagccaccaagtctcgccaacctggacaaggtgaattctaacagtctagatttgccctcctcttcagatacaacccacgctagcaaagtgcccgacctccatgcaacttcaagcgccagcggggggccactacctagctgctttacaccaagcccagcacccatcctcaatattaacagcgcctcattttcgcagggattggaattaatgtccggattcagcgtcccaaaggagactcgcatgtaccctaaactctcgggcctgcataggtcaatggaaagtctgcagatgccaatgtctttgccttctgcattcccctcgtctacccccgtgcctactccgcccgcccctccagctgccccaacggaggaggagacagaggaactgacctggagtggatctccccgggcgggccaactggactcaaaccagagggatagaaacacgctgccaaaaaagggcctccgatatcagctgcagtctcaggaggagaccaaggaaagaaggcatagtcacacaatcggtggtttaccagagtcagacgaccagagtgagctcccaagtcctccagccttaccaatgagcctcagcgcgaagggacagctgaccaatattgtccatggtagcgtcctctcgttagcctctagcgcatcaagcacttattcctcagcagaggaacgcatgcagtccgagcagattcgaaaactgcggcgggagctggagagcagtcaggagaaggtggctaccctgacatcccagctcagcgccaacgccaacttagtggcagcttttgagcaaagccttgtcaatatgactagtcgtctccggcatctagctgagacagcggaagaaaaggacaccgaattgctggatctcagagagacgatcgatttcctgaagaaaaaaaactccgaagcccaggccgtgatccagggggctctcaatgcttccgagactacccctaaagaactgaggatcaagcgccagaattccagcgattcaatttccagtctgaatagcataacgtctcattcctctattgggtcttccaaagacgcagacgcgaagaaaaagaagaaaaagtcttggctgagatcctccttcaacaaggcatttagcattaagaagggccccaagagtgcttcaagctattccgacatcgaggaaattgcaacccccgactcgtctgctccatcaagccccaagctgcagcacggcagtactgagactgccagtccctctatcaaatcgagcacatcttcctccgttgggacagatgtcactgagggccccgcgcaccctgccccgcacacacgcctattccatgccaacgaagaggaggaaccagagaagaaggaggtgagtgagctgcgctctgaactgtgggaaaaagagatgaaactcaccgatatccgtttggaggctctaaacagcgcccatcaacttgatcaattgagagagacaatgcataatatgcagttggaggttgaccttctcaaggccgagaatgaccgcctgaaagtggctccggggccttcttctggcagcactcccgggcaggtacctgggtcatccgccctgtccagccctcgacgctcactgggactggccctgacacactcctttggtccctcgctggccgacactgatttgtctcccatggatggaatctcgacctgtggccctaaggaggaagtgactttgagagtcgtggtgcggatgcccccgcaacatattataaagggagatttgaagcagcaggaatttttccttggttgcagcaaagtgtccggcaaagttgattggaagatgctggatgaggctgtgtttcaggtgttcaaggattatatttcaaagatggatccagcttcaactctcgggttgagcacagagtctattcatggatatagtatctcccacgtcaagcgagtgttagacgccgagccacccgaaatgcccccatgtcgacgcggggtgaacaatatctccgtctctctgaagggcttgaaggaaaagtgcgtggattcactggtgttcgaaaccttgattcccaagcccatgatgcaacattacatctccctcttattgaagcatcgccgcctggtcctgagcggcccttcgggcacaggaaaaacttatctgacgaaccggctcgctgaatacttggtagaacgttccgggagagaggtgaccgaaggtatcgtgagtactttcaacatgcaccagcagtcgtgtaaagatctccagctgtacctttctaacctggcaaaccagatcgatcgagaaaccggtatcggagatgtgcccttggtcattctgctcgacgacctgtctgaggccggatctatcagcgagctcgtaaacggggcactgacatgcaaatatcataaatgtccttacattatcggcaccaccaatcagcccgtgaaaatgaccccaaatcatggactgcatctctcgtttaggatgctgacattttctaataacgttgagccggccaacggattcctcgtgaggtacctcagacgaaaactggttgaatcagattcagatattaacgctaacaaggaagaactcttgcgcgtcctggactgggtaccaaaactttggtatcatttgcatacattcctcgaaaagcactctacttccgatttcctcatcggaccatgctttttcttgtcttgtccaattggcattgaagatttccgaacatggttcatagatttatggaacaattctataattccatatctgcaagagggtgcgaaggacggaatcaaagtccacgggcagaaagccgcatgggaggatccagtggagtgggttagggacactcttccctggccaagtgcacaacaggatcagagcaagctttaccacctccctccccccaccgtcggcccccattccattgccagccccccagaagatcggacggttaaggactccacaccaagctctctggatagcgatcccttgatggctatgttactgaagctgcaagaggctgcgaactacatcgaaagtccagacagagagaccattctggaccctaatctgcaggccactttgtag

SEQ ID NO: 126274 - DNA, 783 bp, Artificial Sequence
  Description of Artificial Sequence: Synthetic coding sequence
atgcatcagcagtcttgtaaggatttgcagctgtacctctctaacctggccaaccagatcgacagagaaacaggcataggcgatgtgccgttagtgattttactggatgacctgtcagaagcagggagtatcagtgaactggtcaatggtgccctgacctgtaagtaccataagtgcccctacattattggcaccacaaaccagcctgtcaagatgacccccaatcacggattacacctcagttttagccggatgttgactttttctaacaacgtcgaacctgcaaacggatttttggtccgctatttgagacgcaaacttgtcgaatctgactccgacattaatgctaataaagaagaactcttgcgcgtcctcgactgggtcccaaagctgtggtaccatttacatactttcctggagaagcatagtactagcgattttctgattgggtccccttgctttttcctctcttgcccaatcggcattgaagacttcagaacctggtttattgacctgtggaacaattcaatcattccttacctccaagagggcgccaaggatggaattaaggtccacggacagaaagctgcatgggaagacccagtggagtgggtacgcgacacgctaccttggccttccgctcaacaggacgacagcacgcccagcagcctggacagcgacccacttatggcaatgttgctgaagctccaagaagcggcaaactacattgaaagccctgatcgggaaacaatcttggacccaaaccttcaggccactttatag

SEQ ID NO: 126275 - DNA, 2193 bp, Artificial Sequence
  Description of Artificial Sequence: Synthetic coding sequence
atggagcccggtaccagcaagtggagacgggaacgacccgaatcttgcgatgactcatcgaaggggggagaactgaagaaacccatttccctcggacaccccgggtccttgaaaaagggcaagacaccgccggtcgccgtgactagccccataacacacaccgcacagagcgccctgaaggtggcaggtaagccagaaggaaaggctaccgacaaaggcaagcttgctgtcaagaacacaggacttcagcgcagttcatcagatgcaggaagggatcggctttccgacgcgaaaaaaccccccagcggcatagccaggcccagtacttcgggcagctttgggtataagaagcctcctcctgccaccgggacagctaccgtgatgcaaactggaggaagtgctacccttagcaagattcaaaagagtagcggcatccccgtgaagccagtcaatggtaggaaaaccagtctggacgtaagtaattccgctgagccggggttcctggctcctggagcccggtccaatattcaatatcgaagtctacccaggccggcaaagtcatccagcatgtccgtgaccgggggccgaggtgggccaagacccgtgtcttcatcgatagatccctcgcttttaagtacgaagcagggagggctgaccccttctaggctaaaggaaccaaccaaggtggcgtcaggaagaactaccccggcacctgtgaaccagactgatagagagaaggaaaaagctaaggcgaaggctgtggcactggactccgataacatatcccttaaatcaatcggatcccccgagtcaacacctaaaaatcaggcttctcacccaaccgctaccaagctggccgagctgccacctacccccctgcgggctactgcgaagagctttgtcaagccccctagtctggcaaacctggacaaggtgaattcaaactcacttgatctgccttcttcctcagataccacccacgcttctaaggtcccagacctgcacgctaccagctcagctagcggcggccccctcccaagttgttttaccccaagccccgcccctatcctgaatataaattctgccagcttcagtcagggcctcgaacttatgtctgggttttccgttccgaaggagacccgaatgtatccaaagttatctgggctgcatcgcagtatggagtcactgcagatgccaatgagtctccctagtgccttcccttctagtacccccgtaccaaccccacccgcgccaccagccgccccaactgaagaggagacggaggagctaacctggtcaggaagtccgagagcagggcagctcgactctaaccagcgcgatcggaatacccttccaaagaaaggccttcgctatcagcttcagagccaggaagagacaaaggagcgtcgccatagccatacaattgggggactgcccgaaagtgacgaccagtcagagctgccttcaccacctgccctgccaatgtcgcttagtgcaaagggccagctcacaaatatcgtctcacccacagccgctaccacccccaggatcacaaggtccaactccataccgacacatgaggccgcatttgaactgtactcaggctctcagatgggaagtactctgagcttggctgagagacctaagggcatgattcgatcaggcagctttcgcgatccaacggatgacgtgcacggaagcgtcctgtctctggcttcatctgcgtcttccacatattctagccagatccgaaaactgcggagggaacttgagtcttcgcaagaaaaggtcgctactctgacctcacaactcagcgctaacgccaaccttgtggctgctttcgagcagtcacttgtgaatatgacttcccgcctgcgccacctcgctgagaccgcggaggagaaaatggagtttcgttcctgtcacccaggctggtcggctttagcccggtcctggctgactgctaactctgcttcacaggacactgaactgcttgatctaagggagactattgatttcctgaagaagaaaaactctgaagcccaggctgtgatccagggggccctgaatgcaagtgaaacaacacccaaggagttaagaattaagagacagaacagctccgactccatttcctcccttaactctatcacttcgcattcctctataggatcttctaaggatgccgatgcgtag

SEQ ID NO: 126276 - DNA, 4452 bp, Artificial Sequence
  Description of Artificial Sequence: Synthetic coding sequence
atgctgcacctgcccctgccccggagcggcaggacagtaaatttccctaggagctgggatgaatcttcctcaatctcatccggtctgagtgatgcatctgacaatctgtcttcggaagaatttaacgccagctcgagcctcaattctcttccctctaccccgaccgcttcaaggcggaactcaactatcgtgctgcgcactgactccgagaaacggagcctggccgaatccggcctctcttggttctcagaatctgaagaaaaagctcccaaaaagctagaatacgacagcggcagtctcaagatggaaccggggacgtctaagtggagacgcgagaggcctgaatcttgtgatgattcctccaaaggcggggagctgaaaaagcccatctcgctggggcatccaggctccctcaagaaggggaagactccccccgtggctgtaacatcccctatcacgcacactgcgcaatccgccctcaaagtggccggaaagcctgagggaaaagccactgataaaggcaaattggccgtgaagaacacaggtctccagcgatccagctcggatgctgggcgcgataggttgtccgacgccaagaagccacctagtggaattgcccggccgtcaaccagcgggagcttcggctacaagaagcccccccccgccaccggcaccgccaccgtcatgcaaactggaggcagtgcaactttgtcgaagatccaaaagtctagtgggatcccagttaagccagtgaacggaagaaagacaagtctggatgtgagtaattccgccgagccagggtttttggcacccggtgcacgttctaacattcagtatcggtcactacctcgtcctgccaaaagctcgtccatgagtgtaacagggggcagaggcggccccaggcccgtgtcctcctccattgacccctccctcctctcaaccaaacaaggggggttgaccccttcccggcttaaggaacccactaaggtagcttctggaagaacgacccccgctcccgtcaatcagaccgaccgggagaaggagaaggccaaagctaaggcggtggcactcgactctgacaacattagtctgaagagcattggaagccccgagtccaccccaaaaaaccaggcttctcaccccacagccacgaagcttgcggaactcccccccacacccctgcgcgctactgcgaaatctttcgtgaaaccgccaagtctggctaaccttgacaaggtcaattcgaattctctggatcttccctcgtctagtgacaccacgcacgccagcaaggtccctgatttgcatgccacgagctctgcttccggaggtcccctgccgtcatgctttactccaagccctgccccaattctgaacatcaattccgcttcattctctcaagggctcgaactcatgtctggctttagcgtgccgaaagagacccggatgtaccccaaacttagtggtctgcataggtctatggagtccctgcagatgcctatgtctcttcccagcgcttttccctctagcacacccgtgcctacacccccggccccaccagcggcccctaccgaggaggaaacagaggagctgacctggagtggctcccctcgagctggtcaacttgactcaaatcagagggaccgcaacactctgccaaagaagggactgaggtaccagctacaaagtcaagaggaaaccaaggaacggcgccactcacatactattgggggactcccagagagcgatgaccagtctgagttaccttcacccccggcgctgcccatgtcactttctgcaaagggacaattaactaacattgtgtccccaacagcggcaacaactccccgaattaccagaagcaactccattcccacacatgaagcggcctttgagctttactccgggtctcagatgggaagcacgctctcccttgccgagcgtcccaaagggatgatccgcagcggctcatttagagaccctacagatgatgttcatggctccgtgctgtcactggcctcaagcgccagttccacgtacagctccgccgaagagcgcatgcagtctgaacaaattaggaagctgaggagagagctggagagttctcaggagaaggttgctacgctaaccagtcagctgtccgctaacgccaatctggtagcagcttttgaacaatcgctggtaaacatgacctccaggctgaggcatctagccgagacagctgaggagaaggatactgaattgctggacctgcgggagaccattgacttcctgaagaagaaaaacagcgaagcccaggccgtgatccaaggcgcactcaacgccagcgagacaacaccaaaggagttacgcattaaacgacaaaactcttcggatagtataagctccctcaactccattacatcgcacagcagcatcggaagttctaaagacgcggacgccaagaagaagaaaaagaaatcctggctccgcagctcgttcaataaagcattttccatcaagaaggggcccaaaagtgcgagctcctactccgatatagaagagattgccacgcccgactcgagcgctccaagcagtcccaaactacagcacggaagtactgagactgctagcccctcgattaaaagcagcacatcttcaagtgtcggcaccgatgtgactgagggcccagcgcatccagccccacacacgaggctatttcatgccaatgaggaggaagagcctgaaaaaaaggaagtgtccgaattgcgatccgaattgtgggagaaggaaatgaagcttacagacatccgcctggaagccctgaattcggcccaccaacttgaccagttaagagagactatgcataacatgcagttagaggtggacttgcttaaagctgaaaacgataggctgaaggttgcccctggtccgagctcaggatccacacctggccaagttcccggctcttcggccctgtccagccccaggaggagcttggggctggccttgacacacagcttcggccccagtctcgccgataccgacctcagtccgatggacgggatctctacctgtggtcctaaagaagaggtgactttacgggtggtggtgagaatgccaccccagcatattatcaagggcgacctcaagcagcaagaatttttcctggggtgttctaaggtgtcgggcaaggtggattggaaaatgctcgacgaggcagtgtttcaggtgtttaaagactacattagcaagatggatcccgcttcaacactgggtctgagtactgagtccatccatggctacagtataagccatgtgaagcgcgtcttagatgccgagcctccagaaatgcccccttgcaggcggggtgtgaacaatatttctgtctctttgaaaggtctaaaagagaaatgtgtggacagcctggtattcgaaaccttaattcccaagccaatgatgcagcattatatttcactgctactgaaacataggcgtcttgtcctttctgggcctagcggaacaggcaagacttacttaacgaacagactagctgaatatctggttgagcggtccgggagagaagttaccgaaggcattgtctctacgtttaacatgcatcagcagtcttgcaaggacctgcagctttacctctcaaacttggcaaaccagattgatcgggaaaccgggataggcgacgttccactggtaatccttcttgacgatctgtctgaagcggggagtattagcgagctggtgaatggagcccttacctgtaagtaccataaatgtccctacattatcgggaccacaaaccagcctgtgaaaatgactccaaatcacggattacacctctcgttccggatgttgactttctcaaacaacgtggaacccgctaacggttttctggtccggtatcttcgccggaaacttgtcgagtcagattccgacataaatgcaaataaagaggagttgctacgcgttttggactgggtgccaaaactctggtaccatttgcacacttttctagagaaacattctacgtctgactttctgatagggccttgtttttttctgtcttgcccaattggaattgaggactttaggacatggttcatcgatttatggaacaatagcattattccttatttacaggagggagcgaaagatggtataaaggtgcacggccagaaggccgcttgggaagatccagtagagtgggtacgtgatactctgccatggccgtcagctcagcaagaccagagtaaattataccacttgcctccgccgacagtcggaccacactctatcgctagccccccagaagacagaactgtgaaagacagtactccatcctcacttgattccgaccctcttatggctatgcttcttaaactacaggaggcagccaactacattgagtctcccgatcgggaaactattctggatccaaatctgcaagctactctctag

SEQ ID NO: 126277 - DNA, 4482 bp, Artificial Sequence
  Description of Artificial Sequence: Synthetic coding sequence
atgctttggcctagaaacttgacatcctgggacgattctagctccgtgagttcggggattagcgatacgatcgataatctgagtacagacgacattaacacttcttccagcatatcatcctatgcaaatacgccggcctcaagcagaaagaaccttgatgtgcagactgacgcggagaaacattcccaggttgagcgcaactctctttggagtggtgacgatgttaaaaaaagtgacggcggttctgatagtggtattaaaatggagcccgggtcaaagtggaggcggaacccatcggatgtatcagatgagagtgacaaatctaccagcggcaagaagaatccagtgatcagtcagacgggctcttggcggcggggaatgactgcacaggtgggtatcaccatgcctcgcaccaagccttcggccccagcaggggccctcaagacaccaggaactggcaagaccgacgacgctaaagtatccgaaaagggacgcctgagccccaaggcctcccaggtaaaacgaagcccaagcgatgctgggcgatcgtcgggggatgagtctaagaagccactgccgagcagttctaggaccccgactgccaatgccaattccttcgggttcaaaaagcagagcggctcagctgccggtctggccatgatcacggcatcgggggtcactgtgactagccggtccgcaacgctgggaaagatcccaaagtcgagcgccctggtctctagaagcgctggacgcaagtcttcaatggatggagcccaaaaccaggatgatggctatctcgccctgtccagccgcacgaacttgcaatacagatcactgcctagaccaagcaagtccaattcccggaatggcgcaggcaatagatcctccacaagtagtattgactctaacatctcgagcaagtccgccggtctgcccgtgccaaagctgagagagcccagcaagactgctcttggttcatcgttacccggacttgtaaatcagacagataaggagaaagggatttcttccgataacgagtcagttgccagttgcaattccgtcaaagtcaatccagctgcccagccagtgagctcacccgcacaaaccagcttgcagcctggggcaaagtacccagacgtcgcatccccgacactcagacgattattcggcgggaagcccacaaagcaggtaccaatagccacagcagaaaacatgaagaactctgtggtgatatcaaacccgcatgctactatgacgcagcaggggaatcttgattcacctagcggatccggggtcctgtccagcggtagcagttctccgctgtacagcaaaaatgtggacctgaaccagtcaccactggccagcagcccatcaagcgctcactccgccccgagtaactcactcacatggggtactaacgcctcctcaagctccgccgtgagcaaagatggactcggcttccaatcagtgtcctctctccatacctcatgcgagagcatcgacatttccctgagtagcgggggcgtgccctcccataactcgtcaacagggctgattgcctcctcaaaagatgactccctgactccgttcgtgagaacgaactcagtaaaaaccacacttagcgagtcagatccccacctggatcggaatactcttccaaaaaaaggcttgcgttacactcctacatcgcaactccgcacccaagaggacgccaaggaatggctgcgctcacattcagccggtggcctccaggatactgcagctaatagtcccttttcgtccgggtctagcgttacatctccaagtggcaccaggttcaacttttcgcagctggcatcaccaacaacagtgacgcagatgtctctgagcaatcccaccatgctccgtacgcatagcttgtccaatgcagacgggcagtacgatccctacaccgattcacgctttagaaactctagcatgagtttggatgagaaatcgcggacaatgtcccggtccgggtcctttcgcgatggcttcgaggaagtgcacggttcaagtcttagcctggtctcttccacgagttctgtttactcaacccccgaagagaaatgtcagagcgaaataagaaagctccgccgggaactagacgcaagccaagagaaagtgagtgcacttaccacccagctgactgcaaacgcccacttagtggctgcatttgagcagtcattagggaacatgacaattcgccttcaatccctgaccatgacagccgaacagaaggactctgagctgaacgaactgaggaaaaccattgaactcctcaagaagcagaacgcggcggcccaggctgccatcaacggcgtgatcaataccccagagctgaattgcaaaggtaacggaacagctcagtctgccgacctgagaatccgtcgtcagcacagttctgattcagtgtcatctattaacagcgcaacttctcattcatcagttggtagcaacatcgaaagcgacagtaaaaagaagaagaggaagaattggctgagatcctcttttaagcaggcatttgggaaaaaaaaatcgccaaaaagtgcttcctctcacagcgatatcgaagagatgactgactcctctctgccttcttcccccaaattgcctcataatggctccactggttccactccactactgcggaactcccactccaacagtcttatatccgaatgcatggactccgaagccgagaccgtcatgcagctgcgcaatgaactcagagataaagagatgaagttaactgacattcggctcgaggccctaagctctgcgcatcaattggaccagctgcgggaagctatgaatagaatgcagtctgaaatcgaaaagctaaaggccgagaacgatagactcaagagtgagagccagggatcagggtgttctcgcgcaccttcacaggttagcatttcagcatcacctaggcaatctatgggtttaagccagcattctttgaatctgacagagtccacttccctcgacatgctgctcgacgatacgggcgagtgttcagcccgcaaggagggcgggaggcacgtgaagattgtggtgtcttttcaagaggaaatgaagtggaaagaagactctcgtccacacctgttcctgatcggctgcattggtgtcagtggaaaaacaaaatgggacgtccttgatggcgtggtcagacggctgtttaaggagtacatcatacatgtggatcccgtatcccaattgggacttaattccgactccgtgttgggctattctatcggagagattaaacgcagcaataccagcgagacgccagagctgctcccttgtgggtatctggtgggggaaaacacgacaattagcgtgaccgtgaagggattggcagagaactcattggattcactggtgtttgagtcactgatccccaagccaatcctgcagagatacgtgtcactccttattgaacacagaagaatcattctcagcggacccagcggtaccggaaaaacatatctcgcgaatcggctgagcgaatacatagtcctgagagaggggcgcgagctcacagatggcgtgatagcaaccttcaacgtcgatcataagtcatctaaagagctgaggcagtacttaagcaatttggcagatcagtgcaactcagagaataacgcagtggacatgccactcgtgattatactggataacctgcatcatgtgtcttcactgggagagatctttaatggactgctgaactgtaagtatcacaaatgcccatatataattggaaccatgaaccaggcaacctcttccacaccaaaccttcagcttcatcacaatttccgctgggtcctgtgcgccaaccacactgagccagtcaagggttttcttggtcgttttcttagaagaaaactgatggagaccgagatctctggccgcgtgaggaatatggagctagtgaagattatcgattggataccaaaagtgtggcatcaccttaatcggtttctagaagcacatagttcaagtgacgtgacaatcggcccacgcctgttcctgtcttgccctattgatgttgatgggtcccgggtgtggtttaccgatctgtggaactactccattatcccttaccttctggaggccgtgcgggagggactccaactgtatggtagaagagctccatgggaagatccagcaaaatgggtgatggacacgtacccgtgggcggcctctccacagcagcatgagtggccacccctgctgcagctgcggccggaagatgtgggatttgacggatactcaatgcccagagagggctcaacatccaagcagatgccgccatcagacgccgaaggggaccccttaatgaatatgcttatgcgtcttcaggaggccgctaattatagtagtccgcaatcatacgacagcgactctaactcaaacagtcaccacgatgatatccttgactcatctttagagtctaccctttag

SEQ ID NO: 126278 - DNA, 7290 bp, Artificial Sequence
  Description of Artificial Sequence: Synthetic coding sequence
atgcctgccattctagtggcctcaaagatgaagtcaggactgcccaagccagtgcactccgccgcaccgatcttgcatgttccaccggcgagagcaggtcctcagccctgctacttaaaattgggaagtaaagtggaagttagtaaaactacctacccttcacagattcctctcaagtctcaggtactacagggcctgcaggaaccagctggagagggtctcccgttacggaaaagtgggagcgtagagaacggattcgatacccagatttacactgattgggccaaccactacctcgccaaatcgggccacaagcggctgatccgggacttacagcaagatgtgacggatggagtcctgcttgcccagataatccaggttgtggcaaatgaaaaaatcgaagatatcaatgggtgcccaaagaatcgcagtcagatgatagagaatatcgacgcatgtctgaatttcttagcagctaaagggattaatatccagggactctctgcagaggagatacggaacggaaacctaaaagcaattttgggcttattcttcagcctcagccggtacaaacagcagcagcagcagccccagaagcagcacctgtcatccccactgccacccgctgtttctcaggtggctggcgctcccagccaatgccaagccggaaccccccagcagcaagttcccgttacaccacaggcaccttgtcagccgcaccagcccgcaccacatcagcaatctaaggcacaggcggagatgcagtctaggttgcctggccccaccgcaagagtgagcgcggctgggtccgaggcaaagacgcgcggcggctctacaacagcgaataaccgacggtcacagagttttaataactacgataaatccaagccagttaccagtccaccacctcccccttcatctcatgagaaggaacctttagcctcgagcgccagctctcatccgggaatgagtgacaatgcgccagcctcactcgagtccggctcgagcagcacccccacgaattgtagcaccagttccgctatccctcagccaggggccgccactaagccatggcgttcaaagtctctctccgtgaaacatagtgcgacagtgtccatgctttcagtcaaaccccccggaccagaggcgcccaggcccacacccgaagcaatgaagcctgccccaaataatcaaaagtccatgcttgaaaaattaaaacttttcaactcgaaaggaggcagcaaagccggcgaagggccagggtctcgcgacacttcatgcgaacgtctggagacactcccttctttcgaggaatcagaggaacttgaggctgccagtaggatgctcactaccgtcggccctgcatcctctagcccaaaaatcgccctgaaaggaattgcccagcgtaccttctcgcgggccctcaccaataaaaagtcgtctttgaagggcaacgaaaaagagaaggaaaagcagcagagagaaaaagataaggagaaatcgaaagatctggcaaagcgggcttctgtcactgagcgtcttgatttgaaggaggagccgaaagaagaccctagtggtgccgctgttcccgagatgccgaagaagagtagtaagatcgcatctttcattcccaaaggtggcaaattgaactctgctaagaaggaaccgatggccccgtctcacagtggcattcccaaacctggcatgaaatctatgcctgggaagtctccgtccgccccagctccaagcaaggagggagaacggagccgctccggaaaattgtcatccgggctaccacagcagaagccccagctggatggaaggcacagtagcagctcaagttccctggcttcgtcagaggggaagggcccggggggcacaactctcaaccactccattagctcacagactgtcagcggcagtgtaggaaccacacagacaacaggcagcaacacggtgagcgtgcaactgccccagccccaacagcagtacaatcacccaaatactgcaaccgtggcccccttcctgtaccgctcacagacagatacagagggaaatgtaaccgcagagtcctcatcaacaggagtttctgtggaacccagccattttaccaaaaccggccagcctgccctagaagaactgacgggggaggaccccgaagctcgtagacttagaacagtcaaaaatatagccgatcttcgtcagaacctggaggaaactatgagctccttacgggggacacaagtgacccattctactctcgagaccactttcgacactaacgtcactactgaaatgtccggcagaagtatcttatctctgaccggtaggccgaccccccttagttggcgtctggggcagtcgtcacccagactccaggctggggacgccccatctatgggcaacggataccctcctcgagcaaatgcctcacgattcattaacacagaaagtggcagatacgtgtatagtgccccgttaaggcggcagctcgcttcccgaggcagctcagtgtgtcacgtggacgtgagcgataaagccggtgatgagatggaccttgagggtatctccatggacgctccagggtacatgtctgatggcgatgttctgtcaaagaatatcaggactgacgatatcacaagtggttacatgaccgacggaggtttgggcttgtatactcgaaggttaaaccgcctccccgatggaatggccgttgtgcgggagaccctccagcggaacaccagcctgggcctgggagatgcggactcttgggacgactccagttccgtgtcgagcggcatcagtgacacaattgacaatctgagcactgacgacatcaacacgtcaagttcaatatcttcatacgccaatacccctgcatcttctagaaagaacctggatgttcaaactgatgcagagaagcattctcaggtagaacggaatagcctctggtcgggggatgacgtgaagaagtctgacggcggaagtgattctggcattaaaatggaaccaggatctaaatggcggaggaatccttcagacgttagtgacgagagtgataagagtacgagtggtaaaaaaaaccccgtcatctcccagacggggagctggcggcgggggatgacagcccaggtaggtataaccatgcctagaaccaaaccttccgccccggccggcgcactgaagaccccaggcaccggcaaaaccgatgacgctaaggtgagcgagaagggcaggctcagtcccaaggcaagtcaggtgaagcgatcaccatcagacgcaggccgaagttccggtgatgaatctaaaaaaccgctgcctagctcaagcaggacgcccaccgccaacgctaacagttttggttttaagaaacagtctggctctgctgctggtctggccatgataaccgctagtggagtaacagtcacatcccgtagtgccacacttggcaagattcccaagagctctgccctggtctctaggtcagcagggaggaagtcttccatggacggtgcccagaaccaggatgacggctacctggccctgtcttctagaaccaatcttcagtatagatcccttccaagaccctcaaagagcaattctcgcaatggcgccggtaatagatcttctacttccagtattgactctaatatcagctcaaaatctgcaggcctgcccgtgcccaaactgcgtgagccttctaagacagccctgggctcctcactccctggcctcgtcaaccaaacagacaaagaaaaggggattagctctgataacgagagcgtagcaagctgtaattcagttaaagttaatccagctgcgcaacccgtgagttccccagcccagacatccttgcagcctggcgccaagtacccagatgtcgctagccccactttacgaaggctatttggaggcaaacccaccaagcaagtgcccatcgctacggctgagaacatgaagaattccgtcgtcatatcgaatccccatgcaactatgactcagcaagggaatctggactcgcctagcggctccggcgtgctgtcaagcgggtcaagttcaccactctacagcaagaacgtcgatctcaaccaatcacctctggccagtagcccctcctcagcacacagtgcgcctagcaattcgcttacgtggggcaccaacgcttcctcatccagcgctgtgtccaaggacggattgggatttcagtcagtgtcgagcctccatacctcttgcgaatctatcgacatttctctgtctagcggcggagtgcccagccataactcatctaccggtctgatcgcttcatccaaagacgacagtctgacaccttttgtccgaactaatagcgtgaagaccaccctcagtgaatcaccactgtcgtccccagcggccagcccaaaattttgcagatccacccttcctaggaagcaggatagcgacccccatctggataggaatactctacccaagaaggggctgcgctacaccccaacatctcagctgagaacccaagaggacgccaaggagtggctcaggtctcacagtgcgggcggcctccaggacacggccgccaatagcccattctcttctggttctagcgttacgtcgccgagcggcacaaggttcaacttcagccagttggcctctcctactactgtgacgcagatgtcactgagtaatcccaccatgctgcggacgcacagtctcagcaatgccgacgggcagtacgacccctatacagactcccggtttcgtaactcatcaatgagtttagacgagaagtctcgaacaatgagtcggtctggaagttttagggatgggttcgaagaggtccatggcagctctctgtctttggtctctagcacgtcatctgtgtactctacccccgaggagaaatgccagagcgaaattcggaagctgagaagggaattggacgccagccaggagaaggtaagcgcattgacaactcagctcaccgctaacgcccacttggtggctgccttcgaacaaagcctgggtaacatgacgatccgcttacagtccctgaccatgaccgctgagcagaaggattcagaactgaatgagctgcggaaaacaatcgaactcctcaagaaacagaacgctgccgcgcaggctgcgataaacggcgtcattaacacacctgagctcaactgtaagggcaacggtacggcccagtccgcagacctcaggattcgtcgccagcattcaagcgattctgtgagttctattaattctgcgacttctcactcgtccgtcggaagcaatatcgagtccgactcaaagaaaaagaaacggaagaactggctgaggagcagttttaaacaagcatttggaaaaaagaaaagcccaaagagtgcttcctcacatagcgatattgaggagatgactgacagttctcttccaagtagtccgaagctccctcataacggctccactggatcaacccccctccttcgaaactcacactcaaattcattgattagcgagtgcatggacagtgaggctgagacagtgatgcagcttcgcaacgagctgagggacaaggaaatgaagcttactgacattaggctcgaagccctgtcttcagcacaccagctggaccagttaagggaagcaatgaaccgcatgcagtcagaaatcgagaagctgaaagcagagaacgaccgcctcaaatctgaatctcagggatcaggatgttccagagcacccagccaggtgagcatctccgcctccccgcgacaatccatgggcctgagccagcactcgttgaacctgactgagagcacatctctggatatgctgctggacgataccggcgagtgttcggcacgtaaggaggggggtaggcacgtcaagatcgtggtgtcctttcaggaagagatgaagtggaaagaggactcccgcccacatctcttcctgattggttgtatcggcgtatcaggaaaaaccaaatgggatgtcttagacggagtggtgcggcggctgtttaaggagtatatcatccatgttgacccagtgagccagcttggcctgaactccgatagcgtgctaggatacagtattggcgaaattaagcggagcaacaccagcgagacaccagagttgttaccatgtggctacttggttggggagaacacaaccatatccgttacggttaaaggccttgccgagaatagccttgacagccttgtgtttgagagtctgataccaaagccgattcttcagcgctacgtgtcgctgttaatcgagcatcggagaattattctctctggaccaagcggcactgggaagacctacctagccaataggctttcggagtacatcgtccttcgtgaaggtcgcgaactgactgatggggtgattgcgacctttaatgtggaccataaaagcagcaaggagttgcgccagtatctaagcaatctggcagaccagtgcaacagcgagaacaacgccgtggacatgcctcttgtcatcatcctagacaacctacaccatgtgagtagtctcggcgaaatttttaacggactcttgaattgcaagtatcataagtgtccatatatcattggtactatgaatcaggcaacaagttctacccccaacctccaattgcatcataattttagatgggtcctatgcgccaatcacaccgaacctgttaaaggattcttgggaaggtttttaaggaggaaattgatggagacagaaatttcaggtcgagtgcgcaacatggaactggtcaaaataatcgattggataccgaaggtgtggcaccatctgaatcgttttttagaggcccacagcagttcagatgtgaccatcgggccccggctgtttttatcttgccctatcgatgtcgatggatcgcgggtgtggttcactgacttgtggaattacagtattattccttacctcctggaggctgtgcgtgagggactgcaactatatgggcgaagagcaccatgggaggacccagccaagtgggtgatggatacctacccctgggccgctagtccacaacagcatgagtggcctccactgctccaactgaggcctgaggacgtgggatttgatgggtactctatgccgagagagggctccacttccaagcaaatgcccccaagcgatgcagagggagaccccttaatgaatatgctgatgcggcttcaggaggcagctaattatagtagcccccagtcttacgactctgactccaactcaaacagccatcacgacgacatcctggactcatctttagaaagtaccctgtag

SEQ ID NO: 126279 - DNA, 7299 bp, Artificial Sequence
  Description of Artificial Sequence: Synthetic coding sequence
atgccagcgatcctagtagctagcaagatgaaatctggactccctaaacccgttcattcagcggctccgatcctccacgtgccaccagcaagagctggcccccagccctgttatctaaaactgggtagcaaagtcgaggtgtccaaaactacatatccttcccaaatcccactgaaatcccaggtgttgcagggactgcaggagccagctggtgaaggtctgccacttagaaaatccggttcagtggaaaatgggttcgatactcagatctacacagattgggccaaccattacctggccaagagcgggcataaacggttgatccgagatttgcagcaggatgtgactgacggggtgttgcttgcccagatcattcaggtagttgccaatgaaaaaatcgaagatatcaatggctgtcccaagaaccggtcccagatgattgaaaatatagacgcctgcctcaacttcctcgccgcaaaaggaataaacatccagggcctcagcgccgaggagatccgaaatggtaaccttaaggcgattctgggactgtttttttccctgtcccgatacaagcaacagcaacagcaacctcaaaagcagcacctctcttctcccttgccacctgcagtgtcacaggtggccggagcaccttcccagtgtcaggctggcactccacagcagcaggtccccgttactccacaggctccctgccagcctcatcagccagccccccaccagcagtcaaaggctcaagccgaaatgcaaagcagactcccgggccccaccgcaagagtgagcgcagctggctctgaggcaaaaacccgcggcggctccaccaccgccaacaatagaaggagtcagtcatttaataattacgacaaaagtaaaccggtgaccagtcctccacctccgccttcgtcccacgaaaaagagccactagcatcgtctgcctcttctcacccggggatgtctgataatgcccccgctagtctagagtctgggtccagctcaacaccgactaattgctccacatcctccgcaattcctcagcccggagctgctaccaagccttggaggtccaagagtttatccgtgaagcactccgctacggttagcatgctgtctgttaaacccccaggacccgaagccccgcggcctacccccgaggccatgaagccagcacccaacaatcagaaatctatgctggaaaagctcaaattgttcaactcaaagggagggagcaaggccggggaggggcccggatctagggacacctcttgtgagcgcctagagacattgccatccttcgaagaaagcgaagagctggaagcagcatcaagaatgctcactactgtaggccccgcctcctcatccccaaaaattgcactgaaagggatagcacagaggaccttttctcgggcgctgaccaacaaaaaatcctctctgaaggggaacgaaaaggagaaagaaaagcaacagcgagaaaaggataaggagaagtccaaggatcttgccaagagagccagcgttaccgaaagactcgatcttaaagaggagcccaaggaagatccctctggcgccgcggttccagaaatgccgaaaaagtccagcaaaattgccagtttcatccccaagggcggaaaactgaattctgcaaaaaaggagcccatggccccttcccactccgggattcccaagcccggcatgaaaagtatgccaggtaagtcaccgagcgcacccgccccgtctaaggagggggagcggtctaggagcggtaagttgtcttccgggttgccccagcaaaagccccaacttgacggccgtcactctagtagcagtagttcacttgccagttccgaaggcaaggggccaggaggcacgacactcaatcactcaattagcagccagactgtgtctggcagtgttgggaccacacaaacaactggatctaacactgtttcagtccaactcccacaaccccagcagcagtataatcatcctaacactgctacagttgcacccttcctctaccgcagccagaccgacactgagggaaatgtcacagcagaatcctcctctaccggcgtctctgtcgaaccgtcccatttcaccaaaactggccagcctgcactggaggagttgaccggagaagacccagaagccagaagactgagaaccgttaagaatatcgccgaccttaggcaaaacttagaggagacaatgagttcactaaggggcacacaagtcacacacagcaccctggagaccaccttcgacaccaatgtaactacagaaatgtctggacgcagtattctcagcctgactggacggccaacccccctgtcatggagactgggacaatccagtccaagactgcaagcgggcgacgcccccagcatggggaatggctatcccccccgtgcaaatgcttccagatttattaatacagaatccgggagatatgtctactctgcccccttgcggcgccagctggctagcaggggctctagcgtgtgccatgtggatgttagcgataaggctggcgacgaaatggatctcgagggcatctcaatggacgcccctgggtatatgagcgacggcgacgtcctcagcaaaaacatacgtacagatgacatcacgtcaggctatatgaccgacggaggacttggtctctacacgcgcagactgaaccgcctgccagacgggatggctgtggttagagagaccttgcagagaaatacgagcctgggcctcggcgacgcggactcatgggacgactcctcctctgtctcaagcggcatcagcgataccatcgataatcttagcaccgatgacatcaacacctccagctcaatcagcagctacgcaaacacacctgccagcagccggaaaaatctggacgtacagacggacgccgagaaacatagccaggtcgagcgcaattctttgtggagcggtgatgatgtaaaaaagagcgacggtggatctgactctgggattaaaatggagccagggtctaagtggagaagaaatccgagtgacgtttcagacgagtcagataaaagcacatccggcaagaaaaatccagtcatcagtcagaccggatcttggcgacgcggaatgaccgcccaagtcgggatcactatgcctcgtaccaagccaagcgcacctgcaggagcgctgaagacgcccggcactggtaagacagatgatgctaaggtgagcgagaagggccggctgtcccccaaagcatctcaggttaagcgcagtcccagcgatgctggacgctctagcggggatgagtctaagaagccgctcccctcatcctctcgcaccccaacagccaatgctaacagtttcgggtttaagaagcagtcaggaagtgccgccggtctggcgatgatcactgccagtggtgtgacagtaacgtctcggtccgcaactctaggcaaaatacctaagtcatcagcgctggttagccggtctgcaggtcgaaaatcaagcatggacggcgcccaaaatcaagacgatgggtatctcgccttatcgagccgaaccaacttgcagtatcgctcactgccacggccgtcaaagtccaactcacggaatggagctgggaatcggtccagcacctcttccattgatagcaacatctcttcaaaatcggccggcttacccgtacctaaactgcgtgagccgtctaagactgccttgggcagtagcctccccgggctggtgaatcagacggataaggagaagggaatttcctcagacaacgagagcgtggcgtcttgcaattctgtgaaagtcaatccagctgcccagcctgtcagttcgcctgcacaaacctcgctgcaacctggcgctaaatatcccgatgtggccagccccactctgcgaagacttttcgggggcaagcctacgaagcaggtgcctatcgcgacggcagagaatatgaaaaattccgtcgtcattagcaatcctcatgccacgatgacacagcagggtaacctcgactctccatccggctcaggcgtgctctcgagcgggtcctcaagcccgctgtactcaaaaaacgtggacttgaatcaaagccccttggcttcttcgcctagttccgcacactcagctcccagtaattcactgacgtgggggaccaatgcttcaagttcttcagcagtatctaaggatggtttgggatttcagtccgtcagttcgctgcacacttcttgtgagtcgatcgacatttcactctcctcgggaggcgtgccatcccataactccagtaccggcctgattgctagttctaaggacgacagtctgacaccgtttgtacgcacaaatagtgtgaagactacattaagcgaaagcccgttaagttctcccgctgccagtccgaagttttgcagaagtacgctccctagaaagcaggattcagacccacaccttgatcggaacacactgcctaagaagggcctgcgctacacccctacctctcagctccggacacaggaagacgccaaagaatggctgcggtcacattcggccggcggcttgcaagatactgccgcgaattcacccttctcttccggcagttctgttacctcgcccagcggcacccggtttaacttcagccagttggcaagtcctacaactgttacccagatgtcactgtccaatcctaccatgttgcgaacccacagcctgtctaacgcggacggccagtacgatccttatactgacagtagatttcggaactcatctatgagtctggatgaaaagtcgaggactatgtcaagaagtggctcctttcgcgacggatttgaggaagttcacgggtctagcctttccttagtttccagtaccagctctgtttactccacaccggaggagaagtgtcagtctgaaattcggaagcttcgcagagagctcgatgccagccaagagaaggtgagtgcattaactactcaactgacagctaatgctcacctcgttgccgcctttgagcagagtctgggcaacatgaccatcagattacagtctctgacaatgaccgcagagcagaaagactctgagttaaatgagcttagaaaaaccattgagttactcaagaagcaaaacgctgctgcgcaggccgccattaacggagtcattaatactcctgaactcaattgtaaaggtaacggcactgcccaatcggccgatctccgcattaggcggcagcatagtagcgacagtgtgtcgtccatcaacagtgccacaagccattctagcgttggaagtaatattgagagcgactctaagaagaagaaacggaaaaactgggtaaacgagctaaggtcttcattcaaacaggcttttgggaagaaaaagagccccaagtctgccagttcacatagcgacatagaggagatgaccgatagcagcctgccaagtagtccaaaattgccacataatggcagtactggatcaacacctctgttgcgtaattctcattccaatagtctgattagcgaatgtatggacagcgaagcagaaacagttatgcagctcagaaatgagttgcgtgacaaggaaatgaagctcacggacatacgccttgaagccttaagtagtgcccaccagttagatcaactccgggaggctatgaacagaatgcagagcgagatcgagaaacttaaggcagagaatgaccgacttaagtccgaaagccagggctctggctgctccagagcaccttcacaggtgagtatatcagcgtccccccggcaaagtatgggactctcacagcatagtctgaatttaaccgaaagcacctcgctcgacatgcttctcgatgatacaggggagtgctcggctcggaaggagggcgggcggcacgttaaaattgttgtatcctttcaagaggaaatgaagtggaaggaagatagtcgtccgcacctttttctcattggatgcattggcgtgtccggaaagaccaaatgggatgtgctggatggagtggtccggcggttgttcaaggaatatatcattcatgtagatccagtctcccagctgggactcaattcagacagcgtgctcggatacagcatcggggaaatcaagcgtagtaataccagcgagactcctgaacttttgccctgtggttacctggttggagaaaacacaaccataagtgtcaccgtcaaggggctggctgaaaattccctcgactcacttgtgtttgaatcactgataccaaaacctattctacagaggtacgtctccttgctcattgagcatcgccggatcatattgtctggaccctctggcaccggaaaaacatacttggccaaccgcctgtccgaatacatcgtactgcgggaagggcgtgaactgactgatggggtgattgcgacttttaacgtcgatcacaagtcctctaaagagctaaggcagtatctgagtaatctggccgatcagtgtaatagcgagaataatgcagtcgatatgccacttgtgattatcttggataatttacatcacgtatccagcctgggcgagatttttaatgggctgctgaactgtaagtaccacaaatgtccttacattattggcactatgaatcaggcaacgagctctaccccgaacctccagttgcaccacaatttccggtgggtactgtgtgccaaccacacagagcccgtgaaggggtttttgggccgtttcctgagaaggaagctaatggagaccgaaataagcggacgagtgcgcaacatggaattggtcaaaatcatcgattggatcccaaaggtctggcatcatcttaataggtttcttgaggcccattcttcttctgatgtgactatcggtccaagactgtttctgtcctgtccgattgatgtcgatggctctcgggtgtggttcaccgatctatggaattacagtataataccctatttgctagaagctgtgcgtgagggcctgcagctgtacggccgaagggcgccatgggaggatcctgccaaatgggttatggacacatatccctgggctgcatccccgcagcagcatgaatggcctcctctgctgcaactgcggccggaggatgtgggtttcgacggctactctatgccaagagagggtagtacttccaaacagatgccaccctcagatgcagaaggagacccactgatgaacatgcttatgaggcttcaagaggccgccaactactccagtccacagtcatatgatagcgatagcaattctaatagccaccacgatgacatactcgattcgagcctggaaagtacgctgtag

SEQ ID NO: 126280 - DNA, 7467 bp, Artificial Sequence
  Description of Artificial Sequence: Synthetic coding sequence
atgccagccattctcgtggcgagcaaaatgaagtctggactacccaagcctgtgcatagcgccgcccccatactccatgtgcctccagcacgagccggacctcaaccctgttacctcaagctcggatccaaggtggaagtgagcaagaccacatatcctagccaaatcccgctgaagagtcaggtgctccaggggctccaggagccggctggtgaaggcttacctctgaggaaaagcgggtccgtggaaaatggttttgacacacagatctatacagattgggcgaaccactacttggcaaaaagcgggcacaagaggctgatccgcgacctccagcaggacgttactgatggtgtccttttggctcagattattcaggtggtggctaatgaaaagatcgaagatataaacggctgtcccaagaatagaagccagatgatagaaaacattgacgcatgtcttaacttcctggctgccaaaggtattaacattcaaggactgtcagcagaagaaatccgcaacggcaacctgaaggcgattttgggcctgttcttcagcctgtcacggtataaacagcagcagcaacagccccagaagcagcatctctcatccccactgccacccgccgttagtcaggtggccggggcaccttcacagtgtcaggccggaactccacaacagcaagtgcccgtgacccctcaggcaccttgccagccacatcagccagcaccacaccagcagagcaaggcacaggccgagatgcagagcagcgccagctccaaggatagcagtcagagcaaaattatccgattcactctgggtcagaaaaagatttctagactgcctggccctacagcgagagtgtctgcagcagggtccgaggccaaaacgagagggggtagtactacggctaacaatcggagatcccagagctttaacaattacgataaatcaaagcctgtgacctctcccccgcctcccccctcgtcacatgagaaggaacctctcgctagctcagcctcatcccaccctggcatgagtgataacgcgccagcctcactggaatccggaagttcctcaacccctacgaactgctcaacctcaagcgctattcctcaacccggggcagccaccaaaccatggcggagcaagagtctgagcgtgaaacacagtgccaccgtttcaatgctgtctgttaaacccccgggacccgaggcccctcggcctaccccagaggccatgaaaccagctcccaataatcaaaagagcatgctggaaaaacttaaactgttcaactcaaagggtggctcaaaggctggtgaaggacccgggagccgtgacacaagctgcgaaagattggaaaccctcccctccttcgaggaaagcgaagagcttgaggcagctagtcgcatgctgacaacggtgggccccgcctcgtcctctccgaaaatagctctgaaggggattgctcagcgtacatttagccgtgcactgacgaacaaaaagagtagcctcaaaggtaacgaaaaggaaaaagagaagcaacaacgggagaaggataaagagaaatcaaaggacttggccaagcgcgctagtgtcacagagcggctggatcttaaggaggaaccaaaggaagatccatccggcgccgcagtgcccgagatgcccaaaaaatcaagtaagatcgccagcttcataccgaagggcggcaagcttaactccgcaaagaaagagcctatggccccaagccattccgggatccccaagcccggcatgaagagcatgcctggaaagtccccatctgcccccgctcccagcaaggaaggcgagcggtccagatctggtaaattatcctcagggctaccacaacagaaacctcagctggacggccgccactccagctcaagctcttcccttgcctcttcagaagggaaagggccaggggggacaactcttaaccattcaatatcttcccaaacggtttccggctctgttggcacgacccaaacaacaggttccaacacagtttccgtgcagctgccacagccacagcagcagtataatcatcccaacacagccacagtggccccatttctgtaccggtctcagacagacacggagggaaacgtcacggcggagagctctagcacaggagtttcggttgaaccatcccatttcaccaaaaccggccaacctgctttggaagagctgactggcgaagaccctgaagcacgccgcctcagaacggtcaagaacatagctgacctgaggcaaaacttggaggagacaatgtcctctttaagaggcacacaggtcacccactcaaccctagaaacaaccttcgacactaacgtcaccacggagatgagtggccgctctatactgtcgctcactggcaggcccacccccttgtcttggaggctgggccagagttctccgaggctgcaggcaggagacgccccgagcatgggcaatggttatcccccacgcgcaaacgccagtcgattcatcaataccgaatccggccgatatgtctacagcgctccccttcgaagacagctggctagccgtggatcaagtgtctgtcacgtcgatgtgagtgacaaagctggcgacgaaatggatttggagggaatctccatggatgcccccgggtacatgtcagatggagacgttctcagcaaaaatattaggactgacgatataacatcagggtatatgaccgacggcggcctggggctgtacactagacgtctgaatcgactgcctgacggcatggctgtggttcgggagactctgcaacgcaacacatcgctaggcctaggcgacgccgactcttgggatgactccagttcagtttcttctggtatatcagatacgattgataatctgagtacagatgatatcaatacaagctcttcgatcagcagttatgccaacacacccgcatcatctcggaagaatctcgatgtgcagaccgatgcagaaaaacactcccaagtagagcgtaattctttgtggtcaggagatgacgtaaagaaatccgatggcggcagtgattccgggataaagatggaaccaggcagcaaatggcgacggaatccaagtgatgtcagcgacgagtccgacaagtccacctccggcaagaagaatcccgtcatcagtcagacagggtcatggagacgtgggatgacagctcaggttggcattacaatgccacgaaccaaaccttccgcacctgccggagccctgaaaactccaggaactggaaaaactgacgatgcaaaagtatctgaaaaaggtcgcctgagccctaaagcctcccaagtgaagcgttctcctagcgacgccggtcggtcctccggtgatgaatccaagaagcctttgccgtcatcatccagaacccctacggccaacgcaaattcctttgggtttaaaaagcaaagtggctcagcagcgggcctcgctatgataacagcgtccggcgtgaccgtgacctctaggtcagccactctcggcaagattcccaagtcatcggccctagtatcgcgatctgccgggagaaaatccagcatggatggcgcacaaaatcaagatgatgggtacctggccctgagctcaagaactaacctgcagtacagatcactgcctcgcccctccaagtcaaattcacggaacggtgccggtaacaggtcttctaccagttctatagattccaacattagtagcaagtctgctggtctgcctgttcccaagttacgagagccatcaaagaccgctctcggcagctccctgcctggtctcgtgaaccaaactgacaaggagaagggaatcagctctgacaatgaatccgttgctagctgtaacagtgttaaggtgaacccggccgcccagcctgtatcctccccagcgcagactagccttcagcctggagcaaagtaccccgatgtcgcaagtcctacattacggaggctgtttggcggaaagcctacgaagcaggtgcccatcgccacagctgagaacatgaagaacagcgtggtgatttctaatcctcacgctactatgacccaacagggtaacctggattccccttcaggttcaggtgtcttgtcatcaggttcgagctctccactgtactcaaagaacgtcgacttgaaccagtcccctctagcatcaagtccaagcagtgcgcattccgcaccatctaacagcctgacctggggaaccaacgcatcgagcagctcagcagttagcaaagacggcctgggatttcagtcggtgagcagtctccacacctcttgtgagagcattgacatctcactcagctctggaggggttccaagtcacaattccagtaccgggctgattgcttccagtaaagacgacagcttaacaccgtttgtgcgtacaaactccgtcaagacaacactgtctgagagccccttaagctctcccgccgcatcccctaagttctgtcgttcaacactgcctaggaaacaggacagtgacccacatctggatcggaatactctacctaagaagggtcttcgatacacgcctacctcccagctccgcacacaggaggatgcaaaggaatggctaaggagtcacagcgctggagggctgcaggacacagctgctaatagcccattctcctcgggctcatccgtgacttcacctagcggcactaggtttaacttcagccagctggcctctcccaccacagtgacacaaatgtcactgagtaatcccaccatgctgcgcacccactcgctttctaatgccgatggacagtacgatccctacactgacagtcgctttcgcaatagctccatgtccttggacgagaaatcccgcacaatgtcccgatcaggctctttccgggacggctttgaagaggaatcttgggaaaagtcgagcgttgacaactttgtctccagactacactcctccctgcatttctccttaccgctgtttcatcacgctcggtacgagctggtacatggtagcagccttagtcttgtaagcagtacttcgtctgtgtattcaacccctgaggagaaatgccaatcagaaatccggaaactgcgcagagagctggacgcctcccaggaaaaagtgtccgctctgaccacccagcttaccgccaacgctcacctcgtcgctgctttcgagcagtcgttagggaatatgaccatcaggctgcagtcactgacgatgacagccgaacagaaagactctgaacttaatgagctgcggaaaaccattgagctgctgaaaaagcagaatgctgcagcgcaggccgccataaacggcgtcattaacactcctgagcttaactgcaaaggtaacgggaccgcccagagcgctgatctgcgaattagacggcagcacagctctgattcagtttcctcaattaatagcgcaacatctcattcttccgtgggatcaaatatagagtctgattctaaaaagaagaaacgtaaaaattgggtgaacgagttgcggagcagcttcaagcaggccttcggtaagaaaaagtctccaaagtctgcctcctcacactccgacattgaggagatgacagatagctcactgcctagctcgcccaaactgccacataatgggagcactggaagtactcctctcctgcgaaactcccatagtaattccctcataagcgaatgtatggattccgaggctgagacagtcatgcagttgcgtaacgaactacgggataaagaaatgaaattgacagatatcaggctggaggcgctttctagcgcacaccagttggaccagcttagagaggccatgaaccgaatgcaatctgagatcgaaaagttaaaagctgagaacgaccgcctcaagagtgagtcacaaggaagtggatgcagtcgagccccctctcaagtaagcatttctgcttctccacggcagtccatgggcctgagccagcattctttaaacctgactgaatctactagcctggatatgttgctggatgatacgggcgagtgttccgcacggaaggagggaggtagacacgttaagatcgtggtgtctttccaggaagagatgaaatggaaagaggactctcgtccccacctgttccttataggctgcattggcgtcagcggcaaaaccaagtgggatgtgctcgacggggtcgttcgcagactattcaaagaatatataatacatgttgacccagtgtcccagctgggacttaattcagacagtgtcttaggatactccatcggcgaaatcaaaagatcgaacacttccgagacccccgagttgcttccatgcggctatctggtgggcgaaaataccacaatctccgtgaccgtcaaaggtctggccgagaatagcctggacagccttgtcttcgagagcttaatccctaagccaattctccagaggtacgtgtctctgcttatcgagcatcgtaggatcattttgtctggcccctctggcaccggaaaaacctacttggcgaatcgccttagtgagtatattgttcttagggaggggagggaactgactgacggcgtgatcgcaacgttcaacgtcgaccacaaaagctccaaagaactgcggcaatatcttagtaatctggcagatcagtgcaatagcgagaataacgcggtggatatgccgctggtgatcattctggataacctccatcacgtatcctctctgggtgaaatttttaacgggctgcttaactgcaagtatcataagtgcccttatattatcggaaccatgaaccaggcgacgtcttcaacgcccaatctgcagcttcaccataactttcgctgggtcctgtgcgctaaccacacagagcctgtaaagggctttctggggcgctttctacggcgcaaattgatggaaacagagatttcagggagagtgcgtaacatggagcttgtgaagatcatcgattggattcccaaagtatggcaccatctcaatcgctttttggaggcacatagctccagcgatgtcacaattggcccgaggttatttctgagctgtccaattgatgttgatggaagtcgagtgtggtttaccgacctctggaactattctattattccatacttgctggaagcagtgagggaaggcttacaactctacggtcgccgcgccccatgggaggatccggctaagtgggttatggatacatatccatgggcggccagtcctcagcagcacgagtggccacccttactgcagcttcggccagaagatgtgggctttgacggatactccatgcctcgagaaggcagcaccagcaagcagatgccaccgagtgacgcagaaggtgaccctctcatgaatatgcttatgcggctgcaagaagcagccaattattcctctccccagtcttacgactctgacagtaatagtaactcccatcacgacgatatcctcgacagttcccttgaatcgaccctttag

SEQ ID NO: 126281 - DNA, 7254 bp, Artificial Sequence
  Description of Artificial Sequence: Synthetic coding sequence
atgtctgtgatgctctggcggtgggaacagaataatactactatgaagctgcagatttatacagactgggccaaccattatctggcaaagtctggccataagagactgatcagggatcttcagcaggatgtgaccgacggcgtgctcctagctcagatcatccaggtggtggccaatgagaagatagaagacattaacgggtgtcccaagaacaggtcacaaatgattgagaacatagacgcttgcctgaattttctggctgccaaagggatcaacatccagggcctgtcggcagaggagatccgcaatgggaacctcaaggcaatcctggggctctttttctcgctgtcccgctacaagcaacaacagcagcaacctcaaaagcaacacctttcatctcctcttccaccggccgttagccaggtcgccggagccccatcccagtgtcaggcaggcacgccacaacaacaggtgcccgtgacacctcaggccccttgtcagccccaccaaccggcaccccatcaacagtctaaagcacaggcggagatgcagtctagcgcctcttcaaaagactcttcacaaagcaaaataattaggtttactctcggacaaaagaaaatttctcgactacccggccctactgcaagggtttctgccgccggatcagaagccaagacccggggaggctccacaaccgccaacaatcgcagatcacaatccttcaacaactacgacaaaagtaagcctgtaacctctccaccgccacctccctccagccacgaaaaggaaccacttgcttcgtccgctagctcccaccctggtatgtcggacaacgcacccgccagcctcgagagcggtagtagcagcactcccacaaactgttccacgagttctgccatacctcagcctggagcagcaaccaaaccttggcgctctaagtctttatcagtgaagcactctgcaacggtttctatgctgagtgtgaagccccccggccctgaggctccccggccgacccctgaggccatgaagcccgcccctaataaccagaagagtatgctggagaaactgaaactgttcaactcgaagggcggttcaaaggcaggagaaggacctggttcgcgtgatactagctgtgaaagactggagaccctcccatcgttcgaagagtctgaagagcttgaggctgctagcaggatgttgactacggtaggtcccgccagtagcagccccaaaattgctctaaaggggatagctcagaggacattctcccgcgcacttacgaataagaagagttcattgaagggaaacgaaaaagagaaggaaaaacaacagagggaaaaggacaaggagaaaagcaaagacctcgccaagcgcgctagcgtaacggagaggctcgatctaaaggaagagcctaaggaggatccctccggcgctgcagtaccggagatgccgaaaaagagttctaaaatagccagcttcatccccaaaggtggaaaactgaatagcgctaagaaggagccgatggctccgtcacactccggcattcctaagccaggtatgaaatccatgccagggaaatctcccagtgcgccagccccaagcaaggagggcgagcggtctaggtctggcaaactgtcatccgggctcccccagcagaagccacaactcgacgggagacactcctcctcctcatcaagcctagcatcctctgagggcaagggcccgggcggcaccaccctgaaccatagcatcagcagtcagaccgtgtccggatcagtgggcacaacgcaaacaactggtagcaataccgtgagtgtgcaactgccacagccccagcaacagtataaccaccccaacactgcaacagtggcccccttcctctatagatcccagactgacacagaggggaatgttactgctgagtcatcctccactggagtgtccgtggagcccagtcacttcactaaaacaggacagccagcactggaagaacttactggagaagatcccgaagcccggaggctcaggacagtcaagaatattgcagatctcaggcagaacctcgaggaaaccatgtcctcgctgaggggcacgcaagtcacccactctacgctggaaacaacgttcgacacaaacgttacaacagaaatgtcagggcgatctatcctctcgttaaccggtcggcctacacccttgtcctggcgattaggccagagtagccctaggctgcaggccggtgacgctcccagcatggggaacggctatccgcctcgagccaatgcttcacgatttatcaacaccgaatctggcagatatgtgtactcagcccctctccgcaggcaattggctagccggggttctagcgtgtgccacgtcgacgtcagcgacaaggcgggcgacgagatggacttggaaggtatctcaatggatgcgcccggatatatgtcggatggagatgtgctgtccaagaatatcaggaccgacgatatcacgagcgggtacatgacagacggaggactggggctatatacgcggcgccttaatagattgccggatgggatggcagtggtgagagaaacgctccagaggaacacatctctgggactgggcgacgcagactcttgggacgattccagctcagtatccagcggaatctccgacacaattgacaatttatccacagacgacattaacaccagttcatcaatctctagctacgctaatacaccggcctcttcgcgaaaaaatctggatgtgcagacagacgcagaaaagcatagtcaagttgagcggaactccttgtggtcgggggatgacgtaaagaagtctgacggcggaagtgactctggcatcaagatggaacccggaagtaagtggagacgaaacccaagcgatgtgtctgatgaatctgataagagtactagcggtaaaaagaatcccgttatttcccagacgggttcctggcggcgggggatgacagctcaggtgggcatcacaatgccccggaccaagcctagcgctcccgccggagcacttaagacacccggcacaggaaagacagatgacgccaaggttagcgagaaggggcgcttgtcccctaaagcctctcaggtgaagcggtctccatccgatgctgggcgatcctccggtgacgagagcaagaagcccctaccgtccagtagcaggacccccactgccaacgcgaattccttcggcttcaaaaagcaaagcggctcggccgctggcctcgccatgatcaccgcgagcggtgtgactgtaacatctagatctgcgacgctgggaaaaatccctaaatcctccgcccttgtgtcccggagcgcaggacgtaaaagctcaatggatggggcacagaatcaggatgatgggtatcttgctctgtctagcaggacaaatctgcagtaccgcagccttcccagacctagtaaaagcaacagcaggaatggagcgggaaacagatctagtacatcgtccatagattcaaacatatcaagcaagagtgctggactacctgtaccaaagctgagggagccatctaagacagcactggggtctagcttgcctgggctggtcaaccaaacagacaaagaaaaaggaatttccagcgacaatgagtcggtcgcatcatgcaattctgtaaaggtcaaccccgccgcccaaccagtgagctctccagcccaaacgagcttacagccaggggcgaagtaccccgacgttgcttccccaacgctgcggcggctgttcggaggtaagcccacgaagcaggtccctatcgcaaccgcagagaatatgaaaaactcagtcgtcatctcgaacccacacgcaaccatgacacaacagggaaatctggattctccctcagggtctggagttttgtcatctggatccagctcacccctctattctaaaaatgtcgaccttaatcagtcgcctctcgcatcatcacctagctctgcccactctgccccgagcaattcactcacctgggggactaacgcctcaagcagttcagccgtttccaaagatgggcttgggtttcaaagcgtgtccagccttcataccagttgtgagtcaattgacataagtctgtcatctggcggcgtcccttcccataactcctccactggcttaattgccagcagcaaggatgacagtctgactcctttcgtcaggacaaatagtgtgaaaacaaccctgtccgagtcacccctgagcagtcctgcagcctcacccaagttctgccggtccacgctgcctcgaaagcaggactccgatccccatctcgaccgcaatacactgccaaaaaagggattgcgctacacaccaacctcgcagctgaggacccaagaggatgccaaagaatggctgagaagtcattcagcgggggggctccaggacacagccgcaaatagccctttttcaagtgggagttccgtcactagcccctctgggacaaggtttaattttagccagctcgcctcccccactacggtgacacagatgagcctttctaacccaacaatgcttcggacacatagcttatctaatgctgacgggcagtacgacccgtacaccgacagccggtttagaaattcttccatgagcttagacgagaaaagccgcacgatgtcccgatccggatccttccgggacggatttgaagaggagtcctgggagaaatcctccgtggacaacttcgtgtctcgcctgcactcctcactgcacttctctctgcctctgttccaccatgcaagatacgaattggtacatgggagttcactctcactggtgtcaagcacttctagtgtgtatagcacgccagaggagaaatgtcagtctgaaattcgcaagctgcgaagagagttagacgcaagccaggaaaaggtttctgccctgacaactcagcttaccgccaatgcccacctcgtagcagcatttgagcagtccttaggcaacatgactatcagactccagagtcttaccatgaccgccgaacagaaggactctgagctgaacgaacttaggaaaaccatcgagttattgaagaaacagaatgctgctgctcaagctgctatcaatggcgtaattaatacacctgagcttaattgtaagggaaacgggaccgcccagtccgctgacctgcgtatccgcaggcaacattcctccgattccgtgtcctccataaactcggcaacatcacacagcagcgtaggctctaacattgagtctgactctaagaagaaaaaacgcaaaaactgggtgaacgagttacggtcctcatttaagcaagcgtttggaaaaaagaaatccccaaaaagcgcttcatcccactccgacattgaagaaatgacggattcctccctgccatcaagccctaagcttcctcacaatggtagtacaggctctactcctctgctacgcaatagccactccaacagcctgatatccgagtgcatggacagtgaagccgagaccgttatgcagttgaggaacgaactgcgcgacaaggagatgaagctgactgatatcaggctggaagcactatcctccgcccaccagctggatcaactcagggaggcaatgaacagaatgcagagtgagatcgaaaagctgaaagcggaaaatgaccggctcaagtccgagagccaagggtccggctgcagtagagcccccagccaggtttccattagcgcttcgccacgacagagcatggggctgtcacaacattcattaaacctgacggagtctaccagcctggatatgctgctcgacgataccggagaatgctcggcccggaaagaaggcgggcggcatgtcaaaatagtcgtcagcttccaggaagagatgaagtggaaagaggattcccgcccacacctattccttatcggatgtataggagtctccggcaagaccaagtgggatgtactcgacggggtggtgcggcgactttttaaagagtatattatccacgtggatcccgtgtctcaactgggactgaactcagattctgtacttggctattcaattggagagataaagaggtccaatacctccgaaacaccagagctccttccctgtgggtatctcgtgggtgaaaatactacaattagtgttacagtgaagggcctggcagaaaattccctcgattccctggtcttcgagtctctgattcccaagcccattcttcagagatacgtgagtctgctcattgagcacagaaggatcattctgagtggcccctcagggactggaaaaacctacctggctaaccggcttagcgaatatatcgtcctacgggaaggacgggagcttacagacggggtcatagctaccttcaacgtggaccacaagtccagcaaagaacttaggcagtacctgtcaaacctagctgatcagtgcaactcagaaaacaatgccgtcgatatgcctttagtgataatcttagataatctacatcatgtgtcatcactcggcgaaatttttaatgggttactcaactgcaagtaccataagtgtccatacatcattggcacaatgaaccaagccaccagtagcacccctaacctgcagttgcatcataactttcgttgggtcctttgcgcgaaccacactgagcctgtgaaagggtttctggggaggttcctgaggaggaagctgatggagaccgaaattagcggccgggtgagaaacatggagcttgtcaaaataattgactggatcccaaaggtatggcaccatctcaatcgtttcctagaggcccactccagcagtgacgtcacaatcggaccacggctgttcctgtcctgcccgattgacgtggacgggagcagagtctggtttacagacctgtggaattatagcataatcccatatttattggaagcagtacgcgaagggctgcagctttacggtagacgggccccttgggaagatccagctaagtgggtgatggacacctacccctgggcagcctctcctcagcagcacgaatggcctccacttctccagctcaggccagaggatgtgggctttgatggctactccatgccccgggaggggtccacttcaaagcagatgcctccctccgatgcagaaggagatcctctgatgaacatgctgatgaggctgcaggaggcagcaaactactcatctccacaatcatatgatagtgattctaactcgaacagtcatcacgacgatatcctagactcttctttggagagcaccttgtag

SEQ ID NO: 126282 - DNA, 4482 bp, Artificial Sequence
  Description of Artificial Sequence: Synthetic coding sequence
atgctgtggccacggaacctgacaagctgggatgactccagcagtgtttcatccggcatctcagacacgatcgataacctgtctactgatgacattaacacctcgagcagcatttcatcttatgccaacacgccggcctcttccagaaaaaacctggacgtgcagactgatgctgagaagcatagccaggtggagcgtaactctctgtggagcggagatgacgtgaagaagagcgacggcgggtccgactcagggatcaagatggagcctggatccaagtggaggaggaatcccagcgacgtcagtgatgagtctgacaagtcaacctcggggaagaagaacccagtgattagccagaccggtagttggaggcgcggcatgacagcacaggtgggaataaccatgcctcggaccaagcccagcgcccccgccggtgcccttaaaacacccgggaccggcaagaccgacgatgctaaggtgtccgaaaaaggccgcctgagcccgaaggctagccaggtgaagcggtccccaagcgacgcgggaaggagctcaggagatgagtccaagaaacccctgccatcttcatctagaacacccacggcgaacgccaacagcttcggctttaaaaaacagtcaggatctgccgctggcctggcaatgattactgcctccggggtcactgtgacgtcccggtcggccaccctgggcaagattcctaaatcttcggctcttgtgtccagatcagccggccgcaagtcgagtatggacggcgcgcagaaccaggacgacggctacctggccctctcctctcgaaccaacctgcagtatagatccctgcctcgaccctctaagtccaatagcaggaatggcgccggaaatcggagttccacaagctccattgactctaacatttcctctaagagcgccggactgcctgtgccaaaactgcgggaaccgtccaagactgctctgggctctagcctacccggcctggtgaaccaaacggataaagagaagggtatttcttccgacaatgagagcgtcgcaagctgcaattctgtcaaggttaacccagctgctcagccagtgtcctctccggcccaaacaagcctgcaacccggagcgaaatacccagacgtcgcctcaccaactctgcgccgcctcttcggagggaaacctaccaaacaggtgcctatagctactgccgaaaacatgaagaacagcgtggtgataagcaatccgcatgcaaccatgacccagcagggtaatctggacagtccttcaggaagtggcgtcttgtcctctgggagctcaagcccactatattcaaaaaatgtcgacttgaaccaatcccccctggcctcttccccctcttctgcccactcggccccatcgaactctctcacgtggggtactaatgcaagctcttcgtcggccgtctcaaaagacggcttgggtttccagagtgtgtcgtccctccacacgtcctgtgaatccatagacataagtctgagcagcggaggcgtacccagtcacaactcatccaccggactgattgcttctagcaaggatgacagcctcacacctttcgtacggactaactcagtgaagacaaccctgagtgagtctgacccacatctcgaccggaacaccctgcccaagaaggggctgcgctacacacccaccagccagttacgcacacaggaggacgccaaagaatggctgaggagccacagcgcaggtggcctccaggacaccgctgcaaactccccttttagtagcggctcctccgtaacgtcaccatccgggactagattcaatttttctcagctggcatcccccaccactgtcacccaaatgagcctgtcaaaccctactatgctgcgcacacacagcctttcaaacgccgacggccaatacgacccctatacagactctcgcttccgaaattcttcaatgagtttggacgagaagtctcggaccatgtctcgctcaggatccttcagagacggattcgaagaagtccacggatcttctctgtcactggtgtcttcaacttccagtgtctacagcactcctgaggaaaaatgccagtccgagatcagaaagctgaggagagagctggatgcctcccaagagaaagtgtctgcccttactacacaattgacagcaaatgctcatctggtagcggcctttgagcagtctttaggaaatatgaccatacggctgcagagcctcacaatgaccgctgagcagaaggacagtgaacttaacgaactgaggaagactatagaactactcaagaagcagaatgctgccgctcaggcggccattaacggggtcataaacacacctgagctcaattgcaaaggtaacggcacagcacaaagcgccgatctccgaatcaggaggcagcactcttcagactccgtgagttctattaactccgctaccagccatagttctgtcggcagcaacatcgaatctgactctaagaagaaaaagcgcaagaattggcttagatctagtttcaagcaggcgttcggtaagaagaagagtcctaaaagtgcttcaagccattccgacattgaggaaatgacggatagttccctcccaagcagtccaaagctcccacacaacggcagtactggcagtaccccattactacgaaattcccattcaaattctttgatctcagaatgcatggacagcgaggccgagacggtcatgcagctgagaaatgagctgagggataaggaaatgaagctcacggacatcaggctggaggccctgagttcagctcaccagctggatcagctcagggaggccatgaacaggatgcagtccgaaattgagaagctgaaggctgaaaatgaccggctgaagtctgagtctcagggcagcggctgtagtcgggctccttcacaagtgagtatatccgctagtcctagacagagcatggggctgtcacagcacagcctgaacctaactgagagcacttccttggacatgcttttggacgacaccggtgaatgtagcgctaggaaggaggggggcaggcacgtcaaaattgtggtttctttccaggaagagatgaagtggaaagaggatagcagaccccatcttttcctgattggatgcattggggttagtggaaagactaagtgggacgtcctggacggagtggtaagaagattatttaaggagtacataatacatgtggatccagtgtcccagctaggactaaattctgactcggtgctgggctacagcattggggagatcaagcgttccaatacttcggagacacccgagctgttgccgtgcggttacctggtgggcgagaataccactatcagcgtcaccgttaagggcctggccgaaaattcactggacagcctggtgtttgaaagcctgattcctaaaccgatcctccagagatacgtgtctctgctgattgagcatcggcgcattattttaagcggcccgagcggcactggtaaaacctacctggctaaccggctctcagagtatatcgttcttagagagggccgagaactgaccgacggggtcatagcaacattcaacgtagaccataaatcatcaaaggaactgcggcagtatctctcaaaccttgcagaccagtgcaattccgaaaacaacgctgtggatatgcccttggtgattatcctagataatcttcatcacgtaagttctctgggagagatctttaatgggctgctgaactgtaagtatcataaatgtccctacatcatcggcactatgaaccaagcaacttcatccacccccaatctgcaactgcatcataactttcgctgggtcctgtgcgcaaaccatacggagccagtgaagggatttcttggccgcttcctgcgccgtaagcttatggagactgaaatttcaggcagggtgcgcaacatggagttggtgaaaataattgactggatccccaaagtgtggcatcacctgaatcgatttctggaggcccactcctccagcgatgtgacaattggccccaggctctttttaagctgccctatcgatgtggatggatcacgagtgtggtttacagacctgtggaactattcaatcattccgtacctgctagaggccgttagagaaggactccagttatatgggcgtcgcgctccttgggaggatcctgcaaagtgggttatggatacgtatccttgggctgctagccctcagcaacacgagtggcctcctctcttacagcttaggcccgaagacgtaggctttgacggctattcaatgccacgcgagggtagcacctcaaaacagatgcctcccagcgacgccgagggtgatccattgatgaacatgctgatgcggcttcaagaagccgccaactattcctctccccagtcttacgactctgattctaacagcaatagccatcacgatgatatactagactcctcattggaaagtaccttgtag

SEQ ID NO: 126283 - DNA, 2451 bp, Artificial Sequence
  Description of Artificial Sequence: Synthetic coding sequence
atgctctggccacggaatctgacatcctgggacgacagttccagtgtatcttccggcatcagtgataccattgataacctgagcactgatgatatcaatactagttcttctatctcaagctacgcaaatacgccagcttcatccaggaaaaatctggacgtgcagacagatgcagagaagcatagtcaagtggagagaaactccttatggagcggagacgatgttaagaaaagtgacggcggcagcgattctgggataaagatggagccaggatccaagtggcgtcggaaccccagcgacgtaagtgatgagagcgataaatctacaagcggaaaaaaaaaccccgtgatctctcagacaggttcctggcgtcggggtatgaccgcccaagtcggaatcacaatgccccgcaccaagccttctgccccagccggtgcgctgaaaactccaggaaccggtaagactgacgacgctaaagtatccgagaagggcaggttgtcacctaaggcttctcaggttaagcggtccccaagtgatgccggcaggagcagcggtgatgaaagcaagaagccgctgccatcctcaagccggactcccacagccaatgctaattcattcggcttcaaaaaacagagcggctcggcagccgggctggccatgatcaccgcctccggggtgacagtaacgagccgtagtgcaacccttggtaagatccccaagagttccgcactggtctctcgcagtgccgggcgcaagtcaagtatggacggagcgcagaaccaggacgacggctatctcgcgctctcttccagaaccaacctgcagtatcgcagcttgcctcggccctccaagtctaattctcgaaatggggccgggaacaggagcagcacgtcttcaattgatagcaatatctcatcaaagtccgcaggcctcccggtacccaagctgcgggaaccctccaaaacagctctcggatcgagtctgcctggcttggtaaatcagacagacaaagaaaaagggatttcgtccgataatgagtcggtggctagctgcaactcagtgaaggttaatcccgccgcacagccagtgtccagtcctgcccagacctccttacagcccggtgccaagtacccagatgtggccagccccactcttcgcaggctgtttgggggaaagcccaccaaacaggtgccaatagccaccgctgagaacatgaaaaacagcgtggtaatcagcaatcctcacgctactatgacccagcagggtaatttggattcgcccagcggtagcggtgtgctatcttccggcagctcctcacccttgtacagtaagaatgttgacctgaatcagagccctctggcctccagcccttcctctgcacattccgccccgtctaattccttaacctggggaacgaatgcctcttcatctagtgccgtctccaaggacggactgggatttcagtctgtgtcctccctgcatacttcatgtgagagtatcgatatctcattatcttccgggggagtgccctcacataacagcagcaccggcttgatcgcttcttcgaaagatgatagtctgacaccttttgtgagaacaaatagtgttaagacgaccttgagtgaaaggtacacaccgacaagccaactgcggacacaggaagatgccaaggaatggctcaggagtcactcagcgggagggctgcaggacacagcggctaactctccgttcagcagcggctcttcagtcacctccccctctggaactaggtttaatttcagtcagttggcgagtcccacaaccgtgacacagatgtccctcagcaaccctacaatgttgagaacccattctctttccaacgctgacgggcagtacgacccttatactgattctcggttcaggaactcaagcatgtcactagatgaaaaaagccgaaccatgtcacgatccggttcattcagagatgggttcgaagaggttcacggttcgtcactctcactggtttcaagtacctcctcggtgtactctactccggaggagaaatgccagtcagaaatcaggaaacttcgtcgggaactggacgcttcgcaggaaaaagtctctgcccttactacccaactaaccgctaacgctcatctggtagctgcatttgagcagtcgctgggaaacatgactatccgactgcagtccctaacaatgaccgcggaacagaaggattctgaactcaatgaactgagaaagaccatcgagttgctcaagaagcaaaatgcggctgcccaagccgctattaatggcgtcatcaacacccccgaactcaactgcaagggtaatggtaccgcacagtctgcagatctccgaatacgacgccagcactcatctgatagcgtcagtagtattaactccgccacatcacattcatccgtggggtctaatatcgagagcgattcgtag

SEQ ID NO: 126284 - DNA, 7260 bp, Artificial Sequence
  Description of Artificial Sequence: Synthetic coding sequence
atggcaattgacctgtattgcggactagcctgtttgtggggcatccatgagcctagacaaatatacaccgactgggctaatcactacctggctaaatcaggccacaagcgactaatccgggatttacagcaggacgtaaccgatggagtactgctagcgcagatcattcaggtggtggcaaatgaaaagattgaggacataaacggctgccccaagaacaggagccagatgatagagaatattgacgcatgcttgaattttcttgccgccaagggtatcaatattcagggtctctccgctgaggagatccggaatggcaacctcaaagcgatcctcgggctctttttttccctgagccgatataagcagcagcagcagcaaccgcaaaaacaacacttgtcatccccccttcccccggcggtgagtcaagtcgcgggagcaccgagtcagtgtcaagcagggacacctcaacagcaagttcccgtgacaccacaggcaccgtgtcagcctcatcaaccagctccacatcagcagtccaaggctcaggccgaaatgcagagctctgcttcttccaaagacagtagccagtccaagattataagattcactctggggcagaagaaaatttcacggttaccaggccctacggctcgggtcagtgcagccggatccgaagcaaaaaccaggggtggctcgacaaccgcaaataatagacgctcgcaaagtttcaacaactacgacaagagcaagccagtgacctctcccccgccacccccttcatctcatgagaaagaacctctcgcttctagtgcctccagccaccctggaatgagtgataatgcaccagcctccctagagagcggaagcagctcgactcccactaattgtagtacctctagtgcgattcctcaacctggcgcagcaaccaaaccgtggaggtcaaaatccttgtctgtgaagcactccgctacagtctctatgctctccgtaaaacctccaggccccgaggcccccagaccaacacccgaagcgatgaaaccagctccgaacaatcaaaaaagtatgctggagaaacttaaactgtttaattctaaaggaggcagtaaggccggtgagggaccaggatcccgcgatactagctgtgaacgcctcgagacactgccctcatttgaagagtcagaagagctggaagctgcgagtcgaatgttaacaacagtgggcccagcttcctcctctcctaaaattgctctaaaaggcatcgcccagcggaccttcagtcgggctctgacaaataaaaaatcttctctgaaaggcaacgaaaaagaaaaggaaaaacagcagagagagaaggataaggagaagagtaaggacctagctaaacgtgcctccgtgacagaaagactcgacctgaaagaagagcccaaggaagatccaagcggagccgcagtccccgagatgccaaagaagtctagtaagatcgctagctttatccctaaaggcggtaagttaaacagtgccaagaaagagcccatggcccccagccacagcggaatcccaaagcccggtatgaagtccatgcccggaaagtcgccttccgctcccgccccatctaaggagggagaacgctcccgtagtgggaaactgtcaagcggtttaccccagcagaagcctcaacttgacggacggcactccagttccagttcctctctggcaagtagtgaagggaagggacccggcggcaccaccctaaatcattctatctcctcccagaccgtttcaggctctgttggaaccacacagaccaccgggtccaatacagtatctgtgcagctgccacagcctcagcaacagtataatcacccaaatacggctactgtggccccctttctgtacagaagccagacggataccgaaggaaatgtgaccgcagagtccagctctacaggagtgtctgtggagccatcccatttcactaagactggtcagcccgccctcgaagaactcaccggcgaagatcccgaggctcgacggctgcgaacagtaaaaaacatagcagacctgcgccagaaccttgaagaaacgatgtcttctctgaggggcactcaggtgacccattctactctggagactacattcgacaccaatgtcactaccgaaatgtcgggtagaagcattctgtctctgaccggaaggcccacccccctgtcctggagacttggccagtccagtccacggctgcaggcaggcgatgctccatccatgggaaatggctacccaccccgcgcgaatgctagccggtttattaacacagaaagtggcaggtatgtctatagcgctcctctgaggcgccagttagcatcccgcggctctagtgtctgccacgttgacgtctcggataaagcaggggatgagatggacctcgagggtatctccatggatgcacctggatatatgagcgatggcgatgttctcagcaagaatatccgcactgatgacatcacaagtgggtatatgactgacggcggtctggggctgtatacccggaggttgaaccgcctgccggatggcatggcagtagtgcgtgagactctgcaacggaacacctcactgggcctcggcgatgcagacagctgggacgattcttccagcgtaagctccggcatcagcgatacaattgataacctcagcaccgacgacataaatacttctagttcaattagctcatacgccaacacccccgcctcaagccgaaagaaccttgatgtgcagaccgacgccgagaagcatagccaagttgagcgaaatagtttatggagtggggacgatgtgaagaaatccgacggcggttccgactccggaataaaaatggaacctggctcaaagtggcgccggaaccccagcgatgtgagtgatgaaagcgacaagtccacttctggcaagaagaaccctgtaatctcccagaccggttcgtggaggcgggggatgactgcgcaggttggtataaccatgcctagaaccaaaccatcagcccccgcaggcgctcttaagacacctgggacgggaaagaccgatgatgccaaggtatcagaaaaaggccgccttagtcccaaggccagccaggtaaagcgaagcccaagtgacgccggccgatcaagtggtgacgaatccaagaagcctctcccctcatcctcccgaacacctacagccaatgcaaacagcttcggcttcaagaaacagagcggcagtgccgccggcctggctatgattaccgctagcggcgtgacggtgaccagtcgaagtgccacattaggaaagattcccaagagcagtgctcttgtaagtcggagcgccgggcgaaagtcaagcatggacggcgcccaaaatcaagacgacggctacctcgctctgtcttcacggactaatcttcagtatcggtccctaccccggccatcaaaatccaattctcggaatggcgcaggcaacagaagttccacctcctctatcgacagcaacatcagttctaagagcgcaggtctgccggtacctaaactgcgagaaccgagtaaaaccgccttgggtagtagtctgcctgggttggtaaatcaaaccgataaggaaaagggaatcagttctgacaatgagtccgtagcgtcatgcaactccgtcaaagtcaatccagcagcccaaccggttagcagcccggctcaaacaagtctccagcctggggccaaatacccggacgtggctagcccaacattgcggcgactgtttggcggcaagccgaccaaacaggtgccgatcgctactgcagaaaacatgaagaatagcgtcgtaatctccaatcctcatgcgactatgacacaacaaggcaatctggatagtccttccggatccggcgtgttgagcagcggcagcagctctcctctgtattcaaagaatgttgacctgaaccaaagtcctctggctagtagcccctctagcgctcactcggccccctccaactctctgacatggggaaccaacgcatcgtcttcatcagccgtgtcaaaagatggactcggattccagtccgtttcatcactgcacacatcttgcgaatcaatagatatttcactatccagtggcggggtcccctcacacaattctagcacggggctcattgcctcctccaaggacgactctttgactcctttcgtgcgcaccaattccgtgaagacgacgctgtctgaatctcccctcagttcacctgctgcctcgcccaagttttgtagaagcacactccctagaaaacaggacagcgatcctcatctggaccggaataccctaccaaaaaaaggcttgagatacactccgacctcccagcttcgcacgcaggaggacgcaaaggaatggctgcgaagccactccgccggcggactccaggatacagcggcaaacagccccttttcatccggaagttcagtgacctccccgagtgggacacggttcaatttctcacagcttgcaagcccgaccaccgtaacccagatgtctctgagcaacccaacgatgttacgcacgcattcactcagcaatgctgatggacagtatgacccgtatacggactccaggtttcgcaactcatctatgtccctggatgagaaaagccgaacaatgtcaaggagtggctcattcagggatggttttgaggaggaatcctgggagaaatcttccgtagacaattttgtgagccgactgcacagttcactgcatttcagccttccactgtttcatcacgctcgctacgaattagtacacggctccagtctgagcctggtttcctcaacttcgtcagtgtactctactccagaagagaaatgccaaagcgaaatcaggaagcttaggcgggaacttgatgcatcacaagagaaagtgtctgccctgacaacacaactgacagccaacgcccacctggtggccgccttcgagcagtctctggggaacatgactataagactacagagtctcacgatgactgcagagcaaaaagattccgagctaaacgagctcagaaaaaccattgaacttctgaagaagcaaaatgcagcagcccaggcagccatcaatggagtgattaacacgcccgagttaaattgcaaagggaatggtacagcccagagcgcagacctgcgaataagaagacaacactcaagcgattccgtaagctcaatcaatagcgcaacgtcacactccagcgtagggagcaatattgaatccgacagtaagaagaagaaaagaaaaaattgggtgaacgaactccggtccagttttaagcaggcgttcggaaagaagaaatcaccaaagtccgctagcagtcattccgatatagaggagatgaccgactcgtccctgccttcctcacccaaactgccccataacggctctacaggttccacaccgcttctacgtaacagtcattcaaattcgttaatctcagaatgcatggattctgaggctgaaacagtgatgcagcttcgcaacgagttgcgggacaaagaaatgaaacttacggatataagactggaagctcttagcagcgcccaccaattggaccaactgcgcgaggccatgaataggatgcagagcgagattgaaaagttgaaggcagaaaacgacagattgaaaagcgagtctcaaggttccggttgctcccgagctcctagccaagtcagtatttccgcttctccgaggcagtcgatggggctctcgcagcacagtctcaatctcactgagtccaccagcctggatatgctgttggatgataccggggagtgctctgcgcgcaaggaaggggggcgtcacgtaaaaattgtcgtgagcttccaggaggagatgaagtggaaagaggatagtcgccctcacctttttttgataggctgcatcggggttagcggtaaaacaaagtgggatgttctggacggggtcgttaggcggctcttcaaggaatatattattcatgtggacccagtgtcccagctggggctgaactctgactcagtgctcggctactccataggagaaatcaaaaggtcaaatacgagcgagaccccggagttgcttccctgcggctatctcgtcggcgagaacacgaccatcagcgtgaccgtgaaagggctggcagaaaattcactggacagcttggtttttgaatccctgatccctaagcccatcttgcagaggtacgtcagtctccttatagaacataggaggatcatcctttctggcccatccgggacggggaagacttacctcgccaataggctttctgaatatatcgtgttgagagaaggtcgggagctaacagacggcgttattgctactttcaacgtggatcacaagagtagtaaagaacttagacagtatctcagcaaccttgcagaccagtgtaatagcgagaataatgccgtggacatgcccctggtaattatcctcgacaaccttcaccacgtttcatcactcggtgagatcttcaatggtttgcttaattgcaaataccacaagtgtccatacatcattggcaccatgaaccaggctacttcctccacgcccaatctacagctgcatcataatttccgttgggtcctctgcgctaatcacactgagcctgtaaagggttttctgggtcgttttctgcgacgcaagctgatggagaccgaaattagcggtagagttcgcaatatggagcttgttaagatcatagattggatccctaaagtttggcaccatctcaaccggttcctcgaggctcattcctcttcggacgttacaatcggacctaggctgttcctcagttgccccattgatgtagacggaagtagggtctggttcacagatttatggaactacagcattatcccttacctactcgaagcggtacgcgaagggctacagttgtacggtcggagggccccgtgggaggaccctgccaagtgggtcatggatacatatccttgggccgcaagtccacagcaacacgagtggcctcctttactccagcttaggccagaagatgtcggctttgacggctatagtatgccacgcgaagggagcacgtcaaagcaaatgcccccttctgacgctgaaggggatccccttatgaacatgctcatgaggcttcaggaggcagcgaactattcttcccctcagagctatgactctgattctaattccaatagccaccacgacgacattctggattctagcctcgaatccaccctttag
